United States Patent 9,487,797 (GENOMIC PLANT SEQUENCES AND USES THEREOF) - sequence listing, part 55

SEQ ID NO: 68285 - DNA, 41743 bp, Oryza sativa
  unsure (1)..(41743): unsure at all n locations
cccccccctccgcccccacgctgtctccgccactgtctggaggtagtgcttcgacgtgctgcgagggtccagcgcatacagccgccggccgtcgacgggcaccatgatgcccagcatcagcgtcgttgttgggcgagggccagtggccataaacgacgtccctgtgtcgtacatgaagacgggagaatcctcatggaaggcatgcgtggcgatgacgatcttgctgccgaccgcgaccatggccaggaaggagcggtccaccggcacctctatgtggacggcgactggctaagaaaggtggtggaacatggctacgccagtgccggcgccggaatcggtgaactcgtcgatgtccagcttgtggatgacgtatcccatgtcccaatcaagcaccatgtagaggtgtttatcatcgtccctccaccgcgaccttttactggacgtggcgatgttgctgctgtgttgatcccacaacgatcgcttggagctcaacatcgtatcttcctctgcatgccctatattttttagaacatatcaacttgcattgatccggcttttgggagaaagccgaaaggactacaggaacagagtcttacacaaaacgaaaagaaaaacacgaacatactacattattgctgtgaggaaaaagtacgaattatcccccccaaactatcgtggtcatccgaattacccccctgaatcacaaaaccggacattcttcacccctaactatgcaaaccggacgaattacccccctcaacccaatccacggtggttttggtctacgtggcgtacgcgtggcagtccagtcagcaatttatttatttaaaaaatatgggacccacttgtcatactcctatttcactttttttctctctcttccctctctctcactcttcctctctctctcttctctcactctgtctcacgcgcacagcggcaggcggggggcggcgagcggcggcggcggcgggagctcgcgctgctcgagcgaggctaggcggcgacggcggaggaggcgagcggcgggaaggacggaggcgagcgttgggggatgaggcggcaagcggcggcgagggagagggagctcgcgctgctcgagcgaagcgaggcggcggcgggcatcgtccagcgcgcgctccgtcgccgcggcttcctcgcgcgcccgcttccgcgccgcgtccgccttctccagcgcgcgcctcacctcttcccgctgctcctcctcctcccctcctgctgccgcggccacggcgccgccgtcggatgccgcgacgacgacgacggcggggccgatgaagagctgcagcttcgtcgtcgtcatcgtcgtcgcgtgttgctcgtgggaggaggagccggtggtcgtggagttggacgagaacgcggtggccaacgacgccgtggtggacgccgggaggagctgcagctcaggcggcagcggcggatgatgatgatgatgccgcagcgccgcgggacggatgaccggcagcgtcgtcaccacgggcacgacctcgccgcgcacccgtccagagttacacgcatcctggtgctctatgaagctctccaccctgcaaccacacgcacacaaccacccccaaaccaaaccaccgccattagcgcacactaaccataccacttaacctccatctcatcaccaaacacaacaaaaatacggcaatcgatccgatcgactgatcgatcatctgtacatgtagatcgatcgaaagcaacgcatcgatcgaacacgacacacactgaccgatcacctcgtcccctctccgccgcctcgcctcctccgctgccgcctcgcctcgctcgagcagtgcgagctcccaccgccgccttgcctcgccgccgccgctgcaccccgccgcagctcgccgcctcatccctcgctggcgctcgccgccccccgcctgccgctgtgtacatgagacggagagggagaggagagagagagaggaagagtgagagagagaagagagagaaaggggaaaagtgcaataagagtacgacagatggggcccaactattttttaataaataaattgctgactggattgccacgcgtacgccacgtagaccaaaaccaccgctgattgggtcgaggagggtaattcatccagtttgcatagttgggggtgaagaatgtccggttttgtggttaggggggtaattcggactaccgcgatagttgggagggggggtaattcgtacttttctcttgctaggaacatccagctttctagacacagcacactacaggaacatcatccaaatagaacccttctggagttggaccaaactagatacaagcaaaacaacttagatagacgatggtagatgttgtggtttcagttgaaccaacttccctagcacagcttcatgccacccacccaagattgctctttcttcctctcttaacagcacactccacttctgagagaaagacagagctttgtaagccacctgcaagtgtgatttcaccaagatattgttaaaaacccaatcattcctagttagccaaatagcccaacagaagctagccatcatcagcaactaaaccctagattccttgtcacacctcactagcccaaaacaatcccacaaagatcctggtaaggaattcaagtttatagccaccttaagcacacaccaggaaaaaacagctaaagagcaacgaaagatagcatggttagtatttttagtttgtaaacagagtttacagaactcatttcctccttccaattccttttcaccaattgctcagcacaggggagtctccctctcccaactagatacaaaaaaatgttttatatttagaggaattctacctttccaaactgcccccatttaataccccaaaagttaaaattttgtacattgattttgtggtgaacacctctttttcagtatgaggccaacagacattgtctttatcagtccccatctgagcttccccaattaactctacaagttccccaacctctaaatttcttctaaactccaagctccattctccttgtaccaccatatccttgacagtagcattttgatcatgaataatttcaaagagatcaggaaatctaactttcaaaggtacattataacaccaaacatcattccaaaaactcacatctcttccattgtgcacttcctttgtgactagcctggaaagccactctttgcatttcaacaaacccatccaaaatttgagagccaccactcccattccttgtgaaaaaattacaatttctctaatatttccttctcagtacctccaagcaaacatcaggtgctccactttccaattttcataacccatttactgagtaagtaaagattcattgctctagtatccaaaaagcccattgccccaaactctttgggcctgcacagagtatcccatcttatcatatgatatttatttttttccccaaccccgccagtaaaagttccccctaattgtgtccattttttggtgaaacccctcaagcaaaaggtagaaacccatagcatacatgggtgcactagacaaacatgagttaatcttgatctccctgccaccataagtcatgtaaccactcttccaagactaaagtctcttctcaactttctgaaagattggagatatgtctctcatcccaattctgtcaaccctgtcacgcccggaaaaataccttttccagaacgctagtgtattaatccccgtcccaggaaaagccggggtacaccacacaaacatgatataaaagacacatcattattatatcgataatatttacattattacaaaggcacttcaggcctgacaaaaaaaataaacagcagcggactagcgggcctacggctccatattcataggcgctcaactggggaataagccaggactccacctaatacttcttctccaaagctccacttactgaggggggggaggtagagcaagaatgagcacaaccacagtactcagcaagccacactggcagatgcatgattaatgcaagggggtacaaggggaaatagtataggggttaagctttgcagaaaacagcatttaaaagtcacttagttgcccaaagctattttgtaaacacgatcctagagctacacaatattattaatcaaggccgtggacccacacgaacctgccttaacccaaggcctacgataattcagaccgaactggcaacccgacctgagtcccagctcgtcccaagccaacccaggccaacctttccatattttagttgttaagcaaattttaagaattaaaccactaacttgggtacattgctaggcttgcccatatccgagggcacggctattcgaatagattttactctgatcagaggtgtacatctttacccacaagacacatctttactccgcattccatggccttggaacccgtcgtaaacatgtgacataacccttcacccatcctagctgtgaacaaaagtaccgacccaaccctgcctacggccgttatcccggacagacaggccaggattgagcccctagcaacaggatctagaccgggtgcgccacacacataggggtgagaccacccgcgtactagtccagtgccatggcatctcgactaacgggcaacgacccgtgtagccttcatttgcctagacatctcgattaccaagccgtagctcgcgtagccttcatttgcctcagagatatccatcgtcgtaacgacttcatctatctctatttgtgtccttttgttcaggactagactgagcaccgagttaagccttacccattagacatgtggttagtacggtagtgctttgcaacagaggcccgaagaccggtccttatggtggtcgaggtgctcctagcaaaaccatgcacctcgagcccagcctaaaaccatttgggagtttgaatagagggggaggtgtgtgttcaattccatcacaagccaaccattccataatgtccaaatgatatgagaactcccaaagtctaaagttataaaaccatctagtgtggcctaattaatcagcgaagcatctacctaaattcatactagtggaaccattaatacagtacccactagttggggttttgttttttctagggtaagcgaggtgataataaacaatagtaatgataaagctataacaaggattaataggtattgctaaataaaacagtgataacgcgggaatttaaataaagcaataatgcaataatttaaatcaaaataattttataaactgggattcaatatgctcaaggatgatgcgacttgccttgctcagagagaatggccttccgaaccttcagcgacgaccgcgaaccatgcttcgggaacctttgaaacaacagaagctacgcgaagcacacaagcaaagctacaagcctataaagaagcaataacaatacataaaaggaaagcacagggttctttaggttataacaaacattaagagacttgaacaggtcgattcggggttcgtatgaccaagacatggtcatccgaagtttaatgttgttatatggagatttgcggattattataattaggctttgcaactataaaacatgtgtaagcgctagcctagaaaagataggaaggctgcgccgttgacatgtggaccccacatgtcaacctaaaggaccatggtggaccgggtacatagagacggttcacgggtcgacggaagcggaccccatgtgtcaaccgaggcgagtggccgacaaacggactccactagacaccacgcgggctgcacacgtggaaaccacgcggctaccgagcgggcacactaacacgaacactacacggtcaccacccgcgcacgcgaacaactgccgacaccgatgcacgggtaccggggccgacaaccgcacaacgggcacggtggcaacaccgaaaggacaagggcggacagcgaaggagggatccttaccaccatgcgacgtggcatgggaacgacgacgacgaacgggcgcggcggagacggctcggggacgatggaggagaacggcgagggaacgacttcggcggcgatccttggatgaagacgagacacgaccggcatagggcttgacgacgcggagccgaggacgaggatgacaacggggctgcagcagctcacttgacggaacgcggacggcggacgagaacgacttgacggaggacgaacgccacgacgagcgcgaccgggaacgacgagaggacgacgacgaagaccggcggggttcggatggagaggaggcgaggccgaggacgaccttcccactgcgatgccgaaggtggagatggcgacgtcggctggcgcactggcacggtggaaggggctaccaaagtgggtgccgacgtgaccgaaggaggggcagcgtggacgacggcattccggcgaatccgagggcaagccggggtggaggtcgatgcggcgacgtcgtgggaggagacggcgacgtcagctggcgctctggcgacgaacagcagccggccggagacggtgtagtggcggcaatgccactggacgccggcgggaacgcgcctccggtgctctctccgctaaacgggggacagcccgggggagaggaggcggctaagatgccgcgggtggcgacggcacggacggccggcgcacaggcacaacggtataaacggctgtaagtggccggcggtgcaggagagagatgagggtgatggggagaggtggtgcggccacggggagacgtgggaggaggctaaaacgagagaacggaggaaggggatcccattttatagcggaggggagctagacgggcacaggagagggcggaacggcgctgagaatggcggccggcggccatggaaggtggccggggatggcgcggctgttacgggcgactgagggcatgaattaagggggaaattagggggaatgagagaggaaggaaaggggattcattccccctaatcaatttggaaagagccggcttgaatggggcgaatttgagggaggaacggcgctagggttcacgggagagagaggaggagctgggcgggaggaggacgacgaccgggtgggacccaccggtccgcgcggtcagcgcgcgtgcggcgcgtgtgcgcgggagggctgcagctcggcttgggccagggcaggtcaaggcgggaggaggataggagggagtgggccgggaaggagaggaggagggagtgggccggggaggagaggaggcccgagagaggagggacaagggaggagagaaagactttgggctgaactcggcccaaaggaggaaggaggattatttttagctttcttttaaatataataaactttcttaattgttgttgttgcttaataattatttccggtgctctgaaaattcaagtaaaatttgagtgctctttttagaccaaagagaatttaacaaaaattctccgggccacattcgaatttttcttgcacgtattttagtgtttgccaatttcttttcgaattttaattaattctattattccttttagaaaatgatttttatttcgggatgaatttatcaggacgtgacaaacccccataggcaaactcaagtatgtgaaaggcatcataccaatcttacagttcaacatattagcaattcttaatccctcattatcctccacccctatgacatatacatcacttttctgataattaatcttcatccctaatatctcttcaaagcagaataataacttaagggcaaatatgttctcatcggaattcttaagggcaaatgtgtattgaaggtgagtcaaacccccatccactaagtttggaaccagaccttcaaggactcccctttgtttggttttatccaaaatggcagccaaggcgtcacccacaagattgaaaaggataggagacaaggggtctccttgcctcaaacccctgtaaggcgtcaccattgatgttaatacttactctcccaccttctgttatcttttttatccatcccatcattatggagtcaaaattctttttgtccatgacctcatacaaaaaatcccatttcatcctatcataagccttctcaaagtcaattttgaggataatcccagtatcccttttaattttcagctcaagcatcacctcatgtaaaataacacaaccttctaaaatattccttccaggtataaaggcagtttgagaccaactaatcactttgtttgccacttcagtcatcctaaaattcatagcctttgtaagaattttaagaatcacattttttagactgatgggtctatactgtttgattgtgtttgcatccctgatttttggcaaaagagaaatcaccccataattgatcctatctatgtccagctcatccatgtgtaagtcatctgacatctctttaactaaaacccttatatgaggccacacttgtttataaaaacccatagggaatccatcaaggccaggagttgtattgtttttcatagtcttcatcacattgtccacttaatctaaagagaagggtctaaccatccaaactttttcctccccagtcaatctcagcttatcttgccagatttcaggacttagatgaacttccctacttttttcttttccaaacaaccccttataatatgcatagatgtgctgtttaatttgtgagagctctatgatattaacatcccttcttgcagagagaagatatggcttttcctttttcttgatttgcagccttatggaaaaaggttgtattagcatctccttgtaaaatccaagtttcccctcctcttctctgtcaccagatctgctactgaatgtaaatgttttccagcttcttttccatctcatatctgatttttcattcaatttcaaaaagtccactgtcatctgcttatccagctgtaccaaagcattctccaattccttcttcctcttcttttggacactatttacattagcactccatcccctcagccatctcctcaaaaaccctaaaccctttattgtttcttgcaaacatatcatatcaattctttgttcaaaaattaactccctaagctttctttgtcgccctaatccctctcacattctaaaaaaatctcatgatttactttttttttcctccccttctttttctgctcagatcctatgtattctttagtctttgatttttattggatcactccaccttccctgcagaatcctctccttgcctccttcctctttaaccatcccttcaacatcatcactaatctcaacaaactcagatgctcattgcacttactctgttccgcagcaaacaacatagctttgcttcttctctaacacaaacgactgtcaaatttgtctcaatctcacactcatttctctccaacacaatattacttatattgacaatatcaactaaaacatctctattaactgaattgaaaatggcaaaagagttagacatacctgtgttcaaattgacttcagattttctcaattcagctttcaattgcaccggcacttctatgtccctcaccctcagtccctgtcttataacctgtttagttcccaaaatactttttttttgtgtccagttcctgacccacaatatttatcccacttgttcagacttactaacatcctacctgccctatttgcgtgcgaataaatgaataataattggtggatttcgagcatttgattttggagggttcacggcagcctggttaaccttgagatgactcggatttcagaatcctaatcagtcgcggaattaagatgtgatgtgcttacatgaacatgaacgctggacgggccgtgccgcgaataaacgaataataatcggcgaatttcgggcgtttgattttgtagggttcccggcagcctgattaatttgagatgactcggatttcggaatcctaatcagtcgcagaataaggacgggatgtgcttccatgaacatgaacgctggacgggccgtgccgccgcaagccctctccgcgagaggctcccgcgcgcacgtggtatattaggtcttgtaggctggtttgggctgcatgtcagcgagacggataggccgtatgatagcgttatgagtgagcccgttgatgggagagtatcgggcttctttcatatgtgttattgccccctcttttgaggataattttcatatttcttttgcttgcacatctttttttaaaactgttttgcttgcacatctgagttgtctgagatgcgggtgagcactgtgatattattggggcaccatcataattgtaccttagactattttcgaatcaaggggatgagaacctcaccttccacatagaaaacatattaacgcagtattaattaagtaccgttgagtagtttgagaagcatacgcacaaaagtcgagagtgtgaaagttgtgaaagtatagttccaaataaaacctgaatattgcttataattctttgttgataatttgatatataagtatgatactatgtcttagtacaatgggaaagtattatgtgatacttaactagtatggaagtttttacatagggaaatttaactattcgctactattaggtttgccaattaaaattgacgcggcagccctctctttcctggctgcagcggcggaggagtaggaaagggagccaagtacgggagacggagatggcgtaggtcagtaccgaccagcggattctccaaggaagagcgtggcgagctcagcgcctccagcgatagagttgtcagcagcagcggagccgcccacgtcatcttagggtggctggggagggaggaacgccgcgtcggccgactggagtccgtggttgccatggagcatggcgaggcggaggtcggatttgcggcggcgcttggctcctcctcccatggtgtgctggcgagggaggccgcgttgcgctgctctgtctcgacggcggcgccacccaccaactcgtagctgtagaggcactcgtcgaggactttgaccaccgttggcgcaaacgatgcgagcacggcttcgcacgtccgatccagcgtgtaaatgctcgtccttgaccgcggcgtcacttggctcctcctttacctctgccgcgagccgtcgcaccgccgccgccgctgggaaagagagggttgccgcgtcgatttttaatactgccggaggcagagaggaagggagacttgtgagactgacaagtgcatcccacgtcgctttttacactacattgccacgttggcatcccagatgggcagaagtggtaaaaagataagaagccaccatcttagagaggcaaaaaaaaaaaaagagagcaaatctaaatctaaaagaggtatttggataattgacaaacctaatagtgtcaaatagttaaatttcccttttacataagggtcaacataaaaaaaattacttacctccgttccaaaataattacatttctaaatcgaaaaggctaacgggcgatcgatcgttgccagcgatcgttttttcctcttttagtaagtttatacacctaaagtttacacatctaaagtttatccacctaaagtttgtgaagcgaatgtttataagtcaaaagtttatggcaaaatttgccataggacacacaaaaaacgtgtaattagctgggagacaccgcgaaaacatgacacggctgatggacgctacaaaaaatgtataattggctgtagaacactagttgtattattttattatttctaggtcaaaagaggtgggatattttcctaaatgcccggattgcccttctctttccttcgttttctcctaagaaaggaaggcgcgtggtgggcagggttcaatctatcgagaaggggaagattttcgggggtttatcaaattccgaaattgcggaaatctgggagaaatttcgaacaaattttcaaacaaatctttgaattcaaacaacgaaattaaagattgtgatctagatcagaagatgagcatggagtccatccaatccaaagtagagacaggagaatgagacagtcacacgcaagccccaaggatgggaggcttgtgtcctccctgtcgtcggcgcgcctaagaggcacggagtcactggcggacactccagtcatgctaggcccgcgtcgtcgtcgtcagagtcaccccgaagagccggggagcccaccggtggccactccagcctcgggaggcccgcgcggtttgagtcgttggcgcgccacggagcgccgtcgccggctactccagccacaccgctgccgccggatccgcggtcggcgtcgccggcggtcgctagcgtcggaaggatggcgacctcttgactactggggcgagctgttggaggaggacgacgaagcaaagctgagccagccttcgctaataagtgaggaattcagggattttgaccgtgaaccctcgccccactacgcacgtgaaaacgaaggaaagagaagggggtaatctggtcatttaggaaaatatctcacctcttttgacccagaaataacaaaataatgcgaccagtgttctccagccaataacataatttttgtagtgtccatcagctatgtcacgttttcatggtgtctcccagctaattacatgttttttgcgtgtcctgtagcaaattttgccaaagtttatatacccgattcaaattcaaatttgaattcaaatattttatattttcctcttttagtaagtttatacacctaaagtttacacatataaagtttatccacctaaagtttgtagagcgaatgtttataagtcaaaagcttacatacacgatttaaattcaaatccggattcaaatattttatatataaaatatttctatagataaagtttatgcgtataaagtttatgcgtgtaaagtttacggtataaactctatgcacatgaatgagagtattattttttttattaactttgtgttttttttatttttacgatgaaaggaaagaatagagaggagtatccgctgataatagagacagattagcaacaaacacagtaaccctatttactaacgacactgcatacacacatttcgtacgtacacttgactaaaagtaatattgagacaataaactcagctaattactattattaaacttgattaaaggaaaattggatcccactttggtagaaatactccctccatcccataatataagggattgtgacatattgacctaaaatcccttatattataggacggatggagtattttttttaataaaatttgaatggtaaaaatgtaattattctagaacggaggtagtatattacacaattatttcacgctcgctctctatctaaaccgtcgcgctcgcgcatgtacaaacaatggcaggttgtaactttttttttgatatgggccttgtttagtttcatatgctaaattttattttaagtatgcggacacatatttaaagtattaaacatatactaataataaaataaattatagattttgcatgtaaactgcgagacaaatttattacgcctaattaatccgtcattagtaaatgtttactgtatgtgtatttagatcctaaaaaaatttgtcaaaaaatatcacatcaaatgtttggacacatgcataaagcattaaatgtgaacgaaaaaaacaattacacaatttgcatgtaaattgtgagacgaatcttttgagcatagttgcgctatgatttgacaatgtgatgctacaataaacatattctaatgatggattaattaggcttaataaattcgtctcgcagtttacaggcggaatctgtaatttgttttgttattagtctatgtttaatacttcaaatgtgtatccgtatacttaaaaaaaattagccaaagaactaaacacggcctgtagcaccacattatcaaatcatggcgtaattaggctcaaaagattcgtttcgcaatttatatgcaaactgtgtaattggttttttttcatccacatttaatacttcatgcatatgtctaaatatttgatatgatgaaatttttggatgtttgaagggaactaaacacttccatacgcaggttgtaacttgtgagtgcttgaggaaaacatgagaggaagaaacaaaaagaactactggcgagtagagaaggtcgctcggtggcaggtatttgaggccgtgatgcagacgaattgaagtgacgtggaaccgacgcagcaaccactctatcggtatatccatctcatcactccatcagcatcaaagctcttggcaaaaccagcactcctgcctgtccaaccaccagagaatattcttcctcgtacatccgccacgtcacgtgatcctcccctgtgtcttctagatctatcaacagattgagcaaatggcttacaaattcacatatctcctctcgtggtaaggttttcctcagcattttcgtcgtgccaactggaagattaagacaggctcaacagccctatcatgttcttaaaaaaaaacagccctatcattgcatttgtagcgtggataagcaataatggtgaacattagacatgattaatttagcgaaatgacgaaatgggtagattatttggcgccatctaactagttaccagctatgcatcgacaccgtagatgtgaaaaaacacgcaccaaatgtctagatcgatatcgaccaactcaccaccgaacagtcagaatcaaaagccatctcttaccttctctcctctccctaaagaaaaggccatccttttactagtgtccttgctttttgcgatggcatccatccataatccatttatccaaagtcaatgcgacgccaggaggcgacagacacgagcgcgcatcgacctggcactggcacaccacaggacaggagcccaggaagctacctataccttgctagcttggcgtcttggcgaaacacccccttgttggatcaatctgctgtgctggtggtgagtcagagttaagagttctaaaaaaaaaaagagagtcaaagttaagagatcgaccaagtcgctaaacaaatgcaggataagacgagcacctcagcatgagccgtcgtcctaatttgcaatcacctgcatttcatcttctactactatcagatccaaccaaacaagcaagggcatcagatattcagatcagtatatcgatcaggggcaatggacaatgcgctgatgcatgtgattccacttagtcatgcgagttaaccaaccggccgtgtgcgcaataatggattaaacaagtactagtaacaggagatttgtggcctagttgcctgaatttatgcgtgacgcgtctcccattattggactacttgacgatgatttattgttaagttgacgtgtaaaattattactgtaaactgccttttctgtaatctttatcagtcgatctctgtctctctctccgtcctgccgtacgtggtttcagaaaaaaaggaaggttgttgttgctatgctggatatacaggattagtcatgaaatgaaggggagttgcaagtgttgatcaattagtgtgtcgaaccaaatcaaccatgtcatcagcagttcttgtcttctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaaagaattttcctcgttaattaatcaaattaattaacccggctgtacttagtcgagtgttagcccaagccattctcagccagctagtcctttttctcctttttttttttcaaaataaatagtgctgtttgtacgtgctatggctgttttgaggaataagctgctattaattcacgtcttttatatgaaatgaactcgtgattctatttccaagagatattgcgttctcgcgcgtgttgatctgacagcagcattgacccctcagtataatgcagtttttttatataaagaatcggatgcaactaccaacaatggacaattggacataatcactaaactaaaggaggatcactcctgctaccacatggacaataaacaaattaaaacggcactgaaataccgaattcagctacacacgaaagaagaaaatatctactctagtagcaacttgcaagctttaattccttctcccttaattaacccttcccctttatatatatatatatatatatatatatatatatatatataaactgaaacttgcaatctcctctgcacatattctcagggttcagcctaaataaaaccgagaaaagaaggtgctcctttgtgctctcgtgatgaatctgtcgtgtccatcacgtatagcaggaataaaccaatcgtcttatcctttaacccgtcgtggaacagaatcacgatttcttctttattggacaaacagaatcgcatacgaagtgacgacgaaaagcggaaccaccagaacgatcgatgcatccgcatgatgtggctgatacgaatgatatcacttgacacactcgaccaacggctagctaggcagcgagcggcgatcgacgagcgcgcgcaagcaacggcacagacgcacgcacgcgttgcgcgggcggatgctgcaggagttcgctgcagattgggcgggcgaagccgtggtaaaagctagtactacccaccagctgttccaaaccatctggacgacaccacttgtcaagttgtattgccacgatggcggctttgaacgattgcacgtacgcgaacgcacaacgtcgactcgggctctgttagttttcacgtaaaaacttttcactatgtgacattgaatgtttagacacatgcatagagtattcaatataaaaaagacataattacatagattgtgtgtaaattgcgagacggattttttaagcctaattgctccatgatttgacaatgtggtgctacagtaaacatttgctaatgatggattaattagacttaataaatttatctcgcagtttacagacggaatctataatttattttattattagtctatatttaatacttcaaatatatgttcatatatctgatgtgacacgtcaaaaattttcacctaacatctgtatgaacacagaacacagcctcggtcaaagagaaaaaacgaggcacggagggtaaaaaaggaaaaggggaaaaatcgtggcagaaaggacaggtgaaaaaacggaaacagcgctgtcctgatgtgttcgttcgttggttcgttctcgtagttgtagcagcagagggaagcgtctgtctgcgtcgggtgcgtgcctttggaccggaatatcctggaggataaaccatccgatccgcggggacggtggcagcaaattggcaaatgcgcgcgatggctggccatggcgaacgcatccccaccccgaatattccccattcccgcttccttcctttctccaacgacccacacccaacactcgatccctttccccttcccccgccttgttataaattaggctcggctcccgcttcctcgcgtcgcgtcgcgtcgcgtcacgtctcgttgttgcattgcattgcgcccacgatcctcctatacgcgcgcagctaggacatcctccgaatataatggcccagctcaaggccgcgcgcgtcgccgacgtccccatggcgctcgacgtcctcgccgccggcgcccccgccacctccgccatcctcggtacgtacggattattcaatattcattgcgtggcgtcgagacaccgtgccgcggcggcgttagttatttccttggttatgcagcagaggtggacgcggcgggtgctcggagcgccgcggcggccgtcggcggcggcggcggggggcagaggttcgcggtgatcgggcaccgcgggaaggggatgaacgcgctggcgtcgcccgaccggcggatgcaggaggtgaaggagaactcgctcaggtcgttcaacgaggccgcccgattccccgtcgactacgtcgagttcgacgtccaggtaacgaaaaaaaattcttcatcatccgtccatccatgtccatccatccgtcatagcggtaacctgggtggggttgagctgctcgtgctaaatttgggggtccccgtgggcgttcgagacgaaaaagcgagaccaatcaaggaaaaggaaaggaagagaggcagatggggagatgggttcacgttcacctgggtgatgggacgggtcgccggcttcctctcctcgatggcgacgcgtcagcgccatggagggcagaggagtgggggcgccgcgtagcgtagcgagcgctcgccgccgcccgcgggcgaaacagaagagccaacggtgtggcgacgcgtcgcggtgagctgctgttccgattcgcggtgtcacacgtaagccccacgcgcccgcccgttctcgctcgccttcttgggaaatacgaatcgatcgacataataattgcccttcttggagaaactgaaacgcgaatcgaaaatctcaccggcacgattaattggaatttcccgttccgattctcctcgtcacactggtgctgttttataataaacctaaataaaggggggttgttgttcgaatagccagcttccgattgtaaatttgtgatcttcgcacacaaaaaaaaaaggggggggggagggagtagtatgaaatttggagatgatttaagacatttaaccacaccggattaattttttaatactcacagagacagaaatacatcctttttcagctatatcaagattcttcgtcgagtactccattttatactagtcactttggtgatggccatttttactcctttcagaaattgtgttgtcagatgcccggaaactttgatgtttgcaaccccaatatgtttaggattatcaaagaggaacaggaagacacttggtttgtccaaaaacattttgatactagcattactttaaatgaaaattaaaatgtcacgtaaacaaatgaagtagctaggccgacacaaagaaatggtgtatggaacaaattatctcccagctcttttagtaaaatacgaaacgagttaggttcgctcacgaggtaggtggcaatggatatgggatatgggatatggtccagtttactccagtgtcagctcagctccgaatcaacacagtgggcctttgtcgtttgctcatacaccccacctacgcactaaaagaatctataaagtatcttgtgctgtaacgcaaacatggagcaattcatagtggcgacacttcaggaggaatcattgtgtcactgggcctgtttttggcttggagcaatggcttatcagcttgctctactgattttgattcttgacagaaacaagagatagggtagaatgggtcatatctaaactacacttatggtgacacattctcgataaatgtttccacactcagtttgcttaattacatatgaaacttaaaatgctgaaagaagatactgatttgtttactttttgttcttgtccttctctctttgtctcttcaataattcggtgtgcaaagatgttgagaagagaacaaaccgtgaatatcaattttgcaggttaccaaggatgggtgcccagtcatcttccatgataacttcatctttactaaagaagatgtaagttacttttcttttactgtatgaattacagtagctaccttaaaaattcagacaaaaaagtaacatcattgagactgtcatataggcatggaccatttcgtgaatcatgtgatatatggtaaagaaaaaactaacctgtatccataatggcatccattttcagggtaaaattttagataagcgtgtcacagaccttcagttggaagacttcctgctatatggcccacaaaatgagcagggaaaggtatgctagaaactatttttctcatttgaacttttggggataactagaattgattttaactttggaggataactagaattgatctgatcacatattggttggttctgaattcagggtggaaaacccttgctacggaaactgaaagatggtcggatagtgaattggaatgtgcagtcagatgaccctctttgcacacttcaagaagctttcgagaaggtcaatcctagattgggcttcaatattgagctcaaatttgatgacaatcttgaataccaggaggaagagctcacttgtatcctccaggccatcctgaaggtatgtgttagcatagtgttatggctattcagaaaatttgcagattgatacctatggccaatctaacaacatctcaccttttatctgtactacctgatcaggttgtttttgagtatgccaaggatcggcctattattttctctagcttccagcctgacgctgcacaggttatgcgaaaattgcaaagcacataccctgtaagtacactagtatctgatgcattgcaaatttgcaagttccataacagtacttttcgtaccatgaacagttactgatctcctcatcccttgcatcttcttcaatcaggtttactttttgactaatggaggcacagaaatctacgctgacgttaggaggaactcattggaagaggccatcaagctatgcctcgccagcggcatgcaaggaatcgtgtcggaggcacgaggaattttcaggcaccccgctgctgtaccaaagatcaaagaggctaacctctccctactgacttatggaacactgaagtaagcagtacagtttacggttacctcgagcactttcttgcattatatctgaatttcaagtgctcaaaatctcccatcccttttgtgcagcaacgtaccggaggcggtgtacatgcaacatctgatgggggtgaacggtgtgatcgtcgacctagtgcaggagatcaccgaggccgtctctgagctcatcaccgtcccggagcctgacctgaacgccgataatttgagcaatggggcagcaaaagacgccgcaacgccacatttctcgcagtgtgaaatctcattcttgctgaggctcatccctgagcttgtgcaataatcgatccagttgccttgctggtctgcagactttagtgactgatctgtatacaggaagaagaggagagaccccttgtggagggttacaagtttacaaaacttttaaataggttgatgtactagagctaagccctggtcctgttttttaatttgccctggggacgtttggattcatgatggatcatggatgatgcatcctgtagcaaggagttgaaacagttgttgttactgttgtatctgtaagactgtaacgacgacctatttgggtggagttgaattgcaatgcggaatttggcaagggcagctgtaaaatgttgagctttgccaagataaattgttgcgaggattcaaatggatttgtggcagcaatttaaatgatcacatattccatctgtttttccgttggggatcacctggtaaacatgtgcaaatcttgcagggacgtgtaggattacattacacttacttttcctgcatagcttcaaagttgcaatgctcatcaagttctgattttcggtgctacgattattactgatgaagtgatgaggccccacgccgcagaactgtctgtcctgaaaaactgaaaatcggaaggaagatagctgggccgggccgccatctgctgtccagcccatctgtgcatatgcacgtgctcttcaaggcagattggcaacatcagattgatcactgtcagtgtcaatggctgggcatacaacacacgacatgtttaagcagttcggtccactgacaaataaacctgttcaggaggcagacagaaaatgaaaaagttaaaaaaaaacggcatatagttctccaagcgaattctcataaattcacttatccattatcctcaaaagataaaatatattactctacaaattcacgccgttaaactacatctatataacaaatataaaatatccaaaacactcttgaaatactgtatcttttaaattatttcaaaattatatattcaatttctaatccccttgtattcctttaattaaataaattattattaaataaactattgatgtctatggttctaaatacgtcacaacacatgatgccgacatataataattaatattatgataatattttaaataatttcacatcgtatttttgggtgtcaaatattacttgacgaatgtacaacgctacggaagcagacaaaaacctctatcgtttccattttcattttattttagaattggaaccggaactgaaaacaaagagaataggaatagggatgaaaatggttcggaaacggacagaaaccacctttatcgtttccgtttctatatttttttcggaatcgggaacccatgatacaaaaacgaaatcaaatattatcgaatacgaaaatggagcgaatacaataacggatatttatcaaaatatagaaagcacttaaaactgaacttctcaaatcaactaagagatgtagctcaatattttttttctaaaaaaataaagctattattctacattttatcaattaataataacacaactagttttacactttactttcttggagaaaaaaaaactatatccatctataactataattataagtagtatggtctaataaaaatagcaattacgcaaaaaaaaaatctaaagttcttgactacaaaatatctctatttaattaagcacctcaatacatagtataaatctaaccatttagagtagagaaggctgaagctaattagttgtatatgagaaatactatgttaactgaattcatttccggaaagtttccgatggatagtagccttattatatttgtttccgtttccgaaagtttccgaaaaaattctgaccgacatttttcattcctgaaaacatgtccggaattgggaaactttccaaaccattttcatccctaaatacgaactggcgcgaatacggcaacgaaaatttatgggaagaaaaaacccctcaaacttagcttcgaactttgtcaagtccaattactgtctcaggtctcaacggtcaacagtatatcacaaaacacaatcaattaggatgctaacttgaatttgactggagtattattatggtatatggactatggtatgggcctttgtaacttcgaaaattctgagaaattgtttgcaaacctattctgagttccgacggaaactgcctttatcatatttgttttcgtttccgaaaaaatttcgaccgacagtttgtgtttccgaacataggttaggaatccaaaaagttttcatccctagatgtatgtcatacacctagtgatgtgactataagtatactccacagattagttactgtaaataagtttagtaaattaacagcattctctactaaaggtgtctcacgtgattatgaatggtaggtgttgaaaacaaaatataagcaataatatggtgctatggagattatcgtggtagtttttttttcttttaaaaaaatcactttgtctaggtttcatataaattctcattggtttgggacaaaatttgactctttatgtcaccgagggtgtataagtaatataagtctatatttaattagataaaatagtcatattagctatatttttaacagaaactatctttcattaatatatcataaaaattatctatagcatacaggaaaaaatattacttaaaatttagaaaatccaaaaataaggtatggtaaatattgcataggaaagaatgagacgtagtacaaatagatacgaacaaactctactatcgtgacaatttttgtgttttaagtaatatgcccaaaccaattatttacaaaaacatgtttaacatagagtcaaagaatatttcgaaaatattatcaacataatcatttgtagtaaaaattaaacaaggttcctgtgcatatgcgtgggctaccctcctagttatagtaaaaagcgtaaaatttagaagattgagaagcgtgcccataataatttagtgctattagtgtttatttgttgcatggtgattggtgaagagattctagtgttataacttgtttttttaaatgctctataataattatcggctaatatatagccttttacacatcaagaagattaaattttagaaaattataactagttttgtcaaagctattatttttctacaagtctagctcgtcatttacaaagctgcaacaataatacacgatattataatcaggggcggagctagagcgaaacagagcgtagtgccacttgtttaatttactttactttagatcaagtttaagctgatacgggtgtctaagtttgtattgagggggtgcatacatggtgaaaatagatgaggtatagctaaaaaattttcttgaccgagttcctgggcaccccctaacatatactagctccgctcctgattataataaaattgtaactttgtctccctcagaaatttggatccacctgtcacacatatatacttccaatactctcattgtttctacttagccccacctgtcaaatatgcatatagggacactatggtaaggctatagtataagtgatagttaaattaaataattacacttttctcaagtaaacaacaaagtcaaatcatatgattatgcttgaaacgtgaacggagagggacttagctcatatacagtactgctgctgccgtagaaggcctccaccttttgctctatataaatcatttgtcgctaaaatttaaattttgaaaattttcatcgaagttttttttaaatcgctgctaaatttgacatttatatcactaaaaccatctatataaaaaattactcataaattatttttttaataagccatacgatatattattagcttaattatggccaaatgatgtgagccgtagtcgcaatcatatgagccacggtactgcagaacagaagatctcattctaacaaagaggtttatcagcatcgtcctcgacgcgggacacaacgtgccaaaagcattgcctattggcttcctttcttaagagcacccgaaaaaaactcatctgctcgggcgtttgatagtcggtccatttttatccgtctctttttacatccaaaacgtcacatcaacactattactaatattcatgtccaactttaacaaagcttttagcacttttttctcctaaactatttattcaatatacgatccgatcataccattgtatttgttgcaattgaatatttataacaagatctcatatgattatatttcgataaaaatatttgttttccaattttttgttgcagtagattttttaaatgttgcagtaagtatattacgatgtttcactacatcatttgtaatgttgcatgtggtgttctttgggtgttccagaaagtattttgtgatgtttcagaaggtatttcactagctctataaaaaaattagaatattgcatgtggtgttctttgtatatttcaacagatattttatgatgtttcattaagttattaaaatgttgcaagtggtgttatttggatgtttcactaaatcatttataacgttgcacgtgttgttctcgatgtttcagcatgtattctgtaatgtttcaacaactacaacttaatgtttcatatataatataaaaatatttcaattagtaatataattatgttatttttgttcatcctaataatgtgagatctctttgttaagatttaattgcaacaaatccaacggtgcaattggatcacacatcaaataagtattttgtgaaaaaaatgatttaaaatttgctattaagggaatatgaggagagagaaaggggtgcgnnnnnnnnnnnnnnnnnnnnnacgtggaagagataaatagttccatgcctgtgaaggttcccggagagaaatagttacatacatgcttactgacggcgcctgtttttttttaataaaaaacaaatgcttgatatgtagtcttgtcaagggtgagaggctaaatggtaagaaagaaaagaaggaaggaaacaatcacaaaaagggagaaaagaaaaagaaaagacaaaagcaataaaattcgcaaaaagccaccacctccaccttgtttgagcagatcaacacaccacatgcgagtacgtgacgatgtcccctctcccctccttcacctccggtgaatggcgtcccgtatcgccgcccgccacctcctccgccgccctgcgacggtaatccggcatccctcccccctcttcttacgcatgacgcgtaaaatgtatatgggggatttaatgcgatggggcctgactcgttatgagtctcgttgttggggttgattttggggctggatttaatttgttgtcccgatggtggtttggtgctctttccatcgcctctccgttcatttttcttctgtgttattaggatggtaagaatgcgattttttctagttggttgttgttgatcaggacggtagaggatgcttaaactgtgaaattcgaggagattgcaaattttattttttgtttgctcgatcatgcggtttggtctgattgtgtcgttgccatgctgtagaaaaaaaaactggagagagcatggtagcttctggagtcgattcagaattttttcacgcggacagttagcgatagcaaaagcacaggaacttttgtgtgcaatcatgttgaggtgatatgctggctcccttgatcattgattacctgttgatttttttaaaataaattaaggaatatagatttattccggccaccgcataagaaatggattgcctgttgatgattgcctcaactgcatgatcattacatattaatttaaacattttgtgaattagaatgtgattctagtaaatcttcacgcgagtttaatcttcctactcgatgaacagggacaatgggaacaagtcttggtgtgtgtcactgtgtctgttgaacatcttcatattagtttgtcatttggtttcagtcgcgctagctaccaccgcatcaccaaatatgagctaattagatccatgtcatcgtaaatatgccatattgaaaaaaataccactactatttataaaatcggatagataccactgcaatcttctaaaattagaaccataccactccattacaattcccgtcgtctctgtcacattttctgttagatcgagcagcagctggctgtctcccggccctccggcgccgtccgccgcggccaacggagcggcagttcacgtgggcgcagagctaggcgtcgatgcaggggacgtggaacgcgaggccgcactcggggagtaggcggaggagctcgccgtcgcggaactcgccgaggcagacggggcagtcggtggcaccgagcatgccggcgccgtacgtcgcggtaccgcgtgagggcaatggattcgatcgcggcctcatcgagctgctgctgctggtgctggtgcctacggtggatgaagcagtagattttttgaacgatgatgaagcagtagatggacgtgttcggggtgcggcgacacgacggcgccgcccttgccgttgctggccgtcgtaagcagctgcatcgtcgccgcctctactgcgccccgccgcggcggccgccggcgtccaccgtgcgcatcatccaccgcccaggaagcccttcgcccagcgccggaggcaccatcccccggacgcgcgtgagcagctcgaccaccggagtcgaagccgatgaggcgcacgcgacaaaacggagaagatgatggggagctggcgcgacggccggcacgggcggaggacaggccggcggcagtcgtggctgggcctggcggggttcgcggtggaacggagtcgtcggacgcgcgcgcggaagcgaggggggagggcggcagacgcggacgcctccgtgccggcgacgacgaggagcaggagaaggcgccggcgccgcccgtcgccgtcgccgagctatgccgccgaggaagtgcccgccgcctccggccaaggcgccggaagccccaccgtcaccaagttccctcaccgccgagctccttcgccgccgccgagctccctcgtcgtcatcgtgcttgtcttaggagagatcgatctcgatctcttcggccaggccgttcgtcatcgtcgtcgtcaagcagcacagcagccgccgatcttgggccatcttcctcgccatcaggtcatgtccctggtcccggtcttgagctcctcgtcgccggcgtccccgacatctgctccggccccgccgtcctcaccggctgggccaccaccgccagggctcgactccgacgcgaccgtgtgggctcgcctccgccggcacggcgcccgccacccgcctggacacctgctcgggctgctcctccgccgctgccatcacctccagtttgctccttgttacggttgcgtggtctcggagatggcacaggagtacaggacggcaacgatagaaataacgggggatgaccggaaaaatggatggaaaatacgacggattggcacggttctaattttcctaaattctagtggcatctagccgatatcgcgaatagtagtgatatttttttaatttgacatatttgtattggcatggatccaattaacccatcaaatattgttcttcaaacctgagttttccacttgtaagtagtatagcatactaccttgattatttttcactagcatattacctgtacattgcaatgggattttaattatttaaaattatcattaaaatattattagcatatcttaattgttattgttaatcacatgttgaccttttctttatcatactaatattttttcttccaaaaaagtagagtgatggtgggagtagttaacatgtcggccctttagccccatatgtttttttccttaaaagaaaaattaagagttggtagtaggagtgatggctcttttataagtaagaatagataataggcttaaatggttcgaactgaaaaatcagccaaccagccagcccatacgtagagagagaaacaacccaatctaatctaatcctaatctaatccccatccgggcaggcatccacggatgtttggttgatgcctaaccttgctataactaagtataggctagttaaggcatggtggcacaagtgtggcttagaaatagttggccataagtgtagcatgcttagctcaaaatttgagagtatgacatgtgggtcccaaggctaagaaattgtggcatggcataattgcggtagcgaaagaaacacatacctaagatattgtggcataactaaagtgtggcgtgccaatgtgtggcaaccaaccaaacacgcttgctgctcgctgacgcgctttccattggcgctttgctcacgccccctgcgctgcacagtggtgcctccacccaccttcgtctattactcatggcatgctagcgcgcggcacaatagatgtggtccaggtggtctttccctttctcgtttttgcggtaaggagagttccttttccttttctaaataaggattatatttttgggcctttgagcacttgagctagcgtgtagcactcataaatcttgggggctttggatttggatgttagatgtattttctttcttttttttggggggggggggtggggggcggttcagttaactcagaaatcgtggtgtcgtgcggcaacctcatcagcgcttgctcgatggatgacagacgaggaaaaggattggaggtggacatcaggggaacgaagtagactcctgtttgggccttcaacatgtgctatacgaaacacaagctgggaaggcgttttgttgacgaatgaaatcataattgtgacaaacagaaaattacaaattttttaagtaggttagattagattttatgggggaaattttggttttgccattgaattctctaattgacaatttaacatgcaaacccagtaccccctggcagtgagatattcattgtgctgaaataaggtgaggggctaaggccggcactactgggtagcagatataagttacttgtttacccattatccttttgttcccacaagcatatacggtttatgttccttcatttacttttgcttatacttggtttgtctttctaacggatctggttcacttgcagacattatgcttcttacggagttataaacatgtcagacatttcagcactaagctacttgaaggttagaaactcaacatttgttagtttggaatcctgacaacctcttagtttgttcaaacctttattttaggtgttcatggatgctcactgccaacttggtaatgatcagagcgagcaaacttcattgtcattgtgtgcctgtgctgtaaaagttgattatttggcacatccttgctctctatggtttggaattgtcactacactttactaaattcatagttcttaacaaaaatgtggcatgtaattcatatgtagcggacgatatttcctttcaaatgcttctccttatcaaccttggactagatcatttgcttcaaagaatggtaaggtacagaaaccctatagatgatataatgtttacaaatttctaccagttaaatgcttaatcaatttttttcttcctttaaggtgacttggttgatgctgttgttcccttcatgggtgaatccataaccgatggaacccttgccaccttcttaaagagtacgcatctatctatatgcaatttgagtggtcaaacttctttgtattcacatgctatctgatacagaacctggtgatagagttgaagctgatgaacccatagctcagatcgaaactgataaggtgattctgtgcactgtttattcttgttttcaacttctaagctattgttgctatcttttgcaaaattgttttcagaaaatgaaatacccttttatttcaggttacgatggatgttgctagtccagaagctgggataattgaaaaggtaacaaagagccttcccctgatttgttatttccatatttgctaaatatgattctttagtagattacttttctaaccacatcaatgcattacagttcgttgcgagtgaaggtggcattgttactccaggtgtcaaagttgctatcatatctaagtctgctgctcaaagcaagacacatacacaatcatctgaagatacctcccagaagcatagcacaaaaccaccttctacaaaggaaaacaaggttgaggctaaaccaccaaaagtagagtccagcacaacacacgaatcaaaactaacttcctcttcagaaccacaactccctcctaaggaaagagagagacgggtaaggccatatccatcacttagttacagtacatcatgataagatatactatgttacttcatattcttgactcttgcggttgcatacattttgtcaccatcaaaatgcaggtgccaatgccaaggcttaggaagcgtatcgcaaatcgtttgaaggattctcagaacacttttgcaatgctaattacattcaatgaagttgacatgtaagtgcatcattagttggattgcttatttcttgtacgtctgcttggttaatgtaatgcataagctgctggcttttggccaatttaagataacgggaataagctattcatcctagcgcgcaataatactccaatagctatagtattggttcttgttcatgccaataagttaacgtgattattgtgtaaatgaaacatcagactactatgtttagttgaggactagcatcaatgcacctcatatatttatgtgctagaagaaacggattatcaatggagtttgaatctatatggctatttcctgcatatgttacatcacctttttatttactataactttcagtgtatacaaggataaatttgctttgtgacattcatcttgttgctttcacttttctatatctgtttcaacatcatatgtactgtgatgtaggactaacctaatgaagctactttccgattataaagatcagtttgttgagaagcatggtgtcaaattgggcttaatgtcttgctttgtgaaggtaatgtttacccctttttttcttcttcttaatataatgatacacatctctctcgcgtgttcgagaaaaaaaaaacgcaatcttatgagatacttaaaccataattgtggcaattgtgtgggttgtactaaaaacccacttgcttttgcaggctgctgtttctgcgcttcaaaaccaaccaattgttaatgctgtcattgatggtgatgacatcatctacagggagtacattgacatcagtgttgctgttggaacttccaaggtatcgccacctgtttttctttatgttgactgccctaactattattttatgcaatctgttgtaatgatgtgacatgtcatttgttttagggtcttgtggtgcttgttatccacgatatagatgcaatgaattttgctgacatagagaagggtataaacaaccttgcaaagaaggcaactgagggggcacagtccatcaacaatatggcaggagggacctttaccatctcaaatggtggtgtttatggaagccttatcagtacacctatcattaattctccacaggtgctcacttgtttttttttgctgccttgtaattttgtttgtaagttccctctaacacgagctttatctaatgtagtcatcaatcctcggaatgcattccattgttcaacgtcttgtggttgtgaatggcagtgtccttgcaaggccaatgatgtaccttgcactaatgtatgaccataggctgatcgatggtagggaagctgttctcttcttgcgccgtatcaaggatgtggttgaagatccacgaaggttgctccttgacatatagttccatgcatcatagatggcctacaaatttcactcgtttcaaaataattgcatgaaaaagttgactcatgtcatgcttgcttatccccaaaaaaaatagatggttgcaggcctttagacttgtacaagagggcatttctttctttctttcttttgttgaggtattacattttaggaagatgttctctaatgttttaattttactagagagaaagacgattactatttaggtcaaatagaagctttggagccacattctactgaacttttggcacacaattgtgaaaatgaaatggcaaccaaacatgcttttatactccttgaagtttgcctaactagcttgtataggcggaattggtctccacaggatgtgcgggttggcacaataatattaaatatctgttaacttgtgattctcattggtttctacgatagccacaacaagttgaaagaggccacaacaagtttgtatacaataacatcatctgcatttccttcgttacatgtttccactaaaaccaatagcacaaatttctccgtattttgttctgcgttgccgtcattttttgtgtttggtgtattttagtagttggatatcaggtattgtaaagtttatgagttctatgggttaaacctcactgatgcaatgttgcatagtgctaatttccaattccatgtggcgtgccatatgattgtgaacaatcagacaatttcccctagcaaaaccattaaaaacctcaccctccatgtacttcaacaaaatgtgcaaaacaacatgagatgactactgcgtcagcacaacgattcttacacaggttgctcacagagaaaatgacggcttgttgttataaattgtaaccaacagttaatttttttcactaagtgaaaacaatatgtgtttgagagaactcaccagaactttgataaactactaggctaaacctctacactagccttttctacattatactaaaccagcattctcctattgcaaactcagaactccaaagtcacagctgcagcagacgcaaccaccccttggtgacctggactgagactcgggactaactcatggtgtaaagctatacatatttttcgatttcccacacgatattccatcttcatttatctagcaagttgtcgatatcagttgttccaatgagatgcttcttgatcttaccaaggctgcagaagtgcttctcccttgtgttaataggtacaacctcttgaacaaattcgcacttcataccagctgaaacctgtacatttaatttatgttagatgtgtcgggaagaatcaaaagtctataaatggatacgcagcagatatttcactaattacatcaaacagtgcatctccgagctttatcttcattttaccactattgcacacaagtatcttccccatgaggccacttggaagctcatacagtctacaaccttggattgactcatgcctcctcttttgatcactccaatctaatgctgtagtagttgaattttaaattgcatgtctgtggagtgatatatttcatattaatttatcttactaatttttaaatatttttttaactatttaggtgacatgcatgaaacaaggggatatcctcccctcgagggatgaaaacaatttccccatctctccccctttccggcggctccatcgactacccaagagggacggggaggctacccgtacgtatcgatctggcagggcaccgctgctacccctcgtccccgcggtgtggcctcaccctccgcatctatggccagtgcggtggtgctcggtaaagtggagcagtgcacgtacgcatcggttgcggcggtcatgttgctcctcttcttcatgtcgtcggtggaagccaggggtgacaccaacgacatgtacaagctgtgcgcggacatggcgatgcagcgtggggatgaggaagagtgggccgccggtgaggatattggccatgatgctgccgagcaaccacctatcaacgaggaagtcatactcccgtgaccccaggatgagctctagcacgcggtacgatagcgtgacctttggtgatgtgtatagcggtgctccggccttggtgacgagctacgtgccgaagtcgctgatcttgaggtcgtcgtgggggctgacggcgatgttgtccggcttgaggttccgttgcatgatccctgctatgtgcattgctgtggcaccgtcgaggagctgccacatcagttgtcgcaccgctcctcctgcacgacacgcacaaggcttgacctgttgatgtactccgtcacgacatagcaacacgggcaagctctgccatcgccacccctcttcatctctctgtgtgtcgtgggatgctcaacaaggtacgggtggccctggcacgcctcgaggcaccgtggctcgcgaaagcactccacctcaccgtagttgatccctctatggaggcacttcacggcgggtttccctagtcctcgggtcctgcaccctatgcaccacaccctcgacttcctcccgatcttgtcgaggcacttgtagtgcttcatggtgggtggccacaatgacgggtgtcaaggggggaggggggtcccttggacagcggggagtggagacccctccccgagagtgaagagtcgaccagggggttagtaggcgagcggtgcgaggtatctacgatcacagcggtttcacggggctcggccgccccgcgagaaggaggcaggaggttatacaggtttaggctacccagaggtgtaataccctactcttgtgttggtgttttttgttttctctagatcagctaaatacaagagaggccttttcaggctacaaagcgaaataactgacatagcagaaagcaacccttcatctgtatctattacccttccttttatattccaaggaggggctcacattattacaaatctactcttagtcttgtctcatcagccgtcttgtcgttgccagctggttcccttatgcaaccctcaagaaacccatcaagtcttacggttcatattaccccgggctcccaggcttcgtttgagacagttgggcctccgccagtgtgctcaccacgtggtgcgtggtgggcccgacgaggcccgacctgcccgaaacagtgccacatttgcttctctgcccatttggctaaatcaagtggtgcggggcatgtgcggcgtgtgtcccaggcgccaccgtccaaagtgactcaacgctggcgtcttgtccacgtcctttcaacttagactggccagggatccccctataatcctgtttcatttatggcggggcgtgctgccttacaactaattgtggagcacgcccaacttcccagaagtttctgaggtcgcgtcctattgcgcttaaagaaggtttattattccttgatgagtttctcgaaggcgtcgttgacgaaagaatatcttgagattgtgtgtcttgtaccttctgtcgcccctctgagtagaggggcgcgagctatacaaggtccaaggtgagccctgggcccgaggcaaggccgggcccgaagcacaccttggatcacgcctttatgcttggcaagcctcgtcacccttcttccttgagcaacgtgtgacttgtaggggctaaggcgagctcagggcccagagctaggccgagcccgaggcagatcttatctcatcctcttaagatatagatcttgcatgtttttacgccctcttgccgaggattgtagaatctgcaagggctagggtgagcccggggtatggaacagggccgggcccgagacagaccataggctatatttttaaggcatatttggggtatgcttggggcccgagccaggccgaaagctacttctatactcggagttttggaccatatacgcagtatccctcctcagccagagaaaatcccatatataaaatcttaggtgggcccaaagccctccggaagggccccctagctacaacaccctagggttaccttttatttttaaatatagtgctatttatttgagaatgatccttttgccgtataaatgggtacgtgggttcccatttcaccgacaacggggtcctagacgggaggcggcttgtggtttgtggagttgtgcggtctcttataggggaatcgaggagttttggttacatcatgcggctgagacgcaaagtgtgaagcgagtgctgccgtagatgccaagtggtggtcttggatgatgccaccgaaggcccaggtgacaccatagaggctgacgccaccacattcctcactgacgatggcggcgtcttggtgtttgtgcctgataaccatggtcaccgtctcgtactggaacaatagtgtcaccacgaactcggcgattgccgcgcggtacagctccaatgtccctacctccaaatcagcctctgcgcatgcggcactgctcactctctcgcacctaaacccctctgccaaccctcctagccatgccgctggccctccagcagccggcgccagagtgcatgtgagctttgcttgagagagagagaagggaggaggaatcagagaaggagaactggggcttacaagtgggccccactattttttatgtttacccttgtggttatacgtgggacccgcttctattttcggtttctttgatgaccgggtgccacgttagcacacttggaccaagtgaaactgctcccaaaactaacgagggagttgatttgcaccggttttcgaagatgggggaggcattatactcggttttgtggttgaggtatgcgattcgaccaaggacaagagatgagggaggcaaaatagacttaatccaaatattgaaaatactattggtaatgtgtagtattaggaagtattggtggtaaaccaaacattgacaaaattactattcaaaataccaatattttggtatggcaaatttcggcttcaaaccaactagcccttacatacatttccctctaaaacattctaagaaaacatttgttgagacaaaaatgaaatggtataaattcgtctaaattttattttatttttgatttacatgaaagacgcatacacgcacatacaccacactcacacaaaactcttaacccacattaaaaaggaccattagaaaatcttcagcatcagtaaaatcatattaaaagtacatccgcgtgaggaaaaaaaatatcatgaatacacaattccaaaaaaatataaaaatatacgtgattcgcttagggaacggatcttaagcaatgcaaagcattgtcatcatcgctaagcggagtggcgacagcggtgtggtgtcgcgggagaagaggagaggctaggaccttgggtatggcacgactaaaacaccatgccaccgtgcttctcgaattcattacaaaaatgattcaataatactatagtgttattataaatataatgttgtagaaaccggtcaaacatatatgattaacgctatttaaaatttcacaaatattttttcttgtaatagatatgtaaatattttaaattctgcacaatataatcgaagtacgttgatgataaatataactataaccatatttctttagttgaacgtaattgaagtatttaaagtggtcaaacacacggaatatatcagccaacttgtagacaatacgaacttcaaacgaagtaaatagcacactttttgttgtatagaaatattactatattgcacacatttacttcttattagtcgagaaatcatccgtccgccctttcacgtcccacctagcatggtcacaattgacctcctgaaaatcagaaatagcctgttttttcaacttcatgcatattccatagttcattcttaattgtatggacgcctaatcatgaaaaatataatctccataaaactaaatgtttcgttgcaatccatggacatcttaccaataaacatgtaacacaaacagatcaataagagcattactataaaataggtagcataaatagcatgtaatttttcatatccaaagaagtcctgccatccaaatagttgtttccattgaggcatctaacatttgaaccaatgcggcgcagattgcaaagcctgcacaaaaaagaagagtgcagcatgcagccttccacgagagacaagagccgctccgaatagccaaggaagacatgcctatatatgtatgagtacagagtactacacacacatataattgacgacaggactgatcaggggataatcaaaatgcagatgagcagcgtataaacacatgcacataggcattaggcaagtcatccttggctaccgaatcagctcttgtcctcatggaaggcccctcctctactaattaagctctgaaattaaccctctcaaatctgaatctttcatgcatggcttgctctgcttcattacgcatgtcttcaggtatttatagcacagaaaaggtatatgtgtgcagggaataatattagttggacaatgcagtgtaaatgcatttatatatttgtcctagatacccatatctcccctcaacaacttcgtctgctctttgacatctatacattttgtagtaccatcggaatatattcggttaggttaggttttgacagcttatggtcatggtctatcagctcatttttccctcggcacatgcccaatactgtccgtctatttctgaggtctacaaggcaacacgtctcaaataggttcaattgtcaagtttggtatggctccgactccaagcattctcataaatatatatggagttcttagactctaaatatagtagtttaaaagttaacttttaggcataaaaatatgaatatgacggcctactaaaataactccgagctactctgaacttcaactctaaggactcctttggagaataatcatgattctgtttaattcttataaaaactctcctaattttttttcaatttaaaagaggcctaaaatttgtttatttatttggattggcaagaaaatttgtaataattgaactttatcatgtattacaaataaaatggcggagctaggtccttttatgatgtttcatcttttaagccagaatctattgtttaatagagctggccctggggaaacttttttttttatttttagacctttttatgttttaattttattaatagaccattccaaaatatatttctaaatctaaaccttttagtgtggcctaataactctgtcatgtcgcgtgcagtgggtgtgacaattttgtcttgccatgccagcgagagcgcgtgatcaaaaaacgctgccacgcaagcgcccgccggcgtggccaaataatgttgccccgctagcaggagcggcgtgatagtataggccaaaagtttcagatcttgaaaataaattttggatgggtttatttttaaaaggcatgtctttttaaaattaaaaattaaaaaggttcaaaaaatatttaaaaaatcgccctggggctgttcctaactggtttcgtccttgcaaatacccaactccaaaagctcttgtagtaggagcccaatatatcaagcgggtccaatatatcatgtcttttcctatccggtatacatacacaccaatagatactacaatagatttgctggggcatataaatgatgcacctaaaataaaaggtaaaatctaattcccgcgcgcgaaatagtcttacagcgagacgccatgcggtagccatcgaaagatgtgagtattcatgtagtactagtctatttaaaatttttgatgaattatatatttcaaaccatatattatttttaacacccgttttaaccattgaacttcactcaaaatatatgataaaataagtacaatattgaatatattaaaatatttaaaattaatttagttaaatgttagaattaactaagctctataatgaaagtaactttttatagcattagaagtaattacatatatgtgttaaaaatatcttcataggtaaagtgtagatttacaagtaaatacatgccttttttattcgaggtaaaccatatgtgtgtatagattattgttttcgataaatgcaacttattttatataagaagtaactctttagaaaataggataaactattcacagtattagtattagaagtaactcttaatattagaagttactacattcctagagaaaagtaacttaaaaaaatagaactgaccttttacgatgttaaaaataactgcactgccagagggaagtcattcttcatggtattaaaagtaattataccgctataaggaagtaactcttcatagtattcgaagtaacaacactgccatagaagtaaataatctaaatatattcaatattgagctcgttttgttatatattttcaatagagtacgatggttcaatcaaatcttgaaaacaatatattgtttaaaagatataagtcaccaaagattttaaaagtaatagtgcaatggtactagactccgttagcacgtgagacgtgactacatagtactaaaagtggaaatgcactatgacatctctttttttttttaacaaaactacgtctgagggacgtgatgcttctatttttagcaagtacattcatcgttgtttaggactagagagctatcactcttgttgtagtcactttaatacatacatagtatacctacacatctgtatatacaaataacaataacatcgaatcattcatgctacagttgaaggaaattgtacactcaatcaatctccttatacactaaaaagtaaaaacatcgatcctaacaaagtataatgttgacaattatttaagtcatcactactaggaaaactattctccaaaatgggtcttcgcagacggacgaccggtccgcctgcaggaagtaatctgaaagaactgaattatatattcgtgag

SEQ ID NO: 68286 - DNA, 1951 bp, Oryza sativa
aaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacacaaacgccacaaaaaaaatggagcaaaccctcctcccctcctctagctaatcaggcaagaaggagaggcaccgctctcttcttgctcaatcagctcgagtggcaagggatggagtataagtacaactgtcggaacaaaggtgctggttctagacccaaaaccggcacctttgtcttcctaaccggcacctttgtgtggggcatgaaaagcactattggaagaaaggtgccggttctcgatccaacaacggcacctttgtgtgaggcatgaaaagcactatcggaacaaaggtgccagttctagaccaaaaactggcacctttgtcttcacatacaaaaaaccggcacctttgtgttgggcccaccaacggctagtgtgggagggagaatattaaaggtgccggatttgggctgagatccggcacctttgacttgtcataccaagaaccggcacctttgtgtaggacccaccgtcgggatgaaaagcattagtgaaacaatggtgccggttttgggttgagaattggcacattgtctaaaaaccggcataggttaggtgggagggagaagattaaaggtgccggtttagggtctagaaccggcacctttctctgacacaggttttaggtgccggttttaaaatgaaaccggcacctatttggatataaaggtgccggtttttgaatatgtggagcatgggggtgggcgtatgggtgggcaagacattataggtgccggttttaagtgtgccggcacctatagtggcgacacctatttgcctttttgtagtagtgggcccacctctcatccgcagcatataaccccaaataatgatatcccataatctagacaccacgtctaaactaccagatactactctaatatcatcgtcatgacatagagtataattgcatacgcaaacattatacccgcaccaaagcatctcccagataacctagcaacatattcagtataacatgaacataatgaaaagttggcattcatatactcggaaagtatttcgataccataaatatataaagaagaatactctaataaaagtacaaagcttacaaaagaggaaaggaaaattactagagccatacccaaactcttccgaagacttccggactcctgatttctactctattcctattccactagcttgagactactaaactaacttgagagaatatgagagctcttgcttgacatgtgtgactgaagtgagaagagcaactccttttatagcctcccaatgacggttgtgacggttggaatggtcggaaataccctccaaccgtcattgggggctaatccacaccgtccaggcaaagccctggatcggatggcgctgaggaggattcggccgaacctggggccggcccaatccagcccatttttggctggcggcctcctccgttgttcttctctgcagacttgtgaattttggcccggtttgtcgtgtcaattctgagttcttggcccactcatacataagtataattctcgacatcgcctaattgatttattgtctgtgttgatgtcgattctcctccactttaatgttatt

SEQ ID NO: 68287 - DNA, 11079 bp, Oryza sativa
attggacgtttgttaatgatattttttggattttctcttgttgtttttatcacaggtcgaaatctataagcgatatatctcatattgatttattttaatttttttaaaaaaataatgactatttaagtgatatgaactagtgtctctttatggatggaaacatttttccctgcgtgatacaccagttctacgctcagtgctactaggaggctagcagccacttgctgctgctagagcccaaagaacagtactgtcagttcagatcagttgcaacttgcaaggtctccatcttagtggagtactttagttattcgatcctataaaggtactccctccgtaccctaatataagaggtttttgtgattttacttgcacttgcactttaactattcatcttattttaaaaaattagaattattatttattttatttgtgacttactttattatccaaaatattttaaacgcaattttttgttttttatatttgcataaattttttgaataagatgagtggtccaagtaaaatatcaaaatcgattatattaggggacggaggaagtaattacaaagtctaaaggaatgaaatctccagctagataataaaaaaagtgtgttcttttgttttaagcaggtttggtctgaggtgacaaagactgtctgttagaagtttgcaatgcccatacttttacaaaccccttcatgattagcgattttaatccacaagtctgaataaattccagcatgtctgatgtagctcatagaagcatttcagcttgtcttaatttttttctgtcctcatttttttaatcaaatgactatttcattgtacagtcgtaaagccatttcaaccacagtaatctgctggtaatttttttaatgtcatataaatttcataggtagtgatattactgctgatttcccaccattcaactttcttaaattaatgcctaatatatcatgattatttttgctggcattggtctctttaagcatgtgggatgtatatttgtgggtgtgagtgtggtgagcgtgcgtgtgtcttatcaataatgtaattttaaatttttttatataaactattttataattttttaagtaaatttcatgaaacctcacatgttatgatttaagttgcacaaaatcacaacggctctggtacatggcatataaccatagatattacggtcataagatttcaccaataaaaatagttaacttacctacaatatttaaatgatggattaaaagaattcatatatttcggaacttgtatgcatgtatggtagatcaaagaaaatttagttaatggtgtatataaaactaaatgtcatagtaccagcattacgtgcaagtgtgcaacatgccaaaactccaatagttttatgcaaattggatcataacatcgtggttacgtgaaatttactactatctctgtcttaaaatataacaacttaatactcggatgttatatatcttagcaatgtaaatcttgacatgagacatatatccataataagtagcagtacatattgtgggatagggcgagtagtttttttaaaaaaaaaaacgaaacggtttaaaaactaatccatagttagcaagtggttaagtgagcaaccgtttccatcaaagacggggcaaaagtgagcggggaagacgacacctccgcagctcggcgcacaaagcctgcaggaaacccatcacctgtaaccaatccttccatcttctctgccttctccttcgcttcaccacctcgccaaaaccgccttcccttcccttctcttcccttccaacctctcgttgcggtttgcgctagaaaaaaaagagaggagagatttcaagaaaccgtgggggagaaagaagcaggcaagaagtagcagcagcagcgagtgaggctaatctggtcagtttcagaacagattctttgttgggtctctatccattgcaagaacaggttttgttttttcttttccctttttttgggatcagagtctctccatttctgatgctgctgctgctgctgatgatgatgatgatgcaaggcttgtggcaacttgtttggtgaaagaacaacgagagggatactgggatagggatcaaaggcaaaggtttttgtttttaccccgtggtaattgttcgttcggtttgtgatgggatagttgctgggactgtgaatcattttgccccttcttatcatacagacaggcgcgtgatttgaccagcttgtcgtctctgctctgcctctatccatccatccattcatacatccaaccttgggggttcttgattctttttctcatttcttggggaggcttaattgttgctatcgccctccgcttcaggtgtccatttgaattattcgtcgtttctttcgtatttaattgccatttgctgatttgcctctttatttcggtgggttttatggtaataaaggtgtggttcctttatcatcaaatttgaggtgttctgggttttctttggttcttttttggagcactggatttgtgtgctcttgtaaatcaaatagagtttgtggtttggttcgtattttacacaatcgagttgtgtttttattttagtttgtatcgaaatatttgcatacttgtttctagttccttcaggcttcagttctcttcattattataaaaaaaaatttggtcctttcgtccataatttttttcacaattccatttttgaatgtatgagcttgaattatgtgacttttcagtttgagcttgggattgtcaccttttcatggacgggaccaacaaccatggagcactgatggacgattggatgcttccctcacccagtccaagaacactcatgtcgagtttcttgaacgaagaattcagctccggtcccttttcagacattttctgtgataatggcagtaacaaacatcaggatggacttgggaagagcaaagctttcatcgattcaagccgggaagaaactgctcagctagcaaaaaagtttgaatcaaacctttttggtgccaaccagaaatcaagctcaaatggctgtctgtcagagaggatggctgcaaggacaggttttggtgtcctgaaaattgatacatctcgtgtcggttattctacaccgattcggtctccggtgacgatcccgcccggtgtgagtccaagggaacttcttgagtcgccggtttttcttccgaacgccattgtaagtgacttcctcacctcaatcagtatttgctctgtgtaatgttcagttactctactcatgtggtttatatggaggatatatttgtcagtaaatggtgaaatctaaaccaagatacctattataaaaaatattctaacgcaagatacagcatctttaatttctcttatgtctctgcagcttcgtataattagtggaattttggagaagaaagtgactatatatgttgatgactgattaatcttaatgtcatggttttgatttatgcaggcacaaccttctcctaccactggcaaactgccatttttgatgcatagtaatgttaaaccatcgatccctaaaaaaactgaagatgaaacacgccatgatcgtgtattcttctttcaacccattttgggatctaagccaccaacttgtccagttgcagagaaggtagttttctcaaacaatgtggttctattccctatttactgcaaatctgtaatcactgctcgcctgctcggcgcagttagttttactgttccagcaaatctgacgagcaaaatcaaattatcagtgttatttatgcattggtctgatgatatttatacttttcagggtttcagtgttaatcatcaaaaccagccttcagtgacggataatcaccaggagctcagtcttcagcctatctcaactgcatccaatgatttcacttcaccaactattgttaaacctaagacatctgattccatgttagacaatgatgatcacccttcccctgcgaatgatcaagaagagaatgcttcacacaaaaatgaagagtattcttcagacctgatcattacccctgctgaggatggatataactggaggaaatatggacagatgcgagttagaacagtgagcatcccagaagctactacggatgcactttcacgaattgcgctgtcaagaaggtggagcgttctcaagatggccaaataacagagatagtctacaaaggttctcacaatcaccctttgccgccttccaaccgccgaccaaatgttcctttctcacacttcaatgatctgagagatgatcactctgagaaatttggttccaagtctggtcaggccacagcaacttcatgggagaatgccgcaaatggacacctccaagatgtcggtagtgaagttctgacaaaactgtctgcttctcttacgacaacagaacatgctgaaaaatctgttatggacaaacaagaagctgtggatatctcatcgacgctctccaatgaagaggatgatagggtaacgcatcgtgccccgctttctctgggctttgatgcgaacgatgactatgttgaacacaagagaaggttggctagccttagtcactaatcactcaatgaaccaatcttcactttgagtagctgattgttttccttcaattttattcatttcagaaagatggatgtttatgccgctactagcactagcaccaacgccatcgacataggagctgtggcgtcaagagctatccgggagcctcgcgttgttgttcagaccacaagtgaggttgacatccttgatgatggttaccgttggcgcaagtatgggcagaaagttgtcaaaggaaacccaaatccaaggtcaattctaatgccatttttctcttttggaacaaattctttgcagttcctctaatccttcactacaaaagtaaatgtttagcttcacaatatgacactgtcatcgaaggaacatttctctgtccatatgtgtgcatccatagttggtacaaagaccggaaattactcgcattatctaaaaaactccattttgtatttgcaggagctactacaagtgcactcatccgggttgctcggtgcgcaagcatgtggagcgatcatcgcatgatctgaaatccgtcatcacgacgtatgaaggaaagcacaaccatgaagttccagctgccaggaacagtggccacccaagctcaggctcagccgctgcaccacaggctaccaatggtcttcttcaccggagacctgaaccggcacaaggtggtggtggtggtagccttgctcagtttggctatggctcagctggtcacagaccagcagagcagtttggtgcagcagcagctggtttctcctttggaatgctgcctcgtagcattgcaactccggcgccgtctccggcgatcgccgtgccggcgatgcaggggtacccagggcttgtgctgccgagaggtgagatgaaggtgaacttgctgccacagtctgggaatgctggtgcagcagctagccagcagctgatgggcaggttgccaaagcagcatcctcagatgtaaaaatggcaggaacatgagacaaatggtgtttgctgcttatgtatatgaaacatttttggtgcttttgttaggagaatggagtgttattgtagctcaatttactttcgggggaaaaaaaagcagatagttcaggcaattgtaggtagtagaggttctagaaaagataaatggctttggctgagttctaaataacttcctcctttttcattagcatgtttactggattgctaaactatatattttctgtaaaaaagattatatagtatttttaaaatttataatacatactttaattatgcgctaatgatcccccttgttttccaaggcgtctacagctacagccgaactcagcctcagccttaataagatcagaacttctgcgttgacatcttaggctgactggttttacaatcaacaaattcaatcttgaattctgggagcaaaaaactgcagcaaaaaaaaaggtattttataactttacaggagtaactggtccgcagatttgcattatccagtaattgacgtgcagcagaagatcggacagaaacaataaacagtcaccatttgcaatgcttttttgcgggacagaccaaagtgtacccagtatactgtcatgtcagaacttcgaaacagtcaacgctaacaaaagcgaatcacaccatcaccgcttatatattttctctgcacaaaaatgtgcatatgtggcaactccaagaaactttacatttgacgaggatattttttgagtgaggaggttttaagttaaccctaatcatgttgaaatgtcactttataaatttggtatttctcttcactaaaacgtacaaccaaaacttcagcacttctttttgctcagtggccattaacagctgactgctggaaattctctctttgataaatggctttccaccgctcaagctcttccctgcgaaataatataaacaccagaagttagaaatgggaggagaaattgacccctttctttgggaggagggccagttgcagacaattgcttatactgttgtacaatatcaggttctctaatgcactgttatatagtcgactgcgttagtgctatattatcttatgatgtatgatacaaaagataattgccaatcttgtaggatacaattgtttagctgattattgtgtttctaatgaagcaattaatatatgatcacttatacaaggctactttgtttaagtaattatttttgtagaccactgtctacacctgaacagaatgtacagatgggacaagtgcactgacattgagtatgggagccaaaggagacaaaaaagatcaattaatctgcttgggcatgtttttagattgtttagatctgggaaatatgtgcatagatacagatcattgtttatgtctaagctctactgaaattagctagtcccgatcacttatttgagtttgaccttaaggaacttgatcccaacacagttattaaagaaatcattaagtatcggaaagaacaaaagttgtgtatatatagtccacatagtataatgtataaggtaagtgttgtgtaccgaggtggtaaattcaagtgccattgggcagaaggggccaattgagttatatagtctccccaaggcgattagctgttccaattattggttcacatccaaaaagaagcagccactgcaattcaataaattaaagaaacatatcaagaaggattacgttaagctcccccctatttcatcataatgaagaaggccaaggaccttacgtcttccatcattcctgcggcctagccctcttgtttttaccgactgagaacgtttgctttagatcacctatgtcatctgtcacagtgaagcttccattacgcacgtggctcaggtatcctgatatcttgtgaatatgcagggatcagcctatgtccatcgttatcattcgcgcggtgcgtagctgaacctctcttagtgaggcatgatgaaacaagagaagaatttgcctgaaacaattaaagcatgtaagtatgtgcatcgctaatttccgatattactataagggcgtgtttggataggggtgttcaaatttaaatactttggttataagtttaactgcacgtctgcatcctataaaattccagatccaaagcatcccttaaaacggcaattgctaaattaaattataggctttaaaggtgtgagattttgcatacatccaaagtagatgaatttgccccattccgtggagtatcttcacttaattcagattcaaatcctttacggcgaatgtcaccaatcgtaacaattccttcaagaaaatcttcactgtctactacaagaacacaattttgctgcttatcatgcataagccttgttgcctccttgatagtcactgtaggtgtaaccttaataaattgctttgacattgcttgtgatacctggaacactcgttgttagaaagctgaatgaccacaaaaatatatcaaatttactaaggatgaacttgacaaaataataaagagaatgtagaaaagaggcatggaacctttaaatcatcaagaagcatatcctcattgttaataccatagcggtagggatcatcgtctagaattgcaagttcaacgtcatctctgtctggtcgtctccggtctgtctcattcctatctgtaggaggtaatagtgaagaataaccatgccgaggagatgtagcctcaaacgcctctttgttgccagacattacaacagatggcacccatattgctaaaccaacagctccctgtaaattaaaaataagggtgagcttatgtcacaaggagtgtgcaaactttcatgcttagaagcaaaatagcaaatatatgggatgagacatcaccatcagaggcagtaaaattctgtaatcttttgttagttcgaatagtagtagtactgaagtcaatggaactgagcagactgatgctagtgtggcagccattcccacctgaattaagcagacagtcagtatacttcgtttctatcaaactttaggctaccttcctagctcaaaaaaggaaacttactagtgcataagcttgagggtgtgcaacagcagtgttacccgggatggcagagtttattagttctgctgctgagcctccaaatacagcaccaacagcagcaccaatcatcaagcttggagcataaaggccaccaacaagaccagaacccttgcagagtgcagttgctacaacttttgcagcagccaactgagctaagagccagattccaggggctgaggcactttttccagtatgtaaaatttcatcaacattggtgaagccccagtacagtattccagggtaccttagagctattaaacctgctccaagaccccctaacgcagggcatactacagcagggaggctgaatttcttccttatcaagtcaaaagtctttgtgaaccaaaccaccaactgtctgaatgccacactcactaccccacaaagcatgcctaggataaggtagagtggtaactctgcagaatataacattagtgatttagttggttgcatatttaccagttagacatatcaacatgaaaacagtaatagatacacagttcggcgttcacgtcacagatataccagaacttcaaactattcaattgtgaatggcaagaaaacaagatcggaacaataagaagctgctaaaactaacgtgttgatggtaagggaaccaaccacaaaacttcaaaaccatgagcatatacaagtgtataaatgcgtgatgcatatataaaatagattataaaggcaggatatcacgagtcctctgctatagtagtaagaacaaaaaaaaatctactcaagttcaatacctaactaagcaaaatccaccttcagtaataccaggtttgatcagaataagataaaataccagcagcagattttagttcatacgtcgggacaataaaagctgccttctcccctagcaaaacattggacacagttgatgatataactgatgccaatataatcatagcagtggtaaatggcggtgaattctctgctcgaagtggcctcagtactgtttcaatagcaaaaaaacatccagcaaccgcagcattaaaacctaaagacaaagcaacacaagtgtcaggagagaataaagaaaaaagcattggcctgaagatactggatgttaaagagatgaaattgcaaagatacgtggtacaacaaagatctatagtattgtatttgtagttccagttgcttgcagaattagtttatcttccttttcttgttaacttgtactaacatcttataatgctaaaaggcagtgggaaacgattccaatctgttgcaattcccagatgaatgtaaaaaaatcaaacagatgatgattatttaaaattacctgaagcaatcccagcagctgatccggcagcaacaagagcaattctccgttccctattgttctccatcatttcagcacatccatatgcacaagatttaccaatatcaacgcttggcccttctggccccaatgaacatcccgtccctagagtaattgcagcttgtattgctttgattgtaggaaaaatcgcagccatgaaatcaacaccttccctttgagatgataatgattgttttatctgctcaaatatctccagtaatccgtgcatcataccaacaacaactccaccagtcactggaattaacaatatcctatgccatgtatcagcaagtctctggaggcgaagccaagcagctccctctgtgggtgtgcctgcccatgcccattcatgtatgatatgcacctgaaaagaatagttagccactattgaaccagcagattggtatatgagaaaagtacaaacaggaaacttttggtttagaaatgatcatctaaacttgattggatagctcccgcttaacagatctaagttatttcaaggaaagagccttttctagtaactttaagaaatgggggttcgattaattgcagttcagtcaaagtaaaataggcacatactgtattaacccggtaggacttttctgagtttctatctgatcaattcagatctatgaagtattcagagaacacaaacaatgcaccaaaattgccagcaagtagacataatctagtaaacctcagcagattataataccacgcaagattcgttttcacctaaacccatgccataagaggaagactttaactagcaaagacctcatgtttgtatcaactatccccgtggcatcaaatttcacatgaagaaaatacattatcatctccacgaaacaccctaaacggcaggataaagtaaatgtacagtccatattctcacacgagaaaatggacatttagccacgttcaaaacatggcttcgctagaatgccatcccgaaaacgcgtttcgctaaaatgccaatatgaaacgcgtgctcactgccactttgccattttagcccttttgtgcattttcgaaatcatttttgctcctccaccgggcgatgagacaaaattgcccttcatgtcctgcgtcgccgctgttgaggaagaggagctcgtactcgctggccaatcttcatgtccaccacaagcagctcaccgtcttcctccca

SEQ ID NO: 68288 - DNA, 3421 bp, Oryza sativa
tccttaggatatcccacaaagaagcatttatctgatttaggtgtgagtttgtctgattgcaaacgttttacatagaccacacagccccaaatctttaggaaagacaaactgggacgcttcccagtccatatctcatatggtgtcttatccactgattttgatggaaccctgtttagtgtgaacgcaactgtctctagagcgtaaccccaaaagcttagcggcagatcagtttggctcatcattgatcgtaccatgtccaacaatgtacgattcctccgttcagacaccccattccactgaggcgttcctggcggagtgagttgtggaacaattgcacattcctttagatgattgccaaattctaggctcaagtactttccaccacgatcaaatcgtagatacttgattgtcttgcccaaatgattttgtacctcattctgaaattccttgaacttttcaaagtactcagacttatgcctcattaagtagacataaccatatctactaaagtcagcggtaaaggtaataaagtacccaaaaccacctttggcagttgagctcattggtccacatacatcagtatgtactagtcccaatagttcacttgccctttcactttgacccgtgaaaggtgcctttgtcattttgccaagtaaacaagattcgcatgtctcaaatgatttaaaatcaaaagagtgtagaagtccatctctatgaagcttctccatgcgtttctcatttatatgacccaagcgacaatgccaaataaaagtgggattcaaatcattaggacgttgcctttttgcattaatgttatagactgaacatccatcaagattcacaatgtataagccattcatcatgggtgcatggaaatagaaaatgtcattataatagactgaacaatcattgtccacttcgcctcttgctaagctcctacttcttttcagcccctgcaacgatttgcatatgtgagcaactgacccggtatcaaatacctaagaatcagtagaggaagtagcaagattaatttctataacattaatacctgaggtggaactctttccatcctgctgcttctgcttgaactgctctaggtatttcttacagtttctcttccaatgacctgtctccttgcaaaagaagcactctgcatccttagcgggccctgtcttttgaaccttggtcttagagttgctagtactcgtgatctcatcagagtttagctttctcttttgacaacttttcttgttgttgggcttgcgcttatgcacaactatcacatggttggagtttttcttaatgctttcctcagcagtctttagcatcccatgcaattctgccaaggtcctgttcaggttgttcatattgaaattcattatgaacggctcaaagctgggaggtagcgactggagaatcaaatcagtaaccaactctcggctaaggggaaaaccaagcttatccagactctcggcgtaaccaatcattttgatcacatgtgggctcattggattaccttctgctagcctgcacgcaaccaaggactttgaggtattaaacctctcagctcttgcttggtcctcaaacatgttacgtagtctcgtgattatcgtatgagcatccaatgcatcatatttcctttgaagctcaggggacatagtagcaagcatgagatagcttgtatcaagataatcattgcatcgcttttcatgctccctacgttgagcagcaggagcattgttgggcaagttagctggaaaaggctctgtaagcacaaactctttgtgctcttgcctgagaacagttctcaggttgcgataccaatccatgaagtttattccagtcaacttctctttctcaagaatagaccgcaagttaaaattggatgatgcaggagctgccatgatctacaatagaaatatatgtatgcaaaatcagcatcatgtttacatttaacctttcattaaacaatttaacaaaagatacttccactatgtattgtgaaacaaaattccctctagtaacatagtgagtcaagatcctcattttattagtgtctagtgagctttggcatcatagctagacaactatcaaaataggtaagcaacaccttgctaatcacatcatatgtgactcttgtgctgttggggtgacatctccatgtccaacccaacctatgccccaaggtccaaaactgttttaataaccttgtcaagtaaaccaataatctccgcacatagatgtccgacatctatcctattttatcatgataaaaagtgacactttgctatgacaaacccatcacttatgatcacaaccgtattaggtgcaattactggaagagcataaatcacacttaatttttctgagggaatctatcctaccatgtcatatcaaatatacaacagcagtaaagtaagatagatataaaaaccccaagcgaaatctaaggggcaacgcacacggcggtacatagatctgagggaatctatcctaccatgtcacggggtacatagatctcatctacgattcgccatgtgaaaaccttaacggcgtaatcgaattatgccgaaaccgagtcaatctcactggctcattttttctcattggcgtacggttccagtggacatcggactatccgatgaacacaatcgcgctcagccttggtgagtactagacattccagtgaagtcaccaacccatgcgactatcggttcatctcatcaacccatgcggctatcggttcatctcatgttccgatcacctaagaactcatatacaacataatagatctcatctactacacccgcatatcaactatatgcaatgatctagatcataaactatacaaggcggctctgataccactgttgggataagcgtaagctacgatagcataaatcaaacatttctatcgcataaaccaggaaccaagcaagtattagatcatatatcgttaccactcgacgcgctgcgcagcggaagaagacactgagaagtcgaagaaactctcgcgaagtagcacgcgtcgttgtagaggaagtagtcgatcgcaccggctcgaccttctcctcctcgtgcgttctccttgccgtactcctacgctgatcagcaccgcaaaccagcggcgcctctaccggtatccacacatacagggacgaaacgccacgcgcagatgtgctagcacccgcgcgcggctagggttttgctcggggagggaagtgacggctagggtttctcacgtgatgcaatgcctccaccggtcacacccctcacgaatatataggatccatcactcgggcctccaaggcccgtaagactcctatttggatccctatacgaagtatgctcatattggatctccatccaatccccttagtccggcccattaagcgtgcgaccctgtaggttcatgtatact

SEQ ID NO: 68289 - DNA, 9067 bp, Oryza sativa
cattaaaatacggagggagtattagccaagctacagacactgctacagactctttcggtataaccttcattttgtttctctatctgaaaagtgataagagcaccggacatattacctatgttctgaccttcaggcggaactccgttaacgagtccctcgttgaaaaatctttgattaggagtataattaacacctctcttttgtaaagcaccctcctgttccgttggacttggatttctttctgatgcacttatccaaagtgcatgtacctattgctggctttgtaggggacaacactgataaggcacccgatagggaatcttattatcttggatcgatcagccagtcgcagaacatatccccccatgctgaatcaaagaggagagaaatcatggctagactcaattactcaactgatcttgcagataggttatgatagatctcccattgtgtgattagcaatctgatcttgtttattcatttggtatataaaattcagcatacatttttttgtcaatgttgctttctgatgatcccttccaagatggatacctccgcaccaagaaaagtcctagataaggttaattatgcagtgcctagatttttattttctttcgaggaatatgtagtgtcctagattattccgtcaggtgttcacatttcctctccgaatgcactagtttagtatgataagattgagtgaagacgacgaaagatgacagcttgacacttgttaattactgctgctaaacacgccataatatctcatctatcagattgctagcgacattggcttacttatctctaaaggcagatggggcgatgcctcttggaagcgattagctgaatagaaacaagtaatctatttcccttgcacaaaaaagaaatctatttccttcccctgataagcaaagagagaataacactactgtactgtaactgtcaagaggacaaataattggagctctttacaaaggcgggagacgcgattgcttggacgaaagataaaatgagccgcatgataagagaaactgaggcaaaggggaaaagacctgctgatagcaaagtcgttgcaacttgcaacctgtcgacatgggcgaagatgagggctctagtactagtctacctaccattagtttacagtggcaagcaattctggggctcatctctcgctctcgctgacatcctggcgaacgagggccatatgaccggggggtcaataatgccagaaggcaggccggtgcgaaagcagatagagtttggtcgtgcaatggtggggttatggtgttgacactttgtttgtgtgcctttggatcgaagggaaacggcacctaaaatgaatgggacgactgacggctgatgaattgcttctgggttctgatctcctccagcaatcaggaacatgtatttgcaatttgcaatatagcatgcatgtcctcctctgaaacttctgatagtcatgccgcagaaatcaatcgtccatcgacatattcagatacgagttcccagttcacacgcgatgcaacatgcaagaacgaatagtttttgttcctgcacgattgcaaaacaaagtatatcgcgggtataatatcgtccgccaccaatcatctacgcgaaggggtcctaaatttttataggcatgtacaatggctagggttttttaacaccctgaaaattcgacgacaaaaatctaaactctaaaatgcggattttcaaaaactttttaaataaattgcatcatgccgattttattcgattattttattggagtttgggttcggagtttataaatcgcgaataatggataattggttaggaataaaccctaaaaagtaaatggacaaagtaaataattaaagtgcaacttaaaataagatttggtgaggatagaaatgagtaaaatattattacgaccatatttatatccatcaaatttaaaagcaatggaatgagaattaactctaattaagttcaagtaaattacaataataatatataaaacatggaataaattaatctagaatgaatccatggattggaatggcacaaatattgagtatacttcatttatgcaaaatttggaattaaagaatcaaatttaaataataaatgggccaaaatcgggttaattagaaaacggcactgttcattgcacctgaagtgttcgacgaggtctcctagtcctagcccctcctttgccgcgttgccctcgcgccccgcgcgccgctccgcctcccctctgccgacgccgtcgccatcaccgcacctggccgcccctaaccccgcgccgccgtcgccgtcgtttccgtcgcgtctccgcgccgccgtccatcgccttgcgccgcgcaccgccgctaccgccgtgccgccgcgcgtcgctcgccgccatcctgtcgcgccgtcccatcgcaccgcgcaccgtcccgtcgccactgccgagccgtcgccgtcgtcacctcgcgccccgtgccgcgccgctcccccgagccccgtgccgccgctgctaccgcgccgcgccgcccgttccatcgccgcgcgccgtcgccgttcggccgtcgcgtcgccgctaccgcgccatcgccatcgcgcgtcgcatcacctgccgcgccgcgcccccgagccccgtgccgccgctgctgccgcgccgctgccgctcctcgcgccctgccgcgtcgcgtcgtcgtcacatcgccgcgtcgagccccgcgccgcgccaccccgccgacgccatgaggccgctgcccctctcccctcttccccattatctctctcccccctcccttatataagcccccctactcccactcttccccttcatcctcacctcctcgcctctacccacgccaccacgccgccgcctccacgccgctgcgccgtcgcatagagccgccgcgccgccgccacgaagccgccgcgccgcgccgcaccttgcgccgacgtcgccaccgtcgccgtcgccgccgtcgccgccaccgccgtcggtaagctgccgcctccaccacttgctcggccgccgtcgccgccccgggtagcagagagccgagagagagagagagagagagagagagagagaaaccgagggagagaaagaagaaggaaggaggagagaaaccgggagggagagggagaaggaaaaagaaaagaaaagggagagagagaaggaaaaagaaaagaaaagagagagagaaaaaaaataaaaagaaaggaaggaaaaagaaaaagaagggaagaaaaagaaaagggaaatagataggaaattagagggagattagggaagtttagaaaatttaaaataattagcatttagttatagactagttatagacgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgattcacggtagaaattcggatttaatcactaggaattttagacgtatattatatttagtcgtttaatcctagactaaaatttaatcgtataatattataagataattttaggattccgtccgatatttagcttgtgatagaaatttccaacctattatatggatataatgctcgggtagattaaattaaaaacttatgataacaaaatatttatacccgcaaaatagtttaggatataaaaatcgaaattgggtttgccctagttcgcgaatagtaaagttaatataaaagaatcgacttacgcgttcgacttccatttggatttatttggatttttatttgaattctaaccgaattcaaatcaattttcgcacataactatagagcccgagggagttgcggatccaagtgaaggccaagacccgcaagactttgagcaaggcaagtcatcactattccttgaacatgttgatcccaattgcgaaattgttttgtttacaaataaaattgcatgcaatgatgaacatcctacttgtgattatgccatgccttgattattgtttgccccttattccttcgtaaccatgtttacgtatgagtccctagtcaattatgacaattgcttagaaatgctattctagaatcatgcatactcatatttatcaaatgatgcttgggcaattacttttgggaaggtaattgagatgcggcatgtggagacatgagcgccacattgccatgatgttgatgacatgatttgtgaaaggagaaataaaattaaacaattgttttcgactggggcggacggaggatttgggtggtatttgggaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctaagtgaggcaggtgcgctacgatgggatagccgttgaggtagggccgagaggcgtgccctacatcggtgtcgccattggtaggactgccatgagtgtgagagagagagaacttaacttgaaccataatttaatatgtgtgagacttctctttcccgggagcgccagaactcctcacactgctagaaacatggacgcctagagtgcatgaggatttaagttcatggagcggatactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcgggaatatggacgtcctcagaaaaccataacgactcaatggcgggaagctatccttgggatcaaaatggatggtggacagaaccgtcattgtttaatatgaacactggtattaaaacttgatcagtctatgctaggtcttaggcttgtgaaaagaattacaaaacttgctttgtgcaaaagaaccatagccatcctttgaattcctttgtcatgtgcatcattgctgtggtggcttgctgagtacggttggtactcacccttgcaaatataatcagaagcgggagatgaagcttcggaggatccctatgcctactaccaggagggagatgaagacgatggcgctcagtaggtcttagttacggtcgttgcctgtggcaatggtgtgccgctgccttaactccgctgccttacctacttctgtttttggaatgtattccggaccgctcagtccgatgatttaagactgtgcatgcgggcttatgatgtaataattcgtactagactctcgtgtatgtgcacttgatatttcagctatgagttcgtgtgtaccagactacttgatccaaggaaatggtactgtttacacgattgattcctgttataaaaacgggggtccacagttttcctaggagagaagacgagggagtcacccgcggcgctccgacgatcgccggcggtgattcgtggcggaagggatggccttcgggagttgggagagtgctcctcggcgcgcgagagagtttttgatcaggggagggaggaagcccatggttttcggcccgatccaatagtgagggagagagaggtggaggggcaacacgtgtcgagatccaacgatggcgattttggggatcggtcgaacacctttgagtcgactctcctgactccgtttctacaccacctgtggggagctagtctcgaggagctagggttccaggacaggtggaggagattggagaagagggagacgcaaggggaggtgagagaagtggaggagtggccaagggtaggcggtggtgggcggcggcgagagtggacggtgagcgttcgaggggacggccggagtttcgcgaaggtggtaagaagcggctctccaatggcaaatcaaggcggaggatggaggccgcgtccacctttcaggccgcctaatcgattctggaggggagacgcagggggaaggggacatatccgccctttgcagattgggcgataggagccacaaggtccacatccgccacctccagatctaaatcgaggagtagaggatgggaaggcaaagcatgaggaaattctgcaagttgctgaggagaaggggaagcaggggaaggacacgctgaaaactgaagggaggaaggaagcgggtccaaatttgcaggaaacaagtgctaagatggattctatcagttcaggattggaagcaaagccaaattagcaacaaaatcgagatgagtccaaacattaggttggtgaatcccattcccagcagaggattttctgttctaaatgcaggagttacagtcatttgtctagagattgcaaattgtcagtgttctgtatgatctgtgcaaaagagactcataggacagaggattgctttaggaagaatcagaagaaacctgtagctaaagtagtgggatgtgctgccccaggtctggctgtgtgctgattcagagtgctaagggtatagtgcaaaaagaacatgttaaccctttggctattgtgacaattatgtgggtaggtgatcttactgagcaggctttggaggaaggattcactcaacacttcaagtggaactggacttggaaggccaggatgcaggagaaagggttgttccatatgagattcctaaataagatgaaattggatgagttagctgaatttgactcaattagagtaaaaggaacatctgtacatgtgaaagtgaagaaatggactcaagaagctgaggcagtggggaggttacatgaagtgtgggtgactgtggagggggtacctgatgaaatgaaggattacgaccctctacatgaagtgggttctaatctaggacctgtgatagaagtggatatggtagctttaaagacaaaggatgtggttagaattagagtaggaatgatgacattaaaaagcttgcctctgaccatgactctgatgacacctaagttgctggtttacaaagctcatttcaagttggagcagattgtggagttgggatggtttagagattgtgcacaggaaaagagagttgtggaggtggaggagcaaaatgaacctggcaacataaatcacatgcagaggaataagaaaccaagaaaagaagaagctgcatcaaacatgagagttttggaaaaggcaggggacaagaagaaagccatagttgtggaagaggattcagacaatgaaagtgctcaagcagaattggtgaagctcaaacagatggagatagatagggagatggctctgagagtacaactagaagaacattttaaagtcaagcagattcaacttgataaagatgtagcaggagggatgatagagggtggaatcagagaagaagcacaggctggggaggaggaaaatgagaaaacaaagaagacacaagaagggatggcagataaaagtggtactagccagagagtggaaaatgacagtgaggaggtgatttatgatgaagatgaaccaagagtgcaactggtggggagtgaggagaacatggaatcacaagaatcaagtgactttgctgtagcggtgggagttgttctgtctcaaactaatgaagacatgacagaggagaagaggaagaaaagtctaagacttttggagaaggaagaaaaaggtggccgatgttgcagctgaaaggaaagaggctcttaatgctttcatcaacaaaggtaacaaacaaatcccatctatagttgatgaaagtaatttctctctagctcaaatggctagtctgttaggtgttaatttaggatgtgctctagaagctgcggatacaaatctgaacctaatcaaaaatctggaattggctaggataaatctgttcttgaaagagaaactaaatacttctcagaaaggggagtgtcaaaatgttggggagaacttgagtgacataaacataaatatagatgaagtcttacattcagatgattgtatgtctgattttgattatgctgaaaacatgttgaggctttctcaaagcaattcatcaggtaaaaagaggaggaaaaataacagaggaaaccttgagattttcaaggtcactcctaaatgtagtggcataaatgagaagaaaaaaacaaaaaagaaatcatgaaaggtttattttggaatataagaggtatgggtgatcatgataaaataaagcatctcaatgatttaataaaagagcataaagttgatttcattggcatccaagaaactgtgaagcaggatttcactgctaaagacttggatttaataggaggagggggtaagtttagttggaattggaccattcccaagggtagatctgggggtatgttggtgggaataaatgaagacaaaatggaaattatggaagtttccaagaagaattttttgttgcatgttaaagtaaaaaatagaaatgacaaatttgtgtggagattaataactgtgtatggggctgcccagcctgaacacaaggaggagttcttgagggagttagctcaggattgttatgggtgtgatgaacccctgttaattggtgtggattttaacatcctgagacaagagaatgaaaaaaacaagaggggaggggtgaataaatggagtcttatgttcaattctataattgagaatgcaaacttgagagagatggccttggaagggaaaaaattcacttgggctaataacaaacaaagtgtaactcttgaaaaattggacagaattctttttaatgataaatgggagattaagttccctttggcatgtggaagggtcttagagagaatttactctgaccacactcctcttttgatcaatgttgagggagaaaagtggctatctcctctgtttaaatttgagaatagttggctcatgagagaagatattaatactgtggttgagcaagtatggaattctt

SEQ ID NO: 68290 - DNA, 5529 bp, Oryza sativa
aaccgagccgccgccctctcctctcctctgtgggcgcgcgtgccaccgccatcgcacgccatgggcgccaccgctaccgcggtttcgccgagccaccatgtcggaggtgagcacgcaggggcaccctcccctcgggcgcagccggcgacacctccccccgcgtgcaccaagctcgccgatgcctccccccgcgcccgccgccgccctcttcgccccacaactccggcgctggcccccacgtgtccgttgtcggcaacccctccccctgggcgcggtcggttcaagctcgccctgccgccatcgagctcgcgcccgccctgctcgtggcatcgccgtcctttttttctttccgccgcacaccgccgatctctggccactcgtcgccacgggggcggcaacgtgaccagctgcctcccaaggccgaccgcgaacgcctccttgccgaggaggtactctacctccactccctctggttctgcgccgcccttgctcccgcatcaaccggcggaggcacgagagagaaaaaaaaggaagaagggagaaaaaaataaaattattacatgtcatcgtccatgtggcatgccatgtaggcaagaccacggtcaaacgcggctttggtactggatgatacaataaaccaagtttagagacttcgatgtgcgctttgcaagttcgtagacctaagtgaaacctcctggaaagtttaaagaccgttggtgcattttacttataaataaattacaataaaaacataacaatcaagtttaaaattagataaattttagctgcggctgacaacacgatgaccaaacaaaagagctggtgaggaagtttgaggaatcctgctatctagattttataaagaaggccaaaagaggcacattagtgcttttgtcagtacatcacatgaactcactgagtcactgggtggtttgttgcattgatcatctttataacttgataaagcaataagttaagcaagcattgttcatctttacaacatcaccctttttggatcaccacattccagctctcctgcttttgttatttacactaaagcaaaggatgatcaaagaagcaaacaattcagttttttttttttggaaaagcaagaaacttccttacttgtaagcattgcaatgccactgaaaagtaccagcagtttatggatgctaatgccatcactaatcatccaccagaagcaaatgcaatctactcctactcccccagaaaacaaacaacagagagccaggacagaaaggggcagctcctatctggccagcttttatttagctgttcttcttttggatttactatctttttattttctccagatgaaagcctgaaaacagtagtgagccctctctgtcctctactcaatcctcatcaacagctgccacccatgatttcattatctttttactttccccacattttatatagccactctcctccttaactcccctcctactctcctccattccttcactgccttcacttccctgctcagctcagcagctcaggtcagtctcctcagcattgtttcagctgcaatgccatgctcagaatctcttctcttaattttttggtttccatgagttccagtatgatgtttcatgggttggtcgtcttggaggcagccatttgtttagggcgcatttggatctgttcctcgcagttcttggcccgaggaaagaacagatctttgcgcctctcttgagcttggcgtctcttcttggtgctctgcgtttatgttccttcaggttgaagggaaatgctaatgcaaagcttagcacttaactgttcttggctcccaaattccagagatttggatgcttccagtggtgctgagatctgcaggatgtagtagtaggagtactgtttttgttcttgtgttagattatgtggtctcctgatttggttggtggcacctaacagttgaagtagtagtataatgcagttgtcaattcggactagatcgagtcttgaaagtgccccatcttgtgcatttgtctctcttggtgacagggaaagggccattaatttgtgctaaatttcagtaatctgaaaactctgctctaggagctagaaagatctgaacaataatgagcctggttaaaattctcaatgttcagaattaccacgaactgtagtaatctgaagcacaagaagttggttttctggcatttcagaatacagaacaacattacagatctcttgtatgttgatttgaacttaagtactctactaaatgtgttcagtaaacactgtagaattcacaagattaagagtaattctattcagcagttacagacttgtgctccagaaacgcatgacaaaaaaaattcagtgctgaatgcttcacttcactgttcttgcgtgacatcagggacttcgaggatgatggaatccaaagcagccatgatggtgaccatcctgctctgctgctcctccatctcaccggcgttcgcgcagaagcacaagggtccgcccgccgcggcggccgtgagcctcccgccgtcgccggcgccgtccccggcggcgccgcgccacgtggacctcgccgacctcctgagcgtggcgggtccgttccacacgttcctcgacctcctggagaagacggacgtgctcaggacgttccagagccaggcgaacggcagcaaggacgggatcacggtgttcgtccccaaggacgcggcgttcgcgtcgctggcgaggtcggcgacggcgaacctcacctccgaccagctcaagtcgctggcgctgtaccacgcgctgccgaggtactactccctcgccgagttcaacaggctgggcggcgcggccagcccggtgcccacgctcgccggcggcgagtacacggtcaacgtcaccgacgacatgggcaccgtccatgtcgggtcgatgtggtccaaccccaagatcagcagcagcgtctactccacccgccccgtcgccgtctacgaggtggacagggtgctcctcccgatgcagatcttcaggaccgacccgcccatggcgccgtcgccggcgccggcgccggacgccaagccggcctccgacgccgccagcccgctccccgggaagtcgtcaagcgccaaggcgaaggcggacgagaagaagagctcgtcgtcgccgccgtcgtcgcgccgcggcgccggcattgccggctacttcttggctcttgctgcatctgcctcagctggattgctgctcctgtgttgatgctaagaaacttttctaattcttttttttttttgcatggattgttggttgctggataattttattctttggacatagtaggggcattgtgttaggattaagttttatgggagtatttccgtcatatgcttgtatgattagtcgatgattacttgtttatccgatgcatgttgcgaattgcacaaggtattttatagggttaatttgatccatgccactctaaatatggcaaataaaaaaataccactactattcgcgttattggctaagtgccactgaaaatttttaaaattggatccatgccactcccgccacttttaccatcctccttcctcacgtcagcatcctcaccgtcaccagcagcagcagtggaagtagcagcgggagcgggagtagcggtggcggtggcatggtgcacgcgaggcgcgggaggagaagtagcggcggccctcgccgaccggagctggaggaggagacagggatcgggaggagcggcggcggcgcttgagctaaaggaggagatggggatcgaggggagcagtagcggcgacagccctcgtcggtggggttggcggcgacggagctggaggaggagacggggattgggaggagcagcggcggaagcccatcatccgcggtgccgtcggtgtggaacctagtgctcgccggaagcccatcctcctcgctgcggttgtggggtgtggaaggtggtgcaaagggctgcgaggtcggggcaacgtcctacacggagccccctcgtcccatgggcgttcggcgcgcgacctcgtcggcggcaaccacggtgaggttggcggcgtgagagaggaggacggaaataatgacgggagtggcatgattttaattttaaaaattttcagtggcacccagtcgataacacgaatagtagtggcatttttttatttaccacatttgtagtggcatggattaaattaaccctattttatactgcatcggcagtgatatgcatgctcatgatctgtagaaacaaaccggcggctaaaaacgaaaactgttttgttttaagataatatatatgattttctattaaagttggttaattatatatcgagatgatataactacggtgcacactcgcggtcccttagtaaaaacaaaaacaaaaactaatggtcgggtggccgacggctagggctagtcttcctgcgcatcttcgtaaggtttcgactctctaatcctcatggtttactgtagctttggaaagagcggaacgttagggttttcgattctttcgtttcaccagggtttttgattcttccgtttcatcggtctcgatagttctggggtccatccgcttcattggggacctatttggagattaggaagctcctcctcctccgccaccccctcccgctagatagaagcaacagcttttagtttttactcttttttgggttcgaaatcctttccttgtaactggcaacgaccagtctggtcggctgcattgtgtaacaacaactctattttcttctaatatactgatgtgtaatatctattttgcgcgtttgcgaaaaaaaaactattggtgtgtggttaaacgtaggccccttgaaacgttttgacagtgcgaatgctaattaatattaatgaaaattgtttggcgattcaagaatattctcagggggggtaaaaacgctacagacaaggaacacattttcatctttgagccaaaacctggctacttatcagttcaccgccggagcatggctgatatcttcggtggccgccggcggcggcgaggctgaggccggcgcagtgtgattagtgggccaacgttggatcagccaatggcccggcccagataccacaagattagccatcaattagcaaaccgttggttgtttggcagataaagtttattttagatccctcagctaagcatcgagtttaaattgtgttcgttaatcataaaaccggatataaaacatcccttatcttttaaaactaattattagaagagagacctaaagtgaacatttttcttgttcagcggcctatttgtctaaccataattttccaagctgggcctttgctcgaaaggccgaaacagtgatgaatggagtggtaagagaagtactagcggtagaggccaaagcggttggtcggatgacacgtcacctctcgtgctaagttggttaactttggttattactcgcaccgattaggcgaagagtgcattgcaaatttaaaatgcttatgtaagtactccctctgtccacaactacaggggataaatgaccctttggtttgtccaatattataagg

SEQ ID NO: 68291 - DNA, 1223 bp, Oryza sativa
attctcaacatcgcccgattgatttatcatctatgttgatgtcgattctcctccactttatttttattctctgcaaaaggttagtgaacctaatactagtggaatattattattctaacatgtatatgcattgcaagcatcactagttctcctctattttggctatattgatggtcgaaacttatcgataacgaccgtcaacaggcttgaaagagaatacgtcccacatggtagagctggaagaacccttgtggctgcgattggaatggatatcccttgaagaatttatcacgataacactattccatatgattatgcgaaagtgcagttgcaagtggtgaacaaagggttagagtcatacgatctggacatccaaactcctgatggcatatccgtacttggggatgcggttgacattatagtattgtagcacataaagatatactctttgggactggcaacaatgctctgtcgaaaccactgagacctcctcaaaaacaactatcgaatgataaggtggaagaacatgagcaacctaagagcactgaagtggcatctacatcagcaatattgtcaattatgccagcaatagaaccgaaatcgaagtcgcaacaggtttggaatgggtcgaaatagaaccagatgtgtatgaggatccatctcctgcaaaagacaacgtggacgcaccctcggtcgatgactatgtcatcgacaagtccgaagtgcctaaactggtcaaaagccacaactccaagtccaaggataatcagaaggtgaagtggatggtaaccgccttctgaggtggtaaaaaacgtgccaaggaaagagatgttgatgagaagaagaccggtgaacttgccggcccaaaatactttggaacagatgattgtctggcagtgtttgaaaatggcaaagccttttggctggattatgcacttgaagaaggtccgtgggagatgagaagattacataaatggtacacggacgccaacaagaaaggcctaatgtcattagctgtttgaacatcacctgatgctttcatggccgaggaaggtttcttgtggctcaatttcgctgatcttcacgccgtctgtcggtgacatgggatcaggagtatcatgactagaggtttgaggcagacacaatcgcacacgtggcctggcacccccgagggacgtcgggcccgaaggtgatgtgttcgccctcctcttagtccccccgag

SEQ ID NO: 68292 - DNA, 1393 bp, Oryza sativa
cttttaattttattatgtttattttgaattttagttagttttaaattcctatatagactatgtactctacttctaatattccttattttttaattctgaatttctatttttttttcttaattgtatttctatatggactctatactctacttctaacattccttatttttaattccgaatttgtattatttcctaattgtatttctatatggactttatagtatacttctaatattccttatttttaattccgaatttcagttatttcctaattgtatttctatatggactctagtctcctcttctaatattccttattttttaattccgaatttcaactatttctaaattgtatttctatatggactctagtctcctcttctaatattccttattttttaattccgaatttcagctatttctaaattgtatttttatatggactctgccttttctttttctccgattaatgtgagaatttctagaccatgagagcgaatgtggaggcttctttttctattcctttaataatataactagctgggtggcccgcgcaattgcgcggctagcacccaaacaaaatcatatatttttttagtatgattttacttaaaatttattaatagctatctcattgtcttaagactttgaaagactaaaccttatcatccttgtgtttctaattatatattttttaaaagtcacaccagttgctaccccttatatcatctccttctttatttgcttgcttgatctaccactatttttattcattcttcttggaacctttaaaaattggattttgtagtttttagagtttattgtcatgttgggttttatttttataatttctagatgtcccgtcaaacgttgccattatactcctctacgggccatccattgtctctaccctttattgttattgagattttaaaaatcgaacataattatcgtttgggttcatttttactttctagaagtcctgccaaaccgtcagtagctttgccattgtcctcctctacggctcgcctgctgcctaccttctttattgtcattgagattttaaaatcgaacataactatcgttggaattcattctttattgtcattgagattttaaaatcgaacataacttatagtttcattttttataatttttagaagtcctatcaaacgatgccactatgcccctctacagcatgttcgccacctacttctttattgtcattgtgattctaaaaatcgaacataactatcgttggaattcattttttattttctagaagtcccgtcaaccgtcggtggctctgcaactatactcttatacaccccgctcgctgcttctcctttttattatcattgagattttaaaaatcgaatacgattatcaatac

SEQ ID NO: 68293 - DNA, 1123 bp, Oryza sativa
atgactctaaccctttgttcaccacttgcaactgcactttcgcataatcatatggaatagtgttatcgtgataaattcttcaagggatatccattccaatcgcagccacaagggttcttccagctctaccatgtgggacgtattctctttcaagcctgttgacggtcgttatcgataagtttcgaccatcaatatagccaaaatagaggagaactagtgatgcttgcaatgcatatacatgttagaataataatattccactagtattaggttcactaaccttttgcagagaataaaaataaagtggaggagaatcgacatcaacatagatgataaatcaatcgggcgatgttgagaatcagacttatgtatgaatgggccaagaacttagaattgacacgacaaactgggccaaaattcacaagtttgcatagaagaacaacggaggaggccgctagccgaaattgggctggattgggccggccctagatttggccgaaccagggggttaggccgaaccctcatcagcgccatctgatccagggcttcgcctggacggtgtggattatcccccaatgacggttggagggtatttctgaccattccaaccatcacaatcgtcattgggaggctataaaaggagttgctcttctcacttcactcacacacctcaagcaatagctctctcatattctctcaagtttagtttagtagtatctagctagtggaataagaatagagtagaaatcaggagtccggaagccttcggaagagttcgggtatgactctagtagctttcctttcctcttttgtaagctttgtacttttattagaatactcttctttatacatttatggtattgaaatactttccgagtatatgaatgcctactttatattatgttcatgttatactgaatatactgctgcttatctgggagatgctttggtgcaggtataatgtttgtgtatgcaattactctatgtcatgacgatgatattagagtagtatctggtagtttagacgtggtgtctagattacaggatatcattatttggggttatatgctgcggatgagaggtgggccgctgatggcaatagctcagtacgggtattcctccg

SEQ ID NO: 68294 - DNA, 10473 bp, Oryza sativa
aagcggcggagggtgcgcgcggcgaggcggcccgcgcagccgccggcgacgtggatcgaggcggtgggcacgctggcggagacgctgcggttcacctactcggagacgctcgggaaatggcccatcggggacctcgcgttcgggatcaagtacctcatgcgccgccaggtgagtgcgtcctcggattcgttaatcggccttctggtctgcttgctctgctcgaatctgagaggaacgcggcggattgtagctggctggctggttggctgcacctgcaagtttttgtgttttggatctgaaatggcagctcttgtcttgtgttggagctgcacctccgaagtcgaggtgctcgcgttgctgataggaggcatgcttggggtcgagctgtaggaacttgttcgcttagatggcaagtagtagaaaattcgcgtgtaaaaccggcgaattcagctctgattgttctctatacacataggagtttgggaatttgtgtgcccggagctggtgtgttttgtactgggctgagcatagttctatgtagtagctgttatgttgatggttgggaatggtttggtgttttgggtgaatcctctctttggcaagcccacggcagggagcgttgcaactgtgcactacccgtatctcaagctgcttaatgcttatcaccaaatagatgaatgtgcaatgttgagtagagtattagaatagcatgtattttcataagaataggattagtaattcatctggatgatttcactgaagagatggttgctgacttgctgtgagatgaacctttcgttctgaggggacgaagaattgaattgttagtcacgtaactcagcaaaggaaattggagcttatggactattccttttcatgtgcaaacattgattattgtgtgcaagtttgttatcatcacgtagatcataaaagcatttggtgtctgtggaactgatggcacattttcttgtttgggttacttttcagggaaatttacatgtcgctagtgtatatgctggaaacaattgcattgaactgaaagggcctgaaataatggaagagcttattgttctgagacgattaatcgatctttgctttcttttttctaagaaaccatttccggtcttcctggaattagctggattttccccagaggatgttcttattgaggaacctaaagcgggggtgagttaagtacaaagtagcagttattttctcttcatgtattgaagtacaatcagttataatttagactaaaaaggatcacttggtatttttctcaattcctgattcacaacatatacttacagattttaaagcctgcccatacaatcctgcgtgatgaatgcaccaaatccttccttgtgttgattcgtgggacacatagtatgaaagacacattgactgcagctactggtgctgtagtaccatttcaccactcacttttagatgaaggtggtgtcagcaagttagtgctgggatatgcacactgtgggatggttgcagcagcccgctggattgcaagaagtataacaccatgtctctgtcaagcagtcagtcaatgcccagactaccaaatcagggtacacacttctttttcgttcgtttatggtttcagaactagttgacgatacctatgtttgccctgtgaaattagctgatgatgatttttcatttgtttttaacaaacctatttaatctgtgctggtgacaaaatgctctcgaaacaaaatatgtacatatcattgtatcaatttaccatcagcatcaatttgaacctggtgatccatgtcaattttcattttttctctctttatcagacatatatttgtaggtcaataaaaaattatgaaattgaaattgttcttatacttactaggatatgttatgaaatatggttgactagaaacttgaaattgtcatgttgtgtcacaaaatggtgataataagttctgaactagttgttttaataatagttgattttattctgttaggttgttggccattcattgggtggtggtactgctgcattactgacctacatcctgagagaacaccaggagttgtcttcaacaacttgtgttgcctttgctccaggtataaaaacatagtttgatatgcattagattgacctgagcaattagtaacagttaatttttttggtcagcttcatgcatgacatgggagttagcagaatcaggcaagcattttgtgaggactattgtaaacggtgctgatctggttcctacagtatcaacttcatctatagatgatctccgttcagaggtagctccatttgatgtgctattcttcccatagatgataactgtgctaatgtgtttccaaatatagttctattgttttgagggagaaaatgatccgtttgttatatttatgtaacatgattatttttgttgtccatttaaatgaactgagtctgtaaacatggatagaatatgatgccatgatatcctttctcaaaatttagtagcagtgaagttcactgtctctaatcctcccgtcttatcccctcatctaggtaacggcatcttcatggttaaatgatttgagggatcagatacagcagacacgcttcctaaatgttgtttaccggtctgctactgctttaggaactcgcctgcaatcattttctggtgccagagatagggttgcaggtgctggtgcactgctacgacctgtttcaagcaaaactcaggtaaaatatctgaaccaaaatctgtcaaaaatgtaatatttacatgaattaatattgtgtaccacaaaatgagatagggcggtttgaaataaactaaaagtgctcaaggataacactgaaacagtcggtgcatgaaatatgcctggtctgtctaataaacatttagagatttctatctgccaaatccaaatagttgtttcaatgttgttgatgaatattttgttgcaggttgtgatgaaacaggcacagaatgttgcgcaggctgttgctagaagtagatcagcattttcttcatggtcatgcatgggtgcacgccgtcgaggtgttggtgtagttgctgcaagcgctaaagaggaaataacagtggaaacccacgtcacatctaccactaattcagagtcctatgttgtagaacaacgtggcaccaagaccatggaggagctgcagtacactgcagatagtgtttcagttcatgaggaaacagaagaagaggcccttctgagtgagcatgaatcctctagggagcatgcagaagaagaaataactgaaggtgagatgtggtttcagtacgagaaggacctggatcggcaggctgaagtggaggctcagaccaggcaggaagaagcagctgctgccaaggaaataatggaggaggaaagtgctgttctaaaaaatgttgaggataggcaatccttttcatctgatagtttggagaggcagcagttctaccctcctggtagaatcatgcacatggttgccatgcctcctgcagattcttgccctgatgatccggttgctgctgatgagtgcagtgtgggaatatacgagaccccaagggatctttacagtaaaatccgtctatccaacaccatgatcaatgaccattacatgccgatgtataagaaaacaatggaaatattgattgagaagtttgcgaacaatgatgaaaatttctgtacagactcgacagtagaataatatggatgacttgtaacatcgaagtgtatagtagttctttctgtttagctttaaccacctgatatgctcctgatatgcaatatagaaaagagatgctgtcctgaattacaatatagaagagatgctgtcctgaattagttaagagagttgtggatgatatgatatgtaaaatgtaaatgaaaaatagaattaatggatgtttattaacggaaaatattcctcatacatggtgtttctctgtttagacccacatgcgttttgtaatgtcagaacatagggctgattagccgcacgtaaaacatgattaatataatgtgctaacgaaaaataaggaactagccaaagccaaaacacagtttagaacagccctctagtgtactatacttggagtctcagttttttaaaaaaacgatgtctcaatttagcaaatactgaccacattattactacacgctactcaagatggtgattcccattttaccgctggtatttcctatttttccttttaagacttaacatatgcagttagaaacttctagaatacatgtttaagggaaatatccttataaaaacctttgtaaaaaccgagcatatttttttaaaaaaattcatgaagaaaataatagatatatataatgtatatacctaacctcattaaccttccccttttttcttctctcacgagctatcgttccttaaagaaaagggtgaaaatatacttcatacctatggtaattgtttcatgaattacttcatatatctatactgtctatagtaatttttttgacgaatttatatcccctttcatgtttaacctaactagggacattttagtaaatttttaaaggtcaaaagtgtcaaaatcctcggttcagaaactggcccgtttaatatgagaaaaaacctttcaccatcatacttatatcgttttaacgttgcaggttggctctgtcgtgtaggccccggttgcccgaggggcacagggccttccaaaaattggcgcgcgagcccgcccaaagtagggacgggacatcgctcgcaccatggcaaagcgtgttcggtttgtgggtgtcggcgcgacacgtcagtctctaaacgatcatcaacgagtcgcctgatcaccccccgcagggacgggttgaatccaaacagaggcccccccgagccttttatagcctccggccgccccgctcccctcctcatctcacgaggtggtactaaaatccaaccagccgtcatctcgtcccgtgctcgtgggcttcagagtaagaaatttgcccagtgggttgggcttggtccactaataattttaggaatgagttcactggaggtccctcaacttaacagcgagattttttttaggtctctcaaccacaaaacaagatagatatgttcacctctaaactcattcaaaccgttcaccggaggtcccttggcagtatttttgcccggttttgctgacgtggcatcctagtcagaaaaaaaataaaaaaattctatggggcccacttgtcagcttcacgcatctttttttctctctcttcacttttcttctcctcttcacttttctcttcaccgacggagcgcgcggtggacgagcgcggcagtggagcggcggccagctgcgggcggagccggcggcgggcgagcgcgacggcgggcagagcatcggtgggcgggctgcgggtggagcggacggcgaacgagcacggagccacggcccacgggtcacgagaggttcggctgccggcggcgccggccagcgacgcaaaagaaagggagggcgtcgtcggcggcgggaggtggccggaggaggaggtcgccggcgagcgcgctcctgctcctgctcctgctctggctgctaccgcgcaggcgcggcggcggtggcgccgatgtggccaggaggtatcgccgatgcaggggctcgtcgttggtcgtcgtcacgggaggtatcgccatgcgctggggatgtcaaaatgcagagagttcgcgtcttcgaagacggccatgagctcggcttctcccagcacatgcccctcgatggcgtccatcagcttgtccttgatcacatgtaagcaatcaagaatcaatcacagttaattaatccttaaacagcaaagataatcgctaaaagattgttctgtcgacttgtcttgttgccgaggtgcacctcgtcgtcgagggcgtagagcttgaactggatccggaggccgcaggagggagggatgacgatgacgccggctgcaccgccgaggccgcgtcctgcgccagggccggcgccaccgcacagccacgctcgcgccgagccgccgccagccgcgccccgacgcatcggcgccgccgtcgctcggtcgagctcggctgcatcggcgccaccgccgctgcgcctgcgcggtagtagctagagcaggagcaggagcgcgctcgccggcgacctcctcctctgcccgccgtcgcgctcgcccgccgcccgctccgcccgcagctggccgccactccactgccgcgcttgcccaccgccgctccaccggtgaagagaaaagtgaagaggagaagaagaaaagtgaagaggagaaaaaaagatgtgtgaaactgacatgtgggccccacggaatttttttatttttttttgctgactaggatgccacgtcagtaaaaccgggcaaaaatagacctccggtgaacggtttgaataagtttagggacgaacatttctggttttgtggttgagggacctcaaaaaatctcactattaagttgagggacctccggtgaacttattccataattttactaactaagtttgagcccaatagacttagcttggcccattgttagctttataccgatttagtttgagtcatttcctcctgcaaagaggtaaagcgatgaagaaataacatttgggggaaaatggcttcatattcagtataattcccacaataatagaagattgtaaatgaaccttattcaaaataatcacgaaagaatacatcattattgataatggtggtgcctgatgcggctacaaggtgaagacaccagtttcaacataactgcctttcttttgcaagtgcagtgcgaaagaataaagtgaacggcaacattccttgcctaagaaattattttttattccctttgtgatgggcgaactaacactgcccgattctctctttgcttttcttctcttaagttttaactatttccacaagacatatatacatctatacaattgtaaaaaccctgtatgtaacatgtacagcctaaaaaaagatcctatgggaaaactataccaaacaagaagctaatgctactaaaatgtagttaaaaaaatttgggagaagctaatggaaaacttgcggggacgtataatattcgctttcgccgaagaatggtctcaagtcctcttggcacatgaactccaaagggaaggaaacgagatggcccctaacggcctgtaatttttccataggatcggtgcctgccagatccccatccttgtgagtttctgttatctctacagcaacacccaggtcaatggttgtgtggccgattttctccttccggtgagcaaatccttgcctaaattgggacctgcaagaggtcaaaatagttttaaataccagaggacatgatactgcagctgaaatgcaagcaacctggaaaacaggttatttgttccatacctagaatggatgtgatcattgggaacacacgagaagacattttggtatatcttggtgtttgcctgccatacaatatcaatttgttcagttagagaatgaggtaaatgtgttcacagcggtataaacagaaaatgcagtggaaaattatcagctgctgaaagatggcaaaagttgagtagaaaacagtgcaatgccagaacccagaacagtcatattcaaaagtttccaggttgagcagactagcatttcacgataaatctcaatttcactcaccttagcagtgcccatccagatgttgttataagtcaaatcgtccacaggatccataatttgactaacctgttaaggagaagtgtcagcagaaagaaaactcacaaaaatctatgttgtacatgcagcatcaataccgtaatgtattgtgaaaacaatataaatgcttctgtcaatattctttatatggaaccattcatcaagtggagtttacacaggacgttcttctactgtggttcactgaagcaatcacaacatgaaaggtttgtgacacccaccctgaggcctaaactttcaagtttcaaataaggaaaaatagaatgcaaaaattttccagttttcttattcacaaagaaaacaggtgcacacaggctacactttacacattaacagggcatggaaccctgacatctaggaaaagatgacaaggtagatgttttccagtacaattataccaggtaaaaggatgtaagtggtgccatagtcagttatcttaatcttgacataatcagctaaaagtctatatatgtatggtggctttaaacttaaaagagttggtttgtgattcaagcaagtgaaacattgtacaaacctctcctggatgaaggccaaggtgttctgcccatagagaaagtcgtaggctaagagagaacttccctgcttcccaatgtcttccatccataattgaactgacaacctctttatcttcaataatcataccaatctaaaagagaataaaaacagatcgataatactggttatcttcaataatcataccaatctaaaagagaataaaaacagaccgataatagagtcaacagcagacacacaaatgacctccggatgccactaacaagatgtaagcatgccatttagtcttgaccggatgcagttggcaaagaaagaaaaaatatattccctaggctaggccctcctttaaaatattaattcgagaacacaacaattaatttatctgtatgtctgcaagcaattttcatatactcttaatatataaaaatcatacgtgtgcatctgtcctgaaaattgcttccgtaatgtataacttcaattgatattcagaaatacattatgatttttcaagaaaaagaaatacattatgataggaacgctgtcaaagctgtatttggaacaccgtcaaagctgtatttggaagactgtcaatgttaagatgacatgcatttgtgactggagggcgtgcaaccttaggagcagtcctctgtttaacctaataatgttggggcctgtttggagcacacaggaatggaatatctctgtgttccctatggggccttagcatgcagagaattagacaaaagaggcaactgagaaagccatacctcagaatcccttgatccaagcaaacttctgtcatttatgttagctgatccaatcagtgtcatccggtcatcaatgatcatcaacttactgtgcacatatatctgcaaaattcagactgttagcaaaagaaggaaaagaaagaaactaacattatactaatcttaatccatgacctaggaaggtaacaggacaatattaaacaaatagagtggaaaattaattcaggcctctctacctgattggtgaccaaaggaccaccatcacctagtctgccgtgtgccctgagcccataaaaggagatataatcatgggctttggaaccaaccacatcataaagattcttaagtattgaattaggccctctacaaatggtcctgtattgccagtgcataattgctctaacagatgctgctccaccgtcatcaatgcctccctgtaattaaacatgtaattaaccggccaacacgaagcatcaaaaccatcaataattgttacaacagaacatacctgaaatccaggtaaaagcggtatgacaattataacccggaagcaccttttctccttttctgctctaagtatacgcctgtataatgcttctaatacacggttttttattgtgtcatctcctgaaagacctgatatgaaaaactgattctgcatagaccagtaaaatgaagcttagagtttagaccaagtgaaatgaatctgtattgtatcatctaggtatgaaatttcaatacttccaaatatacaaattttcttggagtttgtggattacatttgaaaatcaagagattaaaaaaggttcagcacctcaatgtacacaaaatgttctgctttttcgatgagagaaaaataggcattgtggatgctcccttcaatttgagttgttcctgctgaccacggaccaacacttcgaacaacctgagttaaaatttaaaatgtgtgtttgattagccacacatgtataatacagttgaaaataatttctatttgttttttagtgttactatacaagcaacattcctaaaaggacaataaaatcatgtctcaaatactccaatccaaagctccacctgtaaaaataaagatatacaaattccatgctttacaaattcagttttatctatcggtatgacatatttaagctagagcaagacatatcttcactccttataatatttcagttcgtggtagttatggttgcttgtacacccatccctcctctttagttggaagaaatgatagcaagaacccacgaggcaaatatagacagcgcaagagaggctacaataccaacactacctctggcttatgcataatactccctccgtattttaatgtatgacaccgttgactttttgacaaacgtttgacctttcgtcttattcaaaaaatttatgtaattatcatttatttcaatgcgacttgatttatcaccaaatgttctttaagtatgacata

SEQ ID NO: 68295 - DNA, 1823 bp, Oryza sativa
gcctctcgtcacagcgcccctcctcatctcggtgatgcctccctccgttcttcctcctcgccccatctcctccccctagcttacggtagtagctcgagtagactccccgtagctagccggcgccgccccgaccgttgccgtcgctcgccgcgtgctcgccgccatcgccgctcgagctccgtagcacccgcacgtcgccagcctcgctcggcgtagctccgtccaatccgacgctagtatcggattcccgtggtcgcgtggatgctctcaccgccgggaatcggtctctcgtgacctcgtcgccgtttccctcttctctcgccgccggttgccgccgccgcaatccgccgccgtcgagcaacctccgacgaatccgagccgttggctcgtctccccttgtcacgtgcaaccgcccggtgtgcacgcttttgcccgtatcaccgtggttcgcaccgccgctcgccaccgccgcccgccgtccattcgcagccgggtcgtcgtctacctcccgccggcccgcgtggcagccacgtaggcaccacgtcggcgccagctcagcctagaccggatcgagccgaccccggtcaatccctccccgtgcgcgcgttccaccgcgagccgtgaggctgcgcgtgggcccgccgcacctgcgtccaccgcggaccgcgcgcatgcaccgcgtcccttccccgcccgcgcgcgtgcgtcgcgtgctccctccgcccggtgagccgagccactgacaagcgggtcccacccgggaccgcgcatggtgagcccggtccaccggctctctctctcctccctcccgcgcgcgcgagtttgggccgccttgggccggccggcccatttagctcggccagaccgctccatttctcttaggccgcgccctagccgtccgagaaaagtctatattccctccctcccttcttttctttttcttttccaaaaaaggatttaaataaatcctttttcctttagaccaaaaatccaataatcttagaaattcaatatcttcccaccgtaaatccgattgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgagaatttcgaggatcaagctccggatctcgagcaaggccagccacctttgaacatcttgagcctctatttagaatttaattatattgcttccgaaatattatgcattgataggatcacacttaatctgttgtcccgtctgcaaggcagattggcagacctacctaatttgttacatttgatccttcctttgttaactgttataccatgtccccttgtaaccacccagttgcgcctcgatattcgtgcactctgtgcgagtatcgacggtcgccttcaaacttaaaatctgagtaacaacttgggtaaaactggagttttacaacagacttggaaaacccgacacctgggtcggtgcttgcgaactaaatgaatttccaaaaccgcggaccggcgaacataccgggtgtacggtttcccgctctcgcacttaaggaccgattcccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcg

SEQ ID NO: 68296 - DNA, 588 bp, Oryza sativa
accaattccgtagtcaataattacataccaagtctaattacaaataaagtaatattatattaaaactcaaataatattacatgctaagactaaaatagtaatgtaatgctaaagtgtctcgtgcgtatatgctaagtctaattaagactacaatagtcaattcctaggagtcgcaccaattacgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaaatccttctagggctagctcttccactcaggcttgacggacgaatccgacaacacgtcttttctgcaagataaaaaaaatgtattaggataaatgcgaagtaacatatatatatatatatatatatatacatatatatacatgtatatacatatatatacatgtatatatatatatacatgtatatatatatatatatatatatatattgcatttcacgttaacg

SEQ ID NO: 68297 - DNA, 1247 bp, Oryza sativa
aaatggtgcgcgtgacgaacggccggtcggaggcattgtaatcgaagagatcttggacgagctgtgaatccggctgatgttgccaggcacatttcatgtgtgataccggcttcaagggcaacaacatccttaaatataatgaacgggtgggttcgaaaggtagggtttttggatggccctaccactaggctggctgccttctttcggatgggaagcaggccgggcctgatgggcgagctgttggaaatttggtcataattcgacatattttaattcaaaataacaagataataaatatgatatttacaatgggatttgatccagtgatagtggtgaatgtaatcaacatgagcatgcttaatgtagaataagcatcaacaatcacataataacataatgttgacattgggatgaacattaacagtaaaacttctaattgaaatattgtaagaatgttataccccaagaattgtcctccgctggagtttgaggcagtattgcctccgttggtgttgacgggagcctccttctccttgtatccagtgttgccgttgtctccagtgttcgacatattggtgaaggtgaagtagatgttgacgaacagtgagtagtcgcgccttgcactccccaaaaacctgatcgcccgcccgtccgtgcaaacgtcgcagcagcgcgtggtttcggaggcctactctcccaaagcgtgtgcacacactcgtcgggatgggattaccgtagcaacaacaacattggaaaatggatgaaagtgtgtctgactgttctcgcgggagatcaaatccattctcattttataagaggaatggaagatgaagagtaagagtcatggaataggaagaggaatagagcaactaattgtcatcaactagccatgaaccatcctccactacacaaccatcaaccaacaatcaattaggagtaattgatgtaagttaccaatggaataggaagaggaatagagcaactaattgtcatcaactagccatgaaccatcctccactacacaaccatcaaccatccatcaattaggactaattgatataagttatcaattccctaatcaaatggattaattctcaaaactcttcatcccattgatatcccataaaagaatgaatacacatgaattcctagcataatgagccttggaatttatttgatttaattgatttaatggatcaattacccaattaaatctaacacgggcatctcttgctacgcaagctagc

SEQ ID NO: 68298 - DNA, 35664 bp, Oryza sativa
gtcaagtctagacaaaatagagccagtgcactcttctctgaaataacaataagagcaagttcatcctttctacatctgtgctatcaagaatagtactagctattagttcaataaagtgatgtcaaaccagacctttatttttattcgagtatttgacaattgcagacttcccacctccaggagtaaatttctcacgcactttaaaagaagataatccgacaggctctcttccatcctttgcaagctccccttggactcgggtaagtgcctgctttgctagctgacttgaatctactcctaagctaaaatgacaatcattgtaaaaggaaaaaaaaatcaatgaaagtttagtggtgggatttgtattcaaaacgagaatgcagagaattggtattaactacactaagcggggatgaattgtataagtttataggattttaaggaattaaaccccaactcctaaagcaaccgtcctcgaccaagcacacccctaaatgtgcaaaagtacactaattatttatttttctctttattaagtggaaatccttagcgaagtccacatccatcgcaacgtgagcttgctgatgtgcaaattcatttacatttcaggttgcatggctaatgaattagctaatggtatataaagatgccttcatttttctagtttgtgagcatacacatctctaaacttccaaaatatcgtttgttgtttactggccgatgaaaaggtcgtaggtggttgatgcattgaccacactatcgcggatcatatggaagcattttttttttttgggaaaacatggaacaggagaacatcaccacaaacctcttaaggacgttgttcgtggtgggatcgttcaggttgaagaggccgagcgcaatgtgctccggcgagatgaagttgcatcccatgttcctggagaactccacggcggcctcgaagacgcgcttgctggcccccgagaagggcacgtccgtggccagcccgaccggcgcctgcgcgagcccttccttgcccacggcggcgcggcacgcctcgcgggcgcgctcgacgcggacgcccgaggcgaggaaccccagcggcgaccggtcctccgcgacgaggcccagcagcaggtggtgcggcgccaccgtctcgtcccccatcccgcgcgcctcccgctgcgagaacaccaccgccttcaccgcccgctccgtgaaccgctcgaacaccgccctcacgacgacgcccccgcgccgccgcggcgcgggcgcggccagcagagccgcggacgcgcggatcggtcgccctgccgcaaccgccaccgccctcccacccccgccggcccccgcaggggagaaccggcggcggaggccggcgcccgtggcgaggatggacgcggacggcaccgacgacgacgagcagcagcacgcctccatcgccctaccacgcgccgcgaagctcgctcccaactccccccacggtgtatgattgatcggatgccgctgcagccgaagccgcttcaattatgtggcggattctctcacacccgccgcaaggttgtggctgtaaaggttcgctcgcgaaatggaatagaataatcgggtgtgagaaggtggtgtggggtggggtggatggaagaacagtggaagtggaggcggcacgcaaggaaggagggggagggagggggaaccggcacggcggagggagagagatgcgggggtggaggcagagcgggagaagaaagggattttctggcttggattccaccgttggcgtgcgcctccgccgcgggggtattctccggtcgggcggccacgcccacgcccacgcgcgcgctttatccgaacggaagaggggatggctttgcctcgcgccgtcccgggggccgtgcgatcggggacggacggcgcaggctgcgtccgtaaggttaaccggtgcatgggctgttaggaaagttgtgtgtgtacacgaaaggtttaatgtgatggaaatttgaaagtttgaaaaaaaaattttagagctaaacagggccatggtattgggagagtaccgtttccatgggtgtggcgtctgggcagcccgatcagtgtctcggatcgatttgttcggttacaagtttacgtctaggtacagtgacgtgtgacagaacgggcacaacgaggcgatttcctaattggttgcactatttacatgtgcttgcatgccaaccaaaatggttaacaaaacggttggtttaaatgggcaaatcctagtgttggttacatggaaattggcagaatagcgtacctatacgatgtctcgctatccacacatttgcatgcacaatacaaacacaccgtttaacataactcaaatataatgtaatagatgatagatacatgaacataagaaaatcgtgttaaagcaattcgtatgtacaaatgtccatatatcgtatatagatatcatgcatcgcaatatgtgtgttctatttaaatcaggatatgtcaatacgtgtgaatgtttatagaggtaagtatacctccttgtacatgagtttgtaaaaaaaaaatctcagttgagtagtgttcttacttaataaaatgagatggattttttgttcttagccgaatagatattgagaattgaaatggaagtagatgaccggccataagtgatatagcagtataacccacaaccctaccacaccatttaaggcccattttccaaagctccatgaatccattgttcatggagcagaaaactcgttagaataagtctattttgcgtctcttatctcttttcttgattgaatggtttgaatcaactctctcaaccataaaatcaggtataatatctcacacatctttaaaaaatagtgcaaatcgattctttgggtagtttgggaagtgttttttttattgatgtggcagattgactacaagtaactcgctgagccaacagatgaacccacatgttagcgactctcctctcttccatactcttgtcactaagccaacagccgtgatgccttgcatgtggtgcggtgcagcatgatgaggcccaaccgacgccacccccgacatgtgggtcacacctattgagtcagcaagtcaatctcggtcaacttgctatgttagcaaactatttttcaacccaccgaagaagtcgatttgtgctgatttttaaaaattagggaggtattgtacctagttttgctgttgcaggagacgattcaataaggaggaataaatgagaaacggacaataggcttattccgaactcgttatccgggccaacaaagagcttacggaggcctacaaatgaagcgttatagagaagaaccctcacttgggcctctcattgatctgcctccaaaaggcccaaaagagagggctcgatagctctaaagcatcaaggcgcgtgatcgctatgatgggcaaaacattggatctcgtctcggcgccatgtgttctgttccgatattttttggccgggtggtacaccctcccacgatagatctcgcgtctcgcgattcataacctgatttgatccacggccccgcaggccaagtagcacagtaatacagtatactaccatgcttcatatgattgagcgcgctgcaatttgcagtagcgaaaaaagacactcccaaaaagaatcgatccaatgcaaagaggctggggaattctcccaaaaagaatcgatccaatgcaagcagttgcagctagagcacaagaacaaatatcgtgcccgtacagcagacggacagaggagttggacgcggacagaaaagcatctccatctccatatatcctgtgacggagtcggtcctccgattgtccaacgaacgcaccacatcgatctgcatgcgaaagcgaaaggaggggggggggggggggggggcggcacaagactgactcgccaatccaacggccgcgaggcgatcgatcgccccgtgtacggcgaggtcggctcgtgatcgaagcgccgagacggcgtccgagctgtgtatgtgtatatatacgtgatatacgtactgtaccatccaccacgacaggaacaaggagagaaaaaaggagaaaaaaaaaacaaacactggagacgaaacggatttgcggataggcgccacgcgcgcgctgcgacgttacatataccccggccccgcccgcgcgccgaacgctccctcgtctcgtctgctacctctcgctcgcgcgcccgcccgaaaccgatcgatcgatcgatcaggtgcggggcgcgcggtggccgtcggttgcgggaggcgcgcttcccatcgagcggattaccggaaggcgagggagacaccgatcgagagacagaggaggcgaggcggttgcgttgttgcgggcgttgttgcgggcgggcggtcaggtgagcgggcgcgtcgcgtgccgcatcggcgcggcgggttcacgcgcttgttgccgcttcggttgctatgcccgttttgctactccgcgaggcgggggcttgggactgattgatcgatgggcaatgcaggggcggcggaggcggaggcgatggggggctcgtacgagctcgtcaggacggacgacgcggcggggcacgtcttggatctggaggccggacgctgcgccgccgtatacccaaagggcggcggcggcggcggcggcatcgctccaccaccggtgccgtctccgccttcgtctccggcgtcggcgcggcagcggctcgtctcgctcgacgtgttccgagggatcaccgtactggtacgcgcagaaatcactccctttttttactttgttaaaaaaaatctctttcttttcgccggtatgtttttcctccgattattctgtcctttaaagatttctacggtttattcctgcaaatctttatggctctttcttgcttgattgccctgtttaatttacgatatatgacaaacaacctaccaaatcggattgcttgccgagtgggtctctgtgcctgctgcatgtgtatcgatcatgtggtgtggtctttggtgccaaccaaacacgctccatgactcatggactcatgatgcatggcagtggcttagcagcagcgaccacacttctcttcccttccctttccctttttgtttgtacttgaaccacagtaaccaaaagagagcagagctgcttaaactaacccaacagctcaaactttagctttatcagggaatatttagcgcatccagcgatgcctgtacgggccgacatgataggttgcgtctttctcttcatgctgtcacacacaacatctgtattctctagccacttattatcttgtccaaacagcaaaatgccctctgtttttcacgcacaactttaaccgttcgttttatttaaaaaaattttaaaaaaatttaaaaatataagtcatgagtaaagtactatttatattttattatcttgtaacaacaaaaatactaattataaaaaaattaaataaaacgaacgattaaaattgagcgcggaaacttatggttgcactgacggagagagtagcaagttagcagcaactgtagccattatagtagagctgtggaagcatagatcatcaatttttagtcgcggcacatcttgatgctatgcaagatatagttatttagaactgacgtgaattaacaatcaccggcctggcctgtcagattctgaggagtgattgctcctgagatgtggctagaatcgtcggtgctcgtggcccctcgatcacagtaggaaaatgccctgcctaccatcgtacggaatttctccagctattggactcgaactgcacggcagatttcgtgcactaatatgttcagtttctgttgctttcaaacctccattagtttgatagataagtgggtaatgtcaagtatagctcacctgtaaatatatttagataagtagatgagcggagcgcatgtaccctctatagttggcacttagaaaaagatatcacgtacggtctgatgcagctaacaacacgagtaatcaaataatcaatagaacttctgatggtagaaatatattctcctacaatgagaaacaaaaaccattatatccaaaaacttggttcaagtgctcgtagaaaaggtagacatacttaaaagttgaagatatatcttctacactaattaggtaccctaaagctcccatgtcactaactagaaatatttgaccattgattaggtgagttattctgtcatggctcttaatcatattaggattttgtgttaaatacaaatatgccattggagatattacaaactctttaatttttattgtcatggtgtcttttaatttttgtaaaaatttaataagtatatgacattctgaacccccacttttcaatcttactattgtttaattttaaaattcaaaattagcaagctattgtagatttgtagagtcaataggaaatgagcctaacttagtgagtggtagtacacattagcccataaccagatacccaccttttgtcctaaaacctttttcttacacggggcaattcaagaaccagaggaagccacattttccggacaccgtggtgacgagccgagtgacagaaaaagagcaagaatgttgatcagaaggccgggcgcaccacctgcgcggaatctcatcaccgggcatcgatccattatcctctgcagcgtccgcgtcggcggttggcctctccgcgtcaagacaagcccatgcgacggccggcgcctttttgccatgtgccaccctccccgccctgcccgccgcggcgtgggatcgatcgatcgatcgatctcgtcgtctcctattctcctctgctttccttcgacgcgcggtcggtcggtcggtgcccactcccaagtcccaatcaccaattcacctcaccggcgcgcggcgcgccgcgtgcttcaccggttggaccccctgctgccacggcaaacggcccgcccggtgcatatgcgcgctcgcgcgcgcgggggcgcggggtggcggatcggttggttccatccacccgtcgcaccagtgcaccaccggcgcgggcgggccgggtgcgcctgctgctccacgccacacccacacatgtttcccgagcactttttctcgcgcctctctgctccgtggtactgtgccacacatctcgtcacctcgagctcctttttctggctttctttggtgccgttttccctgcgtgctcgtcaccaccttccgtggcacgcgacgccgacggctgtggctccgcatagcagccgcctgtacgcgcgccgcacacggactaaccgcgtcaaattgcaggaaccggggctgcgttgcgtaataatctcgctggctctcgccgccatctttggtgtacgtgtgggcggcgaactagtacgtctctcaccgtcaccaacgccaagacgcgcacacaaaccatgcccgcccgtccctaccatgtactgtatagatcgtgtgggctaacacgtccggttttccgttctttccagggtcgcaccatcccgctgaccgtgacgcgaccaatcctagtttctttcgctgcttaattcggttttgtccacttgccctggttgccttctcgtcagctactagctactagctagagaaacttaagtgcgattttgagggagagaatagtggagactaaaacaagtgcaatgtcggattcaggcaaactcggtacaaccactgaaccgcacgaccggtggacgcgatgaccgccacggaagttcttttaaaatcttgatatggtctccggcattttgagtacccgaggatatgacctaccaggatgcagagtcaagatccactgagtctgaaccttgaagacttttttattttagattggcacacgaaaggtgagcgacctttctgatgtcattccatcgattactgctgagaaaaaaaagaacatccctaaacacagaaattagaacagttcgtagtttagggtgccctgttgcaaaagtaatgaacgacagacacagaaaagtagtaaccgataagcctgatagatatagctagctagcagtatggatggagcagcacaaatggatcatggatgtcatctttaaaggagctagatctctgcctcacgtagcagtagctggccctaaatcctaatgcaccatatgttcacaccccaactagacgtgtgtgtaccaattcctcccggaacaatcctgtccagtggtactgaaaatgatagccatgtactacatgaagaggtaccacacgtatatacataatacttccatgtgatcaggctggcctttagctaagctctagccaatctgcaccaaccacaccttagcttgtcccggaatatccagcaatgcaaaatccaatctatccgaaagccatgagagtatgagaccaacttaatactaatggcctatacctgcataatcaaaagaagttcattaggatcagagctagcttacggatcacagtgacacatgtgccaatgagaggaggtatattgcacgaacgttgatcggtgcctgggccccactatgctttcttctactccaccactacagtaggtgataggtgacaggccgggtgtttgagtgttaaaaactgttaatgtgttaatgaggtgaggccacggtactaggcatgggaacggtaggttcccgtcgctgtaaaactttggtgattcatggtctctccacctactgtggcttttactacctagcactagctagatggaaatttagtatgttgctgctgtattttggcaatgtaaactaaattgtagattggtgaagagatcagttttgcttttttaggtgaggaagagatcaatagataactctttacgatggaccattttccgaccaatcctcatcttagcaaacctggttttacactcttgcaagtaacttctatgttacaatagttggtgcttgcttcctgcttccaccatattatgaattctatggggttggtatgaaactgtccatttgtgtcatggacccatggtcgcctggccagacaacagaaaccaacggcaagggattcaggtgtccgtggttgatgttgccgaggggcaatggctaacgtgcgtgcatctttttatgcccgaaatgccggtaggcttatcatggggcgagtttctgtgttcccagttgattgctagaatatttggcttttgaggtgaaatgtactgagatggaatctgatgccagacagaaacccatattttggtgaagttgtttagcatcgtattctcccttcgtttcctaagatatttccatgggccgtcagtgttttatatatcagatcgacaatattttagaatggtaatagtgcaagaaccgatattatagtctatttataaagattgacagtggattcatatctggttattcggttttgttttgtgcttttatagcataaccagatctagtttgtactgtagcagctaacaagtgggtctagccagatttattgttgcagcatctgggtgtttcctaaatactttttttttctgaaaaggatcgtacatattttaataaccattggaaatataagtaactcgaatctaaattttccaccgatcttaaagttattttcatcataatctttcgtacaactgaaaagctctgtatacatatattgaagtcaaaatgattgcgccaggttgccaacaccatttaatctgatgttcttttgcatgacaacaatgtagtaggaaagatagattttttaaataagtaggattaagtgttgctttcctccctgcagcttatgatcctcgtggacgatgctggcgcgtttcttccagcaattaatcactcgccatgggacggtgtaaccctggctgatttcgtcatgccctttttccttttcattgttggagtcgctctagctctagcgtacaaggtacaggatgacaaggctaagatcgtgatatttaacttcctttctgaaactaacaccgtaccagtgacacttatctgaaacctaattgcgtcacgttgtgcagagagtgccaaacaaattggaggcaaccagaaaagcaattctccgtgcactgaagctgttttgtgttggtcttgttcttcaaggtatcagttaggaaattcatgaaagctactagctacaattattgtaggaaaatatgtatttaactttctcttgcttctatattatgcaggtggattttttcatggtgttcgtagtctaactttcggaattgatatggaaaaaatacggttgatgggtatactacaggtatacggcacacgccattttataccaccaacactttctccatcaagaataaaaattatagtatataatgacgtatcttcgtggttgcagagaattgcaatagcttacattgtgaccgcgctatgtgaaatttggctcaagggagatgatgacgtagattctggatttgatctgctaaagagaaaccgttatcaactgtgagtataaaaaccaaaaccggtctaatttttttgtgctattgttcttcacgttgatgagaaattagtcctcttattcaccttaaaatatcgtccacttttgtatttccaggttcattggcctgatcgtcatgatcacatacatgggcttcttgtatggtacctacgttcctgactgggagtatcggatatccgttcctggttccacagagaaatctttctttgtaagtgacactccacctttatcttatacagtacaagtggatcaattactactaacaaggatgggaactgatgaattttaaattcaaaatctttatcaggtgaaatgcagcgtaagaggcgacactggaccaggctgcaatgctgttggcatgatagaccgcaaaatcttgggcattcaacatctgtactgtcgaccggtttacgcccgatcaaaggtactaatgaaaagcaacagcttgaatctgtgtgttcttcctcatgtacaaattcggtccataataacaactgctctctcctttgacagcaatgcagtataaattcaccacaaaatggaccacttcgtcctgatgctccttcatggtgccaggccccttttgatcctgaagggcttctcaggtcactggacccttgccatcataataaatctgtctttaactatctttcaggctacaacagtacaacatttcctttgcaaactttgctaaattctcactgttctttcttgattctcgtatcagctctgtgatggctatcgtcacctgcttgattggtctacaatacgggcatgtaatcgtacatttccaggtacagtagttcgctgatatgtcagattgatgagcgtttgattttgcagtccacattgaaaatactctgaacttctctctgttctgaatcgatttgcagaaacacaaggagagaatcatgaaatggctaatcccctccttcagcatgctaatccttgcgttctcattggacttctttggtaagtaatacattgtaatcttcaacatttcattcctaatcatcaggagcgtttgaactgaccgttatgctgatgaacctctccaggaatgcatatgaacaagccactgtacaccgtgagctacgccctcgccaccgccggcgccgcgggcctcctgttcgccggaatctacgcgctggtcgacatgtacggccaccggcggccgaccgccgtcatggagtggatggggacgcacgcgctcatgatctacgtcctgatcgcgtgcaacatcctgcccatcttcatccacggcttctactggagggagcccaagaacaaccttgtaagttttgctgcaacactgacgatgaacatcattttccagatagatttcactgcaaaataacatctcttctaacacggctacctggctggctccattttgcgcagttgaggttaatcggagttggggcatgatccatggatgcagcagctagaagcctagaaggcacgtatagaggcgtatttaggacactatttggacagagacaaacgagacatgtgcaggcctagttttgctacaggcttagttattgttgcacagattcgttctctctgagagctctttgtatatggtaaacaacgagcctgtgtatatcatgacaatacgatctaaaagaaatatatagtacagaaaaaattttcagctgcacagtttaaatatgaagagctgcatgacactacctccatatttaaatatgtaaaacaatgctgatttttatcggtctttgttatacaattttgacaactatttttctattaaaacatactaatattttataattttatgttttttaagagttattaatggttaaagttttaaaattttgactgaataaagtcaacggagtaagactttttagtcaggataaaatctgtttattgactatggccctgtttctttcagctttggattattataatctagattattaagttagattactataagctagattgttataatctgtagtagaataagcggttagctgtttctttcctagattattggatttgcaagtctaaagagggagtgggatggcatggtgggtaatttttcacccaataatctggaaaaggctcacctaaatgagcttatcggattataataagctactttaataatttttctgtttctttcagcttactctcaataatctggattaataatcccaaagctgaaagaaacagggccagggagcttctgcagttttttttttagaaaaaaaaaacattcagcctttaattgatgagggcgatattttggtccaggacgtgtgggctatgaaagtatgaatcctcgtttcagtcaaggcaaatgctagccgaatagtagcccaacataaaaaaagtccagttggctagtttgggccaaaattaactcacaaatatctctgttactaattttactgttaccttcgtgttgaaatataagagattttacctatttactacccaattaaaatcccttatgttttattttaggatggggtggtaactaccttaggacgggggtagtatgcgtagcctttacggcctggaattactgacttgtacaaaatgtcaaacgcatacaattgtacacaagtatacttctctaatatgtgctgtgatacaccatttacaccgatcgtaagccgcggcagcacataaaaaagtccattttttctgacacataaaaaaatcattcatattttttttgatggaataagaatgtaatcttgctcataacgaaaatgagactctcggccgagcagaggttcctcgcgcgcgacgagacgacggtggctttagctaaagctagctatcggcgagcgcgatgagctggtcgacgacgcctggttcggcgagcgtgctggtgtcgccgagctcgtccagctgcctggacgcgatcttccgcaggatcctccgcatgatcttgccgctccgcgtcttcgggagccccggcgcccagtggatcttgtccggcgccgcgaacgccccaatctgccacaagaaacaagtgaaggtattatgcatcatcaggtgaaaactccacagttgaaaacagtagttgacgtgtgcgcgtcttccacggggaaaacggctgagagcaatgcagcaggagaacaacactgtatcaccatcagtgtaaagtctgaagaaaatacctggctgcgaacagtcataacgaggcttttccgtagctcatcgctgtaaggaacaccgtccaccaatgtcacgaaagcgtaaattccctggcctttaacctgaaacgggcattgctgatttaagacctggtttttcgtggaactaggggagagggtgcagaaacatggagccaacacaaaggagcaagatgtaggtatagggatgaacctcatggtcaattccaacaacagcggcctcggcgcattttggatgtgaaaccagagcagactcaacctctgctgtcccaatccggtggccgctatgatttttttcagagaagggtcaattacttatagcttgatttttttttctgagaaaactaagcattgaattgaaatcaagaataagcatgaatagaataggttgctgaattacctgacattgataacatcgtcaacccgtccagtcagaaaatggtatccatctttgtccctggcattcaaattacatttgccagtgtgtaaacatccggtaattctgcaaagctgtatattccactcattgaagaactatttgattgagttacctgctgcaaccatcaccggagaagtaatagccagcaaatggcttgaagtatgtggtttcatatctgtccttgtctccataaagtgtccggaaagccccaggccatgacttctttatgcaaaggtatccgctgcattctccttccatttccttccctttctcatctactattactggctgtcaatcacgtgcacagtaattacaacataagagaggtgattgaaatagtataacaaactcacttcaagtaaaaaatgtataccaaaggtcagtcattgtatacctgtacaccgaagaaaggaaatgtcgcagatccgggtttcagaggccaagcgccaggtaaaggagtgatctgacagaaataaacattgaatttcaatttgattcatcagatgcaactcactttagaatcaccgaatttctcactagatatgtaaagacacaattaccataaaaccaccagtttcagtctgccaccaagtgtctgatattgggcatcttgcatcaccaataatatcatagaaccatctgaaatgaacaaaagagaatgtaagaccttttgagtatattataatttttgacccaggaatcatcacaaacctccaagcagtgggattgattggctcgcctacgcttcctagaactcgaagagatttacgagaataccgagtaacatactgcaaatacatcagaaaatcataaaggatacacaatgagccatgaacataaactgaaacaaagcaaacatcagttataaatttcactctggaagaaatgttcttgtgcagttatttttaaaaacagtcttttgaaacttgatgaaaatttgatcaaaggcgctctgattcaaatgtggtggaatgtgtgaaggaaataaacaggacatgtggttcaatatttgtttgattttttcccttgaaaagtaactaggttcaagatgtatcttcgggttgtttctttataatcttatcacaatgccataatattacataaataattgctggatggcaacagtcatgggtagtaataacacaaaaaattaagaagtgtacctcggtaccatcacgcatgagtgcacgaataagtgttggtgcagtataaaatatcgtcaccccgtatttgtcaacaacgtcccaacaacgactaggatcaggatagtttggagcctacaagtagcatcagcaaaggcattgcaaattacaaacatggcaggactaaaactagtccgaaagacacacaattgttatttattgtgattctaggcataatatcaattaaaaagttctctgaaattaccccttcgtaaacaagaactgtggctccattcaggagaggaccatatgtcacataactatgcccagtaatccacccacagtctgcagtgcacctgatgcaagtcaaacagggaaatctaataagaaataatgcagcttgcagaaaatttcctattaacattaggaacaagtttatactacccaaagatgctaaaaaactagcatcataccagtatatatctgatggcttgtaatcaaatgcgtgcttaaatgttgttgcagagtacaccatatagcctcccgttgtatgcaatacaccctgcagacctcacaatatgttaatgtttggccataggataggctaacaaagtaacaaaccatgtggtttagggtacctttggctttcctgtgctaccacttgtatatagaagaaacaatggatcctctgcatctacccattccacatcacattttgttggaaaattgggcacaacatcctgggggacgcacatcatctcaaattttagtgatataacatgaaatggaggacttaaaaagaaatcttccaaataacacagctgttctgcagatgttctgttcctacttcctaacacatatgacgtggcgtggtactttttggatagcattgaagttgtttgttttgggcgtacctgccaccaaacgtctctgcctgacgtccattttgtgtcttctctcttcattgccgactgattttcgtatgtcaaagaaatgcctgctcagcacaacaaagataagcatgaggaaactcctcaagaactgtatccacaattacagagggattctcagcatgacatcagacgaggctaatttaggcagtgaccaactcatagaagtcagattgtacatacctacatcgactccattcttcgcactgtcagccagcgacacatctactatatctttgagagctatgagtttctttccccttttcaccgcgttgcacgtaatcacaaccttaggcttgcagtcaatgattctttgtgctagtgcgtcagcagagaagccagcaaacacaacctgaacacaattcggcatcacaatatgaaatggaacttcattaaaaaagacacatgacaattagcatcttaaactgctgtgacaattaccgaatgaacagcgccaatccgagcacacgcgagcatcgcaatgggcagctccatcagcatcggcaggtagatcaccacggcatcacccttcccgacgccgacgctcttcaggtaatttgccagctgccatgccacagattcacacgatcacaccacaacaatttagcacaggacaccaaaatcaacctcactttatacgacgccacggaggcattacgtgcaaatgtttcggcgtatctacgataggagcgcgtgtgatctttacctggcaaaccttgttcaggagctcggagtaggtgagcttcgcgtcctggccgggctcgttcccttcccagtacatcgctatcttctcgccgtcgccagcctccacgttgcggtccaccgcattgtagcatatattggtcttgccccctttgaaccactgcaaacaaattcttagattactctcgtggctctcatggcaatcgagcatcggattcagacaattgttcatcatcagtcgagaaaagtgacagtactagcttacttcgatcttgatcggccccttggtgacatccagattctcggtgcagacctcgtcagggttccacttgtgcttccagtagaacgtctccgcgatctccgaccagaacccggccggatcgtcgatcgaacgtcggtacatttcttggtactgatcgccggccatgtgcaaaaacacccggaacactcgtcacaaccaagaaccaaatcgagtaatcgataaattcacagtgaccaaattgttgcaagaaaatggggaatttaaccctggcaacccagggtttactacgactgcgccgtcgctgtctgccactcttgccttatctgcgcctctgcggccagcgatggatggatcgctgcgcgcctcaaattgaaggtacggcctttgaacgcgcgatgcgccgccagttcgagggggagagcgaattgacagcaaccgagaggaaatcggcaaagcagtaagaaaagcagagaggcgtgtatcggcgatcacctgctgcgtggaggagacgagggcctgggaggcgaagtccgtgctggggtggacgaggccgtggtcgtcggacgccgccaccggctcgcccagcacggccgccgcggcggcggagggcctcctcgcccgcggcttgccgttaccgctcgccgccgccgccaccgcggcgtgatcgctcgcgcccatcgcccaccctcctcgccggagcagcggcggcgaagtcacggacatcacccaaggtagagccgcagcggatgcctgagcctgcgcgggaagcgggatcgcagcgcgggcgcgtgcgcagccgcagctggcgtatatatgcagctgggccatgacggccacggctcacctccccctccccctgcccgcgcgcgctccaagcctccaacaacaacaaacacctttctgactttgctgccggcttcagctggtggaggatgcaaatcaggcgggatggtggtgggttgcggagaaacgaaggccccccctctctctctacactctacgtatctctcttgggtttctcctcgtctttctttcttctggtcgtacctggacgttggagctgacgagctgtgccgctagagctggacctcgcggcgtgacgctgtcgcgcgcccggtgacggaaacggagggggagacgagacgagacgcgcgcgggggccgtggccgtggccgtttatatgcaacgcgtggcgctcggaggcgtggcgatcgaggagggcctcagaaattttttgtcacgtttggttgcgttgcgtggacgaccgacgagggggtggacgaccgaccgggggcggggggacgaccgaacgggtggacaggattcgtgtggtttttgacttgggactcaccgcggcggatgccgttaaacacgagcgaacccgactggggttcacatcgtctgcctttcgggctgacggcaaacattgccgttgcatgcatctgtaccgcacattctttcattaacggttgtatatagtggtcctaccacagagattaaactagatgcggctttgccgcataatagaccagccaggatgaaatactccatccgtttcatattgatcatcatttaacacaaattgaaattttcaaattgatcatcatgttatcatagccccttcgtttgacgtgtaatattattgcatttaagcatgaaaattgagtatgcatgcatgtatgtaggaattcgaggtagtaaagctatcgtttcttagagcaagtttaataagatagtcaaccactgactccaaatcatctatagtcaatttagtaggaaattcatatactcctataaacattactacacaatttatacttggtcgcacctgtcatacacacatgtatctgggagtctgtactacagctggctacaaatctatagcccactgctcttctctcttctgttttatctcctcaaaatgtgtcaataactggacctgctcttatgtatggggcctaagaggagttaaagtgtgcatgtttcttgatttttccctaccacatactcacattaaatgaaatataggaaagttaatccttttttttcttggtgaaaaagttatatggtaatgaatatggaatggagggagtaaatgatatggtatgataagtagacttaatttctttatctatttaatgcctgaaattatggaaactatgcccttttattcatatattaatttaaagcagcgagacattgaattcatagacataagttggaagtcgaatatatgcgcacaaattccaaattccaatgaaaccaaagtaatgaaactacttactcccttcttctaaaagtctaaaacttattccattcttaggtttttccaaaagtttaagtcctatttatagtcattatgtgttaaattaaattattgatcagaacccaataaactattttattacttattggttgcatgtttattgcttttgtcacattgtaaataaattaattactccttggtcttggtgccaaaagaaataatccctccgtcccaaaaagactcaattcctgagtttttatgtctaacgtttgaccgttcgtcttatttgaaaaaaaatataaaaaaaaatttaaaagataagtcatgcataaagtactattcatgttttatcatctaacaataataaaaatagtaatcataaaaaattttcatataagacggacggtcaaacgttaggcacgaaaacccaagaattaagtccttttgggatggagagagtaggtcttacttttggatggagggagtattttcattttatctcctggcggagctaaaaagatttttttgagcccaagcaaactatacttcttgtatttgttatataaatttcatcatcaattcattcaataacatataaatttaatggagtttttgtcagtgagcttgcgcggccgcttgcgatagccaggtgtggcttcacccctgcctccacatgtctataaaaatcaagaaaatcctttttttaaaaataatttatcttcttattctttaaacataacgttctaaaagtgcataacattaaaaaattctatttgcacaataaagaagggtaaggaattaattatttgtttgaaaatttggaattgcgttgagctcaagctaaagcaaaagatactggtgcctccttattctcttctactacttaattatatcctgaatactccatcaaaaaattatatcctggataaatgattacaaagagtccttatctgcccattgcaacttgtatgtgcagccgaactgtggtctccaccgtttggcttattttctaataagccaaaacggcttattagaaaataaaaataaatttgtagataaaacttttataaatgtgttcttggtgacttaaaaaccaatgttgaaaaagaaactatgttgaaaatatctcaaaatcaatctcaaaattaagcttgaaaatttaaaatttggctttttctttggctgattaggccatctgatgggagcctgtaagtgtcaactgagagcacaatcaaatcaaatgatataataatatctttagtttttctcacctacactatttgaatgtaatgttcactgtttttttcatttagatggcaacgtcatgcaaaaaacagagccgtccgtctgtacattgatctagcgttcttagagcaggtacaatagcagactataagctagctatagacacatttcaagaatatataataggagagagaagagcagcgggctataaatttgtagccagttgtagcatgaactctaagatacttgtgtgtatgacaggtgggaccaactatgaattgtgtagtatacgtttataggtactattgtatgaatcggctattaaattgactatagataatttggagccaattgttggctatactattaaacttgctcttacgttgtcttcagttgcaggcttgcagctaaataaagtcttttttttgtccttcccagtccctagtccctgctcctagtcgtcgacgactccgctgctctccagtctccattcctcaatctgcttcttgctcctcggcgtctccatcttcgccgcggtgccgctgctacaacggacagtatatggcctcctttgcaggaagttcgatggcgcatgcgtctacaagatcaaagtagcgccgtcaacatgagcgaggagaagtctgcgatgcgctccctgtcctccacctcctgcaatccctcctgctcctcgggccgttggcgggtggttcaccgcggcgtcatagccatgacgtgtaggtgacagaggatccgacgtgacgccatcgctcacccgtgcacgccgcctcctctcctccgctagctagcgccccctcccttctcctgatccggcctccgggtcgacggccaccaccgccgctcttctcttcattgggctcaacggatcttgccgaagtttgtatcggcgacggctatcgcgtgcttgaggtgactcctgcagcatggcgacagccccgtgcgtcaaggaagggcagcagcatggcggcagggagcgcaagggagggcgaggtggccgggcggtggtgaagaagacgagcccgcgccttgagggaggacatgagcgggtggtccgctgcggcgcgcgggtggtggaggatccggtgggcggtgaggcgtgcatcgggaggagggatgggtggattaggggtcgagcgcttttgcgagaaaaaatcaagcttcgttagtccatcacagcgaactttcggggagaaagaagacacgtggcagattttcggggaggagaagcttaatttataggacgccacgtggctcaatctctaaccagggatagagccctgaaatcggtattagagattagagacctactaatcggtattattagttatttctctccaaaacaaaattaagcaaatagaatcctcttttatacgaagagactacaataatctacaggcctagaacaagctcggtatatctttaattattttaggtgggttcttcctaatacataaccgtaaattttctaaaaaaaggaaattaaaatgaaaaaaacagaaaaatctagacatttctcatattacaatttaaaaatacatataggaatctagacatttttcaacgcaaaagagctacgtcaatatattactgcacttaaaattttatacagccgtaacttaccgattagtgacctctaattaatctctctggtagggccacttcatacaaccattgatggaagaacgtgtggtacagatgcatgcaacggcaatgtttgccgtcagccccaaaggcagacgatgtgaacccgactgcgtgagatacggagacgggcgtgtgcgcccgcttcgctgggttttgtcgcgagcgccctgccgttttggtggcgcgtgcgtgcgtgcgtcctcgatcgtggcattcgtcgtcactgacgtaaacgtttgccacttgtctagaacgcgaagtaaagaattcgtagttctcctgctgcttttgagttctcggcttttctcgcggctcgaccgaggcagtggatccgcagtttttttttaaaaaaaacgtatggagtttgttaatccgcgatccttggaacggccacagacctgagcacgaagtttaaagtgttgacatgatcaaggattcaaggggctcctctgaagccgtggcaccgggccgcgcatacggtgtgtacccaacctgtgtgcgactcgagggaaaagaaaacccacggcacaaacggctttcctgcacggtccctagtgtaccagcttctgacagtaatggcacgtacagtaggcaccaacgcatgcggcgatgatggagcccgcgcggtcggtcggatcaggacatgaacacgtgtaggacactccctgtgctgtgtgcggctgtgactgtgcgtgcgcccacgggtatcttctccgaatcgtgcagtcgcggagtcgtcgtaggctagtagcaggtggcctcccttcccggcacacgctgcaacctgcgaaatacgcgatgcgatcaattccatttccatctcgcttcgcctcgcgcgcggccgggccacttgcggccttgcgggatctaatctttcccttccccgtgtgtacccgcgcacacaaacttggtggcggcgtccgctagctgctctgcccccggagactccactccctgtgtcggaagacgccgtcgcgaatttggcttcgcgatccagcgcagtacgtagtgccgcgaaggcagtcagggcccccagccgcttgcgtgaaaagttagaaacgaaataagctaagtactctagtactattataccagtatataggcagcaggattgtcacgtcgaaaaaagaaactggcgagattgatcagggagggatggtgcactgggcttgtcacgtgaggaacacataaatcgaatcgatccccttcagctatatacttaagttgtttattacgtatgttagtgataggctgatagccacttcttgatgtgtgagtgtgaccagttagatcttttctcaccaactagttgcagtcagctagcagtgctgatggtgctaacgttgaaaattggagaatatctacctccctgattttcgtttgtgagatgaacatttagatgtctagttttccaggtaggaccatatttttagcatgcatggggatagagtttgcaagcgtgtgacttcacgttcgaatcttgatgtatactttcactttctcagtgatgcactccagtaggaattctttaaggttaacaatggtgtgctagtggtctccgtctgttaagcatgcgcatgggtttttaatcttgtaaacagcgttgggccgaaggatgtgtgctgagtgccatttcatagaggaataagtctattttgactctctcatagttcttttaaaaaaaagactctcatgtctggcttccgattaaatcatctccctcaactgtataaccgggtataacgcttcacccatcttccaaagccggtacaaatagactcattcggtggttttataagcggtttctgctgacgtagtatattgcctgcggttgactcgttaagccaaaatatgggacccacacgtcactttcctctattcccctcctctctatcttcctctctcctctcctttccacctctcccctgaggccgatggcacaaccacaaagtccacaacatccctcgccgccccatcatctgtgccactgccggtcctccatgccgcgtgcacgacgccggccataccttgcggacctctccacgcctaaaatctcctcctccccccagcgttgttgccaacactgattccttgccactagtttgttatcactccaccaattccttcgacgtgttcctgtaggggcggtcagccggaggggcgtgtgcagtgatgggtaggatcaaaacagctagtgaggtcactctctgcccagatccgaggacgatcggcccaccgtgaggtccccgatttgcgcacacgctaagaacatgatgggcacgatgccgtcatccaccatggtgaagaacagtagaacggcctcgtcctagaacccgtgcctcgcgtgggtggtcaccatggttgtggaggaaatgatgtaccagtcgaccaaaggacacaaacatggcttcacccaagaacctgtgcctcacacggtcaccatggccgtgcaagaaacaacgtcccgtccgggcggaaacccgtagaagagcgcctgcgggaggcaagctcacaacgagtactcctcgaggctagccatgagcagcgtcatggtcaacatgtgccacgccaacctcgtagtccattgcaccaccacctccaagctcctacgccgccgcatcatccatccagttcatctgttgacaaccagatggctttgccgaaggagcgaacggcaggatgcactcctggacgcactccttggtgggttctaacagctttgccaccatcaatgggttcttgttgtgtgccacctctggtggcctccttagcatccaagatggtagcgaccctctaggacttcctttgcgcaccgcctcaccactgtcagccacgtccttcggcgattcagtttgtcttgcctccgctactgcttgtgaggagagagagagagagagaggcggggaaggagaaaatgaactgacatgtggggccacctgtagaaaccgcttcgcaaaccgcacaggttttctaatatggggtatacactatacccgatttatagttgagggaagcgattcgatccaagggtaagggatgaggcaggtataatagacttttatagatgggacttgttctagcgtgacaagtctatgggcccaaaattctttgctattatttggcctagcccagtccatctacaaacttagcatctagcccagctttctttagtcctttcggcccaaatatacagacgagttgggcctttagtccttcgtgtcctttgtcttatctcgtatagtcgtatgccctccggcgctgcatttcgtcacatgttttattcacaagaaagatggcagccaatcagtagcgtggacgtgtggcgtgtcttttcgcttggacgatactggggagcgtaatgctccactattacggacggcaccgttgtaataaaattgtaatgtgccaatccggcaccgcatccaaaaagaaaaggtagatatcggccgcacaacatatcctgcacgtcattgttcgccgtttcttgctttgcaccgtcgaatagatcgtacatttcgtgggatggcgccgcatctctctgcacttctgcaggacttagaggggagaaaacccacaccaacccacatctgtagccgcccacatgctggtaacatgtcaaagtgcgcacctacacaggctctgatcgactacagtggcgcagccactactacagcaccgctacaagatcatgcgatcgagcagtatgttttctcggtccaaacaatataataggcattaccgatttgaaaatatggcacacgacatgtgtttcttttaattaatcgcatcccaaaacctcactagtttaacccccagctgctgcattgtcccacccaaaacgctctccactctccactattcacagtccatctaagggcatgacaaacaatggtaaaaaatcagcgtcaaagactcagtatggaatagtagattattgagcaaattgttgttgtggattacctacttaattatagatccaagataaattatttttttagacctagaagataaattaattttttagaccaagaagataaattaaatattttgataaataaaattaaacaaatattttttataaaaatggtgcaagcaatacaatagaagaaagtattttgagaagatatattttttgaaacatggagcaaacaatccgtttcaacaattcagtaaataatctgaaaagaactaagcataagagaaaatagtacatatgaaatatcaactacttttccaataccgacacaccgagtgcaatttttacaatgtggagcaaaaagagagagaatattgtcgtttattgattaacaaatggtccaataaatatcttaatgccatctacaacattcaatagatcaagaaaccaacatgaaattggacccaccatcattatcccagcggagctgccaacaccgtcgttgatctcccttagcttgttgccgtcatctcccttgagacgcagccattgtctatctccctcgtcatactggtggggcaacaggtcctcgtccagatccgaagaagggcccccataatgcgtgctctctttctgtgcacaccaggagaggggacgtgaactgttggcacttgctgttcaagctgtggcggtggaggcatggaggatgcgtgatactagagaaagagcgagagggaaatggggagaacaagagacaaagagatagatcaagacttcaaaagatgattttggttgagtcaaccttaaaagagtcgatcgactgaatttgctcgatatctctatctatgtcggttcatataaaaaaccggtactgatgtttcacatatcaaatagtattttactgaaccagtatcgatattattagtgttagtttttttaataaaccgattctgataaaatgttattagcgtcagttcttgcctacagaggatgagggttggatgggtggacgggagacattcactatcagttccgggttgcatagtgcattacaattatactattatgttgtaagtagcggttagtagttgcatttgatcgaaaattctacaagatttaagattttttttttcgcgaacgcgcaaaaggattacacgtcaatatattagaagaatagaattttgatacacgacgcactcagccagaccggcctatgacaaggaaggaagaaaaataaagataaaaaacaaagaaaggaaaggaactcgaaacgacggtaactctactccaaacagcgagagggggcagagccactctacgctctcaacaattccccaaaggaagcgacagccgctaatgaccacatccggcctctgaaaggatggactctaggaccactgcgaccaaagagagcacagagtcaaaaaccctggagttacgtttcttccacagttgccatgagactaggaggactacggagtcgaagctggcacagagatgatcaggtaaacaagccctagaagatggccaccaatcctgtagccagctgccacggaggggagagagggcagcccagccagtagacgacaacacccgtaaccagacctgatgagcgaacacgcagtcaaggaggatgtggttcgccgtctcaagctcttgagcgcaaaaggggcaggccgagtggctatcaatgccgcgcttctggaggagatcagccgtccaacagcgctactgaaatgcaaaccagaggaagaatttgcacttagcagggcccttcgcgtgccagagaagatcggcacaagcaaaggagtgctggccaaagaagaacgcctggtacgccgaacgcgccgagtagcgctagtcactcgtccaacgccagaaaagacgatccccgacacccggcgtaagttgaatgtggagcaccgcatcccaaacaagaagaaattgggagatgaccgggacaatgagggcgccgcggatgtcagaaatccaggcgttgtttgctaggccagaagcaaccttgcgcgaaccatgcagacgcgggggcacagcgaagaggagatccggagccaaggaagctaccgagcggccacagatcgattggtcagaccagaaaagaatcgactcaccatcacctggtacgaagaaggtggacgcctcaaacatgtcagagacggctcgctcggctggggccttcaggctatcccagtagggatgccctgagcgttggagccaaagccagcgaacacgcagggaaaaacctgccaacctaaggtcaggaattcccaacccaccgaaagctctgggacgacagacattcgtccaagaaacccgacactgcccaccgtgagccgagtccgtgcccgtccacaagaaggcacgatgcttcttgtcaatggccttgatcacccaggctagaaggccgatcgccatagacacatggaccggaatggaggagataatagattggaccaaaacagagcggccggccatagtggtgagtcgtcccttccagggaggaagacgatgggaaaccttatccacaagcggctgcagggccgccttcggcaacttgtgaacggatagcggaatgccgagataagaacaaggaaaatcagagatcgagtaggaaaagcaggactgaactagctccaggtcttcagccgaacagcggatcggagtaaccgaacacttggcaaagttggtgcgaagtccggacggtacaccaaagacagagaggatatcctatgtagtcccttgatttattgcaccctattttcatttgaattttcatttgaagtggcgtttgaatatataagagcgtacggaagcaccatggcaacaacatggatgaatccttcgccgatcgatctctccagtcgatccatccgtgcacatgtcataacctaaatcctcacggcaaccgagctcaaactctgagacaaaggaaaaaagagcgaccgagtgtgtaaaacaaacacgacacgtccttccgaccttctcccgacgccacagcacaacacaccctttgcgcgactcccctacccatccacctcacccggccacacgtgtcacgccctcccgcacgtgccgcgcgccccccgacccgcctatatacgtgcaccccatcccgagctcacctctactccagcctcgtgtcagtgtcgtggcgtgtgcaagtgcaagctagtcgcagctcgcgcgcggctcgtggacagttgaggcagatagctctaggctctagcccagccatggctgcaccggtcaccttcgccgtggtcgcggcggtggcgctcgtcgcgctgtgcggcggcggcggcgcgcgggcgcaggacatggacaacgagtgggcgcggaacagggggttctacggcggcaccggcggcggcgtggtcggcggtctgctgccgcagtcggacgtggacctgctggagttcccgctgaacctggagtacctggaggcggagttcttctgctggtcggcgctgggctacggcctcgacggcatcgatgccagcctcaccggcggcggccctgcccccgtcggtgcccagaccgccgccctcacccccttcgtccgcgacatcgccacccaattctgctaccaagaagtcggccacctcaggtaaaaacagcggagatgcaaacgtagctcgatcgaaccggtgttccacaagcgtttgatcgattttgtgttaatttgatcgtacgtgcctgcagggagatcaagcagaacgtgaaggggttcccgcggccgctgctggacatcagcgcggcgaacttcggcaagatcgtggagacggcgatgaacacgacgctggacccgcccttcaacccctacgagaacagcctcaacttcctcctcgcctcctacatcatcccctacgtcggcctcaccggctacgtcggcgccaaccccaggctcctcacccctcaggccaggaaggtaaagctgcacacaccccgatcgacacacgcgcatggcacatgatcactctaccaccatcgatcacgcacacagcatgtacgtgcagctggtggcggggctgttgggcgtggagtcggcgcaggacgcggtgatcagggcgctgctgtacgagcacgggctgtcgcgggtggcgagctacggcgtcggggtggcggagctcacggcgcacatctccgagctgcggaacgtgctggggaggaagggggtcaaggacgaggggctggtggtggcgccggggcaggggccggaggggcagaccgtgggcaacatcatcgccggcgaccgcttctcgctcgcctacgaccgcacgcccgaggagatcctcggcgtcgtgtacggctccggcgaccccgccaaggccggcgggttcttcccccagggcgccgacggccgcatcgccagagccttcatcgcctagcaagccggccgaccgatggaagaaaaaggacatagatacatcggaacacatataactcatgttcttgcaagctgtagactatctatacaccttacatgtgtgtcagtgtgtgttttgttatagaacttgcatggataaattggggagtgtatacatgcatactggatggtaatatcaataataaataaaggagacatttacaaatttgtcattatgtaagaatgctactcgagtaatagttctagtggtaattttatactcctacttcctaaattgatcatcatgtaatggaattcaaattttcttaaattgatcattatataaccgcatgtaatggaatgcaaattttcttaaattgatcattatataaccgcatggatacggatttcaacataatacaattaatacagcagggaagaatttatgtatgctaaggtgtactattttacgacttcctttacgagcacggagggagtaattggcaacaatgttttgatcgatacatgcattgtgagagaatatgtgcatgttgtcttgattgatgcgatttaaattattcttggtatatatgatgctcattttaggaacgaggaagtaattttctagtgacaatcaaaccaatgataaatttgtaattgtaattttcccttaataaatgggacaatttgctaacaaatttgatagctagacacatactattttctttctattcttttagccgtttctgatgttaagcctaacgttctgcagtgcccttccgacattggagttcgatggatcaagccatcggagaaatgaaagaagacgaagccgcaaagggcgaaaattgggcctgttgtagtgttgtgcgattggcccaatttaaatgggccgcacgtagccctcaatcccgtttggaataagttcactttgggtccctctatttgtcgcccagtccgattttcgtcccttggccgcaaaaccgggtacgacttatccctcaacttacgaaaaccgggtaaacgaggtttctcggcggttttgaaggcagttttggctgacgtggcttgtttgactaggtctttgtcccacatggtattgacgtggcgcttacgtggcaattacatctcgggaaaaaaaagcgtggtcccacatgtcagctgcacacaaaaatatttttaaaatggtggggcccacgtgggccccacatgtcaacctcacacctctcttcttccctctcccttctctctcttcttccttccccctctctctctctccttcccgggctgccgacgacgcgggtggtcggcggagcaggcgagctccggtggcggcggcgggcatggtcggcgccgccccttgaccgaagcacgttggaggcagaaaaggtttcgagggaggagcagttggagattgcgtcgggggcgggccatggctggagggggaggttgtctatgctgagatactgcagtgaggtgaggccaaggaggaagtcgggtggtagggaggtgaaggcgttgccgtcaagggcgaggcgggtgagggaggccatcccggcgagggaagggacggcgccggcgagcgcgtttccctggagctgcagcgcggtgagcgaggtgagggaggagagcgtgggcgggagcgtgccggcgagcaccctgttggcgaggttgagctccgtcaccttccccgacccgccccgttcacaggtgacagcctcgaagccgcacacgttgtcgccatcccaccctagggccgggaccgacttggctaggtcgtggatggcgtccgcttcggaagccaactcagcgacgtcggcggcgcgctatgatgaggaggagggtgagggttaggaggtgggggatttggggcggagagagagagagagagagagagagagagagagggtagtttgggaaggaggaagggttggtttggccgattccgacgtcgcggtgctcgccgactccgaccgcccggcgcgcgcacttctccggtcacccgccgccaacgccgcgctgtccgcggcgctccggtcgggggcggcaccgaccacgcccgccgccgccgccggagctcgcctactccgccgcccacccacgccgtcggcagcccgggtaggggagagagagaggagggaaaggaagaagagagaagggagagggaataagagaggtgtgaggttgacatgcggggcccacgtgggccccaccatttaaaaaatatttttgtgtacagctgacatgtgggaccacgctttttattatttttccgagatataattgccacgtaagcgccacgtcaatgccacgtgggacgaagaccaagtcgaataagttacgtaagcgccacgtaagccaaaaccgccttcaaaaccaccgagggatctcgtttgcccggttttcctaagttgagggacgggtcgtacccggttttgtacccggttttgcggtcaagggacgaaaatcggactgggcgacaaataaagggacccaaagtgaacttattccatcccgtttggacttccgacaactaaacaggctgcacataatgggtaaaagtctactttacatccctcctattgtcgtcgagtttcagaattgtcgctgaacccgaataccatatataatgcatcccagatctttgcaaaaccgtttaaataagatccttcggcagtatgaattcgctaacgtaacaaattgactcggttcactcacgctaagtacacgcttacatggcaaaagcaaatatggcccacatgtcatcatctcctctcttctctccatcttcttccacgcaccctggctggcactgcttgacactgcggaataattaattatttaccactcttacatgtggtgataaaagatttgtcactgaacccacatttcatagacacataagggctcatatgttatagacagcgagtgacaaataattaattgttacatcttaaaagtggcaaaaagttaaatgtccccgacaccgcgcttgtggacatcacttggcttctccgcatctcctagctgcactccggcggcgatgatgatgacgacgacctgcgcgggccccccaacgtcgcgcggaggagagcctcgtagcgtcgtgccttcgcaacatgttctagacgttgggggcgtgcttcctgaggttgaggatggcctcctggaaggtgccatacatgtcggcgaagacgaagaagccgtcgagaagggaggaggcggtagatgagctagtggtttgggcgacacgcttcttcgggaggaggagcaggttggcaagcgcggcgtggagcgcgtggaggtgggcgaggcctgcggggcggtacggccgtgttggagagccagaagagaactgttgtgatgatggcatggaggtgggagagcaacgggtcggagcgacaaaggaagttgtccgagtagccaaggagctacgaggcagcgaccgtgcagcggccgacgaagttgcagaggaggaagcccgagtcgtttgctgacgggccaatggtctctacttccccaccgctaccacaccggccttcctcttcctaccccattccagtaagctgcttgccgacctccttcatcgcctttgtcaggcatgtcacacgttgatcgccatctcctcgccccatgattgactatcgagccacaacccgggtctcctcccagtgtgcgccgcctggctgcttgtgctgcatctagtccccttgctacaatcggtgttgacgtgtgcgccgcatcgagccggcctgctatcctcaactccgactagtgaggcagtgaccacaccgatgatttcctccagatgcgacgaagctcgacaacactatgccgagctccaactgtcgtgttgtttgcaggccaccaccctcgcccgacagcgccggtgttgaaacaggagcagaaggaaactaggcccgtgattgggtgaaatctgccgcatcatcaatgatcttcggcaacagtagctacgggaaggcagcagcagctgcagtgactggtcgatgaggagggggtggtggggagagataccaggaagaatattgttttaatgatacgtgggtctcacgtggttttgattttttttttaatttttgcttttagtaccacgtcactcaaaaccatcatctatactgccttggacccaaagtgacccggttttgaatattaggaatgcaacatatttggtattctagtttatgaatgattttgaaactcgacgatgaggagggcctcacgtgaactttttgccacgtaatctgtaatagtaccactccgggccaacaataacgggccgcgcatcatccgtaatccctttccagccctgtagttgttagtgggccgtacgcccccctgaaccccattggggccgaatataatggtctgcacatcttgaacctcgttctttgagagtttattaccgctatgtacccattcatgcactgatagaaaagatcctactactcggctcactagtattcatgtatgaatccagccacccaggcctgcaatgatcaacgattgttcttctgccctcaggaacagccacaactcttacagtctcgcgttactctcttacgtttcgagacgtatcttggtcgcttttgttgcgttgttatcatctttcgttttgatttatggacagctcctgccagaaaccagagttgctggcttctagaatagcaaaggcagcggcacgcacggaccaagccagcgattgattgtctgatgagcaaagcaaaggctggaagtgcatttcccctcatatgaacagggcattttcttcaatcagggaaaaactttcaggacaagtagtaggcttgacttggtcactttgttcgggtacaagatgctcacattgaaaagtcgatctctgaaggactgaaagcgaccaacgcgtagaagagagattctctaggaggaagaagcaacgatgcggctttgttggtaagagctgcctgctatgcaagccttcagaaaccacgcaagagggaagtggttcttagttctattgattgacagtttttctccccagagggcatatgctggattgaactatgtaatcaagtattcaagttgtcaaccattcagttacagtactccctccgtattttaatgtatgacgccgttg

SEQ ID NO: 68299 - DNA, 13025 bp, Oryza sativa
gcggcggcgacattcacgctgctcctcactgggctcctactgtggtgagaactgagaatgggatagatctgctgagttaaacctatgtctttctttacactaggtgggtaatttgattgtggtttctgtaatttaattttttattttttattttttttacttctctctcttggtgatttatgtatcgatcaggtataagaaaaaattgtaccaaactgtaaaacatgggcaagtaataagcaccagtacagttgtactactacaaatagatggatctgctgattaaattttttcgtgccaaagaaatactatatgttcactttggatcatctggttgtgtgtcggtaacaatgtgcagccacatgtcatttcaagccagcttgtctctttacaaatgatagattgttctgcaaatttttaccggtgattgctttgcatcagcaattcagccagcaacttctgaacagataatgtttctgatctgagcagcaactaataggcactttgatctgagttagtcagaaggatcaacactgtttcttctttatcgttttatttatggtttaatcaagaaaactttctctaggagtacttgaggccaaaactctaccagcaagatattgtcaggaacaaaatgtggatgctgataaatctgaacaactgacgcaagaagtctctagttctggaacgcacaatctaattgtaataactctgcgcaaacgatgtgcagtgtgcgtacaacagtgtgtttcccagaagcaagagaacactcatctcatgcatatgcatccaagaacataaattattgctcttatccaggaaaaggcgaggatatagaggaaaacaacaacttgtacagatcatcgatgttgccgtgtacacgcagaactactatattggagctttttaaaaggtttacgtgtataaattataaaaccgaggagaaaaataaacaaaaacagaaaaagtagctttatttatagctggaagctcgatgcatcattttcagtttcgagttactgaaaagagaccgtaactagaaaaagtgatagaacgaaagtggtaaggttcaaaaggatctcaaagtgggcaaaagtaaacttgtgcggcgtgggttcgccaacagggcggagcttgatttattcggatcttctagggctgacaaacattggttcctgctttgtttctactagaatcattaacggtggcctaagggcaagttttataataagagcaggtacaataataaaccgtatgagatccatgtagaattttttgctgcgctagagaagagaagggaaggtagagagaacgggcgggcagcccgaggtcatggggcccgtagcaatggtaggaaagtgataccgtcctcgcgtgcgtacatcccgctgccctcacccgcggccaccatagtcctcgtatgtcctccacggccgccgttgttgcccgcgtccatcccgccatcctcgcccgcctttgctgtggccatcgacctcgtcttacgcggccaccgctgttgcccgcgtccctcttaccgtcctcgtttgcatccgttgtgaaatctatcctcatcctccacagtcgccgccgtcgctcgcgtccatcctgccgtcctcactcgtatccgctgcgcccgccatcttcatcttccacggccggcgccatcgcccgcgtccatccctctgtcttctcctgcctccaccgcggcaaccaccgtcgcctgcgtccctctcgccatccctgtcttctgcggctactgccatcgcctgcgtccatctcgtcgtcctctccctccatggctgccaccgtcgttcgcatccgtcatgccgacgttgccatcctcaacattgtccgtcttgtggccctcgctcacgtcatcgcgactgttgaccttgtccaccgcggccatcgccacctcttgcgcccatcccaccctcctctctcgcagctgctgtctctcgctcacgttcgtcgtccttgtcctccgcggctgccgccatagcttgtgtacactagatcgtcttcgccggcatcgtcacccgtgtccaccgcaaccgccaccatctccctcactctcacctgcgtccatgcatagggacactgccccatcctcaccggcaagaagcgagaacaaagagaactcggaaatagaaggatggaacaataaagaaaatagagggaaaagatggtgaggccataaaaataaaaaaaatatttatgttacagtaagcatatgattctctattatatatcttagctataatgtttactgcagatgatgtgcccacctattacagccggcaattggctttgttattgatcttgctctaagagagatgggtgctatctctaatcttgaccgtatcatcgactcataaatataaatgcaacatgtacactactccaatatttatttgccagtctactcttactctcttttcttttgtcttgaatttggtgtagaggttgtctagggtgacttattatctctattctctctcatctttttctctcttccacctcactatgtaaacttatgtggcatccagaagattgtggttggatgcttataatacttgccctaagctcttatcaagaagtccaattaaagattgcaaaaaaaaagaagtccaaataaaacaaatggaacttggtgacattgtattcccttccttccaaaataaataaatttaaaatataataaggtatttcacattacactgaatttggatatatctctatctaaatttactatacttgaaaatttcacatcatatattaagttgatttattttgggacgagagagcaggcagcagcttgcaggcagaggatgaggcgctggttgcaggtttgcagcacgtcgaataatagctatccttgaggggattcggtgagttgcacaagtttggacggccgctattgatattgcatctgaggcctcgtttagatctcaaaatattttgatcaaatatttgaacacatacatgaaacattaaatatgggaaaaaaattaattgcacagtttacatgtaaattacgagacgaatcttttgatcctaattacaccatgatttgacaatgtgatgctgcagtaaacatttgcaaataacggattaattaggcttaataaattcatctcgcaatttacaggcggaatctgtaatttgttttgttattagtccacgtttaatactttaaatatgtgtccgtatgctttaaaaactttacacccaaagaacttaacacaccctaaaccagcagacttgggtgggtctagctctctctatgtcaaattatcagatggatgtggaacaaaacctcgatatagatatcacgaatagtacgtggcctatacacctcaacaaaagaatcttgtctctaagcaggaaaataaacaatcgatagatcgattcgttggcatgaattatctgtaaattttaaaactttattttccacgtacaactcaaaccaaatttggggagaagaatcggagtcgggagataaagcacagtaatatcataacttaacaaaagtgaagaaaaccttatataacagagaacaaatcgaaatcagataaactgagagatatgaaacatcctttgtgacttccatccagtaataatcagcaagaaaaacacctgaactccaacaagaaaaatacccgccgatttatcacctaaagtttggcttgggtttaaacctgtgtttgattgtaaaggttgggaaccttctacttcggcatgtaaaatgggacagcacattaacgtgtaaattaattaagtattaaaaaaacatgaaaatggattagtatgttttttaaagtaactttcctatatattttttaaaaataaacaatttagtaatttggcaagtatacgcacggaaaacataggagtggaggttggaaactagaagaaacactcagccacctctctcaaccttacaaactggatgacttaagatgttttctttttagtacctagcagtacatatcataagataaattgggaaattttgatttcatgttggccagcatgctggaggtgtgtgtatttgaccactagacttttcggcttgtgttgctccaaacgacacatctacatattagaaggaagggttctgaacccataccttcgaacgaacctagtgtgaactgaccttccttccttctctcctcctccatatttccacggcctccttccaaccactgcaactatataccctccttaactgacacccctgattcaggtggtgtttgggtgtccctctcacaaaaaaaaataagtttctagggagggactcacccaaaaaccccctcacccaccccctctgtctttaattcctcacattgatggactagtcattctcatgtcatgcgccaataagcatgctcatcttttttttttttttgagaactagcatgctcatcttgacgctgcactcctctagccttcctttgaactggcatcggttgtactctgctgtcttatataattggccttcccaatctagtccttgctgaataggtgctaaattggcattcagtgctgctagtgcctggatttttggcccaaatcacaataatgtttttctaccttttgagatggaacaaatacgcaactggaaaatcatgcataataggcagaagcagaattcaaaagtgatcataattgataaacgcgcttctcttgaagaaaaatgataatagtgctgggctgggctttgatgcacctccattctcttccggaaaaagtacaccgaaggtccctaaacttgtcatcgagttataaaaagttaaaaacatcctcaaactgcaaaaccagatatccgacgtcccttaattaattaaaaccgatcacaataggtcctttgatggttttgatcccggttttgtcctacgtagcggctgagtcagcgtgggacccacgtggccccatatgtcagggtccacgtcatctctctctctctctctcttctccttgctcactcgctgcaggagggtggctggcagacgcacacggcggcggcctactgctgctgctggccaacgccgccggcgacgttattcctgggtcgcttcctccggggcgcggaggcggaggagttgtcgttctcgggcgaggaggaggagctcccggcggcggcgccgacgttgccgtagaggccggccatgtcgcggtcggtgaaggcggcgggcacggcggagagcgcgtggagggagtcgccgcggaggacggtgtcggcggcggcctggcagaggtcccagtttcccgtccacatgagctcgatggcgccgctcagcgacggggatggcgccggccggggcgcccacgctgctgaacctcttcagctgatccttatcgattgagagctgtacgtaattgtaagctaattaattaaagttaatttctagtagcaactgtgcagagaggttagggttcaatcgatcgatcgccaggtcaggtgtgtggtgattaattatattagttgcatgattgcatctgtgttgatcgccaggtcaggcggcggaggcatgcgatcttggccatggcctcgtcggccgcggacgccgcctctccttctccagctcctccagcacgtcctccctccgcctcccctcggccgcgagccgccgcctcagccgctccatgctgccgccctcctccgcgccgccgccgttcgcgtcaccggccgccgcgcactcatcttcctccgcgtcagcctcctgctctagctcggcctcgtcggccgcggacgccgccgcacgcctctccttctctagttcctccagcgcgacctcgctccgtctcccctcggccacaagccttcacctcagccactccacgctgccgcactcctccgcgccgccgccgttagtgtcaccggccgccgcgcactcgtcttcctccgcgtcggcctcctgctcgagctcggccgcccgccggcaactcctccccccaccgccgccgcgtcgcccgtagccgccatcaccgccgacgccgccgaggcaccgcgggccttgcagagcagagaagggagagagataaggaagggagagaagagaggaaaagaaagatgatgtggccacactgacatgtggggctatgtgggtcctatgctgactcagctgtcacatcggataaaatcggattcaaaaccacctaagaatctaaagcgaacggttttgtaagttgagggatgtcatatatttttgcggttagggtacgattctgtgactcaatgacaagttgagggacctttggtgtactttttccttctcttccccaggaccacattctcagaaggcctatggaccgcagcctgaggcctgccaactgctcgcgagccgctgcttatgggctgccgtgtacttctagccgcggcttacacgacagcccagtcgaaccggcctctacctgttttggagctctccttttttttttcctatcttggataagagcatcaccaatagcatcttaatatccggtaatttaaggatttgtattgtcaaaaatcttttccaactaattccctaatcacattcccaatattttctattttctatcccgcaattgttgttctccacatctagggatgcactttggctcccaatcacgtgagcgaacgtccttttagtttttgggaaaccaatcttaaccaatctcttcgagagataaaaaatttatgacctcaaattttatttaggattcccataactaaaattttgggatagatttttgagatgacgaccaacagattacctataatctttcccaaaaaattgtttttggtttcctaaatgaaaataggaagtgaaaaaactcctccctttaacagatagcctaaattcaatccccaaaacttaaaaataggcaattctgttaaactatcaatagaaaattctatttttttcttacacacgtagaaagatcgctatctcccacgcgcaggcatggaaggagagagacgggagtgcgagattaggagcaagttccgcgcccgcatataaacggagcgaggaatcgggagaagggaactccaaaactcgggtaggagagtagaggatctgttggagctgtttttttatgctcagagaatcattctactccattcccaattatgattttgaggaatttaatcgaaaaaactactacaacaattccctactctccctctcaaaactcagcattcccttttcctttatattctcgctctccacaagtcagatattgttctcgatcccaatttccgtctcttaagagaaactgccactcgagaagacgagcaggatggtgacgctagatgggcgatcacggagccagatgacacgatctaataaggcacggatgaagggaggtccaccttttattttagggaattaaatatagaccatctattggaaggaaataagtttttaattgataagtcttcatcaaataatctcaaaaagaaatttaggaaagagatttttagacataattacagtgaaatggaagtcatattgatcttttggtcatttggagaagacatacattctctttaaaaaaaattaaaatcactgacgatatcttttctgattaagaataaaaagaagattatcgagcatatagattttatcttgaattttattcgcacgcttttaaactgctaaatgttaaaaaactttttatatagtaatttctctataatattagacaaacgcatttttaaatttaaaataattaaatctaattcacttactaatagttttttagtttgacatacatatacttaatctctatctttagcaggctgggccatagaccatttctgttaaaaaagggaacatactctttatgtcacatgaaaaaattaacctatgacaaaatgtgacatcttacaataaatttagatataagtatatttaaatttattatactagaagtatcacattttgcagagggagggtctgggagaacaagctagctactccgcagaagaaaacatgggccaatttttatagcacggcagcaggaacctcctggagctaaagctttctcttctttttttttttttggttttatcttcaccaagtgctcgtcgctgttgatatacacccgatgtaactattcatcttttgttggtgaaatatcgccaagccacttcacttcactgacaaaaaaaattctcactctagctagctagctagtgtcacttccggtcggtgcaggcaagcaaaacgtgcacaattcctgcagttcaacgcgaggccggctagatagctgaaatatctgcagtcaatctcgctgcatgtacttactaggtccgtttcaaaataattaaggtggtgtttggagccagagagttaactttagtctatgtatttagacactaattcagagtattaaatatagactacttacaaaactaattacataaatgaaagctaatttacgagacaaattttttaagcctaattaatccataattagagaatatttactgtaacatcaaatagcctaatcatggattaattaggctcaatagattagtcttgcgaatcagtccaaaattatggatgggtttttattaattgtctacgtttaatatttataattagtgtccaaacatccgatgtgatagggacttaaaagttttagtcccatctaaacagggtctaaacttgattaaaaatttagacaagtacttaaaatggttacagaatttgattttttagatgaatggtatacgtacgcaggatgcctgctggctctagtaactcgttcgtatacgtggatatgttcagatatgaactttcggccgcctacagcggcgcgcgatcgtacgttgccgaccatcacatcatcctctcatctcgattgagttagatgctgtgatattttacgtctggttgctagctaaagtagtggcaaacatatgcatgtcccgcacatgcgcaaatcgcaattgattcgcagacgattgcatcatgtaacacgcagaaagctttgggtttgaactgatgaaggtatgttcacaagctcagtgttgggcaggcattctgttttttctctctcgagaaatcattcctctaattgagtacgagagatttagtaaaatatgcttcgattatttaatatcctgacttagtattttttttaaaagatacataggaagacacacaaactcacttcatactcacgccacaccacatacacacgtgcacgcgttcaacacatgattagactagagacttgaaggacctaaagccttcggtgtgcgggaaaaccgccaaccattttaaccaaaccccaaggaaaacccaccccaacccgggttttaaaaaagggggttggggtggggttaaaatttcccccccttcccttttcttttaaagggcccccgggttttaaaacccgcgtcgttcaaaattattgggttcatgcggactattcaaaattttgattctatcataaatttttaaaacaattacaaaatcataatcataagacaagtactattttcaaaaatgaattcaacatcatccataacactcatcttcttttctcagctcgcgtcccattcctattatctccgttctcctcctccctcccttccttgacgactttaccccatagtcgccgtcctcctccctcccttcctcgactactccgccccatagtcgccatcctccctctccttcccttcctatgatcccatctccgatcgccagagaaccaatcgatgccttccctaatgtcaacagtgtcttccatcttttttccccttcactcaccagatcagagggcatcaatgagagtgtggtggacgatgaggttatgggaccaccgaaattggtgaggtcagcaaagaggaaggcaactacggtagcaagatcgactgaggaggaagaagagagaagaagcaaggtatcaaacctcatacctcgggtatcatccatgataccccgtggtatcatccatgatacgtacttaggtaccaaccgatacccatagataccaggttaccaagtaccaggtatcaggtatcatgtcgtgaggaggaagctcgggccgtcacccgcctagccggtgggtgagccatttacctttgactcctattttcttccccctttctcccctcgacacactacatcctctcctattgttgatgacgttcacgagggaagtagtcagctagcatagctgcgataccaagcaggctcctggctggggaagacgccatcggcgtggtttgctcggagtagttgctgcagcagcgctccgagccagttccttgctgtcgacagctgtggcagaggaggaggcaaaatcacgtgaacagtgtgagggacagattatcaggtgttttaattatcccgtgactttcataatgccacaggatcccgtgcggtagctgccctctattaaaaaagtatctaaatccttataaggtaaattagattatcaaaatatataaacaaaatattataaaaatattttctgcatgaaaggataatttatctaaagaccacactcctataccttacatatcatccaaattgacatcaaaattatgaactaattatgcgcatggatttatacaccaatatccatttacacctatgcacaaataacagatagactgaggaaacatatacttatatgatgatcatttgaaaataatttcaaaaaagttatatgacgatcgaatgggaatggagggagcatcatttattttgttgtgagttattttatcaataaaagtactttaagtatgatttatatcttatacatttgtacaaaattttttgagtaagacgaatgatcaaacatgaatcaagtagaatattaaaaaacggacgtagtatgaacattaacaagttgggatcatgttcatcctttatacacatgaaggataactttggaattattttagattctacaacataccaaatataagtaagttataggaataattaaagtaaataccagtacgctagatcatatatggcaactctgacacaagttttgcagccatgggcatagatatagtgactaagacctacaagagattaaccaccaatcaatatgacaatatccataccagacatggaaatttaaaatgaattagattggattttcaaaccctaaatattttctaatgaaaacacgagatgggaggtggaggaatagagatagggtgggtgtggaagtgggggtggggggagggagtggaccagtcttgatgagctaagaataatactaatgtagtaataaaggttatcaggaaagaggtgggatatcatacgtacaatcagtttagttgggcttgagcattaatttttgtggacatggggcacatggactatgagctacaagagaaatatggcaacgagcaattctcaagtaaacatttgcaataaatttgtttagcctttggaacacaaaatttatttccgcacaaccaaaaagaggggaagggatgaatgaggtgtgattcgtgtgaagggtgcacaactcattcttgataagctacaaacaatttgtactccctccgtcccagaatataagaagttttagagttagacatggttattaagaaagtaggtagaagtgaatggtgcagggttgtgattgaatgagtagtagaggtaggtggaaaaagtgaatggtggagagttgtgattggttgggaagagaatgttggtgtagaagttgttatattttaggacaaatcctacaggctaaaagttgttatattttaggacggagcgagttttacattaatttattatacctacttttggaataaactaaaatgcaggccaccacattcgcacatgctatcttctagtttgcatcataagcaataaacggtcctgctattcatcccaaggaaccatgaaaaccagctaacaataaagccctcaagaatatggagcctactatcatttcaagctaggacaatatcaggttatatattcaagtgcttaccatacaatcatgcagaacatgaattctcgttttgttttttcttctttcttcctccagaccttctctaggacaatagcttagcttggtccgtctacatgctcttcttgtctattgaatatatatatttttaccgattttatagaaatatacacgtttaaaaaaattggcagaagtataccattatcgcggtgtgtgtgtggtgggggggtggtaattgaattcgcatcgactttgcacggtgaatgcgcaaactcgtgatgtcatcacgagtttgtatgatgaatgcgccactacgtgcaaagaaaatagagagaatctattctataccactgagtttgtcatagtttaacaatttaccattgactttgtctctttctacaatataccgacgactttatcaattgttctacaatacgacattgggttgggcttatttttcaacaccatttagcaattaattaagtaacaccatttagcaattaatttattggccgtagtttatttaattatcatcgttagtaattaattaacaactgattcatcattagcaatggaaaacaacattccacattacctccatccatgcgaactcgtgcgtgcggcagcaagttcgtgttcccacttagcaacgacggtatatcggaattttgttataattttttgaaaacgtgtatattcttgtaagaccggtgaaaaagaatatacctttaaaaaaaaatcttgttgtcttagtgccctacttttattttgcttttctttgctcctctttcccatcgctcggtccttccaattcactacaccagatcctcacatctctgacgggatacctgtgacgggcaaacgaaatggtcactgatgaccgtcacctctgacaggtcatacgggatgccgtcatcggtgaggcatccggctgctacccgtcacaggtaactagtcacctgtgacgggttgaaaatagaacccgtcacaggtgaggttacctcaccttaaatgggtttaagtcctaacccgtcacagatgactagtcacctgtgacgggtcgcagccgg

SEQ ID NO: 68300 - DNA, 711 bp, Oryza sativa
aaaatctgagtaacttcttgggtaaaacttgggttttacaaaagacttggaaaacccgacacctgggtcggtgcttgtgaactaaatgaatttccaaaaccgcggaccggggaacgtaccgggtgtacggtttcccgctcttgcacttaaggaccgtttccttggaatttcatccgaacataggacaagtacgaccacatgggtggaatgggacacccctggctgagtaactagcttatcaggggagccttgatgccgagagacatgtggattcgccggggtggtgtcggggaggacccccgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccataagctaggtgatccgggttagtaatgtcgtgtgggtaaagtgtaccacctctgcagaggttaacaaactgttcgaacagccgtgcccacggtcatgggcggatgtgaggtgattcctagcgtagttttgtttgactactgccttgtgaaatttgctgttgtggaaaggggatcgatgtttggaaaatctgcagctgatgggatcagctaggcccgggtggccgtttgaaggttgttggcccgggtggccgtttaaaagttgttggccc

SEQ ID NO: 68301 - DNA, 643 bp, Oryza sativa
cgccatccttcattaatcagcaatcaacgtattatccttctgagagtttgaattttagtgctgtggttggttaatctcctagattataacacccagatttcccaaaaagagattaaaagaaccagataataaacatggaacttataaaaacattgcaaccaactcttcaaaggcttgtttagattacacgtgatgatgtggttcttgcagtacccgcagcagaaattgatggtttcttccatctcatcagaagggaaaactgcagatatcttaatcacaggttcaaatctttcgacatatttcttcacagaagcttggggatcgcaggtggcaggcaatttggggatcccatgacctggttcaggataaacagaggtggtggttacaggatggcaacaaaataaaatatacaattgaaccagaaataatttataattgaatgggaactctggttagagctacatttccgtatgataaccaaacaattctaccatttccaatggagaaagccttgtgaagaaaatattaatatggctcctgtgtcaaccaaattcactcgtcttcacgaagacgtcaaaagttaaaacctcatctcactccttggtcggaaccatctctttttcaaaatatgatctttcatatt

SEQ ID NO: 68302 - DNA, 593 bp, Oryza sativa
cttcagtgcctttatactcttgccaacgctgtgcccggctcctcgcttctcgcgccctctatttcgccccctcgtttctcgcacccacgcttccactaatcctattcgcccgcttgcggcgcatgaggtggatatgcggttgtggcagtcgagatagatcatatcgtgcgcgcgctaattacgctcgccgaccgaagcgacgttaccatatctccagatgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggccttaggagtggcgtcatgcccgaccgtttcccttaaagagggcgatcgccctggcataacgccgggggctactgtcggtgacatgggatcaggagtatcatgactggaggtttgaggcagacacaatcgcacacgtggcctggcacccccgagggacgtcgggcccgagggtgatgtgttcgccctcctcttagtccccccgagggggtcgg

SEQ ID NO: 68303 - DNA, 18753 bp, Oryza sativa
gtggtgggcgccagatccggtctccaggtggttggggaccaccggatctggaacccccgggctccgactgttgcctccttcacacttcgccaaggttgccagtcgtcgcctccttcaccatccgagctccttcgccggtcgccgcctccttcaccttcttgacgtacgagctcagatccattgccagcaagtcctctttcacccatgtattttgtcttgtgttgttcatattgttccaattgttgctactgtgattgatgattctgagtcctatggtgattgagattcttgtgattttgttttgtgattgggacaactgcgatggaattgtgacgatttttttgatttgtgaatgccaaatgcaatcggttgaaatgaatgtgatggtaacctaggaggacggtgtttctcttttttttgccccccttttatcacaccagtgacggtcccaattagttgggccgtttgaggtgactctcacctgtgacgggttttggttgggaccagtcagaggtgactctcacctgtgacgggttttagttgggggccgtttgaggtggctcttacttctgatgggtgttcacccgtcacaggtgactcaagtcatcagtgaccactaatctctgaccgggagctgaacccgtcaaagttgagggtttgagcccgtcagtgctgacctgatctagtgtagtgattatagcttcaatgacctccatgaggctgtgccatggcgcgattgtaaagtggagggggtgtagggagaaggacgtgcggagctaacaaaatgagcggccactaatataatatagctgcatcgtattaagagaacatggcactacggctgcgttcgggaacctactctctggcacgcaaaacggagcagcgattagagcgtgatcgtatttgggaacaccattttcaaacttttaaaaacatggcacaaagtatttgctaattttttttcaaaaatggattaatttgatttttttaagcaactttcgtatataaactttttaaaaaaaacacaccgtttaacagtttgaaaagcgtgtgcgcggaaaacgaggagaaggagttgggaagctggtctgccgaacgcagcctaatacttgtgaattgtgaacagcttactggtaaatgaatgattgaacacgtacaatattatagtacttttgcaaatggtaaaatcaaatgaaacaaaaaggggcctgagcttttagaaatggagggaatttccaagaggtagctagagagataggcatggctcttttgcctttgcatcaacgtctagcactgtgaaaccgataggaaaagcaaccttgtggcaataattgaggctcgggcgacaaaaacttacgtaacggcagcgttgacgcaaagattccccacaagctgatcgagaagaaggcagtacacaagtgacacaccagcagttcagttcaatccaaaggcacagtctcagcaatcatgctgctacgtacgacatgtttcttatcctagctagctaccatgtacaagaaatatccggtggataacctttataatccaaatttcattttgtatatgcaacttttctaatcttggtttacatgcagaatgaaaatttattttgtgttgcaaattttaataatttgttaaagagatgaagttgcgattgaccaagtgagcattatttccccaaccttccgtgctgttacaacttttctgtcgttttcacgtaaattcttcagtccggcaagaaaactttaaagatgtatataatggaagcaaatcaatggacggtaaagaaagaacaaaatttgaatccttagaaacaggaaaattggaggaatacaatgtttgcacacatcaatccatatgaattttttgaagaggctttatcagtggatgaaaaaattcttatgttttctctatacaacttgtaggaaataaaattttcctttggttttccttcaatcctactcactgaatgacactcatactaattaatccttactaatccaaatcctttggttttccttcgaaacgaacaagcccttaatacagtcaacacccataattttatatcatagaatctatcttaaatttaccaattagatttatcttaaaaagccacacgtcaataaaacttccacaatcccttcccatggacatgcatatacataagtatgtaccctcttttttcttgttctccccttctcggatagatgagacggaaaaccaaattaataattcaaaacccatcttaactatgctttaagtttgtaaaagtatgttatctcgagttatattctaactatgtgcatgtcatcaaaacaaacatgaaaatttcaaataaatcaataatatatattatataatcatatatcacttagtgagcccagcgagcccatatgacccgaataaattagaccctaagagcattagtgattgaagttaattctatatcacaatatattcataataaataaaaaatatgaataaatgaaagtaatttttatatttttgacttattataattttagatttgtggtagtaattaattttctggaatatcactaaggttcaatattctctggcacagtttacttgtgcatgtatgtatataaagttataaatgatgatcgacaatacagattatatcatcctatacaactttatcaacaaacatagctaaatacgcatgtgatcttctttaaatctgaaaaatcatacatgtccacagtaaaaaaaagaatagaatttttaaatattagaaaaaaaaactaagtaacatatgccatagtaattaaataaaaagatcactttttattaccgatgttttagtttagaccatcctttaactactgttttcattttggaccgggtaaacttacctttgtttcactttggaccactcgactttcttctcaagtatatgaactgtctcaattacactggtttctacttgtcaatgaactctcatagttatatgtaagactattttttttttggtatatggcaagttgaatgtatatagataaaagaatcaagagtggtccaaattaaagtaccacaaacgtaaaaataccttcaaagtaaaaacattggttaaagggtagttcaaagcgaaatatcgataacaaaaggtgacctaaagtgaaatttacttaaaataatatcagtggctaatctctaggacatataggtatagaatattaattgtaagtgcattaaaagtgtagaactctcctactagatttgttgaagtcactaacaaatttgagataacattagactcttaaaaaaaagataaaacaacaaatgcttaatactctattaagttttagctgtcggatgatttatgtgacttaatttatatgtgtattcaagttatagctaggccatcatacagaaggggaaaaaaagtcatacaagcgtgttatgaaaaaaaaaacatatggatgttctaaaaacttgtattaaatcgttgcaaggtgaatagaatcgtagagatgataactagcatcaagttgcactaggttgctagccaaccaatcacggcactaagcagaggtcataacgagccacaagacaaacaagcgaagcctagccttgtattgaaccttatttgaactcacttttatatctatgtattattatttgtgccatttttgtttgaaacaggccgtggagtcacagatcgaagaccaaccgagctatagataaatgtcatgggaacttctaaacttcatattaatcagaacccatcatatttagttaatattatcggaattgctataaatataaatattagaaaaaattcggtaccactatcaaccatgagaaaagtagctggagtcactaaaaaaaatttcaaagaataataagttttgtattatccaaagatcccagcttttgtattatatcttaacttgataagtgcaaacagacttccagttattcctccgcaagctaagcaagctttgaagtactaactagatgatgtgagactaactggatatatgaacatcttaccgggactttatttagatcgaaaactaataaattttaatcaccggaaaagaatttaacatttagggtgtgtttggttgctgggcgaaagtgggataaggcggcccggagggaaatattcccctcagatgctggatagagcgatccggccgatttggccggatgcagccgcccgaggctcgggcgagccgggcgagcgagtcgtgtgactcgcgtcacccctcaccacgacgacgcgagcgaggcggcggatagggcggccggcgcgggcgacgagagaggaggcgagcgcggcggcaggagggggtgacgagcgcggcggccggcgagagagaaggcgagctctgcagccggcgcgggcgacgagagaggaggcgagcgcggcggccggtgcgggcgacgagcgcggcggccggcaagagagaaggcgagctcggcagccgacgcgggcgacgagagaggagacgagctcggcagccgccgcgacgacgatgagaatgcggcgacgatgacaacgatgcgggcggcgagcgccgcgggaggaggtggcggcggcggcggccggcgggaggaggcggctggtgggaggaagcggcggcgggaggaggcgagcggcggccggcaggaggaggcggctggcgggaagaggcggcggcgacgtgccccagatccagccgtgtttttttttcttttttcttttttctatgtgtatttataatggaaatagtggtgtaaaattgtatcatgtattaatttgatgggggtatattcaccatctcaagtggagaggtgaccacacctacaaatccatcatactccctccaacccaaaaaaaattggatcaccaaatccaccttcgtccctacatccaaaaaagaaactggatcgccatattcacacaaccaaacaaaaaaactggaccgccatatccaacaaaatatggaccgccatatcctatccaatcttgaccgggaaccaaacacacccttagaaaaaatagaggttcccgcgcgttgtaattgtgtgggctacctagttatcttaaaaaatatgcaacggccatttaaagtttaatttgcatatgttctttaggccgtgcatcatccatgggtctgtagcgctggaatcattttttattgtgcttgtagtaataagtgctatcacaaagaaggagtcgttcttacttttaggattgtctttagcacttttactgtaacattgtcatgaaaacagacaaggaagaggattttggagcacttttactgtaacattgtaatatgacaaccacaagttcttccacttcagtacatcaacgttattcaacaattatgtggcgagacaacttagttgccaacttactggaactaatttttatattattgtttgacaaaccaactcttggtgaaatagttaaagagtttgcccaagactccacctatcaaacttcaattcttattatctaattttacacacacttgccatatggtctacctctatatagcctaatttatgagtactaattagggcgatggaccttttttttaaagggaaaacaacacgtgattatgccttttcattgaatatagcgggagaaaaatactaccttctagagataagaaaagagaaaagctctattcactatacagagtggggcaaaaagtcacgtaaaggttttgctcctgccattgcccaattagggggatggacctatgtgtgctattaatggcatgagtgcttgggttgtcttccttacaattccactaaagcacaaaataaatcaattttgcaaaaagtttataggagtgcagcatgtataggtttttagtatgggagaatatccattacggtcgctgaagtttcgctatgagatcattttagtccctgacctttcaaattgtccaagcaagcccttagattttatcatgtggacatatacagtccttggctcatcgaaaattaccatgtgggcatgccatgtcatctttcgatgcaaatatatgatgaaatgcccaatttgcccttacacatatcatagggaaaaaagagagaaaatgagaaaaatacaaaaaaaaagtaggtggtcttgcatatatccattagagttttaacattgaaatgcaactacgtccatagaatttatttggcatggtaattatatatttagtggttgtagctaatttaactttgtatttataatccagtgaaaaaagtttgccatatatccatagttgtattgagcaaagtttgtaaattattttattcttgtatggtatatggaagggtaaattggacatttcaacatatattttgcatgagaggataatatggcatgttcatgtggcgatttaagtgggtccaatgattatattagctcacatgacaaattataaggacttgtttggacaatataaaaggttagggaccaaattaatcccgaagcaaaacttcaaggatcatgttggctattctcccttttatatcagatattgaccaaagaataaataaacgtgatatgaaaagcaactctatttttttttaaaaaaaaagagagtaccaaatggtgcatttctgaatagaagatcctcccgtacgtgttggcagtggtcaatattaattatagcatcggaatctgtagttgctgtttgggtaaaatttgatagttttggtatcccctaatgtgccacaaattcacactagaaatgattgtgggtacttcctaatactccctcaagataaaattactcaatgaaagtgaaaggtttgatcttctcatcttctattctgctcaatctgaccgttcaaggttcatacgggatggtgtgcatagtactggtgtagttgatgaatgacttcggaggatttaatcttatcatttgaacttccgttttttagagagagtttgagaagcatatactccggcataattttatagttgctgaaactttagtgggcaaccatttttttagtaataacgacataaatatatttctgtgccatttgattattttccctaaaaaaatgaaaggagacaagcatagaccgatgtgactaccacattgaaagttataaaccttatggcataaatctgggaaactcaatccaggaagaattttcctttctgctcgcatatacatcatagcaagtaagaaataaactctactttttttttcttcctacagatgccacattaccgttgattaaaaagagatgctattgttgtgggatgctcccttctaagggaattgtattcctattatgcgatccctttctaaacgaacttataggatatgaaaactttagtcttacttctatacaataagtattttcacaattcttgagaaagtacaccattctttctaatattgatttgcattacctccttgtactttaaaaaagtgctgcaaaataaaattagaaaaaggcggtacaaatccttaagatgatgcaccgctgcacaagtcatctttacctctggttcgtaagtgcctgttctcccggttatacaaccgggagtccaaattcgagactaaagatagatatctttattcccgggtaaaataaccgggacaaaagttgatctttagtcccggtactaaaaagaagaaaagcggcagtcccggttgccacttttttttcattgtttctttaccagatgcgtttttccttctattttcttccaaatcggatgggatctatgcatatcccccaataatcaaatccccaatccctaaatcaaaatataacatctcaaactatatatacattcacatcacagatcctaaaaaaaataccacaaatcaaatacatcacatattgcatctcagatacatacaataaatcacaaattctcaaaaaaaaattacacatcttaatggaatcacaaattgcaaaaaaaaaacaaacaaacgaatcggccgccaaccgcctgctcgccgccgcgcgtgggcctgcctgccgccgccctccgcagtcgccgccgctcagccacaccagcgcctgccgcccaccgccactgcctccacagccgccgccactcgaccgcccaccgccgctcggcccgccgccgccgccctccgtagccgctgacgctcgaccagccgtcaccacccttcacaggcgccgccgctcggacacgccggcgcttgccgccctccgccgccgctcgatctgcaacgagagaaggcaggaaggagaggataaggcttgaaggaaggagaggataaggcaaagaaaagaataagagagtaaaaatagaagatgaggagtttgagaggataagtcatagggattatatatggtacatcgaattttagtccaagtttgtgttatcaacctggactaatctttagtcccagttggtaacataaaccgggactaaatataagatctttagtctcggttagagtctccaaccgggaccaaaaatcccctaggggcctgacagcccatgacagcacatgaaccgggactaaagatagcacatgaaccgggactaaagatgatgttaccaaccaggactaaaaaacacatagttctattctgcttataaactgggactaaaaaccatctttagtcccggtttttattggaaccgggactattgtggtttttggctgaccgggcaaagaaggtttctccagtagtgatggtatatcttgtatgagaaaatatgtagtgaaatcatcaaaaaagtaaaaaacccttaaaaaccgaacctaaaagttatctaaatttgtaaaaacattagtagagatagataggtatagacataaaatacattcccatcaaatcttaattgtgaactcaactttatttggaggataaaaagataaatttctggacagtaacatgacaccataaatttgtctttttcgttcctttttgataaagttgagactaaacttaagatttggtgggaatatatttcatgtttatacgtatatctagtaattatttttatacatttagatatttttttagatctagtcttcacatatttgatagctttttttattcttaatcggtctcctagtaaaaagtagcaatgataacttgacagtttttttctcgaatgtgcaggagagctgtgtaatactccctccgtctttaaatataaatgattttggttaaatgtgatatatcctgatacaacaaatctggacaggcttaatatttagattcattttattagaatatgtcacatccaaataaaatcgcttatatttaggaacggagggagttacttaatagataatcgcattgttacaccattaattaatgacacctttacatgcctgaaaagcaaacccttttttccatactcaaaaacaaaccctttgtttgtctgcataaatccaagggcagacatctccaacttgcagaaaatttctactgtaacatgtactgaaagccacataaattttctattgggtaaatatagcaaacaagaatataggatgaggtttaatcaggatcacatagagagacaaatacttttctttagccaatggggattctccagaagcggatatcctccaccactcaaaagagctcctcttttgaccaaaggagcctccacctagctattatcctttcatgcttttatcttgtagcagcttggccggtcagtggatattcccaccatctgcactctaatcaacgagagttcccaattgcatacccagatgccaactcctgagagatgataaaatctatctgaatatatatataaaccatgcaaccacatccagggacccaagagagtatattttttgactagtttggctggagaaaatgaaatcctcaattgtgtgtgtatggagaaaccgatcatctatgagaatctgtgtgtaattgcctgattaagctcaaacccattatttgacagttgacacacacattatatagtaagataagatgatatacccaaatccgaagatgaagggaaaaaaaatcttatatataactgcaacactaggctagcagctccatcaatttccagctcataaataaatttaccacaaaaaccgtaaagtggtatttccatttgttcaaccaaaaagctttcttcctcctcatcagctttatataggatcttttgggaaaaaaaatgttaacacatgcggcatttctgttcttccaaaaagcccaaataactgctacaatgcccactctccctactgtgagttattgatgattctcactgactcgcacaatgttttggcctaaacttaacattccgacaaagaccacatatatagcaccatatgcattcggaaataccaaaacgaaacataatccagtagtatatcgagtcccatggaaatcgattgaaagcagggattcctggttatcccatggcaataattgcatctacgtactgttgatgatgttcatatgtagaaaacgatataactgaaatgttccccggctgacatcagttctagattttattagattctgagaaacgactgatgagaatctgagaaaaaatagacttttctaacttttctatttctcgtttattttatagattttataagtacatattattaaaatctgtgtgagaatctgaaactatttgtcggagctagagatttattatgaaagagcttctggtttttaagttcgctttttagattttgttactatatactattggaatctatgtgagagtatgaactatggccctgtttgaacttgctccaaataaagattaagtatgagcacgcaaaacgagaaatacattaatacatggttaattgagatttaatgatttcaaacttgagaaaatagatttatttgatattttagaacaatttctatataaaaagtttcacacaaaatacaccatttagcagttaaaaacatattaatagaaaccaagataaaattatgtatcttaataacaaaagagaaatggcctatttaattctgaaaaccactaaagaacagggccgagaaaccttggggcaaatgagacaccagaactgagaaaaccttgccttgcctagaagaacccacttgcgggtacgactacaacataaggaaaagcagaggaggtcatgccgggatggagtaacacacagggcccctcttttcactttccaatgattctttgggtgacccacacaaattcccctctaaatattccatctctccaatcccttatataagtgcaactacttgcatggtccatggctccaagctgcctagcaacaaaggtcttaattaggagctctctccattaggatcctcgagcttcaggaagctatctccaacaaaacatacacattcagatcaacttcagtgatggctgcagaatcagaggtcggtgactgcagtaattcctagaattaacctcaagaatctcttcttttttgtttcacacactgttcaattcagagttgatcgatgtgctaatgtacctgtgactcgaactgtacctgcagacgccgcgaataacagagcttcatgtgaggatggactgcaatggctgcgagcacaagatcaggaagactctgcgtgccattgatggtacagaattaattctcctcttttcttcagacaaatccatctagctcagcctcatacaccctccattttaaaaaatattaaatcctgactatatatctgaacatatatttgttcggattcatggctaggatttgattattttttccaggacgggggagtacctatctgaaaattctgaaattttagcattctgaaaaagtgaaaatgcacttatctgcaggtgtgagcgaggtgtacgtagatgcagcgagccagaaggtgacggttgtcgggatcgccgacccggagaggatcgtcaaggcgatcaggaagaccaagagggtccccaccatcttctcccacaccgacccggcggcgccgccgccgccgccggccgaaggcgaggccgcgccaccgccagccgacgcgccaccgccggaggaagcaccggccgcaaagccggcaccatcagaagcggcgccgccgccgccggcggaagccgaccaggcggcggctcccccggccaccgacgccaccgtcatacacatggtgcacgactacccgtacacccacgaccaccaccacgggcacggccaccacctgttcggccgggaccactggccggcgagccaccataccgccggcggcatggtcaactacgggggcggcgcgccgtactacgccgggcacagctacagccacagggcgagcccgtacgtctcggagtacggctacgtcggctctccggctcaccatgagggcagattctacagcagccatgattactactaccctgcagctgctggtggcagagggaagggagatggaagccagatcacctccatgttcagcgatgagaaccctaatgcatgcaccatatcctaatcaacatgcttttgcctgtcaagaagtaattaaggtggggtattatatagtattgatgattagtgttaattaagattactgtaacatgagatttatgtaaaatagtattaattaagaggggtgtaagtaagataaggaaaaaaggggagcaataagatgcttaacttgtagtagtgggagatgattttccttggcaatcaccactattttttttttaccgccgtccactacacctcaagagaatccaacaaagctgtggtcctgtgtatatgatgtgtacttgaaaaaaaagtggcagagacgtcacagtatttccaggccaaatctaaaaactttgtcctgtctagcatgttgggaatagagacatttttgtattctcttgaaatatatgtacatctgatttgcatcgcataaatctagagatcttatcttctgaaatctagaacgtgaggatttttttttttttttttgcttcttgcaaggaagaaactggtgtccataaaaggaggcaaaacatttatatatccagtgcagtttgctgaattttcagttcagattgacagaccaatgggataaattccagttcttcatggagcggtgtttcaagtagtactaggaacagtacgaagaacagggaagctaggtgtgtactgatgcagaggagaatttgatctgacatgagtatagtttctagtgaagggaagttttcagagcaaattcaggagaccaaactcgaccgacaggatggaaggtgtttaacaggtcgacgagaaagagacatttctgtgtaatgataagcttaaagagaagtcaatggctttcagactttataaatcaagacaaactcatgctcagggctagaccaattaaactgttaagttaatcttccattcctttcagtcatccagagaaggtatatctgctcgactgctcccaagactaatgtcagacctggaggaggtggataagaaaagtgattgtgaccccagaaaaaacaaatattgccaattaattatagactcgcggtgatttaattccacttgcgtgatgttttatttgcttagctttaggaagttataaaatactactcctaaatatgttgatttttacaaggagtagttttgttttaagaagtcttctggtttagactttaaccatcgattgcttataaaatagattgttaataaccctgggaaaaatatgtttaacagcatttttgggatattaatctatcaaattattttttattcaataaatatacttatagttttattaattgtcaataaaaatccaaattttaactatttgaaagaaaatacttcctatgaaaatcatcatatccgagaagaaaaaaagatctccaggaaagcaaagcccatttatacattgcttcaagttcaagcggcccaattcaccaccgaacagggcaagaaagtgaataagttcattttaggtctctcgatttatcttcgagtttgaagttcatctctaaaccgaaatattagatatagtccatcccccaactcgtaccatgtatccaatgttgatcctttggcaatatatctgcctctccctcatcaccctccgtcacgcacgccgggtacagcatgtcaccggcgccgtcgggttgcagtggcagttgggccgccggaagtccaccgcccagaagttagacttaacggtgttaaatatttaggaacgaagggagcaataagaggttaaagttgacatagtagtgtgagttgggagatttaacaaatctgatatttcggtttgagggatgaattttaaactccacgacaaattaaaggatctcaaatgaacatattccacgagactggatctcaggacaacatcgcaccggccggttggtcgactggatcaggcaattagcccatttacggagtaaaacaagaagaaacttcttggttctttttatatttatttttcactaatttacaaaataaataaatcgccatatcaaagggtggtttatatggacacacagggcatttttcatatagatccttaccattctctaggtggtcgttttgtgatatttcggatttatataaggtgttgttatagctgtgattgtaatttaaggactgcatgcaatttcagtcgtccatttctttaattaacggatcagatctagtgctacagtaacaacacaaacagtatcccaaactacggtgctttcgctataattcagtgaacaatgcgactcgctagggtataccatccaatttgcatctgtcgatgagaacttatattgtctaattgcagccactattgtgactgcacatgatccgaattcatgatatctccatcgatgaataatgcgggaaggggtgatgtgcaatttttggaggttagtcctctttctcaactaccactgctaggaaaccctcttcaaccccggtttgcaactctcttattggcttatttagtcccagattgcaaaccgagactaagaatctgggactaaagatcgttatctttaatcccggttgaaatactcggagtaaagatacatctttactacatatggttgagccacgtgattgacacaaccatctttagtcccggttgatgttaccaaccgggactatgggttttttttgtttttttcctccttcagtttttttattttttttactccttcagtttttttcttttttcctcatttcatattgattcacagcatagatatcacaaattcattcacacagatcatcacaaattcgttcacaacatcaccaattcattcacagcacatcatcacaaaattattcaccaaaacattcacaaatcaacaacatccacaaatcataaaaaaaaataaagaaaaactcaaacaaatcaaaatctacattgtcgtgtgccacccgaccaccggccggcctcccatcccgccgccggccggccactcatcctgccgcctcccctccggccggatctggcggagaggagggcgacgccaccgccccgcacccggccaccatggtttattctatcccatcaaccaagagagtggaaaggatctatatgtgaaatgactctcatcctattatattatataacccgtcttccggaaggatatgatggcttttttttcaaaaaaaaaatcccagaggaaggagtatttctataaatttgtaaaaatatatatattcatttgatataaaataaaaagtttcaaacatattttaaaagaaaaaggcatgagtattatctattcatttctttcaaaacataatacggacatatgcgctcataaaacacgcagaaacaattaccctatggaatatgaatatacacttaatttccctatgagaaccgagactgagccgtcatattttaaaatgatggaatcatctcaagtgtctcagtgtcaatgtgtatatctcgctcaacaataaaagttaaattgacaataaatacgagcacctatgtcgagatagactagaagttaaacatgagtagatttttaccagaagtaacctaacccgttgttcacctatggttgtgtttgcaagagcaagttaccaacactcctctcttgttttccacgcgcacgcttttcaaactgctaaactgtgtgtttttgcaaaaagtttctatacgaaagttgtttaaaaaaaatcatattgatctatttttttaaaaaaaatagctaatacttaattaatcacatgctaatgaactaatccgttttccgtgcgcactgtgcaggttcccatcctcccctagcgaacacagccaatatttaatagacaaattaagttcagaactaaccatttgaaaggttaatacgggttcattcaatttccgctgcttatcttgtgtgcacaccacctctcgcagaacagaatgttagttgatgttttttttgtagctttaacttgcactctttcggtatgaaattggtacaaatctaaatttgtaaccttctctcatgtattagagtgcacctaaggctagcttctgatggtagatactgggcgggcctaatgggcgatcgatcgccagggcgattgcccagcgatcggtcccccccccctctcccttctccccttcctcctccccttcttttcctattacagtataccaaaaaaaaattaaaaaaaagttacaaaaatttatgtataaaaaatttaaattcaaatttaaatttgaatcgggtatgtaaatttttgacttataaactttggatctaaagtaaactttaggtgtataaactttagatgtataaaaatactatatatagaaaatatttgaattatttgaattcaaattcaaatttgaatcggatataattcaaattcaaatttgaatcgggtatataaactttaggtatataaactttagatgtatagaaatactatatatgaaaaatatttgaattcaaattcaaattcaaattcaaattcaaattgaatcagatataattcaaatttaaatttgaatcggatatataaattttaagtctataaactttaggtgtataaactttagatgtatagaaatactatatataaaaaatatttgaatttaaattcaaatttgaatcagataaataaacttttggtctctaaactttagatgtgtaaacttgaggtgtataaactttaggtgcataaatttactaaaatagaaaagtaatgcggtgccaaaaaaggaaaccaggtggagggagggagggggaggagggggggaggaattgatcgctctgatcgctcgcccagtagcatttccggtagatactccctccgttttataatgtaagactttctagaaatgtctaaatttattaacatctatataaatatataaatataggtaatgctagaaaaatttacattatgaaacaaatgaaacgaaggaagtatattctaaagtttgggattcgtttgatgtcgttggtttaacccagctttccttctaattaataaacattactagctaggtttgtccgagagactcccaactctcaattatctatatgattaataagcaaattcgtggataataactatacttgggacacagtaatatatcatgatgtagattggtttctagggtctaatcctttcttgacatatagtattttataattcttgtgaaaaattgaggactctatatgttggaagacaagattaagaaaacaaataatagggaaaataaatatttttatggaaatgcacatatagctagaggactgagaaatgcaagaaaagaaaaatataaaagaaggaccgtttacgatagatggtataaaagtgaaagaattttaggagagatgaaaactagaaatttttctatgagattaggcctcatgttaagggccctttaattcatagggaaaacacatataaaatttggagtatttcaattattcataagaaagcatttcaaataaaggattgaatcatcggaattattatagaatagataatcatatagagattttagagaaaaatcaacaatagctctaacttcttagaaaaattttctttaagactatctttcatccaattcatgcagtctattcatacgataaatcctgtgtttttcttatgttttgtaataatctgttttgcacacgcattacagtaaaaaaaatctatgtattttcttgctctatttttctcaatcctgcattcaatccaataaaaaattatcatgcgcactttatattaaagacggaagcagggtataactcttaattaacaccgaaaacaaatggaaaaatgaaagaaaaaactcaaacggaaagtaacgaaaccgttggatactctaatggattgtcccgtaggcaacaccaccaccgggaaatattcgccgacaaatttagcatatcctgtttatcctttctatagcgtagacgtcagtatagttcttgctttggggagctgttattctctcctctccaactccaaatccaaatccaccgtaatcatcattcatcagtacaattaatcaacattaaccgcctcattactctttagtgacccttaatttggtagccgtacagtgacagcccatctcctccacctcgccgtcgttgtttatcagcagcgagacgcggcgaagcaaaccaaactgaagaggaatttatgcacttcaccccctggtaaaattctccgagaaacaaatcgctcccacccctcgccgccgccgccgcgttgggtgggcgggggatcgatccggcggtgcccgcccgccatggggacggcgacgatggcgacggcggtgggggcggcggtggtgctgtatttcgtgctgagccggcggctggcccaggaggatgggggtggtgggggtgggggtggg

SEQ ID NO: 68304 - DNA, 4382 bp, Oryza sativa
ggagagggagggggaggcggccggctcgagggggaggggagagggagggttagggttagggatttcaaaatgatctgagccgtccatcaaaataaacggctgagatcgatcgaggatttgggccgcaccacttgggcggcacgcgggccaacagtgaacagtccagcaagtgagaggaagagtatagggatataaattagactttgtttgcttttaggctgaagaagaaagtgggctgaaaaaggcccatagagataaaagaatttttatttaaataaatactaaaatgatatttgtattatcaaaattagcaattaaactacgtaaattccaagaaaatttcaatgagtgtaattaatgatatagaaaatttaataaaaattaaatccaaccataacattttatttctcacacttactttacttataaattaatttaattatatacctacctacttaaaaaatacccaaatattgcagaaaatttatatttcatttaattagaatttaatatgttctaattcaattttatcacttactttacttataaattaatttaattatatacctacctacttaaaaaatacccaaatattgcagaaaatttatatttcatttaattagaatttaatatgttctaattcaattttatcacttcctgctgttcgtcaacgggccgtgggggaccagctggggccaccgccattaccggcgcttctccgacctcctcgtctgcgagccgctgacgcgtcggtttcagggcatcgcccgcatgccgccgcctctgtggagcttggtcttctgcggcgcctacctgatcgacggcggcggcggggagcgcggcgtcggcatgtcgaactaccgggtgctctgcatgttcggcgagctggcgtgcgtcttctcgccggggaacgacggcggctggcgcttcgtcgacacgggcttgaagtacggcgacggcgaggacgtcgagttccccgaggacacccagttcgtcggccgcgccgccgggaagatctactggtgggcaccgggtgggctagtgcaggtgttcgacgaggccacggacaccttcttcctcatggagttcccgaagcacatgcggtgggagtaccacaagtccaacctccgggtgatcggcggcgtggacggcggcgggatacgcgtcgtccgcatgaccggcgaggacctggagatctacggcgagagcggcggcggggagtgggcggtggagaggagcgtccggctggccgaagccacccgcgggctgccggggcgtcaggaggtgttcttcaccgcggaggcgccggctgcgaggatcgtgaccgccggcggcgacgggttcgtgacgctggcgccggcggaagatgagacgtggctcttctccgtcgacctggagaccatggaggcggagcgcgaccacgagaggaacaagcacgtcggcgaggcgcacccgtgctcggcgccgccgctcgccgccgtcttccgtgcttgcggcgtaggtgacgctacgaggacggaaaaaagcggaagccgcctttgaaactgacgacgaactttagagagtttattttgaggaactggtcgaactgacttgtgaagattcatgtaaaatccttgcgtttcaaagctattattagttttaggaaatattcttagttctaggaaatattcatagaactgatttttattggtgcacggtttattacacatataattatgagtggtttaagagcgctaatgaccgttcttagctctaggaaatattcttaaatatgtgattaattataacatgctacaaatctaactgcatcgttgattatgtagtaagagattattttggagcttttcaataattttgttgacaatgaaggactctcgcgtcgctctccccaggggcggccgggtcgtcgagccgcccctctccccccaccccaccccccttctccgcctcgccgtcgcccgagcggccgccggcaaagccgcgcggccgcaagggcggcggcggggcgctcctcgtctcctcgcgctcgggcggcctggggagccgcccggagtggtgacggcggtgaccgccagatccgcgccgtttcggccggatctggcgggatgggctggcggcagggacgggcgacggtggcggccgaggtaagtgcaccgggtggtgttgtgggtgatggcgacggcgttggggcggcggcgcggcggccggcggtggcgtgagcacgcaggcatcccgcggttgccgctggcgtcctccggcgccctctaggcgtcggccggcgttggtggtgaggggggcggccggatctggcttccttgctcagatccagcgcacactcgggtggggacggggtggtttggaatccagccgtcgtgcagatggtgtgaatattgcaggtaccctcggtgtgtaggtgacatttggtggctcccgtcatggatgctatggttgatgggtgctccaaggcaaaagccttgctccgctctcggtgctagcaacggcgacgcccttgggcgtcgttcaccttcttgaaggcgttgctactggagccctcgttcaactccacttcaagagtttcctccgggtgaaaactagattcgttataggatcggacgatgtcgccgttctgtcggcataacctttttgaaggcttcgttttaggagtttatctcttgttgaacgactctacttaggttcagtttgtcaatgtcggggtttttgtcggtttttctttaattaaaccgtgctgttgtaaggtttttgggtccggtttcccttataaaatggatcaactctcttcttctatagtgaattgtatgagctccctgcctgtcccctcgaaaaaaaataattttgttgacaataagattgattaacacaaaattaataaggacacattggcttactttgttcacgctttgctataagcataattgctacaatgataggttgctcatgagaacatctcgcccatttagttaaatggtcagtaagcattttttatccttttaatgacgaacttcacaagtttgaagctgcataaacataaataggacaaatgcaatatgagaattataaatgcatgttaacaacttagtaagttgaatatatacattacaaataattgcaaccacaaacagttaatgcaatagtgttatgcatgaaatcgttgataccggtcaagcatagttgatgatttatgagaggcttctaataccgagcctaaaaaagttcttcccagttaaaaagatgatggcagttcagaaatatagccttatagtctaattacatgtgtcaccaaaggaaaggaaaatttattactgtcatactaactatacaagctgatcaattactctatatcctaccactgtacaaacagagatagtatattaatatagatattttagccctctgataacaaatgtaaggggatttgaaaccaaaatatgtacacacctgccatcaatcataagaacattcctacatgggatcctccttttgtagcctctatagagcttacaaacatgaccattccaataacatctgccacatatgaaaagtgtgttaatagaacttctattttgtcacaaattaatattgtttaggtggtgaattgaactacttaccaacataaatgtcattatggtaagtaaagtcagggccggttcaacaatttcgagggccctaggcgaacttgatactatgggctcttaacaagttaaggctaattttattacttctaatcagtggcggatccaggaattttttttaagcctgggtaagcctaacaatgaacaaaagtacatatatattggggcaattgcttatttgacctcgttttgaattgtaattgccgatttgaccctactttttgaactttgcttatttgaccctcattttcgagtacgaagctctggtctgaccctattccgtttgtgtgaggtgacggtgttaattttggggtaaatagtccattttgcccttgcttatttggccctgttatatcttgtttgtttgcttgtttgacctaaagtttggataatataaaaaaaaatctctttccccggcggcggcggcggcggcgcacccgcggaggaagacggaggccggcgcgcgctgggggggagagagcggcgccctgtgctcttcgccacagcgtcgtcgtcgtcgttgccgaccggtggcggcgagcgcagaagaagattgaggccgacgcgcgcggggagggagggagcggctccctgtgatcttcgccatggcgtcgtcgtcgtcgttgttgctgacccggcggcggtgcgcgcgcggaggaagacagaagccggcacgcagacggagggaggaaggcgctggagcttgccggcgtgcggagggcggacggc

SEQ ID NO: 68305 - DNA, 30124 bp, Oryza sativa
cattatcaaatcatggcgcaattaggtttaaaagattcgtctcgcaatttatacgtaatctgtgtaattagtttttttttctatatttaatactccatacatgtatccaaaaattcgatatgatagggtgaaaagtttttacgtgaaaactaaacagagtctacgtaatgaaaacctgaaaactatcgttgaatcgaaaaaatagatgtatgagattcatcaaacatcattataagtaaaaaaaaaatattctccgtaaaacttttacttatgaataaacttatgagtaagatttttactcgtgaggatataaacgaatctcagatttatttttcaatccacttatagttccagatttatattacaccatatattttcctgcgctttcaccatatattaccatatattttcctgcgcttctactgttctatatgctgcttctgcttccttccgcccgggcttttgtcatctctgcggcccatgcagttgcagactgccacccgcgttatgccattgccttttggtttcacactacgcgagcgccgcgcactagctgcgtacaccgaaaaggcagctgcgtacaccaaatggctgccgagtttgtcgatcaatctagcccgtacaacttccaacgaacggccgcgggtcgattgttttactccatcaccatgcatgatgtttgcaaccatgacaacacagagatggctgatggcacgcatcggcgtacgaagatggtgtcaccgtagaagaaaagagattagtctgagggcggagacgacgaggctctgacacgtgtaggctacgtgccatgctcgcagtttaccggtccaactcaagctgaacagtacgattaatatgctagccgtgtgcctgtgtgaatccgatccgatatcctcattgcaagggagtctactgctttatctagacctgttgcctattgggtcacaatgtcacatgaagcaatcacgttcggcacgagctgcccactggcgcgcctcattgtcacttcgacgatttttagttctttctttatcgcagtttaacccagatcgattggacgacaaactgcgtaccgtcaaatactactgcctccagcttactgtatgaatcactcgactaatagaaaatacatacgtacggataaacaataggaaacacatgcatagatgatgtataaaaagtagcatacggcatttaagaaagcttcgtgatcaagcattcatttcccgttccgtgatgtttgaccaggcataccactcctgacaaatctttgggcatgcaggtgtgtctggatgagaagaaatgacaagactgatgactcccaaacaaaaaaatttctctgtcacattgaatacctagacacatgaaatattaaatatagataaaaaattaattacacggattatgtataaattgcgagacaaatcttttaatcctaattgcgctatgatttgataatatggtgctactgtaaacatttactaataatggattaattaggcttaataaattcgtctcgcggtttccatgtagaatcaattatttcaaatctaaaatatatatttaaagtgactttattatagaatttttttaaaacacacactatacattttgtagttcggaaagcatgcacgttaaaaaaaaaggactccctccccccccctcctcctccggcgttaggtctccttagaattggataaaatttctaaactagagaattaatcctttctaaactagagaattaatcctaaggataaaatagtatgaaccctttgggatggtgaaatattttaacacgtggtctcacctaatatatatttaaaaattcctttgagaaatttcaatgttacacccccttctctcaccgttcactctttaataaattaatataaaaatattatattttccaaacaagattctacgtaattcctatggttttaattgctgtagtgctcaattaataatgacatctcacttttacatttttcctattcctatatttcactgcgtttgtgttctaatagagcccttaagttcttttgctccttccggtcacaaatataaatataagcatttctaaagaaaatcaaataaatatatttttaaatatataataataaataatcaatttatcacactctaataacccacctcgtttcgcgtgccagaataagctgaccaatttcagccatctcgaacatagacttcaaatgagtacccgacgagtgaggtcatcaattacaggtgagtccattttgccttcctcaactgtagctccggtcttaatttcttcccttaactacaaaaccatatatgaggttcacttaactgacaaattggtttgtttttcctcgctaagtgattttatcctacgtggtgtctactgcctaggtggcacattaacatgttctccatctttccccgcaaaaaaaaaaacttgttctaaatattacgtggcgtcaatgtgttacgtggcattaaaaacaatgaactaaaatataaatattgcggccatatgtcatgatctcagcactcttcctcccctcttactattcttttctctaccctttctctatctatgctcatacaggccccgcattgttccctctccaacgtcgttaggtgactagggggcaagccacgccgcctttgatgcgcttgccatcccaccaccgaacccctgagccacttgctgtcaggtccttcccggcccccgagccaccaaccgaagaggagaaggagctccagaacgacatcgcaagatagacgttggccctgatatgctgtaccgcaacgacgaagatagagcgggtcgatcaaatcaacgccaaggaggcggctacgcacgtgtgtcgatgcaactcgagcagagattgtgttgggcccgaacccatcttggtcacacacgggtggaattgagggcgagctccatcttgagcttatcccagacgagaggcaactttagcggcgacattaggggctttgtatggcctaagagagccgtgtgcgcatgtttagtaccatcttgctagtttagcactggtggtgtgtgtatgtgggcccgcccgtcggttgggctgggctgcgcggttctggagggagggctataacactttgtctacagatgacggtggagcctaggaggcgtgtccttgtcccaccatcacgtgcgccatcgcctcccttaccgcccattgccacatcaattttgataatttggcccttttactaaactagaccttgacaaatactataactagaaatagacttttacctctgtgtcataggccttggtgatgaggcccaacatcttagcgccaagcccattagcgctggcacctctgacattttaaaatgatgctagacccacctagaaaagcaagtgagtgtgatgcagtggtaagtggtatttgttttgccttgaagatcataattcgaatccccactgcagcatgatattttttatgggaggctgggaattccctaatggtgaaaaacacacacacacatacagagagagagagagagagagagtcacaacggtgaaactgaagacctggtgaggaaaaaagaagaataaacaagaaatggcgagtaaaaaaaaagaaaaccaaagaggtcacgagagtatgggtttcaaacccaaaaccttccggtttacaagggagaaatttaccactaggccaattaataaaatttgttaagggacaacctaacatctttttaatatacagtgctcaacgccaagacccatggtgctaaggtagatattcaattttggttatagttttttttcaagatctattataaaataagtattatgaaagggtcaaagtgtgaagttctcggccattgctgtctagggagcactgtcatccacctagtcaagcgcgtaattcacccaaggtcatcgatgccttggtagttggcagaggagagcttacggcaacatgttggtcactataaacctctcaagactaggatcgtgacctgagcgggttggtcgaccgcctcccccgccctcacaaggatgggcagatgagctcgagctcgaagaggctagccagtcaccattgttgggcaagctttagcttgagctcgttgatgtgtgtggaaagggaatgggggagaaaaagagaggggcacggacctataaggtccatatattgacttagccatttggactaggatgaactagccatgtcagctgaaaccactcgagagagagtcgatgtgcactcattttataatttggaggagcctctatgcactagtctcatagttgaattggacctttcccattgttgatgcagctcaactttttcgtgcctatatgtgggctgagtggcaccaagcttttaacccgagtaggattttgcgatggacacgatacgaaagaggcctagcagcgatccaattacactctcaccgtctcacggcccaatatcagaaaataaaataccgtgccgatttataattaaaattaaaaatatactgttcatttaatttttttctcatgaatattcaggatgcaaaaatttttacgtaaatgtaccattgatctcgtacaaacattgcgcaagaataatgtcgtggacggtattgcgcggcgaaaatgtgagaccgcgcggtctcgcattatgggagagcgagactaatcattattagttaattaggataattagtctctaattactattagttaattgtcaattaagtaattaagcactaatcaaatgaagccgttggaagatgtcgctgtttgatttcgcgagaccatatagtctcgctcttccattgcgcgcgaccacgcggtttcgcactttaatttcaacgcgcgataccgcccacgacgtcacacccacctcattttcgcataacggttgtgcgagatcgacggtatatttatgtaaaaaattttacattccgaatatttatgagaaaaaattgaatgaacagtatattttcaaatttaattatgccgatttattgttttgtatgaacggttgtgaatgaacagtctttaattcacctacgcggaaaagaaaacacaatctatatattcaacactagcctgatcggagcacagactgcggtgcatatcagaagttagaaattcacaggattttaagttcgattttctagtttagcaaatcggaggtttattccatcaacaactacaagcaccgcttggacctatattcctccccaatctgtgagtttgtgttcccctctctgtgtagcgaaacaggacacgaactcgatctgtctacaaatctcgcggctcctcgccgagcaggagctcccggacgatcttgtcgcccaacccgtcggcgcacatgaagaggtggccgccctcggggtgctcgtggtaccgtacccacgggagcttctccgccacgtagcgctgcgcctccacccgcacgatcttgtcctcgcgcccttgccagatgctgacgacgccgtccccgttggggaacgggttctcgatcgccgtcgggtcgaactcccacgccccgaacaggatcgtcgcgtcgcggcacagcgagtggtaggctccctgcttcgtcgccctcccctgaaacagtttacacgcacggcgagcccgtgtcaaagcgactctctgtttcgttttcatttaaggtttattctgcacgagtgcgtctttttttactcctaagttttagtatagttggtggacatgggatccggtgcaggtgcttaccctgtccaattggccagttctctgaatctcagctaggatctcccagtccttttcagtgaaagcctcgggcttcccctccacgatcggtgagatcctgaaccacttttgattgaaccaggcgtagaacagccaaggcatgtggtgcgcgatccagaacgtcctccggtccccgacgtccagcttgcggtacgcactggccgacacactggcgggcatcggccaccagtagttcaccgccggcacgaccagcgccacgccggccagcctgcaatcgtccaacctctcatcagatactgaaaaagaaaagaccgatcagatgaactgatgctgtgatgcatatgttttgacctgtaagggatgtagttgaggcagctccacgcaacgtagccgcccatggaagtcccaaccacatagaacttctccccgagctgcagcttgtcggcgagctcctcgacgtccgtggcgtcgctcttcagcccccgcttcgggttggcgtcgctgtcgccatacccagccctgtcgaagtacagcaggtaaatccccagctcctctgccagctcctgcagttaaattaaacagaggggatcaaggtataattcacaaccaagaactacatcgacgatcgcgcatgcaagtttagcagcagcagttgttacttgggacaccgggaagtcggattccttggtggaggcgaagccatgggagaaaatgatcttgtacttggcgatctccctgccgaccccggcttccctgtaggccaggtgccggccgtccttgagctggactctcggagaggagaccggtggccctcccggaccgcccaagatcggcggcggcggcggccgcgcgaccttgtacgcccagcccagcagcgccactgcagtgatcagcactaacttggagagcgcaaccatcgcgaattcctggtcgatctacgaacctgcagagatcgaaggcagtgaaattaaagaaacttagtataacgcaggtgacgccccgatgattagccggagtccgagcatgcttaacacggtgcaggcaacatcaacatttataccaggaaatcgtagagacggagcggttcttctcacaatctcatttgtcagttttactcgtcagtgtgcagcgtgaagtggtcacctctcgtggagtcgtggtcaggtttacatgtgaagtgtctatgtcgaacaccggcagtggatcagacgatcagtgaatggtacgataatgattgtaccgtggtgttctgccggggtgtagagttggtcgaactcgcgggatcgatcttgcagatcgcggctatgagatccacatatctacatcatcacccatatccatgtcaattgtacctgatgtctccaagactccacttgtacacgcggggactggtacgattgctacgaatggtggtaccggctggcaggctgaattggccgtaactgcgtttttttgtgtaaggtgcaactgccgagtccgttctggctgctgagctgtgtgctaccggggggagcaacaagaacagcgtgatgttgattttgtttgcagtccgatcgatctcgctcgatctgttcgtttgagacgacaggaggcactggcgtcttctgagaggattgttttactgtgctcctaattaacacatgattgttactgttcgaaatgatatcgcacaatgcacatccttagtccataaaagtattaggttggtacttgtccatgatttattgctgacttctcttgatggaagttagagtatatggattgcagagaaagtgtggacaggctaggcttaacaggcaatacaatcatggagctgggcagctggacttggccatataaagataagtagataacgacagatcaagaactcttgcccgggtcatcatacgaaactagaggaataaagattccatgagaaaaatcgctgttcatccgttccgataataggaatggaacaatgaagagggaaaagatgttcgttcagaaatgaagtgagagaagataggaaaagtctcgcgcgcatacttacagttttgagggaaaaaaagagcagcaagatgaacatccggtgaaacactatttttgtatatggttgaggcaaagtggccaaccagttcgtctccctcctcgctgtgctccgcctccgcacttctgccggccggctcgcctccccgatccccgctgctgaacctcgccgcgcttccgccgccacgctcgagctcgccccaggcggctgtggatctcatccatccatatatctcaagcaggacattttgccagccactgattggtccacttgtgtattctcagaaaaaaaacaacccgtccacttgtcagttgtcactgttagaattgaagataaatcttgaaattacaaacggtaaaaaagaaaatgaaaaaaaaaactccctgcactgcgctacttgcctactctcctctttctcgctatacgcacatacatcagtcattgaaatgtggactaaaatcaggttcttggtccttccaacggaatcaaggaaatacaattactcaagaaaaagataaaaatctagagctttccaacatatacctgataaaaaatcacacaggaatgtttagcttatattcatatggttatctaaatcgcttattagcaaataaaaaattattcatgagtaatttttttatatatgtatccttagagactcaaaagcaaatgatataaaataaattatatcaaattcaaaattaaattctaaaattcaaaatttggcttataaggataagtataagccaaacaataaggccgtaaaagaaccggtgaaaaggatctatctcaatgtaaaaatagatagggaaaatagaaacagatctgaacaggaaaaaaatattcctagataagaaaaacagaaacaagcggtgtatcgtagccgccacaaaattggagacaacgaagacggtagccatgacattttccggatcctttggaagctgttcattcaggggagcaagggtatcaagtcgtcgacgactagccgtgatggtttattagttcgtaaatgcggatgctggacgcatcaaccagccgatgaacaccaaggtcgagcatatccatgccgtccatagcaacaatggccacaagctcaagctcgacaaaatcgacaaaaagggagggagcaaggaggtctccagtaggatacctcaatggggaggttcgaggggcaacgtcgttgttgccgccatcatcttcctattgctctcgctggcatcgtcttcctcattggttattgtatcccttttttatgagctcagacatgcattatcggtagccatggctccaagacgccagatctaacagccttcaactctcaatggccacaagctccaacgacagcgacaaacaacaaagcacgatggaactagtgagctgtgatggtgacaaggcatcgagatccttccgccttttcttttcctttatatttccttttcaccctattaagctggtgatcaaataacaaagttgtttactgtttcgtagttcttacagtggatttccaatcttttcttttgaaaactataaagtcccaatccacagttaaaatattttatctataataagttgtgagagtaacctcacattcatagtgtgttagttttattacgtgatggattttatttgtttagctgattaaattcaacaatgttaggttttagcacaatttaaagtattatagacttagtacaatgtctctatatattgagataatcgagagagggaggtgtcaaagaaaaacggtgtcgccatggagcccaggacccacctagatatctgatagaaaaaacgatttagaaaatgcttctcttcatatattaacgagaaatcacattgaccaaataaaaaaaatctatgacgcttcacgtaccattatgtaattttttgaaaaaaaaaaggtctacgaaagggtacagaagtaagttgtagactttatataattcaaaccaaaaaaatagatcaaaatcatgattctaagatgcattcctaataagacatgtgttttctccaatgtgtgaccactccgggtccacaccagtcatgcgcaccatgcctgcgcaactgcgacacacgtgcctatgaaaccgcgagagtcgactctgataccattttgtaacgtcccgcctctccgaggccaggcccgcttatatctggtagcttttataggtcatagactgccctcacagaccaacacaagttttttcccatcccaaattgctccaggccaagcacgcttaacctcatagttctttggagatcaacaacaggcgcgctcgatcgagcatgaaaacaaataaaatgagagtgagaactaagcaaaaaaaaaaggtatgtgtgcaacaaaggtttaatggaaaaaaaaacaattatcatgaaattcatgcaaaactcctcggtaggaaagaaaaggatagaaagtaagtaaagggaagatgggagaaaaaaaagtaatgagagaaaacaaggtgatttgaataaaattagatttgtgtcttgatcatttttaggtatttttttatttgtttagctgattaaattcaacattgttaatttgttaacacaaataaaagtattataggcaatttgttaacacaaataaaagtattataggcttagtacaatgttcctatatattaagataattaagaggggaggtgtcaaagaaaaacggtgtcgccatgtagcccagaacccacctaggtatctgatagaacaaaatggtttagaaatgcttctattcatatattaacaagaaatcacattgaccaaataaagaatctatgacgcttcacgtaccattatgtactttctggagaaaaaagatttacaataaacaataaaattaaagggtatagaagtaagtaggaaaaaaaccaatatcaaaatcgtgattctaagatgtgttcctaataaaacatgtgttttctccaaacgatcacaggtgtgctcgactgagcatgaaaacaaagaaaatgagagtgagaactaagtataaaaaaaggagtgtatgcaacaaaggattgatggaacaaaaatacaattatcatgaaatttatgaaaaactcctcggtagaaaagaaaagggatagaaagtaaggaaagggaagatgggagaaaacaaaataatgagagaaaactaggggtttgaataaaagtagatttgtgtcttgattttacaccctatttcttagcacttacatatcatttttaggtatatgttagattttagttttcattttttaaaatattcatctgatcgaaactatgtattgctaatactcgatgttacacaggctaaatacccagcgtgccaacgtgcgcgctgattttctagtctattctatcagcaggccagcaatgtttggtatctaatgggcccgtcggaccacttatcggaggacttgacattgggccatatcacttactgggcaagattgggccgatcagcgtattgtccatgaaggctggagagaacgacgaaacggggctccaaaagcccgcatgtgctcataggtcgttatggccttatgggccttgccggaattagccaattaggccttacaattccaacgtccgacgtcgtctattagagacgttcagctcatctcatcatcccccaaaggcctaagcccccacgatccccatgccgccgtgcagcgcactcgtatattccacgcgacgcgagagactcgaccgagtccaacacgggcgctgcttttgaatcacctcgccactaactttctacggtttggtccaggtttaatgatggcgccaccgtttcaaaaggcgaccgatcgatccaaatcgctagctcgtccatgtacgctgcacgcgtatgcctacctacgcgcgcgcgcgcagctcgtgcatgcacccgccttgagcccttgacacgtcccagctcaagctcaagagctttgaacggttgatggttggcgcgcggcgtggtgttgtaacgaaccatgattttttttttctcccttccttcggtgcggtctggtcacccagactggcgcccatcggtcggtcgatcgcctttttgacggagtctcgcgcgcgggccacctgatcaagggcgtcgctcgttctactgggagtaaggtaaagttgcactctgccatgtcggcataagtatttttccggctcccgccgatcttgccgatcacgagggcgatcactgaatagagagagagagagagtagatcattgatagagcaagtttatagtatagccaactactggttacaaattatctatagtcaacttaatagctaattcatataatagttacctataaatatatactacacaatcaatatctggtcccaccagtcatacacacatgcgtcttggagttcgtgttacagctggctacaagtctgtagtccgcactcttatctcttctcttttatcttcttaaaatattgtacctgcttttagagggagtcatcatgaaatgagttggttcaaataacatggatttttttgttccttgctctcctccctcgcgatcgggaaaaatccacaacgaccgcttgtttttggcttttcggcggcagcagcagcagcactgcgttgccccgcgtatggcagtgtatagcattctggcgtatagtgggaagtggatttttgttccaaagagacattctcttgttttgtgcatcttgtgtaaaaacttttgagctcttcttgcgtgtgtacactaaataacaaaaagaaaaattaatcagaaaataaatccaaaacagaacggcaaaaagaaataaaaaaactggacaccgctgccgccgtaggtgcaccggacaaagacacacgaacaattctatcgggtaaaaaaataacaaatttaattgtaaatatacatatattaatttaaattttgtttgtaatttttgttacaatctgtaaaagttgaattttaacttgtatatttgtggattgatacattacatattgatctatcttatttatattttttcataacatgtaaccaacggtggacatccactcgagttaaaatagtttccccaattctatcctctgtctccctgattccctacccggtgtactgcacttggccaaccgatcagccctgcagtcgcgacgacgctcctgcagccgcgcggcacgcgtgggccgccgatgcaaggtccgaaaccaggctagctaggtacgccgcacgcagcagccaccagcacgtacgccacaaatagcaccagcagccagcgatcctcagcgaagaagggccacgcagctagcaagcgcgaacatattcacactctcacgcgctatcccatgatcccaattcccaaccctggcggcggatttgcccaatttggctcgtgtgtgaaagcctccaaaagaacaaaaaaaccatcaagaagcggccttgcatatactacgtactaagagacatacacccaaaggcatataaatggcccccagctcccagccagccatttcagtttcttcaagaccgtgacacatgcactccttgacattaggctatatacacatttcttctagttcttcctccccctcctcatctcccatcttccccacgccaccaaaccccgagaacaagaaagctatataccatctctcatgcgagtaaataattaagtgagagctctctgtgtgcgtataagtagagatcgatcggtataatcgaggactacatgaggatggggctgcggacctgcagcgccatggaaggtgaggtcgtcgccgcctcgcctttcttcgagtggctcaagccaccgccgcggccggcgtcatcctcgtcgtggtcgtcgtctttctcctcgtcgtcctcgatggcttccagggatcaagaaacagtagtacctggtgaagatggcggaggtgaaattcaagaagatcataagagcggtatgacttgtttgccgctgctcagcatgctcgaggaggggaattcgaagaggcatgagcaccctgtgaaagaagagatcatgagcagtgcacacgcagccggggtagtggagcctggcgtggagttgaatatcggcttgccggttacaggatctagcgctcaggaggtcaccatggaggaggacgatgaggaggaggatgacgacgacgtaggggaggaggagatggacgagtggaagcctatgcatggcggttgcaaggtggagggggatgaagagcagtacggcgaggcggtggcgtcggtggaagggtcgagcagcatcaccgccgtgggggatatgttcggcggggtcggggcggagagcggcgtggcgatgagcagccggtattggatcccgacgccggcgcagatcctcgtcggcccggtgcagttcatctgccatgtctgtaacaaaaccttcaacagatacaacaacatgcaggtactacatgacgtccttgatctttgtcagctagcttccattttgatttttacctagtacatcccatgttttcataaattttgaaattcttatatgctcatctttggaaaaggaaatcccccgcagataaatctagttttagaaaatatattttcaactgtgagtctgtgaccgacacggacatcacaaactcacaaactgaatctacaggtggtgtgactgcctgaagtgttacgtatctgagaatgtacaaaacacacaattatttcgtatacaaatccccacaatgagatattctcgtgcttcggcgctaataagtgatcgaacactaacacacactatataaccacttcattcgtttcttcaattattcagaacacatactccaattatcgtatagctctctgatcgatcgtacgttgcaatattaattgatgatgtggggatgatgatgatgcagatgcacatgtgggggcacgggcgggagtaccgcaagggcccggagtcgctcaaggggacgcagacactggcgatgctgaagctgccgtgctactgctgcgcggcggggtgcaagaacaacgtcgcccacccgagggcgcggccgctcaaggacttccgcaccctgcagacgcactacaagcgcaagcacggcgccaagcccttccgctgccgccgctgcgccaagcccttcgccgtcaagggcgactggcgcacgcacgagaagaactgcggcaagcgctggttctgcgcctgcggctccgacttcaagcacaagcgctccctcaacgaccacgtccgctccttcggtgcccaccacctccccgtcgccgaatccgccgccgccgccgccaccacccccgccgacaaagaccgcatcataagcttccaacggtgagaaatatcgatcggtcgaggtcgacgatgatcgatcatgatgtgtaggctgcagttacctggttcgttactaagtctatgtatacgtgagcactgctgctcgcgtatatatctacttagtaagttaaccatgcaattgtccagcatatagacaacaagttaatcaaactatagctactagctagagagtaatgtatgctgatatgtgcatgcatccgtggggatttaggaggaaatttaagcagactattagcacacaataattaaggtggctttcagccggtgccgatcgaaagctgtgagcctgtgaagtagatgaattttcttctgccagagtgtgagctgtttagtgaggctatgtccccagctttgtatcggagaaaatttctcagcttcacaggctaattaaacaggtaatttggaacctattttaatttacatgcatttattaaacgattattgatcaatgagagagctgattaattcttaacttatatcgatcggatactgcttaatttaccatcatatatctgtgtagttcttgattaattacccttttcccccatgaagtaatcttttttttattaattatgcatgcatgcactacaattttttttatcatcagtatatatataattttgttttcttgaaatctgcctgtttcaaaatttatagaagagcaagtagaatcatggagttctgataagatgactgaaataatgctatatgttgaagtcatttctgtggttttccatgcatgatcgaaattcttgggtcgatcatacatctgcaggggaattctccttttgataggagaaatagtgaataattatgttcatatatccatgtgagaccgatatataatggttcaagttacataccagtactgattattagcaactttaaataagctcccacattaatcggagaattagcgaataaattggctataaatccaagtgggagcaagataatatatatataatggctaagattaaaataagagcaagttgttagttagatttttcataaattttaaatcatgacaatactatagtgaaggctccaaaccatgtataactttgtaatatcaactcctaatccccaaactgttaaatgaaaacctaaaattaagactccatgggaatcgcaaatttttatttattaattgaaaaactttaaattattaaattaaaaaactttaaattattaaattaagaaaatataaagaaactgaaatgttattaggtagattctacatgatctttttgtaagatctatgtttcaatttaacctatgaccattaattaagttagattattttatttttatgtaaatacaataaagttcacgtataacctataccggaatttcgatggagattattagaccgttttggaatgatacacatgttacgaaccagttgtaaataaaccatgcattaggcagaaaattttgccagttagcaatacccatgtataaaattgtccgagtacaattttttctttactgagaatagagtgtttatattaaccctgatggactaaaaaggttaatttagattgtcacccttagcaactgcttcatgccacctgcagctagcatatgacaaccccggggaatgatttttgcaggtaggagtaactgttcgtctgcaatctaaagaaaatcaattacgtagtactccctccgtcctatataatataaaggattctgaaataatgtgacatatatattctagtactataaatttggacagagagtattaggatgtgtcacattcttcatatataatatcttatattttgggatagaggaaatagtggatacgagtggttgctagctctgtttaatctctaaagcaactcctgctaattgccacaggcgatatatgtaggtttgcagttagacacctaactaatttcgactcctacgactctactagttgatcacttgagtcaggctagctataggatagcatgcgacgtggaggatgctatgcaaattttggcatgggttgtgtttagatttaaactttggatccaaacttttaactttttctattatatcaatctatcatacacataacttttcagtcaaatcgtaccaattttaacctaaacttttaattttgaaagaaattaaacatagccctggtatgtggtgcaccgtgcacgccttatatggcgtttgctagcgccatagccgtagctagcaaaaatttcaacattcttcgcggaggcatatgtggcgaagtcaaacttagaaaacgacggattcacgcgcagctagatactagctagccaccgatcgcgtcatcagacacggccaaaaatcaaaaggctaatctggactcaagtgcggcgcggtgcacctagattaagcgtaaacgcgcgcggagacacccaccaacccggactaattattatgagggctgctaccccacgggattccgttgcttctagcagtcacgggataactaaaaatcccgagagatttaataagcaccatcaatttcgtggggaagcccacactatcctgcgattccaccttatccaatcctccctggtaccttgggtaaggtaccgaggtggtacctagtacactgatatcagctggtaccccggtatcgactaatacctggtacctgggtatcgattgatacctggtaccatgggtattgagctgatacctaggtatcaggccttggtacctgggtatcgactgatacctggtaccctgggtatcgagctgatacctaggtatcaggccttggtacctgggtatcagtgtaatatccaaagagagaggaggaggaggagtcgcgggtcagggaggttgagcagcggggcggcgacggaggaagaggaagaggaggcaatatatctggtgcctaccttgtgccattccgtcgctcgtcgtcgtgcctcgctccaaaccgccgaacccgtggctccatcgacgccacctagagcagctcctcgtcgctcatgttgtgccaagcgctcgcccccggtggccgcgtcccccactccctgaccgtaggaggcgccagcgccgccgaggaggagcagggcggcagcggcgaggaagccaatgacaagaacgacaaagaggaggagcggcttgaggagcttgatggggaggcttctcggctgtcgtcgcccgtggtggtcgggagccccgctggctgtcgtccaggtcgtccgcgggggttggtggtgacgacaccgtcgtcgtcgtcgccatcgttgccaccgccgtcgtcgccgtcgccgtctccgtgctcatgggtggcagtcacagagagagagatcgagtggaggggaagagacagagacagagagagagagagcgagtggaggggaagcgacactgagagaggggaagaggagataaggcagtactactatcccgtctctacgggatgccgttaggtagtttttttgaattattatggcaagaatatatatattggctttatcgagctaagagcccaggtgctttccctcgtccacatttctaaaggcttctgcgtgggggtaattaacgacgacgtaataacgagctttttatttttggatcgaccagttagtccaactttgtggctcccctggaccgcaaccagctggtcacacacacgcagcgatgtggagcagcttgtatcgtctccagccttcacttggagtctttgtgtgagtgcgatggtaagcacggaaaaggaattttggatcgtgtaattaaatggtttctgtgtagtatctgtgttagtgcgctaccttgaccacgtgaaaacaatgtgatcgagtaaaactactagtccatgtgcatgcatgtttaccagagtctcatcatgtatacgcccgggcagtatgttagcaaaatgaaaaaggaaatggcttaatatatatacttacgccgtatgcataacactcacgcatgatcgatgtacagtaatcctccatgctgtatctactgcctcgtcatgggtctgaacatgtaccgacgacgacgatgggtcgggggaatgtcaaaaaggggaagcgcgcgttggcaaaggtatcgtgaactcgcgatcggtcgatcgagcaacaggcggccggggccgggggaaggtgaccggtggtccggtgcaacgcatatgcctcccctcgcgttaattctttcctgcctcgcgcatatataccgtacgtgctacatggggagaatataagggcctgtttagttgtggtgaaataaaacttttttgtgtcacatcgggtgtttgaccggatgtcaaaagaggttttcggatacaaatgaaaaaaaaactaatttcataactcgcctgaaaaccgcgagacgaatcttttgagcctaattaaatcgtcattagcatatgtgggttaatgtaacacttatggctaatcatagactaattagactcaaaagattcgtctcgtgattttaatgtagattgttcaattaatttttttatctatatttaatatgctccacacatatgtgaagagattcgatgtgatgtttttgtgaaaagtttttgggactaaacagagccttaagaagaacccgctgcgcaccaccaaagtggtacagtgatcaatcgatttaacccattaagcattattaacccaccacgagcgcttgtcggttaaataatcggccgcccatgaatgatccccatttcggccgcccggccgaccgcgcgccggccaatcggaccaaggaaatcacgcgtgcacgtggcaccagcagccacagcggcgcgagatgcgggtacgatatacgtacgcatgcgtgaccgcgcgacgactgatgggaacgcgtagtaacgtacagtgcggctggggctaattttagctagctagctctgacgtgcggttcacttgtttgtttgcgattgtgtcccgcaagcgatatgtatagtgctcgatcgagcgaattgattaaggccaggtgtacacgagatcctagctacaagtagtaatttggattttggattttaatcatgcgtagcaaattagggacgaaatctctctctcgacagcgcatgcagcagagcagcagcagttatacaaggatgcatgttcacatggacaaacgcggtttaccgtacgttgcatgtacacgtgttggatctgatcaacgtcatggtcacacgtaggaaacgaataaccgatcggtgctatatatacgtgcagcagcggggccatatatacgtgcacgatgtgcactgacatatgcatgtgtgaatatgtgatcagatttcgtgcgtactgctagttgcatatttcatctcgttcacggtcaccgagtctcaggggatcatgattatagacgccggatgagaacgactttaaccagaagactattgagacaagggccaaaagcgagtaggggtctcgttttgtttcacacattgtcaggagctctctgcagacatgttgtccaaaatctttcatgcaccttccaatctccttttcaacatcggcaagtttaaggccatagttcgattctcatgcattttcctgtctctacattctgctatttgcggcagcaaagccaaataatgcatcatgcatgcatatttctacccatgctgtacttgccctgttgcccaacgggacaatatattgctcgaaccaactaatcacgtacaaataccgattaattaaccataatattcatcataatcagcaatgttttatgcaaagcaaaacccctctaccttggggacgatataggtgcagatgctggtgcaatctcaagatgacaagttcatttttaaaaccgttctaatctgcatgctctcgtcacaatacgtactagtataaaattccagacaagataaacttagcaatccaatgaagattgcagctgccgaccggtagaaccaaattatcctttacagtaaaataatccacaaacataatcagtgttatcctggctgagtatggtttgggatatagacgtatgtgatttctgttgagattatgggcatataatgatttaatttattccataaataaatcatgacattacatatgaaaactagcatgaacgcatcattagatctacacatgtaaactacgcagaataacatgaacagatcaaatatgcgtaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatcagcaaaacaaaactgcaaaaggaggctgcatctgcgcaagggtgaggagccaatttttcggaccattcgacgcgtacgtcgtgcacgcgcgccgcccgccctgccgccctgccaggcgaggcgagcgagtgcgcgcgtgtgtttcccctcttctctccaccacacatgcttcaagtggctaggagggcatcctcccttttaaggaggtccccatctcctagaataagcaaggtggtactaaactccacatgcatgtcatcccatgaggtgggcttttgtgattttccaaagaattaatcttcgagtgggctaaggcccattcattaattccaacaatttcatagcatgcccgcggcaggtatgcaaggaaatgttgagcaaaacaatattagacaatgtgcgacaatcacatcaggcagattactgaatttgacgacctgttaatttattttgagcctgcatgcgcccatagctcgaccactagatgcactcagaaaagcggtcctcaaaatctcaagaaaggaataaagctgtgtcggtttgacatctaatttggtcctcgtacagcttacctgacggaaataatctacgccgtccttctcaaaataatataagtatttttagacttcagcataatttttgagatactactttaaccaataatatttataaaattaagatattttaaataaaaaaagttgcatgttagaatagtttgtttaataataaatctagtgacatcaattttacatgattgatttttttttttgttattaatagccaacgtttaaagtatttgacttggcactattctaaaaatgcttatattttgggacaaggagtacttatctgttttaatatataagaaaatttgattgaatgcgatatattctaatactacgaatgtagacatgctccttgcattgtctaaattcatagtactgaagatgtgtcttatctaaccaaaatatcttatatttggggtggagggagtagaagaactgatgcctacttccatctatccacaataggtttatcttgcaccctcttatttatcctaaaataaattcatttagcaatcattcaatcaaagtttataaaattaaagaacagttatcttagaactaaataaagtgaataattatactagaatatgataaagcggtagtgtattttagttgttttatattttattagtatgtatgagataaataaagaataaatttattttatgatatatggagtatatatttcgttttcagtatcagttgagcttattacaacatcacttttacacagacttgctaggaccctaggggtatataactttgatataagacagatgatactgtcaatttatgctgcatgtgccctctgtcgacgagtgatactcgcggaccagaagaatagggtattggggtacgttagaacaggatctacgtagtacgacatcaaaacagacaaaagacaatgattacactggttcaagccccttatcagataatagtcctagtccagtttatatgggattgatgatgatgagaacagattacaaagagagtaaccgaacagacaataccgatgagatcgtagtcgagggactcgacaagatctcccggcgagttggctccgtggactccggcttcgtaaactttggtgggtgtgttggcgatgaggtgcgatgccttttgcccctccctaggggtcccttttataccgtgggataccttgacccttaagtaaaacttggagatatgtaaaccgacacgatatactatagattttaccctttccgagtaggacttttgcaattccttaacttcgtggagatattttccctaatttgaggtgaattcctaacggtgtatacagaaaccaaccgtatacgtgaaggtataccttatcggtatattccataagtcgtaggatagagggtatgccttatctgtaaccctgacaccctccatcccaaaacaaactaatcttatactagaatgtgatatatcttagtacaaagtataacaaattgaaacatattttatatcagatttattgtattaggatgttgatttattttgagatagagcgatggagtacttaactttctcctgtcaaccaccgtgttgaaggtagtactatacagtattctttcactgatcagtcaaagtctccattaaaaacgacaatacatagctgtctgaatgcattgggttatctgtactttatgtaattgactgcagaggaggtggttccgagttccgaccttccggcgtagtggcgacaaacaatggacttccagtgagcttgcatcagaacatagtcacgctggcgaagcacgcacaaactcgttcgatagctgcacgtacgtctcacactgtcagacacacacacacacacactttcaatctttcatggctctgattacattcaaacagtcaaactctgcctttggacaagtagagtcttcaggatggaccatattaaaaagttaatcaacgaagaaaaaatcgtatgcaactatgcattgaacaggaaaaatacaatagatgacagcaggtcaatggtagtaactgggtgaacatatgtgtaggagttcaacttggttgaaccctgtaattttttttctctttctgagaattttcggttgccgtctactcttctgagttatgggtggtaaatatcacaatcagccatttagctcccaagtcaaattaaccacctaccacaaaataaccactactggtatacactcgaaacagcaccttaactggttgacactgagtctgtgacatttgtctgtctctttcattctctgaataataaaataagctcggcgtccatggcatcatgacatgctcagctcagttgctacgagtcactagtcacactgctggctctaaggttgggttctagatttattgattttgtctctgtactcactgattctggtttagcccggttgttggagggaggctgtaattctacactcggacctttactgggctgtgttgtcatcgtttcaataggctgaatcttcaccggactctttttaggaactgaagcccatcttcatactactccaatagtccaatctgctcagctgcggagttcagacttcagactacagccataaactggcaatctgtacctgacatacgcactccaatgtcacagcagcactagcagcaacaaagcatgatgcaccacgaagccggcaaggactggtggaaggctgggagcatcagtgagctccaaaacatgactaggctgtcaaatcactttattaggatacaccgattagtggcagaagttgcaaaagttccttgtcaggcaagcgataagcagcttttaggtactgattcgagtattcttttaatgctaactgcagtagcacgggcgcgtcctttgaatcaatcctggtaatagtagtaggttcatggtgtaaaacacatatggctgtgttcgctatgggttgttcccagtagcacggaaaatagagcgatctattagcacgtgatcaattaagtattagctaattttttaaaaaaaaatggattaatttgatttttttaagcaactttcgtataaaaactttttaaaaaaactcaccgtttagcagtttgaaaagcgtgcgtgcagaaaacgaggaatataggttgggaaaatggacgcccgtacacagccatatgcgtggtcgtcgttccaagtttcaaccaaagtacatagtggtaaagaacaggtaataggaccatctatctactcagaccccagtacagtggtaatattactcatttactctattgattgtactgtagtaacagctaacaagtggtctcacatgtggactatacatgtactacttgcatctcaaatgctcaccatggagctggaagaaactcaatatgacatgaatcaaagtctcaaagggtgtctactgtggcgtgcctaatctaggtataggcatgtaacaagttgaggcatgcaatcaaacacatatttcatactgagatcaaaacacaagattcagattgtaatgtatataggcaaatcctcctactcctttcgaatggttatatgaaaaggaaactttcaagtgatatttgtcgaaaattaagcaatacaagcaaagagcatccggatcatcctgaccaagtgcaaccattaacaatttagcatatgattcatcgaaatggatagccatttcaaagtaggagtatactatatcaggatcattttgtgtatggatcccgagttcataaaagaacctccccatttcaagagagtagcccctcagtatcagtacacgctagcacttcgatcactataatagggacgattatttgagtcaatcactaggcgggatcggaaagatacaaacagaagagtccttaagacaaggataaatgtcaaaagtgatataaagttgttataatttgtagtacttagtacttttagtttaaaataagctccagcacactcaatatcatgccgggagtttccttaaacttaataaaccaccgcgtgatgtatagcggatcagcagatgtgtattccctccgttctataaaaaaaaaccaaactagtaccggatgtgacacattctaatacaacgaatctggatctagaatatgttacatcctgtactaaattcgaaaaccaatctagtaccggatgtgacacatcctagtacaacgaatctggatctagaatatattacatccaatactaaattcgtttttttcatgacggagggagtaacacggtggaccaaatcatcaatcgcttactccgtatttcacacattgatctggattaaataacaacggtgaagtggttactcccataatgtatcctcatcatgatgtgtgaaggtacatgaggtgcggaactggcgcatccacgaacatggtggattcacttcaaagaaacaaggagaatattgttgtcagatcaaatcatggccggccatgagatcgtttagttacagtgggaaaacatcgagtatactagggaggttttgggatttagggactaaactttagtccctctcacaaaagtataagtccctccctagagacttacggtatgtttttgagatctctcccaaacatcccctataaagtacacaaatacaaatcctctagattcactgttaagtttgtagtgttgctccctgaaatatcaaagcatctttttctcagcacaggtaatacattaaagtcatagtagtgcgttcaccgcaaagaatttataaaaatgaaatgaacatagtactacaaaacataggagtggcaactggcaacacatacatgcacaaaccaacctagtgcaaagcttcgagccttcggttagcaatcggattagagaggtagaagaagtgcattggcagggaaggacttgcacaagttattttccgaggtgaaatgagcagtcaaattggaatttggaaggtacacagatgacacaatgcaaagctaaagttgtatttgccatttgggaaacatggagagcaaagttgcagcaaggctgtatagaagatgtacaattgattcttcatgaaattacgaagaaagatcagtctaaattacagttacagtgccaaaagcggaagaaatcgtcctcgtatgctaatggagggatcctaatgcttagtacacacctccaatcccaccatcatatcaaaatttcgctactatttcaattcgtctatcaatctaatcacaaaaaataacccaccttacgaagcaacattttacactgagccactaatacaacacaatcctccaccggaaaaaagtggcataacgtcgagcaccttgcgcgcacgcgctctaatggtagaacacgacgggcgggacggcgataccggcgtcgttgaggaaggggactacctccggccggtcggcgaggtcgcggtagaaggcgtactccgccttgtagtcgtggaggtccagctccgccttctggttgctgtggtaatggtgcttcgcgtcggccgccttcccgaacccgaacacgctcaccctgtcgcacactcccacggcgaccatgatggcctgcatccccgacgagtagtggaacatggccgcgtcgcgcgtgctgctccactcctcggccgcgcgccccgtctcggcgacgaagcggcggagcgagtagtacttgacgatgcgcgcgcagaggacgtcgaggcgtggatcggtgacggagatggatgcggcgtggagggagcgggaggaggcgttgcaggaggcgacgtcgaggaagtgcgcggcctggcagatgtagagcaggatggggacgccgtcgccgtaggggtggcagaagcagttgggacggcgggcgcagagatggaggacgttgctgttgatgaaggagaggttggtcttggcgccgacgttggcggcgaagccggagatgcgggcgttgttgaggcggaagacggcggcgtgggagtcgatgagggcgccgtggctggcgccgaggaggatgccgctgttgcccacgacggcgcaggaggggatgcggccggggagggagaggagggaagggagattgcggaggacgccggggtcgtgccggcggaggcggtgccaggagcggagcgcgcggcggagggatgggtcgaggtggagctcctggcgcgggagcgggtggaggagggggtcgtggtcgtgatccgggtggtggccgcgccggtagacggggaactggtggtggcggaggtgaaggtggagcctgtcgccccggaggcgccacgcgcgggcgcgcgcggacgacgccgggaggcggccctcgaggaggtcgtccacgtcgcggcgcagcggcgcctccgatggatcggccgcggcaaggcggaggagcgtggcgttgaggcgcgcgggatcaagcggcggcagcggcgcgagcacgggagccgggcccaccgacctgcgcaacacggaggggaacgaggccgcggcgcacagcacgacgaagaggagcaccgcgaacgggcgccgcagcggccgcttcatcgccgccgccgccgccgcagcatccgccgccgcgggctaagtgggtcggggccgccgcatggggggcggcgcatcagggagagagacacagggagggttgtgttccgttccgtgccgtgcgagctgagctccgagtgccgcgcggtgtggggcgacgagttttttatcggacgcgatgcgttccggttcgcgaggtggtactaaaatagggagcgtgatatgtttgcagtttgcggttggttggaccttgggttcgggggaacgggggatccaatgtgctctggttgggttcgtgcattggagggagtatataatgattctctgcagggaacagggctgcgggcgtgggtcccacaacaagcctgtacgcatgacaggtggggccgtcggtatgagttgctaagcttggcgtggccacgtggtgtccagcgtagcgttcgatgtgtgtgattcatgcagaaacgcaatgaactctgtacctcgcgccacatgacgctttttatgattgttatacggcctcctcggagtattaacaacctgcatccagtgttttacgtgtgcaagctacacgttcaaaaaaactagtactactagtagtagcgtatgttttcggcgtgtaagctatgacaaaaacagagaaatttcgttgtgttttacgtgtctgtatagtagaatttaaactcgtcgcaatcgattcattgaattctttccaactcagccagcctaggccggtagacttggggtcaactttggccggaaccaatccgcctcggttaatccacgccctgatgttgccgcccccagccgtcctggtcttggtcttgtcttgtttatcaaacatcagaggttcagaagcgttcaaccctctcaggccgtacctttgttaatcttatattagcgataataaccaccgctgtaggttacagagatcggcgcaggtggatggatagatatgctcctattctattacaacaaactcaatctagccttatctaatcatatctatccatctaaccatgccgtgtgcatcacacaaatacatatcacatgtttaacaccctccctcaatcataactttcctaagttaagattgtacttaaaattctccaactgtcgaactgacaaagcctttgtaaaaccatctgcaacttgatctcctgtaggcacaaaatcaatttctaacaatttccttgaaactctttctcgaacaaaatgataatcaacctctatgtgtttagttctggcatgaaacacaggattagcagaaagatacttagctcctaaattatcacaccacaactttgccatagatggactctcaacttgcaattctgccaataaagtctgtacccacataatctctgctgtagcattagccaaagctttatattctgactctgtactagatctagaaacagtagcttgtttccgtgcactccatgacacaagattatctcctaagaatactgcaaaacctcctgtacatctcctgtcatctagggcaaccagcccaatctgcatctgaacaagcacttactaacatag

SEQ ID NO: 68306 - DNA, 607 bp, Oryza sativa
agagattcgtcgctacgctactcgtcgcgcgcgatcgaagagagcaacgggcaccatcttagcggtggtggtgggagctagcagccgatcgagtgccggcacgccgcgctatcgggtagtcagggtcaaacgaacacacaagggctataggataggataggagagggacacatcacgcactcgtcgcgcgtgcatggggccggtatagcgcgcgccgtgcctccgccgcagcgtggccgccgcgctccccgtagcaacagtggactagtagctcgctggtggagtggtggtgactggcgagtgacagccactggtgtgccgtgccggccagccgtgcagattgctcgccgagggaggcatgcactggcacgcgccacgtacgggcccaggcccagcgaccgcatatgctggtgtgtcaccacgggcttaaccaaccagagcagtataagcatgggtatgatacgtacagatccgtttatgatggttgcatttccccgggaggtaaaaaccgcggggttcatcggcgttgcctgcccagcgctacctttctcgcatagtcgtatgacgctgtgctgctcgcgtcagggctaaagataacgctggcagg

SEQ ID NO: 68307 - DNA, 537 bp, Oryza sativa
tgcatgactgtgttttcttggacaaaacatatgtgcagattttgctggaagtgttgtaacaccatttttacatttttttataaaacggacgggttcaggggcacaatgtgatctccaattctccatatattcttttgaactaaatgccagcatgctgcaatggaattcaataacctacaccataatttgtaaacttgaacaaaatcttaaaactcgaatacatgatttgcatcagaccaaccagccacttgcatataaacatgtgtagtgtacaatcatctgcagaagatcatacgattaacgcgcctaataaatcttccaaacagaaagctagcgtgagcacatttcattgacagctaaaggcaatactagttttgccaaccacccaggtaacacaacagcagcagaaacgcattattgtgaagttacatttactgctaccacagatctttgggagaaaaaaaaaggcaacagttctttacacataatgtaaaattggtcacgacctattaatttggaaaagcagatgaagcacac

SEQ ID NO: 68308 - DNA, 37778 bp, Oryza sativa
catacattaaaatacggagggagtactacggtaatacccttgcattagacctaatgcgcttaaattcacatccctcctcccacctccagcattaactgcgggcctgtatcctcaccacagatccccaattccctcactcgcatatctgtaccatgcgccctccatgcgccctcgcattgcacttcctactttgcagtatgcactatgcccactaaatggctgctgctttttgacaggaaaatacattcatagaaagagaagggtgtccggcactaaagaattgtatttattttaaggattgacagctcagttctcttttcataaaaaatatatattattttaagagcaagaagttaagtttcagtttgccaacccattatttctccagatcattcgtctaatggtgaataatctgagttgaaccaatgctagcgtgggtgttaacatgctttcaaggaggagctaggcctacatttatttaggcttagggcctgttcactttgatgccaaaaaaaaccataccaaaatttggcattgccaaaattttggcatagttgccaaaattttggcatttgccaaaattttggcaacttaccaaaattttggcaggatttcttttatagttatcaaaatttggcagcaaactaaatgtggccacttttttggcaactttaccaaaatttggtaaggttgaaaatggcatcaaagtgaacaggcccttagagggcaagatcttcattttttgcaatcatggcttagatctgtataatcctcttgatttatagttaatagttttaacattttataaaattatacacagggggaatccctactgcttctgatataaataataataattctgagttgcatgtggcaaaacacaagtcttgggtaactgaatttgtgaagttacactatccaatccagtaaacaatatagacatcaagaaattattactaatgtccctgtttgtttctccttaggattgtaagaagctgatttttaatttaagaatatgattttaggaataattttagagtggtttttgtcattttcattgtccagctcctttttgtaattgtcagcaatacaggtaaaaaatctacataaattattcttaaaaatctaactttaaaatctaataatccacaagaaacaagaagggctgaattgccagtgtagatggtgcaaactaacctgacagcaacaagttgctcggggaccaacttctccaatatcaagcacataatcgacctggtctcctcgctcctgtgtctcccaccattcgttatccatgtgatgcacattttgttttgaggtgtcataatgtccaattactgatgaaacatctggggtaccaagattgtccacaaaacctttcatctgtaaatcctgaagagaagtatcttgcttggccttccggttgggaatgggctgtttccaatgggttttatttgggtgatctgagtgaccatgattgttatctaaaccattcagacctaactctccattatttgatgcctggtgatcaggctcatgaggcaaaagcaatggaatgtcctggcatgatgctggtgctttcaaggagcttaacttctggcctttaatatcctcaacatgagtctgtttacttacttcctcatttgattctttgattttacccatgtaatggggaattaccatgtgatgttgaggcatcaataagggaattgcttgctcatttggtgctttgttcctctgcataagattgagttgtcaatttcaacggtgatagggatgagtaatattaaccagtaaacatacctttgcatagttccagcgctgaacaaaatgccttgctatgtctcggcatgcaggaccataaagagcacactgaacatcatgccagggcatgcgaggatatttagtacgatcaagctcatctttcatggtgtcctcccaagaatttggctcagattcccttaaacaagatagtaaaatgcaattagataggcaaaaaaaaaggttttagaatcattaggaaacattaatcgtgttcggtaaattaggaaacactatcctataaatcttgagataaaaatatgatgagagcacaaaacattacctaggattgtagtaatcttttcctggccatattgaaggaggaacatccacaactttatgctcaggagtatcataacgaccaaagcataaatcaaggcctccaatatagcatacttgattatcaacaataacgattttctcatgatgtgaccttcaaggcaatagccaaccataaggatctaattaactgcagaaatagtgtaaatgagtgtaaagttctcaccgtaccataagtatatgccagttgagaaatgatcagggtatcgcagaactttaacattctcatgaatgtttaaaagcctctgtttgctgtacatgctgttaattttcaatgcaagagaaacttccttgtacaaaagaatatagatctgcaaaatagtaccaagtcatagttatctgaaacttgcagttgagaagaagtacgaattaactcataataagcaaacgcagatttgcttaaaaaaaaacaaatgctgcttagtgtcccacaaagaaatgaaatttatacacactttcttaaagaattatgtacaacaaagcatatattcagcaatcctagtgatcctactattcataagatatacttattttggtatgactacaccctcaaaatcttacaatctaccttgcttccccaatcctaccaacacataagtccccagtgagcactgtggcataactaatgttgcaccccacaatacacctctgacaatttacacaggatatcatctggaaagggtaaaaaaggaaacaaaagtataacaatactatttggtcaaattttacttgaacaaaggaaactatcagttaaatgccattattggatagtattgcattttattttctaactctctagcagtcaaaataaagcaaatagtatagcaaagtgatgttagcatatgcaaacgacatttgtcttggataaaagtgatggagtgctacgcaaggtaatcgggcaatctttgcatgcgccatggataaagtgcacctacgtgagaaatggaggcaacttttgcatctttcttggataaaagtgcaactacgtgagtaatggagataacccttgcaagatacacaatgcatgtttatcacttgtaaagagcttcagaacacataatgagtatttttggagaattacattcttcctctattagcacgacatgcagcttgtatcttcacaaatacagaacattacttactttaaaatgcatacagccaatatctgcaaagttaaacttcatacacttgtctattatcatctcatgtagacagctaccagttaaacatttgatgctaccaaatctgttacaaacaaataaatactgcaaagcggcaaaataatatatacgagtgcacaactgaacatgattttagcgcttgaactgattgataacaccataaaacaatcacatacctgtacaccttgctttgcccttgattctagaagaatatcaagtctagaggattcatgatggtggaaagggcgtcgaaggtacagttctgggcacagccaccaatcagtaatgaatatctgcatttaacagtttaattatcttccactgcatggtcaaaattttaacctttttcggaaatagtagttgagctaatgaaaatcaacctccgatttggcttcctcaattgaagaagcaatagcattaaacgcagcttgcccatcaagaaaccattgtacgacgctaccatcttcagtcaaacccctaggtggtgcgaatgaaccaaaacggtgtgggtgagaccaaccctctgggggtcgtcgagcagtatttattgcagatacccaatctttcactttagcagaacttcttgttctcaattttattgtccgccccccagaagacaccttcaacaagtattagcacttagaaacttacagtgaaaaaacagatgccgcatgcccacatttattgcatgctaccatcttggtttacaataggaagatcaaggccaaggccagtatcacaaaagagcttgagttttattaacatcagcggagtactatacattagttcctacgtttttctatgacagaactatggacagctgatttgtaccaggatatatagctgtagatcaactagggagcatatgtagaacaagtactaatataaggaacgtgcagaagatgggtgataaataaacctgttatggttactagtttctcaggaagaaactaaaatcaaaaatactttcataaagatccaactcctaggaagaagctcagcgactcccatgaagcactaaagaagattcaccatgagtcagagccttaggtgtatacccactctatcttgcttaacgaaagttcatggtatggatggagtacattggacaattatagcctcctgatcttactacaattatgttcatgtattggtctggtttcatctgacaaaaaggaaaatatggtcaaaaccttttggtcattggatgtatccaacaaacacagaccagttaacaatgatttggtatgagcattatccattttgttaaaaggagatgaagactagagtatcttgtgaagtgccaggcaagcaaaatgctatcaaaatgggaaatgccttctttagaaaattttactcgttttattcactcatgtcaccagttcaggcacacgtattagagcctagaggcatactagcatattgtttttctagatcatattttaacaatgatttttttcaactaaacttagaggagcgatgccagttgagactgtcgccaactcagaaacatgcttgctttaccatatttagaagtcatatgaaactagattttacaattacatcaactcagaaacatgcttgctttaccatatttagaagttaaatgaaactagattttacaattagatacaaacaaacacattttgttttgactggacttaaaacttatctgggtaacaaatcaggttaaagaggtccatgggtcaacaaagtcttaatgttgtggaagacggtgacaaggttataagtttttttttttcatttgagggaggaacacgctgtagaccagggcatacctcaaatgcaaagtgcaatggattatgttccttaatctctcttgctagagtgctttggccttctccatttctatccatgtgaggtgatacatcaaagataactatatccaaaagctttggatcaaatggatcttggagcaaagctaaaaatcctggcttcagtacagcccaaacctatgaagaagtgttcaatgtcacgggtcacaaacaaggactaataaggataaaaatagatataaaataacatcaatgcgcatcatttgataccttctgccagctactgttgcagaaactaaaacatccacacaaacaacatatgttactgctaccttcgtcaatttttggtaagtgtccaactgtaacataatcttcctttagcttaggcccatattctggtagaaatgataacagagagacttccaaaaatttacaaacctgcattttatttcatgttacagtccaaaagagggtagcaccacagaaatatatcctaattgacaaattcgatgtttttggtgatgtatagacattataaccaaaacaaatatgacgagagtatagagaaaatataggctttttggtacctctcttgagttgacaatttccatgtttcccaagaaatggttcagatattcttgcatggcaacctttgcacgatcagaaacagattgctgacgaccaagggctggacgaatgacaggcaagacagcactagagggaacatttctgcaacaaaagttttgtattcatttcttaatatgcacaggtaaacttatggcaagtcaactactccaattgcatcaataaactggttacagaaagatttcattgctgacgttttcgtcttcgttttagtccattaaggtcaaaattattaatagaacagcattacctatttttgacagagtgttcatcatgttgtgaaggaacatgcacgtcatccgcttcatcatcatcatgcacaactggaatatgctccccaattcccaaattttgaagccattccttgacctttaattttgtttgaaaagaaaaaagaggttggttcagtttcacgactgaaaaggaggttttgttctgagcagtgatatctctcctactatgaattagcagccgagtaattagagtagaaagagcagtggaacaaaggtctgaggattctctcattttttattaagtgcattcttcatggctataataataacaataggaatggcatactagagatgcttgcaacaaatattatatgtttccacaaacaagtggggcatgatagttcatggcgaatgaaatgcaaaatagtaaaccagagaaaattatgtttttcctaatacgtttacaacatacaataaaatgtcaaaatgactgtcaacaaaagtggtgctgcaaaacttccagtaacagatttttctggtgtccaatcacagcattcagcatttcaattgaaaagataaacagatgcaaatacagctaacgaactgtgatgattatgtaaccgacctgttcctgtttctcatggaattcctcaagaaatgcacgccttttcaacgcaaaatgtagatatagaacctgtgatgccttcttatatagaagccacctaaactgatagaagaactagttaacattaccgaaggataaaatgttcataattcgcatttcacagaactgtaaaatctcaacaatgcaaaaaggtgaaatgaaaatagcatgtcctggataataaaccactttcatatgatttttttttacagaaaaggaaaaccattttccttatggaaaagaggttcaggatacgaatccatagggaacagactaatggtgttagtttttttttacagaacatatcaactagacataagctgtgatagtgcacagctcatgttattccttgacttgggttttatgtttccatgtaacaaagcatacatgtgcatccaccaaattggaacctaacattacaagaagttcaaacagtacacttccttggacccaaaaaaaatgaattacagataggcataggtagtcaactctaaattcacgtgaaaataacatggaaatttcacagtcacacgcacagcactgtatctgatcccccccccaaaaaaaaaacaaagaattcgcctgcatttgcactgaaaatttaatgatcaggtcgcctgagtttcataccccaccgaatcagtgaaacaaagtaccaaccactctttcgtgcaagctccaccaagctactcattgacatagttgctacacagacaacagaaagggaccccttcttcttcttcttcttctttttttcttttcgttttctagcagcggtggaggctcactctatcttaaaccgcacaaaatcaggtagtatttttttcttttcattaaaaaaaagggaaaaacacattcagaagtcaattggaaatcaaatacgcgcaggcatcgacgaaacaaaccatcaaacatcaatttacgcaacaacactacaatgccaagcaccatggacgctgccgaatccaaccccgcctcaccaccgaatcgcgcaacccgtaccccaccccaaaacgaaaacccgagcaggaggaggggggaggaagcggacctgcttgtactggacctcgacggtgtaggagagcagcatgggcgtgatgtccccggcgtcgggccgcgacaccccgacgatcctcgcccgcggcagctcgtcgaacgcccccgccgactcgggaagccggaggaacgaccccgcccccgcagccgccgcctccccctccggctcctgcggcatcctcacgtatccccctccgtactcctccacctcctcctcctccgcctcctctccctcccgcgcagccgaccgccccccgctcatagagacacaacccacgaccacgagatttttacttccggagagagagagaatccggcgaggtgggggggaatcggggggagggcggcggttgggtgctcgttgatcggatgcggaatgcaacgggaaggaggaggagggaggaggtgaggtgacgaccggcaggtggagagggaggggggaggtggtgggatctaatattttccggttccgttttgagatggaattggatgggttggggacggtgacggggtgacggcacgggaggggcgtggagggacaggtggacgtggctgccccgctggtttcgggggcgtgggggccagccgtatgacgtggcatgggagagcgcctctagtgaagggcacacttcattcaatttggctcaactagaaaagggtcaaccatggcatctctgagcccattctcaactcaatggctagaatagtgtcaatagcattaaataaactgtcacctaaaaatctatgatgaaagatgatgtagcaagtgataaatgaggaaagagaaggaaactaggtctttgcatgagacatgatttctacacaatacccaagacatcatgtgagataagtagcattaaatttaagtatggaaaagtgatgtttgtattgaaagagtagtgtctagtactatctccattttaggttataagactttctagcattgcccacattcatataaatgttaatgaatttaggctcacatgtatgtctagattcattaccatatatatgaatgtggacaatgctagaaagtcttataatatgaaatggatgaagtattagtttcttgataatgtgaagtttataaaaattatatctaatgtcttaggttgggaatagcctgatgcaatgttgctgctagaatgtggtgacacgatagtaatctacttcctttttttaaactatgtagtaatctactagtaaaaggattcaagtcactgacacatatgggccatggcaaagtgaaaccacatgtcagtgactcaattgcttatacagtttagtcagagaatatgcttatatacagtgcgttgtcttaaaaaaatgtactatagttcacgtgaatatgagctaaaacaactcaagaaacaactagcatgttttaaatatataaaaggttttgtccacgtaattatatagccaaatcaccttatattctgatatagaggtagtaccttggaaagcaagaagctaaactctttcagtaaaaattactcacatatcttatctaaataaaatatgaagtcaccgagcaaaaaactttctatagaccaagtgtactgtaaaagataattcaatatttcatgggttaaagaaaacttctgccatgcctagtattgtttagcacttgaattgtcatgaattcatatgaccatcgaatcaagctcctatcactgactctataatcccgaactgtccttgccctttcctctctataaaacatcgtttaattaaactcgatgagaaaaatcgtttgaaaattaatcatccttcccagcaacggctagttagctcacgtaaaccatttgcattagctggtcccagtggatcgtgggacacccaattgactagtactacggtaaaaagataattaaaaacacctataggagtacaaaattatcctcgtcgtttttggcaaactacagccaagcaatttgactgatgctaacttaattaggccctctttgtttaggtttataagccaaaaagtctaagccaaaacaaacaagcagctttttcatttgtcttttttgaagccataagccactctaacactattaagccaaaagctatgttggagaagttttttttggcttatatgagatagatatatgactccaccactaaacttaggacattaaatctactggcttataaatcatataagccaataagctgacttaaaagtttaggccaataagtctaagcctaaagagggccttagtggcctcaaatgaaatgatccgtagggggtagttgatgcggacagatcgatggatggaatcagccggaggatcgcggggaaagggcgcgagaatatgcgtgttttgtgcggagatcattccttgcaagataccacctgacgtggcgcacgcaagtcgccgcgggagcggacacgcatatctccgtggcttttgattggggtttaacgtgagggtgatcattggaagaaaaaaaaatttaaattatattattgatttttttctaagaaatatgcgagatttaaatggatttgcataaatagatagtgtcacggtacgcagtacgaaatcgtaagaccaaagtgcgatagcgatgatggcatgatgacgcaagtggtcttgcagggcgagagtgctagatcgctcgctggttgccgtagcccggaaatgctactgggcgatcggattcttcccccctcctccctctcccatcctccacctggtttttttggcatcgtattattttcctattctagtaatttatttatgcacctaaagtttatacacctcaagtttacacatctaaagtttagagaccaaaagtttatatatccgattcaaatttgaatttgaattcaaatatattttatatatagtatttctatacatctaaagtttatacacctaaagtttatagacttaaagtttataagtccaaagtttatatatccgattcaaacttgaatttgaattcaaatatttttcatatatagtatttctatacatctaaagtttatacatctaaagtttatacacctaaagtttatagatctaaagtttatagacccattttaaatttgaatttgaattatatccgatttaaatttgaatttgaattcaaatattttctatatatagtatttctatacatctaaagtttatacacctaaagtttatagacccaaagtttataagtcaaaagtttacatacctgatttaaattttttatatatagtatactatatataaatttttctaactttttattttttaaaaaatttttgtgtggtgtactgtagcagaagagaagaaggggaggaggaagggggagaggagggagctgggtattgtatagggggaggagggcagatccagcgtattgtataggggaggggggcagatccagcgtatcgtataggggggaggggagcagatccgatcgcccattaccccccccccccccgggtagccagtaggagaagcctcggtctttattcctcgagcgacaccggccggaatgatgctaaggccactctcaatgggaagtttcacggcacggtttcacatacgccacatcatgtgtcaatgcattaaatgtgcatgaaactctcctgaaatgcccattgagactggcctaatgacacaattaataataatcttaatgagtaacaattaattacttcctccttccctaaattttgacgccgttgacttttctaaacatgtttgaccgttcgtcttattcaaaaacttttgtgaaatgtgtaaaattatatgtatacataatagtatatttaataataaatcaaatgatatgaaaataattaataattacttacttttttgaataagacgaatggtcaaacatttttaaaaaagtcaacggcgtcaaacattttggatggagggagtaattgttaatggtgctaattgatccattaatcacgcgagtgtcatggggctgtttactgtatcgttggtgtgaagctagctttttgcgtttgctgtgtgcttggcggacccaggattttaaccctgggtgtgcctatgtcacgagccaaatcatagctttcacagtttataaaaaagtatagtacaaatggttattattttgacgttgaaccagtaatgcattcttagaggaactgagcaaaaatataacaacaaaattgcaacttattcctattgtcttccgatattattcttccctattttgaatttccttataaccttgtgttgacgtaaaaacacgaggcctgggagatctgcttaactccagtacaggtccaaaacttgcctttgggtatgtgagcgtgccatttgatttgatcctgcaatcaacaagaaacaaagacaaagaaaccgcggttaaatccataaacgatagtcgatcggctagatgccgatgacatatcatttatctttgagccgatgtcatatatgcatcgatcggcggtcattaataagtaagaaagaactaaatctatttgatcggctgtagatattaacggtatatagtccttatatcgatatatacttaaatcaagtgattgggatagatcggtcgccatgccgagacagtataaatcacttagatcgaaatatatattaataacgagactatatgtgttcatagcatagccaatcagatagatctagcatgtatcggctaatactccgatactactctatattaagatatcacagcaagtaaaatataccaaatgaaagcctaatatacttaaatgcaataagatcttaatataaagggcagatttaacatgtcaatgaagcacataagatgaatatagttaaattaggtaagatcggctgaaaccccgatactaccctaatcggcaaccaaagacatgctagagattaaaattctaatcacgactcataagatcaaactcaactgatgcagctataagtatgaaaagaaagacaatatctagacaatcaagccgctggaagtttcatagagtggtggatatcctatataatctaagtcaacattgatatttaacctaatcggctgccttctactgacagatgttagccgattgtaggttagataacgatattgtcggagattatataagatatatgataactcgacgaattacatagacaagattagagtatcataaagatggaagcactaatcccgagaacgcaagccgccataacaagttttatctcttgttgaagatcaaaactgatgcagctcaacccgaaagcaagaacttgtcgaaacaaaacgaaagtaaaaagggtggcgatgcgccgagattatattgaacgtgtgttaatttgattacatggggctcgggtctatttatacccgagaattacaagatatgtccatatcggacacgactcttatccctaacaaactctaagataccataagtctttgcggcagacttttgcccaaacatatctctaagaaaattacataaaatatcctaattaatagatacaattgacttctcaggactctatccatgcacggcaatcatcatgaagcacgtcaacctaacccgacaacgcatgtcgtgccatattgtcggattcggctcaataggctaaccccgtctgactcgaactccgccgatcttagtcgtagccgattcggactcagccgatcttcactctgttttcatgataatctctatctcgaactccgtctcgatccctcctttacatccgatccttgaattaccaaatttggtcgttaacaccttgcatcaccatcacgagagtgaagccctggatatagccttggtgatgtagaacaagtgaaataaaatactccctccgtttcacaatgtaagactttctagcatttcccacatatatatagatgtttatgaatctaaacacatacatatgtctagattcattaatatctaaataaatgtgggcaatattagaaagtcttacattgtgaaacggaggaagtatgaaagaatgcctatgttcctcctcataattgattgattcaatttgacctaatcctagagatcatgcaacatgccttcactgatttggcatttccattttaatcaaatatagccatctaaggaaggaggatgagagattttgcaacttcagatattattttttcagggttttcaattaatccctgccaatgccaaagacaagattagagttatagaacaaaaatgagaaaagagtatacatgcacagcacggctgaaccctgctggtcaccgcagccgagtctccttgtcctcgttgccttgctgattggcgcgcttgccaccagaaggaacatgatgcggacatcactatttcggatacatacaacaacaatcctccaccggtcactaaaggaccgataacaagagctcgcgcgcaacaattgaatttagtggtgagctcgttcctatattcttctttgtacgaatttgagaatagattgctacctaatgattatattgtgattaggaacaatggaggggacaatgagacacttggagaaggacttagagtcataaacgatcatcgaggacgtccaagtcaaggtggaggcccaaacaaggtcgacttcgagtgcaattcggagtccagtaccagtatgcactaaaacgggcgcccagatcgcatacgtgctcggattggggcgttctttatatggatggaaagctaagaatataacatttccaatggttttggtcccacgtccaaattctttccgaatcaacagggattgaccgaacaagttgacgtccagaatctgttccggtgctgcatcaccgtatttgggcctttgagctgtgtatcgtgttggaacccattagggttgcgtcaagggttggttgcacgaccccaaactctatatatcagtacccgccgtcacctttagggtttggattttgcttagattattctgtcgagaacaattttgccgctagatcggtttgtaagacctcaacttgtgagcttaatcatttatctgcaattttggttgtattctaccttgttcttgtttgttttcttctattcgcaaacagggattagccttctcggtaaggtcatctgcgttttgacacgggtgataaccagaggagacatggtgctgcgattgcggggctcaagagcgtgtttgttcaagaagccggatcgatttgtgtcgcgactccacccaaatcgttgattatcagaacctttcagaatatcgagaaccctagtccacatcagaacacatgcacacgccaccgcatggttcttgtggtgagctatgcgagaacgataaaccactaggccttgatctgtcgacttcttgataaaaaacgaggcaccattcatcattcaggccaactgaagcatactagatccccttttttttccgtaaattttgggtatgccggtgcccacccgacacatccccagggtccacccctggcttaagtagagtactgagagggtacatgtgggaccggccaacagaaatggcaaacaggaggaatagaaacgggaaaggggagaaaaaagaaagaagatatgttttcggatacaatatgctgtaaagggtgtggttttgtgataaaagattgctgaacttgtgaattttgcgataaatatgtctcaaagcttggtgttttgtaataatttactgatatgctagtggacggttgaagagatgggtttgcagtgcttccactagcgcttttcagtgttatttaggtgaggtgataagtcctaagaagagaggttggagaagggggcaaaattaaaattttctattgtatttgttgagaaaccagtctattgtattgattaacacacaagcaaacaaacacataattgtgaaacacagaaaatatggacaagtggaagctttatttcttctagatttaagtataagctgcaagagaagaagaggaagtgcccgagatgggtcaacctcaccttggaccttcagagccctatttatacgcggaggaggttggcggcttgcgatgtaagttggtttccatggcaagcttgcttctcccgcaagctgtcttctcctgtaagcttgtttacgccacaagttttctttcgtgataagttatcttttggtataaactttcttctaatgcaagcttctttctatgctgacttttcactcttgtcttaattcatccacataaaaaacatatttcataacaatattgtgacatttatctgaatatattttggagtggcattttaaaaactagttaaaaccatatgatttgccgcggatacatggataattgcacggtactacctctgtctcaaaatataaaggattttgactagatatgacacataatacgaatctagacaaggagtttgtccatattcatagtattaggatgtgtcacatccgaccaaaatcccttatattttgggagatggaatatatattatagaaaggaagtgtcagggttatggataccacatacccaatagtaatcgactaagctcggcagggcccaccatatacgaagtcttataaggaatcatacctcgtatatagaaggagttctggataaggaaggacaataagagttctacatggaaacgacaaggactactcggattgtatccatattggtctccctagttctacttcgagaaggggacatctatgggtataaatacaagccccctaggaagagaggggacacgccacgagggcacaagatacacaagccaatgcaaaccaatatgtcaccagataccgacatcagagattagcctagacaaacccaatccggtgcctacggaggccgacaagagggattagcgctatctctgatctcgacgagttcatatttgaggaggaagacaactctgccgtcgactacgtgttggttatccatgccgccaaatcgacgaaagctagataggttatccaaatattgtacttgtgtgattcagatgaataagagcaacaccggcttcggccaacatgatgtagggctattacctgtcagataaggggcccaaacatgtataaaatccttgtctccatctcttttacctcaatctcacatataccctggtaccgacgatctccatactatccaaataccgtagtcgcgatctcaaacatcgacagtgtaagggtatacctgagaggctatacccgcctacagtatttgtatagtatgagaatcgttggtgcaagggtatatgcgggattgaggtaaaagagatggaagatggtgatttttatacaggttcgggtccttaactaacaggtaataaccctattcctgttggccgaaacatgagttgcctttatttgtcgaatatgaacttggcgagattggagttgtgttatattgacctgtcttcacctctgttagcctatcccctctacttccggggagtcttgtatttataccctcgggtgtccccttgtccaagtaaaactaggaaactaagtatggatacgatctgagtagtcctttcatgcctaagtagaactttgcttctccttccttatctagaacaccttccatatatgaggcttttgtataagacttgatatatggtgggcatcgccaagcctaacacaaaagttataggtatgtcttttctataacactgacaatactctatatgttgaaaaattgaaatgatgtgagaactatgattgacatgcttgaagtaataaattgtagatgatgtgacatagttgcatgagttttaaatgctctatataataattgatagtggatgatgatgtttcatatacgtatgttgagctttgaaagtagtgtgtacaacaatatagaagatgtagatatatctttggaagtggcattattgagttttctctctttcctaggctttatatcctgcttcttgggccttgactaggctagcttctcctgttctttgaacagctattcccgattggaataagtctattttaccttcctcaactctttgtgttgattgaatcccctccctcaaccgcaataccgagtataacatcttctccatcttcaaaaaccgatacaaatcgagtccctcaacggtttggtgaccacgtggcatgttgacttggtcttcatgccatgtggtgtctacgtggcacttacgtgtcatttagaaaaataaaaaataaaaaacttagtgggaccaacatgtcaatcaaacaaaaatgtaaaacatagtaggctcacatgttagtcttctctccctttacccctatccactcaacagaagcttgatcgccagcacagtccccttctcgtctcctcgaacatagcccggcaccagatctagcctcttccccatcccatggcgactgcgggaagaagggttacagggagggccgagcccgacagagacaacgacagtttctcctctcctctcttctccctactctctctctctctatctctcttccccttttctctccatccatctcttcgagcggagaaaaagacatcgacgatagtgatgggggacggtaggctggcgagggcctcagctgcgcctgtgatgtagctccgtcgtatcgcccacgacctcaactgtgctgcccagatgtacggtgcagtggagctacgctagtcgattccccctggcggcatcgcggtccccggagagaggccgatgggaagagatctggcaacaaggagcacatggatagagtagcgctgcttggtgggggggggggatccggcgactgccactctggaagatccacgccctttggaggctggctcaatgaggactgagactgactgtggcaggaggtgcacatccaagcattggaaccatcacggtagcgtatggcggcttggtagagctcgtcgtcaccgggatgggaagggggaaatggaggtcggggatgggagtgaagggggaggggacaagaggagaatggatgaccccatcattgtcaaccattatcgcgcttgcaatagctaccgctttcaccgacagccatcgagctcatctaccgaccgcctccgccgttgctgccccatcctcgccgaccgccaccttcccgtggacgagctagagagctcgccggccactgccgacgccggagatttggggaaaagagattgacacgtgggcccgctattttttatttttttcactaacatgtgggtcccatctagtttttttttattctagtaccacgtaagagccacatcatcatcacatggcacgaagaccaagtcaacatgccacgtaggaaaaaaaaccaccagccaaaccgtcgatggacttgcactagttttcaaagatagaggagccattatatccggtactatggttgtaggatgtgattcaactagttgataccccgcgcttcaccgcggaatatatggatgaatgcatcttatacattatagtgtatagaaatgataaatgtacatgtttaaataatgtggagataataatttgacattgattgcatattgatttttaaaaatacaagaaaattgcaaaatgatatgtcatatttgcatgatatttaaaatattctatataataattactagtgggtgataatgtggcacacttacatatgatttaaaatactctagataataattgctagtgggtgatgatatggcacacttgcatgtaatttaaaatgctctagataataattgctagtaggtgatgatgtgatatacttacatattaagtctttaaaaattattggacatcaactttacagtaagataagatccggggttagaaaagagggagatatgatagatctattccttcattgtcccttgctcacaacatattcttgggccttaagtgggccaaactccattaatctttgcacagccggccggttcacggttcgttggttcacaaagtaggcaacaaatcatcattgattaacgatcttaaggctgagttctttgtgttggaaactcaccttccatgtacgtaaaacttaacgatttattagcattagcgtatgattaattaaatactccctccatctatttttggtagacatattttcaaatctaaaaaaattatttttgattggcatatttcaatccaacaacctatcctcttaaagattttttcggatttaatgtgtgactccattttaccacaaaagattggttacatgggcatcgagaaatataaatattaatgaatcgctggtttacgaaaaataattagtagcatgtttaaataaatgataagtagaattacttatatttggtctgtgtgccaagatgaaatatgactatcaaaagtagacgaagtgagtattaagttttttttaaaaaaaataatatgctttttaaataatttccgtataaattttattgtaaaagtatatgttttagtagttcgaaaaatatgcacgtgaaaaagagagagttgagttgaaaaattcaactaaataactcagcctacgaccttatttagatgggactaaaacttttaagtccctatcacatcggatgtttggacactaattataaatattaaacgtagactattaataaaacccatccataatctttgactaattcgcgagacgaatctatttaattaggcttaaaaatttatctcgtaaattagcttttatttatataattattttttaagtagtctatatttaatagactaaattagtatctaaatgatccaaataccacctaaagttccaattcaagtcaggttcttaaacgaaacctaacaacattgtttatacttttgtttttgtcctgtactaggcattagatgatctcagccctttccctgctgaagctggacaaatggtaaatcccttgatcggtctatcccagcctcccaggctcgccgctaaacaactttaattaatttatctaaaataaagaggaagcatatcatcaactgctatcctcgtcacctctcccctcccgagttgacttcccctctcacgcgtattcaggttggttcgccatgccggcgcgaatgtccatcacatcggcgtcgcgtcgtctccgatgagtaaagctagtcggcggctgaaacaggaagggcgccttaacgtacgagaggacacaggtacaaattgttgtgcttttcaaatttgggcctagtttagtttctaactttttcttcaaacttttaacttttccatcacattaaaatttttctacacacgtaaacttctaactttttcatcgtatcgtttcaatttcaatcaaacttccaattttaacgtgaattaaacataccctggttcaactcgtcagcatggcagggttttactctttgaaatccgtatatctccctcgctttcatttcttctcgcttacgttttcttgccctttggtatggttatttcatatcatctgaaattgactttcgagattttgaagaaaacaggatgatcaaacatatatgcaagaccataaccatatagagatagttcacgatttttttaggaaaaagtacgaattaccctcccgaactatcgttgttaaccgaattaccccataaaccacaaaaccggacattcctcacccccaactatgcaaaccggacgaattacccctctcgacacaatccgcggtggttttggtctacgtggcgtacgcgtggcagtccggtcagcattctattcattaaaaaaaatgtgggacccactctcttctctctcttactctcactctcactctatgtcatctctctctcacgcgcacagcggcgaggacgaggggccggaggcggaccggagtatcgtactttttcctcttttttttgtttacgagcagttggtttgatagccagaccggagtatcaattcatcatttcattgttgaatcgggccgttcaattcctctattggaattagaaggatgatctgggctattttgattataggaattctataagaaattataggatttcaattttcataggatttattccatctcttccaaaataaatcaaaatttttatataagaatctagagggagagattaagtaccacacttgaaatagcggaacaggggacagaaaatagaaaatcgaaggaatacttccatggatctaccaacatactccatccatccataagagttagacttatttcatattttagtgtttccaaataaattatttctagtctctatacatccatgacataaattgaggggtaaattaaatgttagattagaacccgaacccgaggagctatattaatacttattggttgcatgcatgcatacactcattggtccttgttacgtgcaagatgagttaatttttctttgatcttgatgataaaaataatagtgtaacttttgtgaaagttgggagtataatacaaagatttattaaattcacaattaataaataaatttgctgaaagagggagactagggagacgggatgttgttagggtgatgtgagcttttacgatgctcgtgtcataacgatgttagagcaagtttaatagtagagctaactgctggccataaatcatctataacttaatagccaattctacaatagttacatataaacatatactacacaatcaatatctggtcccacctattactacacaatcaatatctggtcccacctattatatacacatgcgtcttagagtctgtactgcagctgactacaaatctgtagcccgctgtcttttctctccttttttatcttcttaaaatatgtttatagctggcttatagtctgctattatacctgctcttagcagctatttctggttgataactatttataccgcacatgatactgtcgataccagaaatgatatcggtaccatgataccaagatatcaaaggtgtcaaggtataatggctatgggtagacgtcgatctacctttgaaagggtcacttagacattgatgagggtgaatagataatttaaaataaaataagtaagctaaaatataaaccaggttagattttcttagactaaattctctatatacccttgaaaacaaacacaatccctttcatacccttgaaatttaccttatccattcgatacccctgaaattttaacttgatcctcttccatgcctctgcagttacattttccttcgtttcactgttaagtttggttgcaaatatcttttatgcccttgatgatttatgtttgaatataaacttgaaaaacgattgaaaattttgtttgagtacacgatatatgcattttatgaaaccaatgagactaaataattagagcataaaattttgccataaattttgaaaataaaacaaatgtaataaattattttttctatttaaaattttaataggacaatgaatttttttatcggggcattcatcaaaaaatatcataggcattggtagtcctatcttttctatggatactcctcattcttatgacttttttaaaaataaaataaatacatatttttattttattatctaaaataaattttatcctaaataatgtatctcacaacaaacacatatctataatagtctaatgcgacaaacttttatattttcaataatgtaattcataaatttctatgctcattcaaagggtaaaatggtcattgttggtattacttaacgacattactagaaatataattcccagcaatggcgcagaaatactcctggtatattatggttatagatttcatccgcaagcgcacggatataccattgtagcattttacccgagagtattccaaaggtatcgtatttgtttatcccgtggaaagattatagtagagagaatcgtactaataatttatatattacttgtaataaccatagtctaagcagggggttaatataagcagagggtagagtgatacacaagcataagactattcactctcatattaaattatccgagctaagtggaaagaaaatagaaaagaatatattcctatacttctagtatacataatatacatacatcctagctataagattaactagctaatacccttattccgatgccctcctggtacttcgagaagccaccccctactgccgagtttcttacgacagcccatcatgaccatacaaccggggctaaatacgaaggaataccctccccagggaattaactaaggactatatacacgcgcggaggaatacccgtaccgagctgtcaccatcagcggcccacctctcttccgcagcatataaccccaaataatgctacctagtaatctagacaccacgcctaaactaccaaatactactctaatatcatcgtcatgacatagaataattacataagcaaacattatacacgtaccgttgcatctcccagataagctagaagtataatcaacataactcagatataaagtaaaattggtattcatatactcaaaaagtattacaacaccagagttgtataaagaagaatattctaaataaagtacaagtcttacaaaagaagaaaggagagctactggagctatacccgaactcttccgaagacttccgaactcatacttctattctattcctactccactagcttgagaatactaaactaagtttgagagagtatgagagagcttgcttgaggtgtgtggagaaagtgagaagatgagctccttaaataggctgccaatgacggttgtggcagttggaatggtcggaattgccctccaaccgtcattggggagcgatccacgccgtccagaagaaaccctgcatccaacggtgccagggaggggttcggctgaaccaggggctgggccttcctagcctattttcagtaggtggcctcctcttttgatccctgtcacagacttgtggattttggtaaaattcaacgtgtcatttctgagttcttggcccattcatctgatttccgacatcatctgattgattgatcgtctgttttgattttgattctcctctattttatgtttattctctgcaagaggttagtaatcctagtgctaatggaatatttattattctaacactatttctcctttattttggtagtattgactgttgaaactgatcgttaacgactgtcaatagtcatttctatataaatttgatggtcaactgaggggaagggtatggaaagcatcaaaatcaaatttcaagggcatacaaggaagtaagcaaaattcaagagcatataaggaattagctaaaattttaggggtatacaagggattaacgaaaatcccttatgtacctataaattctcacgtaatcccttatgtgcccctaaattatgccttatcctctatgtacccttgggttttcatctttatcccctatgcgtattacatgagttgactaatttttcaaaaaatgtttatatcacccttgtgtctacttattgcttagagttgattgaagaaaaacacccttctcaacataaaagttgattcatttataaaaacaaacatgacataattactttatcataaatttgataactaaaatttagatttcttttaaataagtttcaaattagatttgatgaaatttgttcaaaatttttactgaaatttaaacccaaataagaaacaattttggtttttcaaattccgaataaaacttcttgtgtatttcatttttttttaaaaaaagcttgaaaatttatattttgttttggaaatccggtgtcaaatatgtcccttttgatttttatcatagattaagattatttttataacaggacttgtttttaaagtaggtaccataaagtacgggtaatatagtcattttgggataaatctaatggtcaattcatagtcaactcacgacaagggtatagaaggataaaaaaatctggagcgtactaaggatgaagtaaaattcaggggcatataagagattgagtgaaaactcgtgagtatgtaaggaattttctccaattgtttatacgcttgaaagtgtttgcaaaggaaaatggaacaatcgaatcgacatgaaacaaaaccaaaatcgctacagatcaatgacagagggagtgggagcgggagcgtatcgagggatgacaaaaacactatggggtcgaagaagggctcggatttaacagacgacaaaaacgttactaatgtgtaggtaaagataacgaaaaaattagtttgaaatggacgaagtaattgtttttggaaaaatataagcctttcaaagctaataaaaactttgataatagaagttactagcattaacgacagtaggcatgatcaggattcaggattcctctctgatgcttagcacagcccctgtctgtgccctctcacctgtttcttcacctacccaatctaacatggagtactgccttaacccaaactctcccaattcccctcttcaaacaactacgccgcctccatgagctccatcacggtgcttcgctggtgctggcgccttgttctccgctcttccccttgtcttcttcgcgctctatccttcaccaccgcctccgacaaccctatgctgcctctacaggcgacttctccatctccggcatccttctcgccaggcggacggacggttggtttgcttatggaaggtggatttgttggtgagtgagtgaccatgcagtggaggcatcctccgcgggggctaaggtgaggcagattcgccggggacatggagtcatgcgtctgcgcgtgcgcgtggccaactgcgcctaccgtggtggcactcttcgccaccggttatgaagaaggggtggctgaggcgcctcatgatgtcgatcccatggtgagacatcagaccggaataccatctctagagcagcagaaaattgttagaaatctgatgtcttagagagaacaagtctagtgctatgataaacgtggcagaagtaacacttacgaatcaactgttgcatgcattcttaacattcttcattatatgctacactaaacatgaacagtcagtcatgttatccatgtctgcgagttcagtttggcattgcatataacctttctttcagatgctagattaatcagttacaagtaaactaactaactttacttggccttgtttatgcagagggaggccacctgttgctttccaatttttctgctgggtcacgcatgaatagccaagacaataatcttaaaaatttctttcagacaaatgggcatgtggtttttcaaagagtggagaacaactgtagcctaagatattttacggaaaatgagatacggcaaatcacccgtggttatagcattttactgggaaaaggttcattcggtaaagtctacaaaggaatgctggatggtcgatgccctgttgctgtgaagcgatacatacatggaacccggaaagaggagtttgccaaggaggtgatagtacattctcaaataaatcacaagaatgttgttcgacttttgggctgctgcacggaggaaaatgctctaatgatcgttatggagtttatctgtaatgggaacctgaatgatatccttcattgcagcaacacaaatggacgtgttcctttctctttgggcaaacgtttagacattgccattgaggttgctgaagtgctctggtgcatgcattcaatgtataatcccgttctccatggtgacatcaaacctgctaatatacttgtggatgaaaatctttcaccaaagctatctgattttggaatagcaagattgctttgtgctaatggggctcaacatactaacaatatcattggatctataggttatgttgatcctgcattctgcatgaatggaattctaaccccaaagagtgatgtttacagctttggagtggttttgctggaaatcatcaccagaaaaaaagcagtggatgggaccatcacccttgctcagcgtttcactgaggctgttgaacaagggaagaaggtgatgcatttgtttgacgaggacatcaacaatacaaaaaacatgaacttcctcgaagatattggcaagttagcagttaaatgcttgaggagggaggttgaagtgcgtcctgaaatggttgaagtagcaactagtctaagaatgattaggaaagctctagaggaagaagagggaaatctgattcagcagaacataagtgcaccaagcaactcaattccttcaaagaatgtgaagtcatcagcacagcaatttggcaatctaaaaatctttaaacaagaggaaattaagcttatgacaaaaaactacagcatgaaatttagggaagagttctgtgaacggctgtacaatggagtcattggcacaacacatgcagttatagtaaagcaagtgagaacatcttcagaaagtgacagaatgatgtttctgaagactatgagcatactgtctcagaagtatcacaaaaatattgccaatgttgctggcttccacttaggggattccatttcagagtgtgtgtatgaatcttgctgtgatttatcccagggaaatgacggccatgtttgcttctgtaaccgaaacctttatgacattatctgcaccagggaaaaactcccccttcatctacgtttatcaatagccgtccagtgtgcagagggcctggttcatatccattcattgttagctgaaaatcctgattcacattctacaggcctcttgggaaacttcaggtcgatcaatatttttctggacaagaacttcgtgccaaaagtcttcaattctaatttatcaacatttcttgggctttcagtcatgcagaaacataccgcctctgtcgatcgtcctaatgaccaaagatcacaaatatattatttagatggaagggatatttctggtcagctgttcaatcccaagtctgatgtttatagctttggagctgttcttttggaactcatcacttggaagacagtgagatacatgtctagtggaagagttcacatgcttaccaaagacttccttgatacttatagaatagaccatagtgcagcgatatcttttggcaagaaggtttatgatgagcaaggtaagtgttttattcacgaggcaattgctattggagttgagtgcttacaactgatgtccagacgcggccaaaaatgagtgatgttctttcacgtcttcggaccatctctgcagctcagagtattagaagcaaactcatcatggctacacaaacaaaaggttgcacctcttagaccaataaatttgcacatttatcacatggaacatagtgcagtcaaacttctaagattttaaccactattgtatgaaaaaaatgccttacaaaatactacctttgcagcctttgtaattgtaattcaactacaagtttctcacacattgtattgctaatagctacaaaaccatggtgtgatatgaaagcaacttgaaatacaaatctaatggtaccattttaatatgactaggcatatatgtaacttgactaacggtaaaaacttacaaattttgaagtgtctacatggcttacaaaatcgaacagatgggtacctccattatacattttgtttttagtttttttacttgtacattattactccctttggtttcaaatttactcaaattaaaatggacaatgaattctgtcatagaaaaaccaatcacatttagcggtgatgttctttaagatgtattattctcatatcaaattttcaggtatagcaatactcattttaatcgaaattatgatagatgaatttaaatgtgcaccttgtttgcaaaaatataaatattattgtgctaagtacttaagtagcactccctctagccacaaatacttggacgttttagatacgatccagtcaaaattttaaaactttgatgtttaaaagttttattttaaaaacattaaaatgacatgtgtagatttgtctggttgtccagaaaggtacttccataatctcataaacttgtattttactacctccattcctaaaaaaattcctttttagctatgaacctagactgtgttgtccatgtttatagctaaaaaggcactcttcagaaagggaggtagcataaaattattgttaagagatgcactttaaagacattaaaaaaggtcaattttcaaatgtcaagtatcttttactggatggagtacaactaacaaaatacgaattttgtaagcagcaattaacttaatctattggattttattcttttggtttctccaatacagctagtggtgacaacaaaccaaaccaacatgtagcccctccccttaccaagaagtttgtcaaaactccaccaactattgtatcgatcattcccctgaacatattggagaagataactagcaacttcagtaatgatgccctaataggagagggcccagacgccagagttttctttggagagcttagtgatgggcagaaatctgcaataaagaagcttgatcctaatgaaaaaattgtagtgcaggtcatggatgcatgtcttgcctttcaccttttgagttgatgctctttattcatgagtacttgaagcaagggaatgccttctcaattccatgtgtcttgcaggttttgaccatttcaagaatgttgaagcatgacaacattgtccaaattcttggatattttattgaaggggaaaatcgtgttcttgcttatgagtatgcaccaaagggttccttgcacgatattcttcatggtaaggaataacaaaagatttttactttgacatattcctatcttgcttgcttactgtattatgatcaatagctgaaataatatgatttttttactacattactttatgtgttgaattgcttgttgcattactcaagagggtgtcagaggagcccagccaggaacacctctatcatgggagcagcgagtgaagattgctctaagtgctgcaaaagggcttgagttcctccacgagaaggctgtgcctcctgtcatccacaccaacatcaggtccaacaacatatttatctttggcaatgatgttgcaaaaataggtgacctcggcgtctccaagcagctttatcctgaaagtgataatgactactacaatacccgactatatcctctgcgcagttttggctatgatgcaattgcaccagagtatgcaatgaaagatttccatgcttgagtttcttacagtactagtgcctaagcttggatatgatatgcattatcctactgatatgttctttccttcgttggttcttgttaggtgtaggaggacaggacagtaaagtgtaaagagcgatatctacgctttggggctgtactgttggagcttttaactggtcgcaaagtagttgattattcacttccgcgtttccagcagagcctcataacatgggtacacatgcaacaagttcactcgctgatctaatttctttataggatgaagaagctaaactgttgacaatgagatgcaggctacaccaaggcttagtgaagacaaggtgaagcaatgcgtagatccaaagcttggaggagcattcccactcaaggctgttgccaaggtaataatattcctattcgaagctttgatgttactgtctgtgtttcgcaaacaatttgagattttgtggtgtatagtttacattttgaattgtgctttattttctaaagtaatgaattgtgcattttagtattgccgttttttcttacattatagatgcataataattttaagggaagtttcatgtgagatcatgttttgtctccatggaatctgaacttcgtcaggaaaactaatctgtagggtcaaacaatctgtttctgttctccactttaaaaaaaataacatgtggtttcttttgcacatatacctcgaggttggctcccatgcaaagttagagatgaggataggaagaccaacaaagtagggggccagggccttgtgaatctctacatataaaaccctcactggtcacacgcatagtggaaaaaaccggaccggggacggacccggtgagctcgtcggttcaccggtcggaccgccggttcatggctaattattttttaagtcataattgactttaaactgctaaatagaatatgtattgcattctaaccaacaaatttctatacttcacttcagaaaaaaaataacatagttatatacttcttttggaactttcaagattttgagtgtcatacatttttaaataattatgtattagatacatgaaaatcaattgtctaaaaaaactttatttatttaattttgtaattttattggattctataaacataccacaataaatcttttaaggaccatgacattatcccaattcccaaacaagttaccgtgaccagaggtagattaccaaccgtccttttaaaaaaaaaacaatttgtttaattatactcaagaaaattaaagttcaagtacaatgcacttatggagcatgtacttttgaatctattaataaagtaccataagcaagtcatattgtatactaggaaatactaccatgcaagggccattagagaccagacctgtctggtcaatcatctctgccaagtgccaacgtgtctattgatagtaggcggtccattaaggttattcaatcgtgcaaaaacatttaagagagatggttttctataataccttgttttggggagttcagagagttttttagacaaacaagatatttgaggggtaaaaatggacttatccttcttttttaaaactatttgatctgcatttgttcgccctcatttgttctcacatctcgaatatcaatcaaatcaaatagttataaaagatctgaagaaaatgctgatgttggtacagtagtcactatcataaaaaaaaaaattccaaactcaacctatagatcaagagagagagaacaaactaaactctatactaggtagtgtgagcactatttatagtcagatttttgttctacttttcaatttgtacaaaacggagtatattaagggggcgcaagcggcgagcgagattgctattgggcgatcagtcgcgcgcctccctccccgcgcgactggacacgtgtcgcgcgcggagagggggcggcgacgcgccgtgagggagcgagcttttcgtttttttttcccttttttcgtttatgttcgttttttttcattcggttttttgtttggtttttttctctggtttttttctgttcggtttgtttttttccggtttatcttctttcggtttttttccttttttttaaagatgtataaatacaaagtttgtattcgtatatataccaagtttgtattcgtatatacaccaagtttgtattcgtacgaatagaactttctatacgcgcatacaaactttctatatgtgcatacaaactttctatacatgtatacaaactttctatggacgtatacaaactttctatacatgtatacaaactttctatacgcgtatacaaagtttgtaaacacatatacaaaatttatatacgcttatacaaactttgtgtatgtgtgtatatattttttatgcattaaaatatattcgtatatatatatatacacgtgtatatatatagtatataatatatacgtatatacataagatgtatatagtacctatgagagagactagagggggggttagaggggggggtgactgaccgcgcgcctccgcgcgcgcgcggctgatcgcgtatcagcaccccccagcggcgagtgctcgcgcgtgccacgtcggattttctctacagcgaacggtggaaatttgcgaaaaaccctccggtttgttcgtaatcccaaataggttcctgccgaacagtgcccctgagatgatattctacgtaagggcccttctaaaatctggatattacatgcgggggaggggaaacacgcgaaataggactgcgctgtaaaaatcgaaggtcgaggggctttttcgtaaagttccgcgcaataacccgcgccccaaccctagccgcctccgccccgcctctcctcgactcctcctccctctcgtcatgcgccgtccctctccctctcacgccgccgcccgcctctcctcctccctctcgtccccccgccgcctctccctcgcgccgccgccgtcgcgtcctcgtcgcctccgcctccgcccacaaaccacattttttcttgggggttctgcggttcttgggcgaggagaggagatgaaggagatggtggttgggtcggtggcttcggcgccggtggggaggtggggggcggcgtcgcccaggtgctcctggagaggatgaaggattacgggcaggagggcgttcacgctttgggacaacctctcgcctgaggacctggaactgctcgtcagggatatcgaggtgagtaagcccaatgcgctgcaggttgggagaattttgcgtcaaatgttgcttcttgcgttggtaacttttttccaatcgggagcttctgtccgtttctatttgccagggacgaactctgtataaaagtttgatatttttgccggaattctgcctgaaagctctggtcctgaatgtggttttggtctaagtatgaattctgtaggagtagcagttgatttatcaattgaaagttttactacggttcgtgggaagaggagtttggattccagtgataatttacttcacactttcacagttttgttgtcactatcaacaattatttatctgctctccatgggtcttaatcttcattgtttacactgcaaaatagcacaagagaaacccgcagcatgtttttgttgtcatttgagctagccatttcaacagtgactaatggacctacatataatgcatttttttcagagcctagatctttcaaggattgatcggatcatccagcgctcccttggatcacctcatgcgaaaaaaaaaatgtctttccaatgtagaacattagagttatttataattttgtcatcacacttgccttaggttttttggataatgaaagctttacagaactcagtcaattacatcaagatgataaaaccgtactgtgaaactttcttagtacttgccttaatcttatggtgtgattaatgttctttccaagtgcaggcttcctttgcccaccgtcaagctggtgtcggagtccagcgtgttgaaggtagaggagaggtcggtggtggaacaaggggctgaaggccatttcggaggggaagctagccgttatccttttagccggtggtgagatgctctaatagaaagattacctgaatttgctatttctgtactgtgtgcattgggaagcagcctccttatggtttgattcctcttcatgtgtgtgcaggagacttggcctggcagctctgatcctaaagggtgtttcggtaggttgattccactgcaatcttattaataattgactttatatgaacaaatgtatggatattttttcagttgaaaaaagtgaggtgctctgaattgtttttgttttacacaatgtttttttggttcagaaaccctttcaatattctaatgtgatgaacaaggttatgtcctttgagctcactgaatctgaaattttcaccttttatcttatttcacagttcaacatctggtgggataatcgatagagctatatatgcagaggataggacatggtgactttatgaaattggtaattgccatttgatgtactacaataaaaagttactttaactggcggagtacagtattaacaatctgctttttagtctgtaacagtgaaatatcttggaatatatgtcgattacttaagatcttgttgaaggatatctggaattggctgcagagacaatcatttttgtggcagtcatgcccgggtagggtgtagagtactgcattacagtggatgttgatctacatgtaagtataggtgtttgaactactgccctctaatttagcatcatcttgagtcttttttctccatgcttaaatttaatttgttcatagttcagacatttcatctttattaaattaaatttatgctaagtatttggcatacaaactgtacactctaagttgacaaatctcatatatgctattatctccaaagatgttgcttccaaagataaaaactcaaaatctttagattttaaaattctatctcaaatctagtgggactgcactcaacttagttgatttgtgattgtttggtgaaacaatgtagtttttcaaataattatacttaacttatcacctatgtatagcttactgcaaagcataactcatgtatttcagtattgcatttctccttgcttttcaccaaataatatatagtacttgaactctatagtttcccgtcctgaatttgacaagaataagctaaaattacgggtaaagtttgctttggagtgtaaatttgctattctgccatagatttatagttacagctgggagctatttctagacagtcaactctcctgaaaatcgattcatattccaaaggcaaggcatcaggtatacctaacctctctttctatctaaattgatttgctttcttcccaggatataatcaaatacaaacaattacaaataacaaaatacggagtaacacaaaggcagttactaaagactccctatagtgttgtcactcgcattttagcatagcgatctcccacggacaaagttgtgctgaaacacggtctacatctatcatatagtgctgcagcatatgacctcataaaattttcagccctaccacccaccaacaacagaagatattcactaagtcgcttcagtgctacacgttctagcaatgcctacgaacatctatagacattgttattcatttacatcatctgcatcttcccatccaatgaaaactcacatacaaatatattcgtgcaggtaaccgcgggcgtacatttagggagctgtgcttttgcgaaaaaaaatgtccagcccacaactgatctaaaaaagtacatcgaagctattaagcggttcctacaccattcaagcagcttctatgctgtaaccatcaacagcacattcatcaagcaagatagagttgtaagctcttgcaacaattatttatttttcccacccctatcattcatgataatattgcttttctaccactaataaagaactaacataccgtgcaattacagtactttacaaaggaattttcacagaactacataaaaccgctaatggaaggtaaaaaaccgtcgacactgaagtacaagtagcaggaggtatttcaaccagcatgatcctccacgtttcaacagatgaccgttgcaacttgaagaaagggtggacaaagttcgcagcacagatgacatagctctcggatcagtttgcatcttccatttctacaggacaacctgcctggaggttactattgatgtcctgtgaagaccatatgggcattcatagctatcttatgatcatgcttctgctgccagtaaacaagctgatcactatcaggatcggccgcttccctcccctggaattgttaccatgcttattagttctacaccttaggtgcttactatccatagtgcactagcttggacattttaagaaacgtctgtgtatatccatgttgctgctaaagactactagatatcggtatgcctataactgtttggcactgcagtttacttctatttcacttcctgctttcttgctctcttttttaacaccaaagaatacttacatttatatctcatcatctggcgtctttgctaattacccatttcttgcccaccgtaattccgctcaggtggcgcgccaacggcacgccccaggttctagttgattttaaacttgtatgtttatggagtgatataacataatgaattacgttagcaattttttttaaaaaaaatcattactaattaattggtatgcaagtaatggtggtatatcatgttaagggatgacatgactttccctaagtgctactctatacaaatgtagagtgtgtttccttcccaagttatatacacattaacgtttttggggtcactactggaaaaatcattgagtaaaatacaccagcggttcttaaacttgtcaggaggtttcacttagatccacgaacttgcaaagtgcacatcgagatccctaaacttggtttattatatcattccggttcaaagccgcatttgactgtggtatagcctacgtggcacatcacgtggataatgacatggaattttttttatttttttctcccttcttccttctttttttctctttcttcgggctgc

SEQ ID NO: 68309 - DNA, 34906 bp, Oryza sativa
  unsure (1)..(34906): unsure at all n locations
ttatctgaggaactaagttcctaatttgaaaagactcgaaatttccactataggagcgaattttagattggatggttaagaggctaagtttccaatttaaaaatagtgcatatatttagttagatgtagagccgggcctgggtaaaaaatatccttctataaaaaatatgaaacggcgatgaacttagaaaagaaaattcagacattccaggatcgattcttacgctggaaatgttcaaaacatccatccaatttaagtagaatttgttcattaaccgatcggattccgaatcatcagagaaacaagcattttcaggctagagatgtatatgtatgtacctttgcctcctcctaggacgtgatgtagcgggttcgtccggccgaagagccgcttcttcttggacttggacttgtggtggtgcttcttgtcgtcgtcggagtccgaggacgaggatgacgacgatcccttcttgaactcatggatcttgtcgttgatcttctccagcagcgacccgtgctcctcgccttcggacatcattccctcccccctgatttgatttggtacacaatggcaaacgaaacatcaaatcgaggactgaaatctttttccacacacgttaatttattcttcagagaaaaaacaacaacaacaacagaagaagaacaatacaatttgtctaaatccaacgccaggtgttgcattgcattcacaaagaaattatcaacaacgcaatggtcaaagatcatggacacttacagtgagacacaacggtttattaccctctctcgctcttcacctctatctctgtgtgtgttcttccttgaaacgaaggaaagcctgtgtttattctggggggttttgttcacctctcatgtctctctatgtagcaatgacactgtttttttttctttttcttacgtctgggtggcgtttcttggatctgcggggaggaaaccgaaatggcggtcgggaggcaaaggcggggggtggtgcgttatctgacgccgggaccgttaggatccacgtggacggttaggatttcgccacgtgggtgctatggacggccgggattgcggttcatgggcggatcgatcgatggccggtacggcgtctcacggggcgccgcgagtatcggcctgcagagcgtgtggccctccacgtaacaaggaggaaaggagggaaggtctaaggttgaaaacggtatgaaacttgtaaagtgttggctactgttttcgtcctgtggcggaacgttatattttgattatggattgttcgaaaatagaatggaaatgttatggcgatttttttctggtcattttaatggtatactgttttcatatgaaatttttcagaaattaccgtaatccttacatcttgtcaatgttggtatacccccctccgtccaaatatgattagtgcgtaagggagaaaaatattccgagtttgatcgtcgttttttcatgaatgctcgtagtgtctctagcgagaggtgaaatgtcagagacgggataagcatatccaatggagacataggtaataggaaacacaacatgtgtggaaacaaatcgacattgcatgcagctcctgatatgacgagtataatgttagttattgtatatgtgggggcattaactctttcttggtcttcgtgacaaacatatgccctatcatatttggatggagcaagcataatattactatgaactattaagtatttattaattatttttggctatgaattctaacttgatctacctacaaaacaagggagaatttactacttgctatcctccaaaataaacatgcccaaatgctactttctaaaattttcatgttctttttgctacccgggtctcaaccttcttcactttttggtgacgggcactataccagatcagtccatctgccatgaacctaaggctgtattcttctccctattttctcaacccacctctctcgttttccgcacgcatgctttttaaactgctaaatggtttgatttataaaaaactttctatatgaaagttaattaaaaaaatcatattaattcatttttcaaaaaaaactagttaatacttaattaatcatacaataaaacaaacttcgatttgcatggaggggaggtggggttcccaaccacctcctccgatgatctcatatgtgaaacctcgagatacacaatggattttctattatctttttacatcctactacaaggagagcctatacaggattgaaaccacagtttgcacgatgtatttgaacaggagtgtttgatcgatatgagacgagaaaatccaatcgctagctacgtacacgtccgaattaattaccagcggccatcatggccttgaattcctcgtagtcgacacggccgtcgctgtcccggtcggcggcggcgatcatgtcgcgcacccgcgccatgcacgcggcctccgggagccccatccgcgacagcacggcctgcagctccgccgcggagatgtacccgtcgccgtcctcgtcgaacaccccgaacgcctccctcatgtccgcctccttctcctcctccgcctccgccgccgccaccgcctgacgaccacccaggccggcaagctcggcgtggagcgcctcgaattcggcgaagcggagccccgccatccccggggcaatgtacgccgcgacgaccgcgtcgagcgcggcggccgcgggcggcgcctccccgcgcgcgccgagccggcacagcgcgcccgacagctcggccggcgtgatcacgccgtcgccgtcgcggtcgaacatctcgaacacgcgccgcagccgcagcgtctccgccctccgccggtgggccgcctgccgctgtggctgcactaccgacgccggcgcccgagatgctgcggcgctggccgtgagaacggacgagggcggcggaggacgcagcatgttaatggagcgctacttggttttcaccaatgtgtgcacgtgtgtacggaagcctagtttgcttgccttgttgggtcatctaatgaaagagcatcatgtgcgttctcgcgtggtttattttatagagcaagtaaaaatgtaaaatggaacagggcaacgacgacgacacgtcgagggtactactggagtagcacgttgttaacttttttttataaatatttgaccatttattttattaaaaacttttgtacaaaatataaaataaattaagtcatatctaacatttaaaaataaatcaagtcacaataaaataaataataattatataatttttttaaataattaaatgtatcttaaaaacgttatatattaaaaaaatgaagggagtagtttgtttgttcggatatatatatgtgccaaagagtggtacgccaggtacgcatgcgcttgaaaaattcttttttgttttgggttatgttttttatatttatcgtcttaatttttaacagttagtggagacaggccgcggtcagtggctaaaatattttatattccttctaattcatattattaatcgttttgatatttttcatagtgaaatcttagtaagtttgacaaatttattttttttattaaaaaatttagcaacatataaaatatttatatccattagttttattagatttaatattaaatatattttgataatatatttgtcttatgttgaaaataccactgtattgtttttataaatttgatcaaacacaaaaaaaaataactaagaaataaaattaaaatgactaataatataaaactgaaggacaacttgacacgtacaactagctagagtacgtagtacggtatggaaaaacagcggctgtatctatccaaaatattcagctgctgcttctgtacgatttttactacttctggaggaacactgtttaatatattttttatatagcagggccggtcaaatgattagttgaccgaattctattaagctaataaacctgcacaaagagggacataaagtaatagtattttattttattattccgaattttataatttaccacttgatatggactcttgatattttatagtattttacatggggacttattatattttttattccgaattttactgaaaattttattttattttggagttttgtattgcgaccaaattacttattttattttatttttattacgaattttaattaatccatattattttatttaatatgtttttttgagaaaatttcttcaataggttggaatttgtatgtgaccatattattatgcggcgcacttaagagtgtattgacgtgtaagcatacgtgtaaaaaaaaagagagtaacatactaacatattaaaaataacgaacacaagaagcgtgagccgacaacctactgctccattaaacataaaaacctaaaacatgacaccttcacctcgattttttttgatatatattgagagaaaaaaaaatccaaaaatatcattaacaaacgtccaagttcaacacatatcatcgatgagtacgagttttaaaaaataccacccgtacaagtgactttgtcatagaaatatcatcgtcgtttcgtcgttagggttacatacatcctgctccgttaaatgcacttttttatcctatagcatctaacataaggctgcaaatgaaatcctaacaacgatgatatttctaggataaatttacgtgtacatttcatacaacttgtagatatttattagagcttggtaattttttttttggattttctcatgtattaaagccagggaagtttccgtttcactactatagagattgactttggtgccgattatggccttaggtgccggattctcaaaccggcaccaacatgcggcacaaacgaggaatcttatacatgcatgtcaatacaccagtacatcttaggactaggagtatataaagacgtacgtacttgtgcatggaaattaacctagcaattcatataccatcacatttaatttccttgttctagaggaaaaaacaagagagaagagaatgacgacgacgacgaacacaaacgcgtctccttttgtaattttcgtaggaaacgcaagcaaagctcgttgttggctgcatgctgaataaaataaatagctttgctcaagtcgttatctatcagtctaccatttccatgctgtgatatcttatgtatatataatatatttggtcgacgcggcctacacacggttcaaccgcgttggaagaaataaattaaaatggaaagatcgacacggatagggacataggaagcttcgctgaagacgatgatccaagagctaggtagcttggctttggaggaaatccatatattatcaacaaaagtgtatatattgtaatatgcaacttttgttatagcattaacttacaaatgtggtttggatacacattcagcttttgttatagtattaacttaattaaaaagtgtatcctaaaacttagttcttttcttcaactccttttttattagcttttcaaactgtcaaatggtgtgtttttaaaaaagtttctatatgcaagttgtttaaaaaaagcaaataaatccatttttcaaatttataatagttaatacttaattaatcatatactaatgaggtttctcgtttcgcgtccgcaaaaaatttaccttctttttgaagcatcgaacggggccttggaaactttagttatatatagtattaacttaaaaatgtggttcgaatacactttcaacagtgattttggtgggtcaagagttttcatctctttgagcatgtattcattaattggtgtgtacccgtggtgtggtgtgcatgtgtagtggagaccatgcgcgtctataataaaaaaaaacagttatgctatatatatatatatatatatatatatgttggcacacaatttcaagaaatgaatagttttggaactgatgcaatgcttcatatattgtacagctttggtggattaagatatacttgtatttttataaagattatctggcacaactatttcatgttcgcatgatcaaagatgttttagggtagtcctaaccctccacatctaccaatgtccacagaatttatggctatcatataaacaaaaatttgatgtgacaaggaaattaggggtgagagagagagaagagaaacagtatgtctcatgcatgaaacgggctcggcgtacacaccaaggcccaagaaacaagagaaatcagcgttgggggcaactcatcgtttcttccacacacccggattttactcgagctcccaatccactgttcttgtctccgtcccacacgccagcttcttctaccgtgcaccgaatcctcacgaaattttggcatgttcccaagcctcttggtgccaacatcttgctcaccttctctctatctgtctcgccgcctccattttcccccaatcacccatcttttccaatctctctctgcttgatagctaaaatcggacaaaataatcctcaatcactcatccctaagaaataagttgtcctaagccatgtgcaaggatgaatacaacagaatgaattaaagaagtgccaatccaaatccaatcatgccgccagtgaatactcgcccctgttctagatgttgccggtgctccagacacaactactcttgctagtggtgctttacgagctagtggtccagtcgtcggttttcctgcggcacatgctcatgccactagtgcatggtggccagaatagtctcctggcaagtcagaatggtatggtgcaaattttcctcccaaagacataggttaatcaatgttgttagttaattaatgggttatattagaatgacattttttttcacttcaatgaactcctgctagtttatttcttatcatatatacctatgttgagctcacttagttactagcaatttcctacttcgaggttgagtgatgtcaccatttattttcatccattggatccttctgctcaacgtagcagattgctccctcaaggctttctctcttgctctgtgagcctaacgtaattccccacatggtccagccagccagtcaacaaccttttccccttcccctcccccctagcatcgcaggcggtgcattcccttccgttcgttgcgcatcaccaggagaccttcgcattgtgcgttgccaagtccctccccttaggatttggatcgtttgccttcatagcatgaaggcacgagcatgcagttagcccatcatccacagttcaagcaatccaacagttcacgttgcatgtggacttaacaacatctaaattgatatcggtctatcaagcaatcgaacaactcactttggattacttgaacggttgtgggggggttgactgcaagctcctgccttcacccccacgaaggtagacgatcaaaaccttctcctcattgattcgcctcttcctccatcaaaaaccgtcatattgtttctcttctaccatcccaagaggtatatcaaaaaagagtaaagtttagttttatatttatccaccaaatatgtcttagttccaccaaatattccacacccacatcttgcatgatcttgatcagaagtatgttttgctatcttctttggtcaagatttttgacttagtaataaatgtgaatacaagtgtgccttacttgatccctaccaaactccacatatttgaccttagagtagggacaatggcaatatcttggtgaggaatacaattatacaccactgagggactgagagaatcatttgaggaacttgttttttttattggaaaaaatcatttgagaaaatctccggaataaaagttagacgagaaatgggtgagtagtgctttactaactgttctgtctctcaaccgcccaagacaaggtgaagcatgatgcctcacagtttaggcgtatgggtaagacaccatgctgactggcatgattctggtaagagaacccatactatgcatttttaacattctagatatatagcattgcagcaactcctgatttgtttgtttcatttcgtcctttactcgggacgagcaaagattaaagctttgggggggggggggttgttgacggtcgttatcgaccaatttcgaccgtcagtattacccagttaatgaagactagctatgcttgcaatgcataatttccaattaaaatatctacttccactatgtgctatgatactaacatatatgcaggataagcatttataaatggaggagaatcgacggaacataaccgaacaattaaatgaaatccatcgagaacagacttatgggtggataggcctctaaacccattaaaataatatcaattgggaccaagcactacactactgagccgaggaatcaacaaggagtgcacttgccgagttgtgggctgttgggacaggctagggttcggccgaaccagcagctagcccaatcagcccagtttttcaccaactggtagttatcaacgtcccaaggcggttgtgaccgtttctacctgaagaaaccgtcgctggacacttggcgcaaggaggtgaagcaagagggaatatgctcattggataccttgagcatctccacactcccaaggcacctcatggcctataaatacccctcctctcattccattcacacacactcaagaagaagatcaaagagctctctcaagtttagtagtgttctagtgctagtggagtaggagatataataattttcttagtcctcgagtctttagtagggtatggctctagcagcttttctatcttcctttataagacttattaaattaatataatattcttctttatatatcttcggtattttatcccctttatattatttgagtaccgactttattttatacttgtatcgatatagttgtttagctagcttaccagagatgtgcattggtgtgggtcatggttgttaagtcaaacgaataatcgtgctcagatcgattaagtcgggtgattttgacagtgatggtttgttggcccatacattgggtgggcactgggccatatattgactagctcattaaggggatactatagcaaaaagagaaggaaaccctagtcccactcccacagccgccgcaaggcaatcagcagaaaaagaatagggacccgatacgagcgctggctacacaggcttgtgcgctggcgcctccagccaactcctccttcccttttgctttcatcctctctatctctggcttttctcttctcccatcccaaatcactggtgttgaatgcaactggtgggcaactgcaattgagttcatccattaggaatcaacctcgaggttagtttcaacttctctccttttccctaaaggtttctatggtctcatgctatgctttgcttactctttcttgctggttgctttgctagttctcttctctcactatctcatactctgctgtccaatttattggcctgatgcaagttgttgcctgctctagtgctctgctagatgccatatgccctgcatagtatatgtttgttggtctagtagggatgcccatgtgtgcttgctgcaagcctacaatgttgcttttgctagtgttgtgtggaccactggactagtggacctgctacttttgctagtgctttgtactatctagtgttattatattggcaagtagccaagtgttgttgctttgctgtttgttttattcatttatcttggatggcttttagtgatttgtcgtttgtgccatgcttgtgctgtggttttgtacttctgttagtaacttggtcttagcaagttagcatactatattgtcaatttgtgagctaacatctagcacaaatataataatttacaggtagcatggcagtgacaacgatggatcaagctaacggcgttcaaggccagaatgggagcaatgagctgccctatgatccaaagaaggaccctaaatggaaggccaactcgaaggacccgggatggaagtatacattttatccggatttggaacataaaaaaaaatattgcgatgtgtactttgtgacaagaatatggtttgtggaatatcaaggttaaagcgtcacattcaaggaggtcatccagaagtagaaaaatgtctgaattcaacttaagaagtgaggaatgagcttggtgaccacttggcatctcattctaggaagggcaaggtcattcatgttgatatgatgatggtgatgaagatggacaggttgctgcagaccatgaggaagaagtggctgtgcaagtcaagccacaagtaaagaaaggtttagctacaatagctgttgctactatgttaaagatatcagagccacccaaaggtggtanatctgtgcttcaatggttcggaaaagcccaaaagaagttgtagaaagaaggcatatgaggggtccttctcaaagaaccatagcatcacaaagaagatggagaagatgagagttgatgaacatgtgctgatttttggtatgaatgtggcattccatttaattgtatcaagtcaagaagttgggagattttgtgtgggtctattggacaatatggtcctagatacatatcagcctcttatcatgaccttcaggtgccattgcttgaaaaggcaaagaagaagacaaattcaataagagaaaagcatgaattggcttggcaagaatatggttgttctctcatgtcagatgggtggatagacaaaagaaaacgtcacttagtcaatttccttgtcaatagtctagcagggacattcttcttggagtctattgatatattacacctagcagctgatgcacaattgattgcaaatctattggagaagcaaattgatattatccgaagaaattatgtggttcggattgtaagtgacaatggttcaaattataaggcagcaggtagacttctaatggaaaggattccaactttgtattggaccccatgtgctgcccactgcttggatctcatgttggaggacattatgaaaattcctatgttgagcccttctattgcaaaagccaagaaagttactacatttatctatagtcacagtaggcttcttgatgctatgaggaagaagacaaatggagccgacattgtgaggcctgcagctacacggtttgctactgcttttctcacattgcaatctatgtggaagcattgcactgctttgaaaggtctttttgtggatgaatgttggactagttccagcttggctagaaaggaggcagggaaaaaggtttcttcatatgtgctgacaactgttttttggaatggggttgaaaattgcatgagagcatctcaggcgctgctcattgtgctaaggctagttgatggtgatgagagggcagctttggctaaggttagttatgctatggaagtcgctaagaagaagatctagagcattctttgtctctcaaggcaaaattacttgagaaggtgatgggtattgtgagcaaccgatgggattcccaaagggatcagaagttatatggggctgcatacttcttgaatccaaaaaggttctttgaacttaagagtgaccttgccaatagaatgttgtgtactaagctgaggcatatgttcaatgaggtgttatggaaaatggtccctgatgaggcgaaacaaagcaaaataagctcgcaatctgatgattatgtgagagaggagggtgaatgcttctcttctaagttggctcaagctgacaagacaaagaaaaatccacgtaagcatcctctttttttgtttgttttttgtttcaatctggctaggtgtaagtgtatcaacttgccttttcttgctgttctttggtggtcagcttatggaggccttgcttttgagctccaaactttagcaaagcatattgttagcctttgttgctcaacatcaggatgtgagcgtaattggatgccactactcgtgatcatactatgtaaaaacaacttcaatcagatctgattgagcatatctagcaaaagtttgggaattcaaaccaattaggtgactattcatcatttgaagtttaatttacaatctctatgttacatagagatagtatgcttcatataaagttgcaaactcgactacattttaccctagcagtaccaattcagttaaatatgttctctcttttttttttgatgtgaagcttccgcattattttgatattgacttgtctattactctttttttttaagattaggtcctgctattttggtggtgttgtgctgttgtatgaaatactcatgactactgaaattttttttccttatgttctgcattgagtccattatagtgtcggtgtgtgtggcagacttgtggctacatatgtttctttattttggtgttgcggtgcatctggacgaactactaatatcatagagactaccaatttgatgaaccctgagctccactcgagacactcaaggctgttgttggcccgatctttcggtgagttgatgataactacgattttggagaaacgttgacgacccgactacaaccatacgagacgttgttgtgttgcgccttagcgatcgatacacctctccgtgggttgttgatcttgccggtgcagatcaaccttattcctacaagcaaatctaagaaacaagcaagaacaagataaaagcaatctgaattgcagataggaattgaatacaaatgataggttggggttccgtaacgagtaaaccggtgatctaaccgatcacaggattacacggcaaagtagcaaagttaaactttaatctaaacaaaactcgagaaaccctgaaggggtacctaactatattanagaggtaggaggacgaccaaggggactctagggtcgtgctccactttgttggggtgcaccccacatgggccctccttgggccggggttccagacgaagttacaagcccataggcccattataggtgatgcaacaccttgttactttaattgcggctcactaagatggaatttcgcaatgaagctggatccgttggaaagaggactccgagatctttccatcaagtactcacgggctgaaaacagagctcatatggagatttcgcggccgtttgaaatcagcagtgcagcaggtggccgaattggattccagcacttggaggccttgaccttaatgtcttcttgtccatccatgatgtgagcaatggttgtatccgtagtagctatggtcacatcatactccccttcttcatggaaaaccgtcctcggtttttccatatggtgctcttcacatagtccattcaaaataacatgtttcatccaatcaagactagagaaactcgaagtagtgtgattaggaataacatgtttctctaaatccgaacaaatgaaaactctatgcaccaaatatatttttctatcattatattcatcaaagatatgaaaaatagcattagttggacatggcaaatcagacttagcaaataatttctcctccaaattattgagctcacaaaaatcatcaaactgaacatagcccaaagtatttaaagaagttatcaatttacgttcctcaacatcattagcaatgtgaacaacatgcttaaaatcagcacacaatgaaacactagaaatagcaggttcattcactagttgtggcatggatttaagtgaagcattatcacacaactcttctttatcacaagaaacagcaagtaaatcaacttgtaacaaaggcaaatcagaagtagtttccaccaaaatttgctctagattagcatggatagtggacaaatgtgactcatcagaagcacactcaccttgactaatattagcaccatttaatttaccttttatgccctcttcagataatataggtgcatcagtcttttcttcttccttcgtgagcgatggagatggcatctcgagcatattgctcttctcctcatggtgaatgttctgagctccctgcaaaatgtcagtaataggaagcacaagcataacctgtttctcccttgggttctttaaaatattgctctcaacactgcaagcaagcatgaacaagtggcctatatgattatatgtcacgttaataagcccaacgtgaatatcggaattaagccctctaaaaaatctagtcattatgttctcattgctttcttttaaaccactataagtgagacaaattttaaagttatgaaagtactcccgcacagttttgtcaccttgttttagatgttctaatttctcaaggagtatgaaaacacaaaagttttcctcatcattgttttgcattcatcccaagtttcaagcttattgccaacagtataccaccaagaagatgcagaaccggtacacttattactagcaaccttaatcatttgagcattagagaaatcatactcatcaaattgtttgtctaccgctagctcccaattaacataagcggtggaatcatacttaccatcaaaaactggcaaattagattctacccttgcaagatcattatcatgtacctcatatgctatgcgtgaagaagtcgttatatctcgttgatcgtgaagaagtcgatgttgagcatgaccatctcgtttccccttgtgcaatcctgtcatggttagtagcaaacaagaaacatacacaagaatatgcacgctcctatcaactacttggtagtggaagctccaatatcacacacactcaagcttttttaccaagctcttacaagttcttaccaaagcaggcataatggtgacgtacactgactcaaccaagcaccccaatggaggttcgatgtatcgaggccttggcaaacacctgctgtatggctgcaatcaaatctgtggagctctgggtaggcttaaatatgtagcaaaggaatagcaaatgttcaaatcagagaatgcaaagttgaataattgttcaaagtcaagtaccgtactggtcctaggctagaacgtaccagagacgcgagcctacacacaaacggtaccacaaaatagcactaggaacaacttaagcacactgatatatccaagcgatccagaagataacaagtgattttctcttttccttccttcttctctttttctttctttctttcttcttcttttttttctcttttttttgtcggtgcggctttttcttttctctctttttttttccacctttctgcctttttttttcttttttttaacaaaaactgactcaaggacatcaatgtaaggtcatagggacccaaatgtaaatatgaaaattacatggactcaactgtaaaagtcaaaaccaaaattataaatcatacaaaaatggaatgctgaatttatactggttccgtttttccaaacagatctcgaaaccgacaccaaacaaaaattcaccaaggtgtctagcaactcaaattgaagggagcgagtcggactctctctagtcacggtggtgatgggtacggtaggtcgaagggttcggcctgcccccccacaagtggaaccgaatccaataaaaaaaaactttccttttcttttctttcccttttttttcctttccttccaccccaccgaatccaaacagatctgctatattcctttcttcttcctcgcacacacatgcacgacacaccaccaaatagaagctatgcaacttgagaattcaaaaattaaccgacagaaacttttgaaaactacaaaaatagaaccgtggcagtgagccgattccgttttcgtaggtcccgacgacaacagagacacggaggcgacgatgactgtggtccaaaacgtgactagaactcaaaactctaaacaaactagacgctatgatcagcaacacgacgtgacgacgcaacacaaaactcaacaacgcaaaaactaaaaagaacaatgcaatggcacaaagatggctaggtacatgatgcaatttttttaggcaattttctggttataggtagataaaaactcaccgagcaacgaaagctctgataccacctgatgacccctgagctccactcgagacacttaaggctgttgttggcccgtctttcggtgagttgatgataactacgatttgggagaaacgttgacgacctgactacaaccgtacgacacgttgttgtgttacggctgagcgatcgatacacctctccgtgggttgttgatcttgccgatgcagatcaaccttattcctgcaagcaaatcgaagaaacaagcaagaacaagataaaagcaatctgaattgcagataggaattgaatacaaatgataggttggcgttccgtaacgagtaaaccggcaatctaaccgatcacgggattacacggcaaagtagcacagctaaactttaatctaaacaaaactcgagaaaccctgaaggggtacctaactatattaaagaggtaggaggacgatcaaggggactctagggtcgtgctccacctggttggggcgcaccccacatgggccccacttgggccggggtcccagatgaagttacaagcccatatgcccattacaggtgacgcagcaccttgttgcttcaattgtggctcattgagatgaaatttcgcaatgaggctggatccgttggaaagaggactcctagagctttccatcaagtactcatgggccaaaaacagagctcgtatggagatttcgcggccgtttgaaatcagcagtgcagcaggtggccgaatcggattccgacacttggaggccttgaccttgatgccttcttgttcatccatgatatgagcaatggttgtatccgtagtaactatggtcacatcaacctatgtttctttttacctgtgtttgcgttctatcattttggctatcaatgtctctcttttattgtactgagatgtatgaacatggaaatttgtgttgatatatatctactagtttctactcgtatatgcactgatatgtgttagtttcttctcatttactcagattagcactgatatatgctcatatgttgatagtttgacacatacagtacaatgtagctactgattttgatctttggatgtatgtgatgcatgtcacagttgatccttctccatttacatgacatgtaaagagttattaaattttcttctctacagaaattgctatggacactatgcgttgggagatagtgtcaacatatatattattatgctttctctcctctagacactacccatcaatggtgggttgggattgcccttagggttgaatagggatttttaaactaagaacaacaattagatcctagttgcaatttatataagagatagcctagtgtatctaggttgactactgtgactatcttgcaaaattaaacaagtttttacaacctagggtcaatcctagtttggaatgtcaatactaggatgtatattgtgataggtggaaaactgcaaatagagtagagagagaagttgacgacgcatgccgagttcttctttgaggtttcgaatatttggcaatttttgctagttcatattggagcactctacaaaaacaatattatgccatcatatatggtgtgtgctctttagtggtagcatttctcacttcggatagactagctccaaacccttgatatattgcttggatttcctacaatcaccaacaaggaagatcattgggtcctttgatttgtagaaaaaaaacatagaaatattgaaggaaaatttcatatgaaggcctttgaaacaaaggatttaattatattctatcctttgaaattcctatatatggaatggacaatcccataaagattttagagaaaaacttagcaagagctccaactttttgaaaaaaatttcctttgagtctatctttctcatctgattcctgtgttttttctgcaatccaatcaaacggtcatttttgtgtcttctgacatgttgcaatcctctgtattgcacttacttactttcttgttagaatctcgtgcttttccattcctacgattcaaagggccctcaattataactacaagaatttataggcatgtactaaaatgctaagagtaaccagacaaattttcactttactaacatgaagtctcttaaatttatggatgcatataatgcttataactagaacttagcctcattagcgtatgattaattaagtatcagctataaaaatttgaaaactggattaattttttcaaatcaacttttctacagattatttttttaaaaaaacacatggtttagcagtttggaaagtgtgctcatggaaaatgaaggggatgaagataggaagagggactgccaagcacggcctaagtttttcttccgttatatgcctcggagttgcaattgattgagatcagcattacttccttatataaaaaaagacatgataagaaaatttatgatcccagtcataaatttttgataagctactagtttaagagaaacaaacctaccttctactatatagttggtactcactaactcctaaatcttaacatgcaaatttgtcacatcatcacccactagcaattattatctagagtatcttaaatctcatgcaaacaagatacatcatttacaattttgttgtagttttcaaactcaacatgcaatctccacatcattttcacattatgtaaacatatacatctatcatttttataaagtataatatgcattcatctacatattcgagagcaaagcgtgaggtatcaaccagtgaagtaaacaagttaatacgtaacatgttgtagtgggacggttgggtatacactaaggactttcgaaagaggtacacactgaaaacaatgaaaaaaacacagatgtttagtactcgtacttagctctagcataatactagttaagtgaacaagttaattaatacataacatgttgcagtgcgacgattgggtatccagtaaggactttgaaaagaggtacacactaaaaacacagatgtttagtactcgtacttagctctagaataattttttcttagtacatcaaattactaactacaatatttagaacaagaactgcttatggttggccagttttaccttttcttgtttttgtcttgaaacaaatattgattaggacataatccattgatgatgagttaggtagatatttaaacatgggagaacattgttaaatattgtcggtatcatcataatcgcataagtatttcagtgatacgatttcgagctacaacaatatgaatatcaaaaaaatgatgtactcgaatagtttaaccgtttaacctgtgtggaccatagttggttagataaaatgatacatgcatgagaagctaagctattattaaggtaagggaaaagtttgaattaccccctgacaattgcgttagtccgaattacccctcgaaactgcaaatccagacatttaacacctcaaaattttcaaaccatacgaattgccctcctaatcgattttaacccggtattgcttttatgtggtggacacgtggcaatctagctaaccaaaaaaaagttaaagaagatgtgggtcccacgtgtcagccttatcaactcctcttcctccccttcctcctttctttctctctcatctgccgctgaggcgttgtgctccagctcggagagtcggtgaggcagcttccaaccgggtggtgagtgtgatcgtgtcggggcacacgacagcgacagaaatgaagtcggagggtacgctaagcccgtcattaggaagagctccaacctgtgcgggcgcagccacgggcgcttgcctgagccaccgggcgagaaaatggagggaggaggaggcgatcgagatcaggtggagggagaaggcagcctggcgatgatgctcaacgacggagagttgtggcgagccgtgtaatacgcgatgcggcaggagacgacatgggtgagatctccttgggagagctcgtggtcctatgatgaatcgtcgagccatcaccttcgcggacctccagcacggcagcaccccctccattccccaaccatgcaggctgccgcaaggccccttcacaacgcctcctgccccaagctagctgattgctcttctcctctccctccttggatctgccctcatcgccttctgcactctagaggcctccgtcggcaccgtcttcctccgcctgctcgtggaggccaccgctgccgcctccctctatcagttctagaggctggcactggtgtcgccttcctctgcctgctcatggaggctgttgatatttcttaacgacataagtagaaaaataattcccagcaatgacgtagaaatatttatggcatacttatggttacagatatgatccgcaagcgcacggatataccattgtagcatttcacccgggagtattccaaggtatcgtatttatttaatcccaagggaagatatgataagagagtactatgctaatagtttatatattacttgtatacatcaaggtcttatgcagaggttaagcaattcaaagggtaggtgacacacataagaaagaactatgatactctcactaaaatataatctaagctaagtggaggaagaataagaaaagaattcattcctatacttcggatatacatacacatttagtctacacttgttagtatactgtcatgcaaccaataccccctaacagtgccctcctagtgtttcgagagaccatcccgggttgacgagttccttacgataacctgtcatggtcgtccaatcggagctaaatacggaggagtaccctccccaggaatttgtcttatgaatatatactaacctggaggaatacccgtactgagctgtcaccatcagcggcccacctctactgtcccgcagcatatatgcccagatagtgatacttaataatctagacaccacgtctacattattaaatattactctatatcccccgagatgacataaagcaaccgagcaattggacactaaacccacaccattgcacctctctggtaggctagctatacaactatattgatacaagtataaaatgaagtcggtactcagataatataaatggtaaaaatattgaagatgtataaagaaaaatattctattaattcaataagtcttacaaaagaagagaggaaagctactagagccataccagaattctcctgaagacccgaggactaagaatactattctgattcctactccactagcactagggtactactaaacttgggagagtgagagagctcttcttcttgagtgtgtgttgagaatgagtgaggtgatgtccatttataggctggtaatgacggttgccgatgcaaattgtcggaattaccccgcaacctccattgagggaggtatcctggatgtccacgtggagggccgaggtgaggcacctccggccgaacctgggccggcccacctggcccccagttttggcaggtggccttcttaacttctcccttatctagaaggtctattggatcatgtcaattctatgtttttggcccatttatccataagtctggatttcgacagcgtctaactgattgctcgtttattttctgtcaattcttctccatttatatgtgcttctcctgcatacatgttagtagcatagtacatagtggaagtagatattttatttggaaattatgcattgcaagcatagctagtcttcattaattgggtaatattgacggtcgaaattggtcgataacgaccatcaacagaggccaccgaaggcttcttcatgcctcatctggagggcacagtgctgccgtcagctcctccttgcctgctgtcctgttgggtgtcgagagagaggagaaggtggaaggtagaagggtatgcatatgatatgtgggaccacccgatgttataatatttttttaattgaaatattgctgactaggctgccacgtgggtaacatgtcagactaaaacctccttctcgattgagggggttatttcgctggtttgaaaacttgagggtgttaaacgtctagttttacagtttagagggataattcggagtgacacaaataatttaggagggtaattcgaactcttccttaagtaataaatagaaagaattaaaggacgtcagttcttcggctacacaacgagataaacaattatctctctcctagacaatcgaatgaatgttttaatttacatgtgcattataagaacaatccgatggtcatgatttaaattatggtatgattaatacatattgagtttctttcatttatatagaatagaaaaaacttggtaaacctaagtacccatcttccctataattcaccaactgcactcctatatacaaacctcattcatgaaatccaacgatccaaaatgaacgaatccaatggctcgcatcgtcccacggaccccctcacctccctgcaccgcacacaccccctctctcccctcctctctctctctctcacctggaaatcactcgtgcatcccacaccaaccgcgacgccccaccattgccctccctccctcaaagtgctcctggctccctcataccccttgtcgccgcatgccctccacactgccgctggcactccccaccgtgcgccgcccccggccttccctgctacaaaggcttgcccctcctctccggcatcattcatcatctccaccttagccgcccagctaccggtcatcgagcagaatgatagcttttttatgagagacacaaaagaatgggcgtttctcagttaactcaatgtacaaagcaatcatgtatagggaagtcgtttctaaaaaggacatgatttagaaactcagaatacaattttcttgtggtacttaaagagtggagtaattttagcaaaggataatttagccaaaaggaagtagaagggtagtgttaagcgttgtttttgtgattctaacgaatcaattcagcgccttttctttgattgtattttggcaagattcatgtggaatgcagtctatatatcttttggaattcacccgcctaggaatgttgctagaatgttcgggaattggcagaagggggttcggcccaagttaagggctcaaatccttgtggggatgggaactttgtgttgggtggtttggttatgccggaatgatgtagtctttgatggctccaatactaatttttttgttgcaggtgattttcaggggggccttttggacaagacaatggtctttcctacttaaggaggaagatggccaaaaagtgagagaaggttgcttgatgctggagaagagagtttttggcttttctgcaatgaagggattgaacttaagaaaaagattaggatattaatactatcttgttttcttatgtggtacggttgaaactttgtattaactttttaagaattgttgtttctagagactaagtggttgaaactttgtattaactttttaagaattgttgtttctagagcctaagtgctcgggtctagttgcttcagatggtgttaaaccttttgtaagggtgtgagtctatatactctttgtatgtttcgttgagactgtgtagaggccggtttaatccattataaaaaaaaaagaagccggtcgtgatctgcagccgctgggccgcgggtcgcgatctgaacagatcagtccgaccgcaatcgctgtttcttttgctgcagaacctgaaaaggtcaggatagcaccgatatgcactagattttgacctatatatacttgcctgcccttttctgctcactagggatcatgatatacgataggcatttcagaccaatacttgccactgttttaattctcttttctgtttccatgatcatcatgtcaagaggggcaaacctgacagaaaaatctcaactgaaatcatttgcgaaaccagtgcaacactgcaacgatgagagtgagaattagtctggcaaatgaaaaaaattacaaattatgggttccactcatatatatctcagtcaatcacagtagtatcttggggaatttcaactgaattctattttgcacaaccacaaacctattcacaaacatgattggtacttttgagagaaaaactggtgagaaatctatcttcttgaaagtttagctaaagagtattcttaatcaaaacactaatataagaattagatttactggacaattgagcagctgtgaatggttgtttaatgctatattaaattactaattgaattgcaatgtcaattggctgaattaattttcttctataagattggaccaatctagaagggaatacacttgcctaaacttttctgctaattgaggtataactggtaccacgcctcatatgcaatgaaatgcaaatattattagctgtatcaataggacaagcagaagaatctaagatgcaaaaaggaaatgcagtatatatctaagctgaaaaatgtttgttatttctcaactgtgtatgtatacattgaagtcatttgacttgtgctatatcatggaataaaaatatatgacagtatatctctattcatcaaggaaagactcccccgcgtcgctctcatgggggcggctcagggtggggggggggaccctagccgcccgcgccgccacaccctcttccccctcctccacctcaccgccaccggagctcgccggcggcaaagccggcggtgagccaggaatgcggcggcaaggcccatacggctcggcggaaccgccctctgcatgaggaggacggagatggccgacgatggcgcgcccggaggtggagtcggccgtttggcttggggcagctggtctggcgcccttgtggccagatctggtcccctacctgtaggccaacgcggtgggcgacatgacggagccggagtggggcagcgagtggcggcgagggaggacacgggtcccggccggcgaggcagctgcgaggcggtggtggccctcagcccggtgatggggcagccggatcaagtgccccttggccagatccgccgccctcctagccgaatgacgacggcgagctgcctaggcgaggtggggactggtgtgccctcgccagcgcagggaaggctgtgggaggccggcgacggaggacggagccgggcgacgagcgcgtgacggaggcggggggctggtgctgcgatggaggcggggggagggtgcgcccactggcggttgcgggtggcccttgtgtgcggaggcagtggcggccaccagctgcgcccaccggcgtcttggcagcgacgcagcggggcgctcatggtgccgatggctagccgagcctcgacagccggtcccatggccgcatcggccggtggtcggtgcagcagtggatggcggcggcttggcggacttgtgagcctgcctgagctatgggtggtgggctaggcttggcggctaaagggacgatgtggcggtccggcgacgttcgttgtgtggatgggttgtgtggttttggatgacgctggcgaaagcctgtgctggcctttggttggcttgacgacggcggcaccattaggtttcgttcccctctttggaggcgttgttatggcatctccctcactaccaagaacctttcccatgcatggatggtcgttcgtggacccccgcgtcgaagctctgtaagcctagcttttcggcgaggccttcgtctcctaggttcggttcttgatgtgatgagtgtccaactttcttcgttttcttctaagtgaagtcggagctgctttgttggggtgcgatgaagctaggcaacgataacacgttgtagttttcgaggggtgttggtgttagctgtgtacaagaagtggtgctctggtaacttgggctgatgttcaaagtggacaatcaatgtgttgcttgttttctgtgatgcctttggcaatgatgatgtgatagcggtggagtcggagctgctatgtcgctaggcgacaagcccggtaacgataacatttgcctcacgaagtcgaagcctttgtgtcgcttacaacaagctctttatcgatagttgttttgggctccaacatttttcctttttccacggtgttggtagcttaagttagagtgttgtggtttttgcgcagttttcccctagttaactgtgcattgtaaggtttggtctcgttttctccttaaaatgagacacattcttttttatataaaacgtcggtaacggcctgactgttcgaaaaaaaaatatgacagtacaaatatctattgcaacgaaacaatctcactatatatgcttttgaatctattgcaggtgtatatctcaacaattcaacaaggatgatataactgcttatgaaatttcttgcttcctgcatcctgtctctgatattcagttgtttattctgtcaatttttcggcaggaattatcaattcatcttagtgctttgcattgtcaaatggcaggtgtccaaaagcatctcagataaaatctttcagtcttgaatttttaatttgtttttaagagcttggccatattatgttattctcttacctttgcctgcagcgataaggaagcctatagttacttggtcttggacagcggatgatcaatgcaatagtggccagtgcagggtaatctttcaatgaatataattgctggaaacaaacaatatatttgtcaatattcgtactgttgccttagtgtctgtatgcatgtttgtacattgctaaaagaccgatgagaggataattagagggattgagaataatcagtaaatacacttctcagtttcgtgtttctcccggatagatatgggagcaagacaacaggtgatgatgagaactggaacacaagctaagctacatgttcaaggatactcaggtacctcgctctgccaacaagtatgttcaatccttgcctagaaatttcgattgataaattttgtttatttttaaataagtgctaatgatgtatgcaggtttctgatctccgtgtttcagcttactactgaaatggacaataccgttggaacgtcatgaaaagattaagtggcaagaaaagaacaagcaatggacaatctccattaattccgcatacacttggggaggccgggcgcctggccgcttgcaaaaactggtgtctgtcactggtattcagagtaaaaaacttcactttccgattgcttgatagaaaactgaaaaacttaagttcatgttaatatatgaacccttaatgacgataataagagttggatttttttttaattttctgccaaacacgcacaccactcagatcgatatggctcgattcatacttcatcttttggtaggttttcagttggtactgtttttcatgttttacatgaaatttatgtactaagctagcattccattgatcgattttactgccctggaactccttcctcataacttctatcaaaacatctcattttacaggatagattcatgcatttcgaataggaaaaggtacgaattaccccctgaactatcacggtcgaccgaattaccctcttgaaccacaaaaccggatattcttcacccccaactttgcaaaccagacaaataacccccctggcttaatccgcggtggttttgatcctacgtggtattccagtcagaattcatttataaaaaaaaaggtgggccccacctgtcagtttctctctcttttatctctttcccaatctctcactctctctctctcttctccatcagcgttccatcagaggccgcacctgtcagggccgacgctgccgccgacgtccagaccggctgccgcaccatgctcggcctcatagtcaccgggatcgccggcggtgccctcgcgcaggcggcgctcgccgaggccgccaagcccatcaagctcggccccccgccaccgccctccggtgaaggagaggttctacctgcagccgctgccgccggtgggaggcggcggcgagggcgaaggaggtgaggtggcagcgggcgcgagcagctggcggcgcacgatgagccgaggtcggcagctagcgggcatgggcggcgagcgggagcggaggcagctgcaggtggcgggtgaggaaccgacgacggcagccgggcgggcggaggcgggcgtggcggcgggcgaggagccgaggacagcagcagggatggctacgagcggcaggcgggcaaggagtggacgccgacgggcggccggtggtgggcgaggcaagcggctcttctacggtcacgccgccgtgaggcgcctaccaatcccggacgccaatgacgagcacgtcggactccgtcgatgacgacgacgagaagctctgcctgggggagtggtgctcgttgcggttgtacctctacttgacactggcgacggtgcccacggcgagcatgaggtctagctccgccgcttcctgtcacaccctgaagttcttctcccaagcctaaattaattaataaatggtctcaacaaattatctgtgtattggcaagagagaaaccctattttaataaatgcaaataataatcagaaatggcacgtgcaatttttcttgggttctacatgtcataatatgctaacaagatttttagagctctataaataattttaaccaatttaaaatgagcacaagcaattattaaatccctggaaatcccttttttcctttttttttctttttcccctttttccttcgaatgggccatcggcccattctcctctccccacccctccccgcgcgctagctgggccggcccgaggccgaggcccagcgagcggccaccgcgccccctctctccgggccactgacaggtggggcccacctgtcgggcccaacccctacctgcggccggcgccgcctcgcgccgctgccgcccgcctctcccgcgcctcccgtgccatgtcgcccacttctcgcactcgccccgcacgtcccgcaaccgccaccccctctcccgcccgcacgcccgcgccgagatggccgggattcaatttttgaatcccgcctttctctccaacccacctcccccacgtcgccggccgattcgcgcccctcccggccacgtctctccccctcgcgcctatataaagcacccctgtcccctcctccacctttttcctgttcttgccgagctctcccgtgtactccaccgccctagcgccgcgcaccacccaccgccaccactttagcaacctccggccgccgctcgccgccgttagagccgccaagcctcgccgtcgcctctgtcggctccgcaagcccacaggccacgtcgtccactccttccccgtcgaaatatgccaccgggagccgtcctccgtcgcgcgccggtgaacccctccattgccgctgccttcggccgtcgttcccgccccttttcgcaccatctcgccctttctaaattggcccattttgttccctaggtttccccggagcccgtcccgccgtcgccgtcgccttccaccactcgccgtcatcgatcgtcgtcagtgaggcccctcccccttttcccctctctctcccgcgccgcctagcattgccgcttagccgcctagccgccaacgctagcgccgcgcccggccgcgtgccgcctccgccgtcggatctaccctcagatagatcggggccgtccgttaccgcccgcgtggcaagcccacgtggccgccacgtcggcgccacgtgtgcgccacgtggcgatcccctctcccgataccgtggactcggtccaccgtggaccggcgtccccgagccgatgacatgtggggcccgcatgtaggcgcccccttgtgctgacatcgctagggttaattattgcgcaataaatcaattaatgttttcctttttatagtaaaagcacagtgaatcttctaaaattcatagaaaattcatccgtgctctgtttaagcccattcaagtatcagtaagtcaagaaaaatgcaaataatccattaaaaatggttttgttctttgtttcagttgtcttttagcctatttgcattgtttgctttgtatgtcgcatagattccagctctcccgacgctccggtgtacttcgagatagtcgtcgaagttcctccggccatagagcaaggcaagtcatgcttgtcacttgaacatattgatcccatattgcaaatgctttttaaatattgcattgttttataatgctaccatgggatgtctacctactggatcgcttagccatgcttagatcaactagtacacaatgggggaattacattaatgcatagacttaagattctagtattgatgttggattagtgccaccgctttggtgttggttaattaaaatatattaaatggtgggctgtgggtacatggttctgttggtcgcgcccatggcaattaaggaccggttcgcgggaaaccctggaagaattcctcgtacttaccacaagccagcatgggcaactgctgggcttgtagtgtagctttcctctagctgacgcatccaggcaagggtgggcgtgatggagcgggatgggccctgcgacagcctttgtcgcttccagattcacctaggcacaagaggggactgcccgctgccttgcgaggagtgggggtgaaacctgaggtgtggtgtgcttggttagagggggttatctgaagggtcctatcacggcctctttccagtatgtcatagtggcatgtcagtgcacgggaacgtgtcgtggggctgtgtcttgtgggtacagttgtacacctctgatcagagtaaaactattcgaatagccgtgcctgtggttatgggcggtcaaccagattcatcatgattagtctcacctctagcttagcttaatggaactgattagttcagttgatggtttgggcctgtctcaacgtggtgtagcgttgagcagtgattggtttaatactggttaattactataactgttttactactttcaactactgtttataaatgctagctttacgcaaatgaaccccctttagcctcctttgattatatcctgcatcataccctccgttctggtatgacttgctgagtacagtgggtagtactgagtcttgctctatctcccaaccctcagagttcaagtacgcttccgatggtggtttctccgaggagtaggcttcgtctgtgctgtcgaggatgcctgtggagtggtgttcccgctgcaatccaagtcaaggcttagctccagttatcttttaattttcgctgcatttatgtaagacttttataatgtttgtaagacgtggatctgtatgtcaactttatcgtttgtgtacactggccggacctagacaggggttttaatgcacgtttttcttgaaattctattcgggaatttcagggcgtgacaccgcctcctcctcgtcgtcgatgtcctccgcgaactcctcctcggggctctgtgtgtacttgaccgccggcacgagacacgggccacgggcagaccgcgagccacgggccgctgcttccggcgatgccgcctcgcctcgcgcctccgccccgtccacccccgtgcaccgccgcccaccgcccccaggcaccgccgccctccacccgtccgccgccgctcgccgccagccgtgcccgccgcccacatcctcccctgcaccgccccatgaccatgagagagagagagagtgaagagagaggaagaggggaagggcacgtggtttccacattttttaaaaatagaaaatgctgactgggttgccacatgtatgccacgtaggacaaaaccgctcagaattggatcgagaggggtaagtcgtctggtattgaaagttcagggtgaacaatatctggttttcgggttcaggggtgtaattcagtcgaccgcgatagttcaggggggtaattcgtacttttttctttcgaatatgtacaagtcatagatccatgtaaatataaatgtcaattttcatgttgcaggggtggctcatcaccagttgcattagattttatgttgtacataacactctaaaatgatggatccttttctttgtgatgctgatcagggatagcttagatcagagggagggaagcatgaggagaatgctttcatggcttcggcagctgtttggagtagtgcaattcttctctcaccgcacgacgacaatactcctgtttgaaatacatgaatttattaagggcatcaataattatatggtttcaaaagataaaaaagttgcagtgttatgttagacgcgtggctatgtaattaacaatataattattctatattcttttttcatcaatcttaaatatatcttataattcttgattgtaaatcatgtattttttttatttggtttaacactaaatactaaatattgtcgtagcgttagcacggatatattactagtatttagaagtacaagatttatctaagtagtactccctccgtcaaaaaaaaaaactcaatttctagaatttgaattttgtaaaaaaaaataaacttctaccatcctacctacccttagcacataaaacgagaagttttatcccttaaatattctttacctacctatcaccattactatattttctaataagggtcattttagttatttttacttctcattaaatttgtattaggatgctaggaatgctctttttatgggacggagggagtacatcatagactgcgttcggcaagaggagctgggaacccactctctctttttccatgcgccatgctttttaaactattaaatggtgtattttttgaaaaaaaattctatatgaaagttgctccaaaaatcatatggatctatttttaaaaacaaattagccaatacttaattaagcatgcgctaatgaaccgttccgttttctgtgcgggagggattaagttctcatccttactaccgaaagcaacctaaagaacttggccgtgttcattgcgggaggttcacaaccggaaccggaataatacacacgaaaaacggaacggtccatcagtgcatgattaattaagtattagcttttttttaaaatatggatcaatatgattttttaaataactttttacagaaatttttaaaaatgtatcatttagtagtttaaaaaaatgcacgtggaaaaagagaggaggggagttgggaacaggggaaaccaacgcagcattaggaaaccgggtagtaagaccctatttagatgggactaaaacttttaagtccctatcacatcggatgtttagacactaattataaatattaaacatagactattaataaaacccatccataatcttggactaattcgcgagacgaatctattaagtctaattaatccatgattagtctatgtgatgctacagtaaatattctctaattatggattaattacgcttaaaaatttgtctcgcaaattagctttcatttatgtaattagttttgtaagtagtttatatttaatactctaaattagtatctaaatacatagacattagtatcaaatacatagactaaagttaagtcactcgatccaaacaccacctaagcctctagctgaccagcagcaataaaacagcaataaaggtcgatgattgccgagcctgtcccttgtttcaaaatataaaagaaattttatttaaattggagtgcaatacaagcatttatgtaatgatggtacacaatacaagcatttatatgcactaattgccttgattcccaccacttcgatgattccagagcaaatcagattcttctcaagaaaatcaattcaaaaattaacaactgaagtaaaaaaaaaacagatttgaaggaagagatgtctcactaactttttttaagaaaaaattataaacgtattggaattgaatataggtccatggagttgaaacccacaccccttgtcactacactaaatgcatctcacaactgaagtgactaaaaacatttttttaacgtgctaaacaacttagatgtctatgggttcacttatgcgtatgcttatcaagcaaatgctataaaataaatcatgataagaaacacaaaatcaatatcaaaattcaatttaaaaatcaaattttggctataaaataactcacaatgagaaatcataaatcaacataaaatttaaattttgtttttcaagtataagcatcagtggaatgctgggaccgttagaaatttttatttatattatttttttggaaaagagagtaggatattgtgcctagcacttatctattactttatgtgggacccacttttatgggacctaaatatcagtgatggtggtggtgaggcagactcaccaccgccagatggaacatttacggcctcatattttcgcttatgcatgtgctaatcagccaaaatttaaattttcaactttaaaattgatgccgaatttaaggtttttccatcaaaatttattttttaccctttgcttttagatcactaaaaacacatatataaaagttttattcacaaattacttttcgtttgcaaatataacgtttggcttcttacacgaataagcgaatcgataaggctattaaagaagtaaagatgtagtatattacttcctcctccatccgtccaaaataagttgcttttgtacataaatttaatttagacctagcatatgttcaaattcgagtattttttttgaacgactcgcacgagacggtgtgaagttctattgatagagtaggaaaaaattacaagattacaatcctgaagggtcataaccaggagaaagaaaaaaatataccaccacccacacaccggtagcgccaacacacacgaccaggagaaggttagcaccggaccggccaccgctagaccaacaaaggaacacagacgagatcaccctacaacaaggggatgccaaaacgacgtcttcaagaaaaaaagtgacggaaaaccgccgccgccgtccatcagggctcaaaggagccaagactgggctttcgcccggcaatcacccttgaggggtgagacagcacgacaacgccctcaggagggggaattaaccatcgttgtcggtccggccaagaccgggctaggttttcacccgccactcaccacctgcgaatctacggctgatgcaccgatgctccaccaccactcaaactctgccgacatatggggcccctgcaccgacgcccccccgccggccaaccttcgtgcgtcgaagaccgcgccacacccaccggcagctccaccacgcaccgaggtcgcctcttccaccgc

SEQ ID NO: 68310 - DNA, 717 bp, Oryza sativa
gcgctttctctctctccatggagtatgtctgcttgaccatttgctccagatgagatgagattattgtcatctggtctgccttttttccggccctcccggctacaattatcgcggtcgtctcagaagactcggcacgcactcccatgctcaaactccggcttgatccgcgccgcgcggggtggagagtttttttttcctttccttttaacgccttggacttggacctgatcagagagtgctgggcttatcagctcagaagtgagagggaagaagaaactgagttcggctttactccagcttcttagtgaaggcccaaataatgccatcacaagttgatagtttttgataaggaaaaagtatatttggactccctcaactaccgcctggagtatgattcatatcctccaaccataaaaccagatatatcggctcctccaactatcaaaaccagtacaaacaatgtccctcgatggttttcgaggtggttttggctgacgtgacgcctacgtggtgatcttaactcttaaccgagtctttgtcatacgtgacgcttacgtagcattagaataaaaacaaaaataaaaaaatgtgggatccacatgtcattcacataaaaaagtattgtgggaccactgacatgtgggacacacatgtcatcctccctctccttcccttcttcctccccgtctctctcccttatctctttctccggagcgg

SEQ ID NO: 68311 - DNA, 732 bp, Oryza sativa
attcctgcagcccttttgaacataataaagaatattttttaatttatgttggatgggaatgatgtctgaatttatcttgaaaaaaattctatagtgttctaattttgttaggtttgtaaattattttctgacagaaattacagtgcaataaaatgatatgcactttgaaaatcatatcaatctgcacgcaaaaaaaagagagaagaaaattgtatcaattttcaggacaaatatgttttcatgacaaggaagcatgatttcatttgtgacagaaagtttttaatggaatgaacatggtttctgccagccttttcaagagactgagggagggagagagagagaaaaaggagaataacaagttgctcctcaattatagggttgcaatgatatatattacctttaaactaaaggtctcttagccattgccacatatgtaatgtaatttaaattcaaatggatattaaaggccattccaagtcacattccgcgttctcgtggtcataccgcgtgaacctagtgatggagaagagatcgaacccggtcatacttgggcgctagcttgatgtaagtcattgtcacaactaggcgagtcgtgttctataacaatgtagaatcgaagtaaatcaattcttgaattgtctcgcaaaaaaaaggggtgatcttgagttgaattttatcaattttaggcaaaattgggtgaacaaggaaaatagaagagatcgataaaaaaga

SEQ ID NO: 68312 - DNA, 681 bp, Oryza sativa
atactaaatgtaagttgctgcctcaattcatcagatgatgagggatcctaacggacatgccagttcttccagttctgccaaatgtcctatcaccatctgtccaattaacgccgagggaatttggtctattcttctttcagttctgtaggatcgaatcataagaactaagccaaccagagggcggtgaatagttgatatacccaaaaaccgaaaacttttagcggaaataaaagttaccctcaaaatcaatgaaatcggtctgaccgcgcctattccgctggtctgaccggtgtagatcgctcgtcctgaacgtcccgaagtcgcctctgcctgtcgacaccgccgccggtctgaccgccctgatgcgccagtctgaccaccgataaatcgccgtttagaccgccgaaacccggtgaaacacaaatcgaagaaccctcaaagtagatgacaactttattgcttctctctatgtttacaaagtgcaccaacagcactccttacaaaaatctcgactaaactcgaaaccctaactaaactagcaactcaattgctctaaaaagcaataccgggaagcctcacgctccccctctatttatacatgaggtaagcagcctaaagccacgaaccaactcatactaagagtcctaaacaccttaggaaaccctctagtacaataaacaa

SEQ ID NO: 68313 - DNA, 2888 bp, Oryza sativa
cgggtgggccccacccgtcagcgagggtggcgggcgggcccgcccgtcagcggcgcgcgcgcgggaagaggccggatgggccgcggggagaggagagggagggggagggagatgggccgagccggcccaagagggagagggagggaaaggggactttttagagcttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacaatatgcaaaccaatttctgctgggatttgatagctgtatatggagcagcccaaaatgcacacaaggataggtttttgactgaactggctaacattattcagaaacaaatgaaacctttagtcatgggtggtgattttaatattattagaaaggaaagtgataaaaacaaagctggagggtataataggtggagtttcatttttaatgctgtcatagagcaagctaatttgagagaaatctttctaggtgggagaaagtttacttggtgtaacaatcaagagaatcccactttagaaaaattggacagaatttttgtgaacacagattgggaaaaggaatatcccctcacaatggcaaaaactttaactagaagcatttcagatcataatcctttgcgcatagatactggagtcttaaagattactcataagagcttcaaatttgaactcagttggtttcttagagaagatttaaaagaaattgtggagagtgtttggaaaattaattattatggatctagtattgagagatggcagaaaagatttagagctttgaggaaaaaacttaatggttggaataataattgggaggggagatataggagggaaaaagaaagcattcttgagaaaattgaaaatttggatgcgaaggttgaaagatgtgggatgagcaaggaagatagagaagaaaggaaggagttggaggataaactgaattttgtgattagagaagaaaagattaaatggtttcaaaggagtaaagaaaatgagttgttagagggagattgtaatacaaaatactaccatgccaaggccaatgggagaaaaaggaaaagctatattcattccttaactcaggaggaaggtgaaatagaagggcaagagaagttgttaacctatattactagcttttacaaagatttgtttggtcatcctaaacagaacacactttttctagatatgagaggggttacaacaataatggaagaacacaaggtgatgttgaccaaacctttcagtgaggaagaggtcagaatagttgttttcgagcttaagaaaaacaaagctccaggcccagacggttttattggtgagttttatactcagttttgggatctgatcaagggagatcttctaaaattggtgaatgactatcacaaagggttggttgacattgatagattaaattttggtgttattaccttgattccgaaaattaaggatgcagctcaaattcaaaaatataggcctatttgtctcctgaatgtcagttttaagattataaccaaagtgctcatgaataggattacagaaattatgacatatatcatctcaaaaaatcagacagcgtttctgaaaaatagattcataatggaaggtgtgctgatcctgcatgaaattcttaactccttacatcagaaaaaacaaagtggtgtcctttttaaggtggattttgaaaaagcatacgacaaagttgattgggtctttatttatagaatgttgaaagcaaaagagtttcctgatcaatggtgtgattgggtaatgaaagtgataatgggtggtaaggttgctgtccaagtaaatgatcaagtggggccttattttaagacacataaaggtttgaggcagggagatcctctatcccctcttctattcaatttggcagcagaagcactaactttactagtgcaaagagctgaagataatctgttgatagaaggattgggggaaaatgataacaacaaagtggtcattttacaatacgctgatgatactatatttcttcttcctgataatgagacatatgcaaaaaatctgaaatacatcttatgtttgtttgagcaattatctggtctcaaaatcaacttcaataaaagtgaggtgttctgcattggtgaggttgctgataaggcagaggttttcagtcagatttttgcttgtagtgtgggtgttttgcctatgaagtatttggggatcccaatagatcagaagcgcattacaaaaaaagattggagaaatgctgaaaacaaaatggaaagcaagctgggatgctggcaagggaaacttcagtcaatagggggaagattaattttgatcaattctagtttaagcagtgttcccatgtatatgatctcctttttcaagttacccaaaggagtgaaagaaaaaatggacttcttcaggaggaggtttttgtggcaggaggaccaaggcatcagaaaatatcatttagtgcaatggcccattatttgttcacctagagatcaaggaggtttaggtgttctggacctggacattatgaataaggccttgttggggaaatggatttggaatttggaaaacaaagaaggttggtggcaggagattcttagggggaaatatttgaaaaataaaactatgtctgaggtaaactttaaacagggtaactctcatttctggcatgggttgatggaagtaaatgatgattttttttaaattttgttca

SEQ ID NO: 68314 - DNA, 683 bp, Oryza sativa
atatggtaacgccgcttcggtcggcgagcgtaattaacgcgcgcacgatacaatccatttcgattgccacaaccgcatatccactcaatgcgccgtaagcgggcgaatgggattagtggaagcgtgggcacgggaaacgagggagcgagatagcgagatacgagggagcgaggtagtgggcgcgagaaacgaggagtcaggcccagcgatggcaagggtataaaagcatcgagaaaaggatttgcttccttcctttcgccattgttcctcttgccttcgccacctgagctctaactctttctctgctacgccctactttcgccacacgcgctcgttctcaatcatctcttcctccgccgccatggcacggggctctgctctgctcgacggcagtgtactaccgccttcccgcatcgtgaatgagaggcacgccggactgccgcgccgcttcatgccggagtccgccaccggtcgggagatagtgatgctgggcgaggggcgcccggcaccagactacccggggcggtccatcttcttcctccccttcgcgatggctgggctggtcccgccatttcctcatttcttcatggatgtcctggagttctatgacctccagatggcgcacctcacccccaatgcggtgatgacattggccatcttcgcgcatctgtgcgagatgttca

SEQ ID NO: 68315 - DNA, 12739 bp, Oryza sativa
ccgggggttctccccggcaccaccccgttgaatccacatgtctcttgtcatcatggttcccccgattagctagttactcagccaggggtgtcccattctacccatgtggtcgcacttgccttatgttcggatgaaattccaaggaaacggtccttaagtgcaagagcgataaaccgtactcccggtacgtcccctggtctgcgattttggaaattcattttagttcgcaagcaccgacctaggtgtcgggttttccaagtcttttgtaaaaccccaagttttacccatcgttggatgttttaaatttgaggggaggtgctccgatgcgcgtgcctgtaggcccgtgcatcgaagcacaacagttgacaaaggtggtttaagtgttcaataattcaaggagggtaattgcagcaattaggattggggccggcaggctatctcgcaagcgcggccgaaatacttgtgttaaacttattcatgcaatatttgcggaaaagaagtacttagatttaaattataggtgcaagatgatcaaaggtgacttgccttgctcgagagcttgatccttgaaatcctcgcactgcgggtcttcgggctccgaaactacacgcgaaacgggacaactcaacaaatggcgaaaataaagccctattattgacctctaaacgtgccattaaatagatctcaagatttgagaaattttggaagttgaacggagtcaaacggacatacggttgagaagatattgaatttctaagattattggatttttggtctaaaggaaaaaggatttaattaaaccctttcgaaaaagaaaagaaagagggaggggaaacagacttccctcgggcggctagggcgcggcccgagagaaaggggcggctcggccgagcataatgggccggccggcctgagaaggcggcccaaggcacgcgcgggaggggaggagagagggagccggagggtcgggtccatctcgtgtggtcctgagtgggacctgcttgtcggcggctcggctcaccgtgaggaggagcacgtgacgcggcgctagggtttggagcggggcgcggtgcacgcgcgcggctcgcggtgggtgcggatgcggcgggcccacgcgcagcctcacggctcgcggtggaccgcgcgtgcgagcggggcagaggggagcggcggaccggggtcggcttgacccggtcttggccgagctggcgccgacgtggcacctatgtggctgccacacgggccggcggaaggttgaagaaggcgccggccggaacggacggcggacggcggctgcgaacggcggggcgaaccacggcgatacaggcgaaatcgagcacaccgggtggttgcacgagatgaggggagacgagccaacggctcggattcgccggagggagttcgacggcggcggattgcggcggcggcaaccggctgcgagaaaagaaggaaacggcaacgacgcgactagggttcaattcctccggactagagcatctacgcggccaccggtgtccgtttctaccgtcggattagacggagacactacgagagaggccggcgacgtgcgggcgctacgaagcacgggcggcgacggcggcgagcacacagcgagcggcggcagcagtcagggcggcgccagctagctacggggaggctttacaagcttctaccgaaagctaaggggaagaggaggaacgaggagggggaacggggaggaggcactaccgtgcggggtgaaggggcgcagtgacgatggccgacggcgcggggcgtgatcgctctggcctcgggccggggaagaggaaggagagggtgcgcccggagtccacgtcacgcgtcctcgctcgtgccggctcctccgacacgcgcgacgacgaacggcgacggcgaacagggcagggcgcggcaatggcgagggcgaaaatgggaaagattggtttggggaggggctcgggtttatagggcggcaatgtcggttcggaaaccgaccttgggcggcactagggggcgagggaacttcgaggggatgggataggcttcacgggcgcggtcaaacggcgtggaggacgggctggcgcggcgcggccgctcctctgccctggcgctagctccgagcggagggagagcagaggtcgggccgagagaggaaagcgggaaacggagggggagaaagaaggctcgcgctatgctggtttggggaggaagagggatgggagcgggaggcgctgcctccgatttttggacggatgcaggcggcgcggctcggggacgcgcgctggctcgcagggcagggcgcggcgcaggcggcgcagcgcggcagggcgcggggccagacggcgcaggcacgggcagcaagctgctgacgacggcgacgactgcgcgggcgagcgcgcgcgcgaggtaacggcacgcggggagcttgccggggatggagcgggcagagagagcgggagaacgagagagagagggagagctcggctcggcgtcggctcacgcgcatgcgcacatgcacgcggcgcacgggcaaagcgaggggagagctgggggagagagagagatgggccgaggaaatcggcccaccgaacctgagggaggcaaaatagacttttgcggaggaatttgatttgggaaggatttggattcgggatttgaatttgacgatagatcgggaattcgagattagggattggcacggagactgacaacaagaaaaaaaaacagatttcgcaattagggttcttagaatttaaatttttccgctaggcgccacgatggaacgggcgctacaagttaagagtccgtataaaaatacaatttacaaataactaaaatttgagattaagaaaaacatgggaagaagagtcaatataggaatacaatttagaagtaactgaaattcgaaattaaaaatgaaataatattgaaagatgagtttagagtccacgtagaaatacaattagaaataataaaaattcagaaataaaataaataatattgaaagaagagcctagagtctatatagaaatacaatttactgaaaattcggaatttaaaaaaagaaatattaaaagacgagtctagagtccatataggaatatatataatttacaaataactaaaatttaatattaaaaattattaataactaacacgtatataaaatacaatatgaatattacaagttattgcaaaatttaaaattatgttgttattttaatatatttgaataatatattgaaaaaacatatatgctattatatgagagaaaatataatgatgctagccgcacaatctgcgcgtgctaccatgctagttgaagagaaaattaagtgcaagccgcagttggtgcggaaaaaaagagcctcttattcgtctgcacaattacaggttgcaaattggattgctgctatgcacttgtattacagtattcactccactggtaaacacagcaaactctcatctctctccatgacgccgcaaagcatccgtgccaataggacgggtccctcgggcaaacgcaactggcaaacccgtagggccgcgagcagcgaactcgatcgatcacaccagctttagcgcggctcccgccgtttccggccaagtgccccgctcgccggatttccagaacgggaagcagcagcacgtacgccgcggatcaccccaatattactcaccggctcaccgcgagacgagcaaccacaagaagaaaaaatctgtactactagcgcgtagtagtgtagtgtagtgtagcggcgtggtcggccaagcacgtgcagggtggagaagtgcgtcttgttcttggagtgtggtaaaaaaatatcctttgcttctttttgtgtgtgttgagttttgttgggggagggaggtgttggatcgcggaggcatggctcatgcacgcgcatcagtcgagggggtagcatgtgtcatcgccgcccgtgttccagaggaagtgcgcgtaggctgccgcgtggtgcgagttgctgggttcggcggcgatggcctcctggtacgtctcctccgcggccgcgaggtcattgcgcgctttccacaggaaagtcgcgtaccgacccatcgcctccgcgtccgccggctccgcgcgcaccgcccgcttgaagtagtgctccgccctgcatccgcgcaaaaccaccacctcggtcagcgcccgtaaaaccccaagaggccccggcggccatttcgtcgaacggctggcgacgtggcgcgcagcaactcaccgatcgtggtcgcgctgcaccgtgtacaggaactgggcaaagttggacagcagcagcgagttgtctggctcctcggacacggctcgctcgtaccgctcctccgtcgccgcgaactccgccgtgtcctccgtgtccagcttggcctccaccggcgccacgagctgccccagtgtgtccgggtccatcagcgcctcggcgcgaacgctcgcctgcatcctggtagcctcatcggctatccttttccagatgaccagttcgtcctctgtctcctccacggccattgcttctgacacgggcacggcctcctccgcgccagctcccggcgtaccctgtgacgcatcctgcggcaacaccgcgccgctttgccgatttgaccactcgtccgagcgaccgtcgccggttgccccggcgaccggccgcaccttgccgccgccgccgctgttgccacccaccgaggccgttcggccgatggacaacgtcttgagcgaggcatggtcgaaccgctggtgggaatgagactgctccgcgtgctgggtgtcgaccatcgccacagtcgccgcggggggctggggaggcgggagcgtggcggcggccgcgacgctgtcgcccatggagtagacggtgaagttggcgagcagaagcatcacggagaccatgagggcgggggtgccggagaagatgtgctggaagagccacacgaaggaggcgtgcatctcggcgtggacgcgcgcgagcacgcgctgcaggtcctcgtagaagagcgcctgccgcatctgcagcgtgaagctctgcagctcccggatgatgagcaccatcgacgagaacgcgcgccccaccgcgccgcgcgcggactcgccggcgcagtcgatcagccgctcgtcccaccggccctgctgctgctgctgctgcttcttccgcttgagcatccgcagcgacagcggcaaccccacgctgctcgcgctccgctccacgctcgccggccacccgcagccagcggcgccagggtgcagccccaccgccagctcctgaatcctccgcaagaactcctcgtcgtccccgccgtcgctcccgatgctgtcaatgctagcgctgagagcgcgccttgccatctggtgcccgccggcgcgccggcgggtcataccgacgctccagctagccagcgacgactgccctctcgacagcctgacacctccaagaacgccatgccgccgcgacgtcgtcgcggcggcagacgacgaaggcgacagcgacgacgacgacgacgtcgtgacggcgcatggcgacgacgtcacggccgcgacctggatgcccatgggtcgcagcgaccaccctcccggccacccaccggagcgacggttgggaaatggcccacacagctccacaaccgtgggaggctggctaaatgcgagggggtggcaaaggaagaggaagaggaagagggggagggggaaacgagcggtggccttatttcaggatccgggaggcgtgtcctggtcaaccacccccacgcagctcgtgaaggatctagcactcctgctactgccgctaccggtgacaccagtttcacgaaacaaaatagaaacgatacggtacgcccctccttaatataggcttgagccaaaattaggcgctcacacactcgagatacgaatggcaagcagtatatactttggaggggggggggagagaaaaaaaaatcaagaacaaaaatatgagatggtgttcagtagcgagtgaagagggaagaagagtgatgggagaagacgaagagcgtgtagggaggccttgcctatttatttcgtgcgtgccacccggatgcattgcatgagtgtgcggccgaagaatccgtagaccgcctcactctcctgtacggctcccctctctcatcatcaacgtgtgtgctgggtatggccaccccgaatttctgtgacttttttcttattgtctcctacttattattcataagtgtgcaaaaaagccaaatatactttccagaaagacatctcagaattattttaggaaaaaacttgtttatttgggccattccttttatattagaaaattcaagaaacctttaaccgctatacattgccattgtacaataaaatttatttcccttcagaagaaaatgcaatacttacttttgacatttaggctttctacagtctttaatatacgactttaaccatagttttttattataataaatctataatagtctaataagtttatgaaattatgaatgtatcgtgctttagcattcaagttcgttttcaaaggaggatggcgtatcataatatctttggttttgtcaaattatagcttaggctttggtttaatagttatgcatgttgaaaatccggtatattctgtactttcaagtactatttttattttttggaaccaaagcatagaattccatttcaaggaaggatgatgcaccgtagtgcctctggttttctcaagccttgctttttggcctatgctttgatggttgtgcatgctaaaaggctagcacgtttcatatttttcaagaaaaatctgtacgtgctattttaaaaatatttttaaactaagcatttaaaaatttatttatggataactaaaagaactgctactgcatattgtatccaaaacatcaatatagccatttaagttgctgatcgtttgacacgaagtacataatcggctaaagcttgaccagagcagctagtacagtgtacagtatgtagtaaagaacgacatttcagctcatttcacgtggtttaacttgaaagaacaagaaaaaaaaaagagaccagaagcaactctcaaacgtgtccacctctgttcacgtgccaacagctgcggcggtggcgctgcaactgtgaagcctcgaggcttttgttgctccctccgcggctcccgtcccacacgtgtccgccattaagccgcggtgtcaatcggtcaccacactgcgctaggcaagtcatgcccgcccccatggtcgcccatggactcatctgtacagtgaagtcgcgcatgggcttcactccactctggcctcacgcttgcacatctcctccccaccggtgctgctctcgtgcaacacggtggtggtgctgatgcggctcactactcgacgcctgagctgacattttttggagatacctccagttagcgtctcttattccgtgtcctagtagttcaccggttgtagaaatgattgagttaaaattctacctctaccaatactgtctttctccttgcaaatcgcgacactgacgctgaactgatgatagcgcctagcaagcggacctcgtacgttcatcacggcaccaaccaccagcacggttcggaacgcacgcgcgtttcggcaattttttttcccgaaaggcacccatccgattcggacctttccgctcgctggcgagtggcgacacggcgcgcctagctagacgccgagacggtaacggaaaatatctcgggcctggggggtggggggtgtttacgagcggacggacggttgggagggcgtcgagaggggggccccgatgggcgccacgttcccatcgagccggtgttgggatcgacccggccaaacgggccggaggagatttcgatcgccccggtggaatcggttggtggtttgcccccgaattggacggtcgagacgggggcggcgttgtggcgagcggccgcgaggaccagtcctaggtcgcgcctgggccacccccgcggcccggccccgcctcgcctcggcgtcgcgcgagcgacagcggaaacgtgagccacggctagccgccaagcgagggtgtgcaagttgcatcgccatcactgtacgagtataacttggatttcctctccttgttgatgacggagacgcctggtggttgtttttcttctcccctcctcccaattatactcttcagttttttttttcatatttacagtggtatgtcgggaacatggtgcctattaatgacaccagaatgcatatattcatattactcttcttttttctggagagaggcagagacgaattaaggatcgaagtgctacttgtaatggaatgaaagggagagaaagaaacagaaagtagatgtgcacacccttgcagcaagttgattttgattgtttctgtacaagtaactttccttcctcagtgattttgattgtttcgctctcttcctcctgatgggccctggagcaacgatttgatgttggctcgattgcgttgttctgattcacgacagtatcagttggatggcccagattttgaactcgaaggtagatacgcatggttggattcatgcgtctttcaatctagatcagtgagtgcttccgattaaccaggtttaaaacgccgagcttaccatgtatctgttctgaactttcagcaagggtgtcttctcgtctagatgcgctgtcctactcttctaccaacatttttggtagtactgctcaagccctccaatcattttgggatggagtgaatctacttggggaaagtttacggacaaacagtagatatcaaagagagatccagcattttgtgtggttgcagagaaattccgtctcccttcctgatcgatcaacctatggccagtagaaggttttgttttgatccttgcctgcatgtcatgttcttttccgcggcctggtagatatgaacaatattttagatggaactatcatcagaatggccaattctcagttagatcaatgtacttagccttaattaataatggttacattgacagaaataagttaatttggaaactcaagatgccgcttaagatcaagatctttatgtggtatttgcttaagggagttatgttaaccaaggataatttagcaagacggaattggactggtaatttaagatgttgcttttgtacgaaaaatgagactatccaacatctgttcattgattgtcattttacaaagtttatttggagggcagttcagttttcttttggtttatatattcctattagcatatctcatatttttgatgattggcttcaaggagtcataaacaaaaagagcaaactgatacttgttggagcttctgccttgtgttgggcactgtggctgagtaggaatgatagggtttttgacaaatcacctactattacttatatgcaggtcattttcaaggcaacatattggcttcgtctgtgggcacagttacaaaagtgtgatgaagatgcagatttcttaattgttgcatgtcgtaaggttgaaacgatggttatgcaactgtttgccaatcatggatggagatttaccaataaactggaataatgttattttgtctagtttggttggtgtgtttgcttctatttgaacttcactcttacagagtgctagtttgtaataattggctgtaactctttcgaataaaggtcgggatgctatttcattccattatctaaaaagatatgaacgatatctccaacgaagcatatatatgcccacagaaccaaaattgggtgattggtgcaactcccgtagcctttgctagtttgaatactccccacttctcaatccactttctaccgcatgaacactgaaatgcagaaccagaaatgcttgattacctcaacttgatctgagcctgtcataaattagtatagttctacaagagtttgttacctgcaagaactacctcaacttgatctgaacttgtcataaattagtatagttctgcaagagttgttacctgcaagattttatttcttgcaaagagaaaaaaaaaacacacaaagaataagacgtatgatggcacttcaaaatgattgcttttgattagtagctgcgtattagccgcacactgacatagatcaggcgacctttaacagttggcgacatgagtaggctttgtcatcttcagattacatgtatccctcgcgatgtggacggcagtcgttccgtatttgtgctccttgctcagaattcttctttctggctatcatgacgttaaaagcgtgataggtgccgattgaaaatgacgattgaaatttgcaggaagtggcgattgaaaggaaggaagcgcaaaatgcattcatcaacaaaggtcaggacttgattccttcttttgttcaagattctaatgtggcccttatggatatggctagtattttaggagttaacttaggctgtgctattgataatattgattcaaacttgtctttgattaaagacttagaatgtgctagaattagtttatttttaaaagaacaagaggttatgaagaataagaattgtgaatctaaaactgagatagaattccctgtggaaaatttgcttgatgaattgtgctcttctgagggatatgactctgatttggagcacattgactctttacttaaaggctctcatttttctggtagtaagcataaaaacaaaagaggaaaccttgagattttcaaggtcactccaaagatgagtaggaaaaaatataataaaaaaaccaggaaaaaaatgaaaggacttttttggaatattagaggaatgggtcaggttgaaaaaactagtcatttacaagatttgattaaggaaaaaaacattgattttgttgggattatggagtccataaagcaggatttctctgctggtctattgagaggtctaagtggtaacaaaaatatgaaatgggagtggttgccggctatgggtcactcaagaggatttttggtaggaattaacattgacaaactgagtatgttggctgtttcaaaaggagattttcatgttaaaattgaattgcaagatatgtgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcatacacaaagacaaacgagaaacagtggaagactagggcgacgaccacaggcgcttgacggcaggcacgagctagacaccaaagccttcttcttccaggggctcctcttcttggtttgggaaaaaattgagcaagactgagtacaaccaccgtactcaacaagacacacccacaagtgcaggataaatgcaagggagtacaagggggttataatataaagggttagggtttgtagtaaacagcattaaaagacacttagttgctcaaagctattttgtaaacatgattccagagctatacaatattattaatcaaggccgtgaacccacacgaacatgccttaatccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagatgtgacatagtttccaacccatcctagccatagacaagagtaccgacccaaccccacctacggccggaacccccgggacaggtatgcaggactgcgcccctagcagcaggacaccggccctgtgccatgacatctcgactaccgggccgcagcttgtgtagccttcatttgtcctagagatgtccatcgacccccgacttcgtccatctccatccgtgtacttttgttataaccagactgagccacaaactaagccgcaccgtgggtcccacgcgtcagccgcacccgagggcgcgggcggctgacggccgggcgccacgcggcagccactcggcgcgcccgagggcggccaagccggcgcagccggcggaaggcggcgcccgcgccctatggtcgccggcggcgcccataggcacggcggagcgccggccgagagaggggaagggaagggggaaaaagaagcggcggtccacggctcaccttaggtcgacggcgacaacgaaaaaggtggccggacgaagaaaggcggcggcgcggctcaggtcgacggggtcgacggcgttccggcggccggcgagcgaaacggaggggtgaacgaggtcggcgaggatgcggcaaagccgaagaaggcggcgccgaggtggaaggtggtccggggcgacgacgccggcggaccggagctcgacggcgacggcggagagagagagcgatggcgtgagctcgattctggcgaggaggaaggccggcgagaggcggaaacggatggaggaggtgcggggagggtttaaatagggttggaaggggaagaggccgcccggaggggaaggaaaccggcgcggcgctctcgggctccatcaatggcgccggcaggattaggggagggtttccaaacaaatccaagggagagagggagggaaaattggggggaaaggcggagggaatcacgggtaataatttccccctatt

SEQ ID NO: 68316 - DNA, 32568 bp, Oryza sativa
  unsure (1)..(32568): unsure at all n locations
cacctctagcaagcttttctaaagattgggacattggggtgtttgaatgaacaaaatttgttcttcatatatatagcactaattatggtacttaagtgattaatcagttttgacttttcttgattatattttattattttctgttccttccttgaacagtttactcttgtcaactaaagaaagataaacgaaaacagttaatgactaacgccccattagttgccctactaagtcaaaacaaaagttaatttgaattttcaaaatcaattttgaagttgatttgaaaatattttcaacatagtttttttttcagtattagcttttaacccgctaaaaacacatctataaaagtattgtctaagaattaaattttattatataataaatcgttttaacttattaaggaatatggaatcgatgaggacctaggaaatggaactggagacagggattgaacactaatcaatcctatccatctgcttgacctgtcattttgtttgtgtttcaaagctcactttttaaattatcttcttccttttctccatgcacagctatcactttgatgatgaccacagagggtagcattgccaccttttgtcacctctcaatttcttaatccatggaaaggtggcctagtccatcatgcagtttgctttcagcaatactctacctctggtaactcccttagctggccaagagattaggattaattaatttcgtaatgtggtgaatggttttttctaatcaatcatggccccatattttacaacaaacatggtgcacgtgttaggcgatggtttaacaggtgttgatctcaacaataaaggagaacattgggaccaaaggaaactaggaatcactggcttttcttctgttttaggactatagttcaaaagccgtctggcccatatcttgctcttttgtatctaattttgtaaatgtaggtgtttcattgtcattggttggacaagtcctttttttccttttgattgagtaagatgtttagtcatgactgacagcgtgacataaattaaatattttaaaatataacttgacaaatagtttaaaataagtggtctaacaaagcaatgcagaagaagaattttttttaaggaaatgaaagtttggaagcgtggaccaaataatccacagcaatagcccaataaaaataagttgaaatcaacgagaacactatttccagattacttgtgaagtcctctgatgttatttacgattagggatattcaacttaagtttctttctcatcatctaaatgaacatatgcttctttcaaactgcataaaccattcagcattcagctttctagatggcagagtgacatccatcattgtgtcaaatttattatttcttccatctcaagaaaatattgttgcctttaacatttaaaatttaccctaaaatatgtaaatagctacttcgcatattctctcatctcaactaactacaaccatcaaaataaaaaactaattacaaccatattatatttttttgtctattagtttttttcagctaatcataatattcacctttctatcaaaaaataaaaatagaacataaactttccatttaaatttatcgccctctccttaatcccttaaaagtttaaagatagctacattctacaaatataagctttacaagtatttaaaatttgttcacaaatataatgattcaatgagtaccacttacccctcgatctcacttctcatttaagttttttcatcttgttttcaactactatatctcattaaatgaggaatataaaagtattttctgatcaactttaatctttgttagagaatatagaaactttaaatttaagaatggagatagtaataaaactatacggcttcataattgtcaacattaatcgtccacctatatatggaggttatgccggtgttcaaagtcgcacgaagcatgactacgtggctagtcctagtgttgacagaaatttcatacaagtactacttttaataattaatcatgcatagtcacacgtacggtgtgctaagtgctttttatgagaaaatactccaaatactccctccgtcctataatataagagcaggtataatagcaggctattaaccagttataaacatattttaatgagatagacgatgagagagaagagcagcgggctacagatttatagctagctgcaacacggactccaagacaaaatgtatgtatgacaggtggaactgtatattaatagtatagtaaacaactattgtatgaattgactatagatgaattggagatagtagtgagctatactattgaacttgctctaagggattttgagtttttttttgcttatactgtttgaccacttgtcttattcaaaaaatttgtgtaaatataaaaaacgaaaatttgtgcttaacgtactttggataataaagcaagtcaaaaaaataaataataattctaaaaaatttttaaataagatgagtgatcaaagagtgaaaaaaaacttaaaatcccttatattatgggatggagggagtaagtatataggagccacatgaagatcttttgagaggacacgtaccttgtgggatatcttggcaggagagatggaagaagcacaagtgtccttcatgctgacccctactccatagagggtagccaagagcttggctgagtcactgcctcagcgggaggaggggttgggaaccgcaaaacaaaacacctattattattatatgattaattaagtatttactaatttttttaaaaaaatagattaatatgatttttttaagcaactttcatatataattttttttataaaaaatgtattgtttagcagtttgaaaagcgtgcgcgcgaaaaacggggagggaggttgggaaagggaggtaacgagcttaccatacccaagccaatcacacggtcacaccgtccccaacacagcctcgtcctggaattttttttcgagtaaagtccatcaccggtctctaaacttgtaccgttgtgtcatttcggtccctaaactcgcaaatcgaccgttcaggtcctcaaacttgttcgactgtgtcatcccgatccctaaactttcatatcactcatttaggtcctccaacttgttcagttgtgttaccccggtatctaaacttggatttgaatatcatctgggtcaaataggacggtctaaagactttatatttaaaataattcataactttttcatgtgaactttaataaagacaaactttatatcaaacttgtagccctcaacgcgatctataactttgtagttgatttttttattttaagtcattttttgtctgaaaatgtaattttaaaattaaaatttccaaatctataaacatgcaacaatattttgggaccctaaacagtttaaattcaaaaacttttcaactacaaagttgtaggtcgtgtcaagggctacaattttgatataaaatttgtctccattagagttcacatgaaaaaattatgaattattttttatataaagtttttagaccatcctgtttagagaccagggtgacacaactggacaagttggaggacttaaacgagtgatttgcaagtttaagaaccgggatgatacagtcgaacaagtttggggacctgaacggtcgatttgaaagtttatggaccgagatgacacagcggtacaaaatttaaggaccggtggaccggtgatggactttactctttttttttatgggccctgttcaatccatcgtcagaaaatattggtgaaattaaaacttgacaataccaaaatttcgacgaattcaagatgtgagagtgatgttcagtttgataccttaccaatttttttattgttttgtgaaaaagaagttcaaataccaaatgttggtaggaattgacaatattgtaatggtgaggtcttgtttagtttgttaccttactgagatgtggtaatgctaagtttggtaaggttaattttggtaataaactaacaagctttatattttagttttaagaatgaattcctttctcagcacctagagtcggtgccagcgtcattaatgttgagccgttggaccttaacgttagattcactgacgctaagtaaaagatagtacatttctacaattataaaatatataaggtttctaaaagaacggaaatggaaaaatgcggcatctctggtcggccaagtatcctctgccataaagatattgcttaatagtcagaggtggatctaagcctagggcaccttaaccgtggcccaaagcctaagattaccatgtaatcaccatacaaaacccaacttctctatgagttggtacaagtctttggatcaagtctttggatcaattctgaatccgtccttgttacttatatgcaggttctatttttctattggttcatatgtctataataacactatcattacatacaatgatactatcttatatacaattttttttagataacacattggctccggtcctggacacaaatacaaaagtatcaagacagcaagcttttaaagtttgcatgtcgtaatcttaaaacaactgtcatgcaactttttgtcaacttccgatgaagatcacaaataggatctaataattatgtactctttatcttgtgttggtggttattagtttgtgtttacttcatgatctggactatttttataagttttctttgaattgtgcgcgctttaagtgaattggtataataatcggctataactcgttaagcaaagaccgatatgatactctatttcattattaaaaaagatgtgaatcccacttagccaggggcagccaggattataccgaaagtagaacttaatcactagattataaactctttaaacaaattttaataagaaaattagtaaattccttgtatttttttctgctccgctagcctagacacgcgcgccgccgcggacacacgtacgcgtcggccacacgcgcgcggcggatatttgttgggtttgaataatggccaatcatgacttgccctgcatgcatgccatacacatacaggtacagcgnnnncgcacgcggatggatgatggatatatgcaggcaggcgcgcggcgcggctggtggatcatcgatcaggttccatgcatccgaagagagatcgatcagctttgcccctacgccgcgtcgcgggggtcctgcaaaaattaacaacgaggagacggccgctggctacctcatgctcatgggacgtgctcgtctctcggctgatgcgattagccgagttcgttagtacagggtacagatttccaaccgggtacgcgtggaaaacggaacggtctattagcacgtgattaattaagtattagctaatttttttaaaaaaaatggattgatttgattttttaagcaactttcgtatagaaacttttttgcaaaaaaacacactgtttagcagtttaaaaagcatacgcgcggaaaacgagggagatgggttaggaaaaggaggttgttcccaaccgaaacagtacgtacggaaaacaaaacggtccattactacgtgattaattaagtattagctattttttaaaaaagatagattaatttgattttttaagtaactttcgtacagaaacattttataaaaacgcaaagcgcgtgtataaaagatgaggggagagggggttggcttgtgcactgtgcagaacccacccataatctccgtttcttatcccgtgtataactaactacagggtactttgtcccaagagaatgtcaggtacacggagagacgtaccaaaaaaaacacccgaaaagaagaaaacatccgacctgccgggattcgaaccagcgacctaaggattatctgcaacgtactacagttatagtctaatcaattataactgtgaagatctgtttttttccaagaggttttgaggtttcaaatgagccaaatcttgggtgcaatctttgtgcgacatgtaataagcacagtccggatacacatgtacatacaaccacttgtttgacaaaagaaaaaaaaaatttgtaaatagaacagcccgtttcgacataagcgaacatgtacatacaagtagccttgttttcagaaaaccaaatgagctgaaagtttttatacataaatacaagaggtcaaccagacatatatgagccttgttttcagaagagaacgaatgagctgagcctttcagatgcacaacacgcctgactagatcgacgcatctaccaatatgtatccaattcttgtttcctgtcgatgtagaacagatagcaagtttagcaacaggcatattttttgcaacatggaagttccaaacgggtccttcgattcagaattgtgtactccagtatggcgtgtgtagacagttaatttactccatcttcagcttaagaacaagcttgttcggatgttcagcaatccggttccgcagatcttccttgagcctgtcatcactggaaccatgctcgtccttgtccagccgcactgacagcgactccaggtagcggtgacacgagacggcagaacacagctcctggatgtttttccagttgatgcctgaaaccccaagcttgcgcagctgcgtgagattcttgagctctttcaggaaggccttgccacctgcgacgccgacattgacgacgcccagcgtgtgcaatgccgtcagctcctcgatccccctgggcacctcaataccagagcaaggatcaccagcatgcctgcctctgcacagatcaggcagccaggatagcaaagcatgtgttgacctgcattttggttgtgtctctgtctcagcagctgctaggcttgcagatgtgccttcttcacccaatgtgactttggtgccaccacgaatgtactgcagcttatgcagcttgacgatgactgttggcaatctgacaatagaggtgtgcctgatatccagggtctgcagctgcctcaggccacccaaggagtctggcaagcggctgaccattttgcatcctcgtaaggaaaggaacttcagacgaggcaggcttacgacacgctcgaggtcgtcatttgttacatctgatgcattctccagatccagcactcgaagaagcttcatattgtcagagatgaagaatgattcccatttcccaaacactgtcagagaccgtagccgggagaagtcgatgctcatgaacacgatcttgtccctctcccaggtgctccctatgacaaggtgccgtcccgtgcgttggctggtcaggctgcagcgcccctgcagtgagaagatgtggttgtcgtccatttgctgcgacatgatgtactcatggaagaaactgttcacctcgcaccagactattctgttgccgctccgtgaggtctgctgcataatgctcaggccaaccagctttgcgaataacgtctagccattctcctctgcgctattgttggcagtgtccctggagtagccctcggcgatccaccgtcttatcaaacgcctccgccgaatgcttctgtctcgaggaaaaattgacaggtagaagatacatggcttgagggaatccggggaattgtgaaagtaggattgcatccaagcaaatagaccccgcaaactttcaaatcctgggttagtctgtaactcgtgcataaacttcttattgaatctcctccatagcacggcatgtttactccgggtggccataaagcgacctatagcaactattactttaggaagtccaccacacttctttatgatgagctttgcttcatcaatcatctcgggagtcagatcaatgttctgtttgtaaagcaggcggtcctggccatgcttctttagtaaaggagatatttcttcagtcatcccgggagtattcgccttacctaacataagccttaactctgtatcactcatgcaatgtgcagatccgtacacctattttcaaatatttcaagaattacatgtcattttttcagaattatcatcaatttgcacgtgttaagatgtgattattaatatccgttacaattggatttagatgttgcaaacaaaattgattatttgctgctaaatcacaatataccaggataccactcaaataagcaagaaggggaagagtaaatttcaaaaaagtgatactttgaccaaattgttgcaaaactacaaatttaaggtgatgtatcacaaaactatagatttaacaataagttcatcacaaaaactatatgtctaaggctaagtaccacaaaactacagatttaataataaaattatcacaaaacaaaaaattttagggtttaaatccttagcactaatgttatgttggagttataaaatgtccaagttttgttattaaattaaccctaaacttgtagttttgtgaaaactttgttactaaattggtagttttgcgatacttcaccttaaatctgtagttttgtgataaattttgtgttaaaatctatagatttttgaaacatcatctgtagttttgcgatagtttggtcaatatgtctatagttttgtgaaatttgctcaaaagagaaatatgacactgactaactacctagcatgtcttgtttgatccacaatgtaccactcttccattgcttccttcaaattaatgttttttaacatggataggacaaatactccctctgattcatattataagtcattttgaagtttgacttggaaaaatatcaaagcaacttacaatatgaatcataggaagtatttgttctatccatgttacaaaaaattaatttatagaaaaatatatcaacatttttaacacaaaacaaatatattatcaaaatatattaaatgttagttctaatgaaactaatttggtgtggtagatgttgcccaatttttctataaaccttatcaaacttaaagaagtttaactaggaaaaaaagtcaaaacgatttataatatgaaacggagagagtgctatactagataatgtttccaatattaagcgatagaaatagctatgtcgccaaataatccattattatctgagggcctcgaaattaccacattattcaagaaaatctatgtcgttcgtcgacatgatgcatccaaattataggggtgcaaagcgattgatatagttttatacataatacaattgctcaaaatgattcaaagcttgggattcccatttttggctagcattcttaaatttaggaactactttcaattggggtcttctcagttcaaggatgattctcagattatatttttggaagatatttacctaggaaatagcctgctaaaaacacagttgccaacattgcttaacatattactccctctatcccaaaatttaaggcacgaccgcttttctcccatgtctcataatataaggcatgcatgcatgcatgcattaactatcatctctaaattggtttattttaaatcctctatcatcaatcctccaattatattgcttgcatgtatggaggtgatacaatcaatgagctaattaaattatttcttggtctttgtgttaggagtagttgagccttaggtctcctttaatggttgagctagtgcactagctcatgcttgtccaccttatacaagagatagcaaaaagtctacctttccaataggttgtctcatagcacattgttcaaaatgctttgggttacacaatccctctcacattttctttaggagcttagctcttgaagaagagatagtgcattctctctccttatcttctttctcttccacatcatacaaaagctgatgtggagatttatgagctagctgacttatccttgttggaggaggccttatattttgggatggagggagtagaaagaagcatgcaacagagggcaagttcatgcgttcaatcctgcttaatgtctcctttcgtagagctctaacaaggaataactttattgcttggaacaacttggtggcctgccttatgaatgtttgattgtcacaaaagagagatccatttaaacagaaccttcatcagaatggtcaattttgcattctctgtatgatgttcttcctagcactagtatcccaggcacaaacagactgctgtggaagttaaaagttccactcaagatcaaagttttacgtagtatttacatcatgatgatgtgttgacaaaagataagcttgcaaaaagaaagtggggaggaactaaaagttcatgacaaggagactgtaaagttttttttttatggtcaccatgctcactttgtttggcatgtggtacaaccatacaagtgcattttgattaataataggctatgtcatcattgagttaatttagcttgttatagcacttttatcattctcacagttggtactcttgtacacatatggaactagctaagtagcaagattgcagaaacaagggcaagataacgcacctcttttatgaacagataaagggccgcatcggcttttagaccattgacgttaaacacgaaattgtcttctactgcacaatgtctagcgacactttcttcatttgtaatgacaatgataaaactttctgaatttccagatagtaaggtagattttatcaagtcccattcttctgtggactgcaggccatcaataacaatgaggaatttgtgcttgtgtagaagcttatgacactcctgaattgggtctttggtcctgaacatatcaatgtccttttcccctaaccataagaaacatctgccgttttgatgcaaatccaagagtaaactgcaagccaagtcccttaaattgaatggatgggatacattgacccaaccatacatctcaaattgatcatgtgagttgtagatagttcttacaaaagttgatttcccaacaccagcaatcccccacacagagatcactccaaacctgaattcacctctacttcgaaaaattgcctcagttattaaaaacaacagctgtttattacactcccgaaggcgtgtaaacatgtcatccaagacaaggcctgtttttgcatagaaagaggaaatatcatcctgtcttagtccatccttcattaataaccaatcaattaatatatcattattacagccgaaagtcttttcatctttacttctgctgtcacgataagatccctgcaaataagaaacagttagggggaggggggagcaggatgcaccacacatgaagtagtagatgccagagggtaatcacctgaaaggaggccaaacaaaacaagacggcatgcaaatgattttggcattacttaattcttcaaaagaaacttactaaaaggatttttaccaagaatatgagggtcaaagaaataagtttctagatcttcacagaatgtgaatactaaaaattaatgtttctaggttttcacaacatttatgtttttccaaaaataaatgcctcagttgtgagactcgctgaaactaatactaagcttgttggtattcgtttggaactttaatataacctcctaaactcctggaaatctacaggttgttgatacacatttcaaactaactagtattttacctgaaactttggaggcatttgaaaggcaaatctatctattatatactaaaagttcaacaaaattcatacaaacgctcctagaccgccatgtggcacttgtcgatgaaatgggaactagggtagccctttccctgggaccctagggtcattttcacattagtaccaataaaatgataggcttaaaactatcattagttttaagggacccgggtcctggcctaacccggacctgggggccacttcttatatgccaccctagggccattttcacattagcaccaataaaatgataggcttaaaactataattagttttaagggacccgggtcctggcctaacccagacctggggcgacttcttatatgccgcgtagcctcctttagggcatgaaagcgtataagacacacgtcttaagatggtaggccaaaggccagcctgggtcgtggccttgttctggggctcggccccgcctttgccctcgtaggtcacacgttcctcagtaagaggagcatcgagacatacaagatatgcatcttagaatacaagcggaggcaagcctgggtaccggccctgtcccaggacctaggcctgcctttgctcctgtaagtcacacgttcttcggtaaagaagagcgtggagacaggtcaaggtcttcctcggtcccgaccctgcctcgggacccgagttcacccttgtccttataggaaacatattcctcggtaagaggagtgtggagacctacacaatgtatctcttaggatgacaagctgaggtctgcctcagccccggccctgtctcgggacccatgtctgcctttgctcttgcaagtcacacattctttggtaagaagagtgttgagacctacaaaacatatcttaagattataggccagggtttgcctcggccccggccctgttctgggacccaggcttacccttgcccttgtaagtcacacattcctcaataagaggagtgtggagacctacaagatgtatatctctagatgataggctaaggattttctcggtcccgactctgttccgggacccgggcctgcctttgcccttgtaggtcacacttttttcgataagaagagcattgatgcctacaaaacataccttaaaattacaagccaaggactgcctccgtcccggccctacctaggacccgggttcccccttgcccttgtaaatcatacgttcttcgacaagaagagcgtcgagacgtacaagatatatatctaacccaacttctcttcatcaaagacacctttgaggaactacctctcaaaagggcgcaggggcatgaccgttaggcgtcgagcatcacgatctgacccctccgccagttgcaagccagtatgcatggctttagatgaagcataaccattaaggaagttgtcggttgcacaaagtcaaggtgaaaagacgggggtgctgagtcagacgcgttcacgcgtggcaggacgcgcgtcgtgctcgcccaacgccacccgacctcgctagttgtgcaaaaagggggtaccgtggcgctacctcagccaggtttgggggggtcccgggtccaccacaggacacatggtgggcagggtgatccccaactggctcaagccggtgcccgaagagcccgagacagcataaataaagtaagattctgaagctgaccaactggcaacgacaagacaacaacaagatgggtagttaagaaatgttgaaaatggcattgtgagccccttccttgagctataaaaggaaggggacacgccatggagaggggagggaattttttttaaaacttagaatctgatagcttgtacctgtctcaactcacacaaagaaccaaaacacatgagtaggtttttacacctccagatggcctgaacctgtataaacacttgtgtcaatttcttacttgatgatcgaccgggagagcccgggtcccttcgtgttccacacgacacatcgctctcgtcatgtgcaaggacaatcttccttgggtcaaaccgtctttttcacatcactgggaagggggtctctcttttcccagctaccggtggagtgatccccgacaacactgctataaacgctcctaggtcgtcatgtggcgctataataaatcgtagaaattctaagaaaaaaacatctaaccgtcaattttcatttaatctggtaggaccattatttttaactattagatctatcttaaaaattaccaattaaatttctctcaaaaaaaccacatcgctacgcgtacggtacataggtatgtacgtacgtatccccaaacccatatcccccaatcctcaagaaaagtacgtacatacttccttttcttttttctttctcgcttagattagttgaaaaatcaaactaataattcaagcctactttaactatgcttgaagtagtaaaaatatatgttatttcaagttgtattcttgctaggcgcatctcatcaaaacatccatgaaaaatataaataaataaaagttgtagattatataattgtatacacttaagaacaagtatagttaaattagacttgtattttcaaaaataaaaacaactccaattatgagtggcattctcaaaatttactcgctgcctactataaaaaatactaacatgtcaaaatgacattactaaatttatcatgaacgtattttgatgtactatgtattttctctattcatatattgttaaataaaataacaatcaaatatattcttttacaccgtgtcgatgccctttatctcctgcttaggcttcattcgatctagctcattggctgcgcttatctagggcacgcaaaacgacacgtcatcaatgaaagattaattaagtattaaatattacaaacttgaaaaatgggtttatttgatttgtttaaaaaaaaagcttttgatagaaaatatatgcaaaacatgcaccgtttagttgttcgaaaaacatgctcaccataaatggagtagccaatcggataagcactttagaactcacctttatgtactaaaatgcttaatatgtagtatataatatactttgtcaattaggaatagccaaatatatcaatcatatgttcctactaatcccatgtatataagttctatatacaagccactattcaccaatcatcaaatcatattgcttacaaggcattcatgagcggtgcacctaataattagttgatatccaatgtgcacatgtgtcatcaattaccgaagataaaggacaatactaagtgggcaacaatcaacagatgataggcaagtagagatactaccaagccacaacaaacaatagttaactacaagtatattgcgactatgagtaataacgttcctacacacctatatacactactaagatgccacgtgacgctctaataaattagaaaaaatctaacaaaagttacaagaaaaaagaaaaacaagtagacatcagtttatacttaaatcagtggatccattatttccaatcattaggttaaatctattaaaataatccattgcgactatgagtagtagtgttactacactctacaaatactcctaatatgccatgtgacgctctaataaattagagaaaatctaagaaaaattataagaaacactcatacataggacaaatactcctaagatgccacgtcacactaataaattagagaaaaaaatatattaaaaaacagaatttctagccattgatttgcacttaaaccaatggatccattattgtcagccattagattatattgatccaaataatccctcactcttaaaaatgggctaatccttccctatgtatgtacgtacacaagagatgtcaagaaaaagaaaaagaagaagagtgtgtctacaatcaaccccgtcaagtagttttccatttctttctttgaagctctaaggatttcctcaaattatatatatatgtagcgaccactcctgacgaggttgtcgaagaagccacgccgccgaagcgctgcttctcaccatcccgtcaattctcttgaaagtatttttttctagtaatgatgtaaaaggaaattgcagacacatgcagacacttactagtaaaattttcgagcttacctccttgaaaaacatgcagacacagtgataatatgagaatcgcctgatctgtgatacttggaacggatgtcctgtgcacaagcttgcaatttcgaccttctgtgtggacaccacaactcggcttccatttcgcatgtttggtagattcgatctgatggattcccattctgaaacggtgttcaggtcttctaacacaatgaggtacctctttttatatacttccgtcctgaacttagtgaaaagcttgacttctgctccttgtcgctgttgtccagagtttgtgtagaactgactccgcaaagcctggaagaactcacttagatcaaatggatgcattatctttatccaggcaagacattcaaagtttctttttatttctgggtcatcatacacattcctgatgatggatgattccccatgatcgccttctgtttcccagatggagatgacctgaaggtcaccatcattgttggtgagcaattcagcaagatcccctgaaccactcagctcctttgcgatgtctctcacctcaacgagggcatcagatgctgatgagccacctgcagctggcccgacaggtttggagccggagtcagagatgaggttgtagcgcatgttcctctggctcacatcctccactctggccttgatctgctttatgtcagccaccgcctcatccaggggaagaaccggcgcaaggcaggacggcagcaccggcgccatgaacgaggggaacaaccggtgccaccaagcagacttcttgtcaaggtggattacaaactcgatgcagtcctcgacgtcttaggcaaggttacgcacctgcgttacccaggtcctcaccacattgttgttcgcttgccccctcccgacgacgttgaggaaggactgcatcatctggaactcatccgtgatgaacaccaggtcatgctgcaccctctccttgagctggttctcctccaagatcgccgactgcaccttgatcaccgtcccctccaccaccgacttggtgagcccaagcacaatgtccgccattgtttcctcagcctctactctctgatgtgtctgagtttgtggtgagctagaagcaaatgatgccgctaaattgctagatcggaatcatgggtaggagctgcatctggggtcggtattaaaaaggacagatcagccattgaacaataaatttggacattattactgtattaaactagactatccaggtcaatgaaacaagctggactaagtcctaaaaaaaattagtagatttaatctagcgaaagagcccttacgttaacaaatgtggaacagctgatgccttgaatgattggatcagtgagccttccccaacccaatatcttactcaactggagacgtattgattggtactacacgctgtaacatggggattggttgacaaaaaataaataaaattagtcaaattatcacaaacaaatcacaccgtttgataaacaaagtgggagtacattagtacaagcattcctactaattcctcagtctttcagttgtttactatgaattggtttgctaatcagtctatgtctatcatccaagatcccaaatgcgaacgcccaacgcctaactctatcgcaatccaagttgccttgcatacctcgcggctcccgggcgtgggcgctccggttcgcccacgacatcctctcagcctccgacggtggccgccacaccagccatcctcctccgcgacggcgagatccggcggtgagccgccgccgccgcctgtgtcgcctcccatccatgcctaccaaacccaccagtttgctccatttcgacgcgtggaaggccctgtgggctgcaaaagtccattcggatgggccgggccgagaccagtacgagtgagttgggccggcccaatatgcgcaattttatacccgtaactccgtttttcttcaatattgacaacttatgccctctttgtttaggcttaatattattggcttagacttttaagtcagcttattagcttatatgatttataagccggtggatttaatgtcctaagtttaatgatggagtcatgcatctacctcatataagccaaaaaagcttcaccaacctagcttttggcttaatagtgttagaatggcttatggcttcaaaaaagccaaacgaaaaagccgcttgtttgtttagacttagacttttccgtttataagttggcttataagcctaaacaaagagggcctagaactttaattgacaactttaaactacttcctcggttcctaattatttgtctcataatggttaaccaagaaaaaaaaagagacttgtcgaggataatggagtaatactctctccattcatgtgataagtcattttgacttttttttactcagacttcttaaaagtgatcaagattacaaaaaatataacaatatttatgtcactaaatttattttattaaatctaaaatagaatatattttgatagtttctttgttttatgttaaagatatttctctattttactataaacttaacaaagctaaagaaagtttgacttaaaacaaaaatcgaaacgacttataatatgaaacgaaggtagcagtatatagagatcaatagtatatatggttacaaattatatcccttttgattatttgaaacaaaacatacatgggcttgaataacctgaatacaatcctatctagaaaagtgagggttttatccaaaccggggagggccaattcaaccatggaggcgaattctcggtacacgcaaagctctgtaagctcttacttgtcatgtcccaaatacctatctctcgccaactattcttatacatgtagacatactcagatgagtcatcggtaatgtaggcacaatttggctttaacataggataatccttggttgaaatgcacattgtgctattgtatccaaggaataatgcatgatcatccaagctcttcatcttcacaagttttttccgatcaaaatcgactctgaacacttcaatgtcagttgtcttgagctctagatatggatacatgtcatcattgataccaacgataggatctaggtcatcatcgtcatcgtccacctcaagattatttggatgctccgatgaagatgttgccatcaggtcaacatagctcctccatctccgtacttgaaggatgtcaccccatggcgcccgtaggaggtacatggccgaagggtaccaccgttgtggaactttgcctgtgatctgtctcacgataggagaatctccattgagatctaaggtgtagatggatccatcgaagcatagcgcgtagaaaaagccatcatcatcgttgtgaaagaagtcttcaaagccaccgaagcaagggtgtttgtccagcgagacccacgtccatcgctcatcaccaggccgggcgaacgagagctcgccgcactccatatgggcgagcagcgcgacacaagcgcccccaccggtggacgggctacaggaaaggaccacccgatggtacatgcattcccgtgcctcattcgccgtgagtaggagtggctctgggtcgagcccaggtgtcgaactcacgaagacgttgtacatcatggcaccgttgttgcctgcaccggtgaagctcttctccacatggtgaattccggtgataggagggagacaggcttgggcgccggtaatgggattgatgaggcggaggttggagacctcgtcggcggtgacgatccaaccgtgccccgcaccgaccacggagtgttcggtgaccacgccgagtgggaaagggactcggatggactcgccagtcaaggggcaatggacgacggcgttgttcggggagtaggcctcacaggcgtagaacagacacgggagctgcttcgccgatgatgggagagggaagcgggcgcggcggacggcggtagacgcggcgcaccatgaggcacatacagcgctggagcggatcaggtctgggatgtccaaccgctccataattattagaaggacgtcctccagcaactccgcccagtcggatgactccattatcctctcctcctcggtgtcggcggtacaaaaatttgggcgtaacacagtggccagcaacaaatacatagtgcgggtgtaccccgaatccgatccacctaacgtcgtccgaatccaaaaccgtcgcggccacgtcaccgagttatcttgggccgcctgatagcctggtggtgaggtggacggctgagatcgcttaaggagcacttcgttttctcctcatcgatctctccagcctctccgccgcgcgccgccgccaccgccaccgccgccgccgccgacgacgagtccctcttcccttcctctcctgtctcctcgccagccttcctactggccacacggcctcgacggtctcctctaaggatggagggagaggatgaagagaggcagcattctgcggggattcgcggctgcgcaggtgtggcagcagcgggcgggcttgagcgagacgagggaaagcggggaggtggggggggggcaccgtcggatgggaagatcgagaagctgagcgcggaggagcgagtcgccgcagtccttcaccacctggtcggcgccgtcgatggacaggtggacattcactgcttcccgatggggtacctaccaacccgtctcgaggtcggcatcccggcggcccggtcacccctcagcacgccggcagactgagcggttgagatatattcacagtacatctctatattccctttgtttgtttgtttgtttttgttttgttttggagagagctattcgctttctttgttgttgtatcatcaaattggtcaccgttgctactgcatatcatcacgagaaatgaatcaatgatgtatgcagaagctagtagcttcaatggtagttgcatcagaaaacagaaagcatactgtggttcctcatgaggatttaggcacgtcaaattaataagtctaacttatttatggaatccccttatttatactatgtagtatcaggcttgtgcgttttggaaattaatcactgcaagaagttttaaagtgttttccgttttccattacagctatcatttggagctccctgctttattagatggccagcatgctcatgttgggttcccccctggacaacagctgcaatagttatcaatggtaaacaatatatacttcctgtgatttattgcttgaagtccctacagatggaatgtcatttgtagcaagaaaactatatgaatatgagaggatgatatcaagtcccttaggtgccttatatgagatctcaaagaatttgatggatattagatttttttaatggaaagggtattagatttaagggtggagatttgtctcttgaaactgcaaaacttatgatcctatttgatgaaagtggaactccgtgcaatagttattgctattagaggaatgatgattgtttcattgttgaggagttaatgttgtcggcaattttgtcagctgcagaagttatatccagcgcattcccaaattggtgcattactcggtaggcaccccgagcctaatttatgtaggtctcgagagtttgaggcgtttgtgccaaaaatggctttgaattggatagttcatcatctggtcaacttcacctttcactttccagaatgaaggagaagttaaaagatgatcctgttttgtttaatattatcatgttttatgcttcaaagcaaaagcggccagcataatttttttttgcacagcagacatgataagcaggagggatgattggactcactagtcaccatgcattatctgtccctctatgtacacatttcacatcaccactttgaatatatcctgatataattgttcacagaacactgaaatgcagtaattgaggctgaaagatgtatctgaaacaaaggagatctctcttaggccaaaacgaattcaacattgcaccttgtgagattatacgtggatgctttacatgcctccaatttagtaaggatgctgctgaatccaaagaaaggagcgaagcattgtctgctgcagctaagaagtttaagctcccttcctctgaaaatcttggagagattgctgaacattgcaacgaaagaaagtgcgccggccattgtgcagaagaagctggtcagaagctctacatgtggacacttataaagaggaaagaggtactatgctccatcatattttggcttctgcagctgattttatataagctttgatttgaaaggcttctagttctagttctacttttgcagctccttgttgccgatgctatagttctggggctcagaacaaagttcatgtacgtttatgtgcccaaactaacggtatatatttgcctaacctcatgggaagcactttcttttgttgctgatcgttttactttgccttgatacgattaatcttttctatgtagatggaacggaggatacattatgatgaagttgagagcctatctattgagtgcttggaagccactggaatgttggtgcttgaagcatgcaggaacaggcctcctcaaaggaggggaaatcaagtgaactggtgaagtatagagcttttgaggaagtcatcatggtgatgaacccatgaagttgctttggtggttatttggttaacccgtccgaattgatgttatctgaagaaaatgagaaatctggagcaacagaagctggttgtgacactgccaagtcagttttgctgggtgatgaagccgtgaatgctctagttgccctggctgtcctgcctccggtgatacaattactcgagcgaagttcctgtggctcttcatgcgactctgcggtggacactggagtttttacattctctttggtgaacaacagtaataaaaatgatagaagagtagcatttaaaagttccttcagagttcatcaagcaaatatcaacttatagtgttgtagatgttccattgacctcaatgtcaagtagtcttcttttttacttcaggccacttgaccaagtcccagattcagttttgacagaagaaagactctgtatcggtgatgtatttgtcagttgatccttcatcagcttgtccggagctacctgcagttttttttatagtggtgaactcttacacatgtttgtcatgttgctttgttactctggtgaagaagaaaaatagtattgaagtttcatttgaatgaacatcttcaggctctttaaatcttgagcaactaccatttgttccttcaaaaaatcaaatctgagcttgagttgagaagcgaaatatgatagtaccacctcgaatatatatagatcatatcgtaaaaatgcagcttcctgtacagtcaaacaatctcagaatttctacccaaatcctacctccatgacatcacgaaacaaactgcaaatttctgtttctaacccaacagttgtctggatttctctgcacatcctatttctaacccaggaattgtgaactgtctaacatggattctaagcagagaacatttctaacccaggaattgtgaactgtacatctactcacagaactgtctgctgacccaaaaactgttccctctgaacatttactctcctgacccaagaactgtttgctcacttcccatggatgttcttcttatgacggtagtagtcggcaagattttggaagaagttgtggcagtaggagcattccaccctgtccttgctgcgcatcagcttgcgatggcaagtacagtagtggggcctcatggagcctgacgacaaactccgtggtttcgagccctcgaagcagctggtgcacggcttctcccctctccctgcctgatcgcactcgacgaagaacgagaggagagggccgtgctgcggaggtgtctcgccggcgacgatggagacgggcggctcctcgtcttcctcctgcaatgccgcagtcttgtcggtgtcggcgtcccaatcttgatcgaagccctcccaatcttgatcgaaggcgtcccaatcaggccaatcggcgtcgtcggcgtcatcgtcgtcgtgcattggtggctgcagcaagtgggcgtcaggggcggcctcgccggcgtgggcgacggcttcttgcagtggtggctgcagccaatgggcgtcaggggcggcctcgccgtcgccgacgtgggcgacggcttcttgcagaggtggctgcagccaatgggcgtcgggggcggcctcgccggcctgggcggcgacttcttgcgggggtggctgctcaccggcgacgaggagggcagcgccgcccttgtcctccaccgccgctcccgcaccctggagctgcctcccggcattgttgttggaggcgtcggggaggccacgcttcttgtcaccgttcttagcgtcggggaggccgctcttgtcatcggcgacggcggaggcccccgcaccctggagcggcgcttcccgatcgttcttggcgtcgccgttgaacgcacccttgccatcggcgacggcggaggcgccgacctgctcctcctctgcccccaattcttggagccaccggtaagcgccgtggccgccctcgtcggcgacgaggacaagcctgtccacgtcgtggggcggcaggtgttcgtcggcgacgcccccgccaccgcccacctcgtccaccatgctgagcccttcttgaatcggcatcagcgtccccgcgtcgacgatgccgtcgtcctcctctaaaacctcgccccgctcgacgacgcactgcttgatcacctcggcgaactggggaaatggggaatgcgtggtatttgatttcttgtttgatcctgacaccgaagcagaggaggggagatttatagtgagatttgtattgagcgcttgtggctttgtgggttcctcgcggatgggagaacgggagaggctgcaatggcttgatccaccgtccaagcgagatccgacggatataattaaacgatattggttaccgttaaacttagttcatggagggaaaagcttgcgtacctgttaatttatttttgttatctgtactttgtttaaggtagtgtttgtctaattcttgcacttggtggtttttgcctactcattttttaaccaggaaattaaccagagtagaataaaggaacgagtccattttataactcctttgttttgtggtaatatagaaaactaattctgaactttataattgaatatacttcaactttcgactctcaaaaccatgaagttttttacttgtgcctgaatatagagctgttttggttgatgtggtgtaaaccaaaaactaattttgagtttttaaaactatttaaagagtagaaaaaaagtatttctcgctaagtttttttttttggtacaagtgaaatagcatacagttggcttacgaacaatagattgaaagctaaataaacactattttttgaaatgggacgaatattctttatagcattgtagattgaatttattagtttaaattttcaaggcgaataagtctattgtgcctccctcaacttatgcccatggttgaatcgcatctctcaaccgcaaaaatgggtatagcccatccccaaactcccaagaccattgcaaatcgactccacgggtggtttcgtccaacgtggaagttcactcatcatttgacccttgccattaggtgggacccattcgtcagcagcttccacctcatcccatattctccctcacctctcttctcccctctctctctctctctcatctcttcctcctctcaccttccatcagcatagaggcagggcggcggcgatggcgcataggggaggagcttgctagccgaccggcctcgccgcgcgcgggtaggagctagccgggtgaccgcatgagggaggagctcgtcgaccggccgcacgcggggaggagctcgtcggcatagtggcagccagtaccctcgttgatctcctgcaacggcccgactcgagcacctagaggaggtgggagggcgaatgccaaatggaggacgtcgaagctcgaggaggtcgcaacggctgcgtaccggctccgtccgtgtcaaaccagcgatgcacggtccgcgacccccgcgctgcaaccgttggcctctgccccggctaccgagatcactagggatgtagacggcgaccggcatcggcgagcttgcaagagagcgatgctaggagcggtgttcgaaagctattccaaaaattgcctccgccgccgggcgagcttcggcttcctctgatagcctcgggggtctcgccggggcgcatcttctccgacagagggcggagcgtgccgtcagcgaggagctgctcggtctccatcagcagcacgccttgctggttgcggatccggatggtggcgacgtggatggtgcagacgacagggtgctgttgctgtgacggtggagatgagcacacccctagctcatcctaacacctattgagttgtgatccaaattcatttgcacataataaaggccagcttctgctgaagagaagcggagacccgtcgctggaggcttgggccggatatatatacctcttctaagccgtcgttcggcgttgtaacctcaccctgatatagtgaagatattttgctggctggcgctcgtggttttttctctcttgttttggaagggtttttcatgttaaatcttgtgtcttctgtgattgatatattgttatttatcgtttatttgcctatcgtttcctaagtcctaacagcaccgtgccccaagacgctagcacaaccagcaagtcgagcgtcgggaaggccagcggccgcgacggcaacaatggccgcatcggaattagccagtgcctgcgcttttctcagtggtggccacggcggcggcgttccggctccgtccatgtcggactagcgacccccgcgccgcacccgctggcctccgcgacctcacttcaccgttgcgcggttgcgccaatcccctctggcctccatggctgtctgcgagggaggagaggggaaataaataatgtaactaatatgtgggtcctcacctattttttttttactgtgagtgacacgtagaagccatgtggaatgaagacctagtcaagatgccatgtagatagcacataagttaaaaccgggttcaatactgtcgagagtctatttgcaccggtttttaagatatgggaggtattatacctggttttgcgattaagggatgcgatttcgaccaagtgcaagagatgagggacgtaaaatagacttattccttcctaggacaatcacgaagaacttatgatccattcagatttcaggcccaccatttggaacttttggcccatttctcaatattcacttacggccgaaacatttctaccttttgctgattctagcgtccatgaagttgcaacatgggttcattttcagttgatttagttacatttaagacaatttcgtcttctttagatttcaatcccacttgggtaatgttgcccccaatttggctgagtaaattgtaggagtttgaccatttgtgacacatcaaacgttgtagctcatggtttgccataggatgtttttcttcgttgtagctaactttatttttgagccgaaaatatgacccaattaaacaaagaaaaggtatggtaatttatgtattataggggataacgatccaaacataacgagattacaatacatgagcctaattttgaattcagagtgcaagatagtgggagaaagagagagaaggaaaagatagagctaatatatactagttgtacaatgaatttatagttagtagtgagttccgagacgtcatccaagtggcaccgaacaaaatgtaagtcagtgatgctatggtcaccgtcattaaaatgataagatggattaagaaaaacgttactaaccatggaattgctatcagattttcagatttgctctcattccaattctaagtaataacgtaagctagtatatttatgtcatgtatccaacgtttgcgttcacttcatattttttatttgttggtaggtaattacaacgactttggataattcaacataaaaatgataaggtataaaaatacatgtaggggatgtagctcagatggtagagcgctcgcttagcatgcgagaggtacggggatcgataccccgcatctccaaactttttaatagtaccttttgcattttttttcccttgctaaagaaattgttggtctcttcgctaatgttttttgcattttttcccttactaaagaaattgttggtctctttgctaatgtgctctttgtatagcccattttgaacatgctaatttggtttatctctcctccagattttatccatatagctgtaaactataacattcaaaagggttcaaaattttcaagaagagatattttaacatatacaataacaaatctacacccttagcccctaggtgattacaaccacgtactatactctactactaaccatggaacttcgctggtcacctcattttcagcctaattttttagcccaacgcaacactatcatatactaaggtggtgtttggaaaggagggactaaactttagtccctctcatacaaacataagttcttacaaaagagactaagggcttatttggttctctaccctaccaatttattggtagtgccaaagtctaggcaaaatttggcactaccaaaatattggtagggtaaaattatttggctaccatttggattgctaccaatataaagtcaaattctcatagtatagtaaagaaacttctagaaaatgaccaaatagtataagggaactaccaaatatttggcttcaatccaaaataacacatatactattcaatttgccaataaattggtagggtgtgtttttggtattaaaccaaaacggccctaaaatttttgtgagagggactacattcccaaacaccacctaagtgcgatattacgagcaatcaatcaatcgagtataatgcagcttaagccagccagccatcgccttcgtttggtgttgcacgtgtcaaatccccgggcgggccggacccaccgtacagtgacagatccagccactggcagttgggccgcgagcgggccaacgaaccaccaccccagcatttattactccccttgcaccaccacgcgtaatccacccaccattaaactctggccccacctgtcatccagcgtgtggtgccacgtccgtttccccttcccgggagggagcagcgtcctgtttgtgatttacccgtattggtttgtacccgagacactgagatgtggggcccacggtgagattggtggcttgcgcgtggtttttcttgtggtcgtaggcacaccgcccgccgcgaccgcccaactactcggtgagttgacttggtaataaagaagacgtatactcgtgtcatggaaattttcgtccaggtcctcgtgggacgacgaaattcaaaccggctccatgcatggcttactccgtacaccgccacacgtactccgtaacacgttacacgtctacgggtggcatgggcgagcgacatgagcggatcgctcattccattatacgttctgtttgctcgtcccatgtgtttgtttggctaggtggatgagcttcgatgaaagatggccgtccgaatttttatattgtttatttaaatggtatgatggatagtacggtctagaaaagggaatattctcttaatatgttggatgagtgtatccggccgatttgactggaaaaagtcatacaaggcatgtgtaatgtgtcatattctgattggctgtggttggtttgattttctgttagcaagctccaaatgatttttttctcctaaaccatttatctaatttatgatttgattacaccattatatttattacaattaaatctttaataaaatctcaggtgattatattttaataaaaaaaatatatatgataaatgtgacccactaacttttggcatatcccaaccatgctatatccctccaaccaaataagaaatttagtcatcctatatacaaatcaaacaaaaaaattagatcgctatataaaaaaaaatatatgaatggtcatatcccattcatgactatcgaccaaacatgcatgcatgacatcagccacacccacacacaccctaaatactctcccggtgatggccatatagtaataatttcattttcatccaagcattgccatctccataaaagtatggacatgaatggacttgtttgcaaacagtgctagagttaaaaacttagaatggacttgtttgcaaatagtgctagagttaagatgatggcaacgaccacccaacaccaatcgatcggctatcgatgtcacgatgcagcaatgtagtcctccggtccaatttccaagcttgtctcacaaagaccatagtcgacgatcaacgatggacagtgcttgccactcagctgtgaaaatcaacgttagtactccctcccttccctcatataaccatgatctcttcatttgatgtgtggtattattacatttatatatacaaattgagtttgcatacatgcatgaaagtatttgaggtagtaaaactcttgtttcttgtgcatggtgggtgttaaagggtgcgtgtttcttgatttcttgatgtttccgccgatactttgatacatcgtccgtatttaagtctatttttaagtttattcgtttttgaaaatacataagaagttgtataaaaaatcattttaaaaacatgctaactttgaatgaaagtcggactcctaattactttataattctcgccagaccattaaaaaaataacgtacatgatatatgatcaacatcccaataaagatttcgaattagatatcaatactatcaaaataaaaatcctatatatacattttagaaaagacaatctaacaataatacgattaaactagccctcacccgttgcaacgcacgggtattatttctagttataaatacaatataggaaagttaattcttccttaatattgataaaaaaaaaacttatacgatgatcaatatgaaatggagggagtggtactgtattagagttgacctctgggaattaggttgctccggcactccatggtactctctgattttcggcatatgataccgttaatttatatatatttgtttgatcatttattttattaaaaatatacacatattaaaaatatgagttgtgctcaaagctagtactacccaactaaaacaaatcacaccaaaataaataaaggttacgtatttttctaataaaataaatggtttaacatatgcctaaaagctatagatataatctaaagttaattttaagttataaactttgattatagaattagtttagggttgttttcatcagtttaggagttgttggcatccggctctccttttttccatttctacgaccgctagtaaaataatctaccaagatcctttaaagtcgaaatcactttgaaatgtaatctttagggattccaagtagattcatagttggctctacacaatttgtcaaatggtcacaaggtcacaggtgttctaaaaagatatttatattaacttcattgactcaatctagttgttagaacacactgtacatgggtctactatctcaatttgatgcatgtcgtcgcaagaataggtgctaaagtccctttttctccaattcaatggatacggttaaagttcctaagagacaacacgttgataataggtttgttgagacgagattatggcatctagatcttcttttagaattaaaagcccacttaaacggttcagtttttttacttagaatatgagaatacatagttgtaaaattttaaaaataaactagaaacccgaagttatttttttcaacttctctatattcttaccagatgaattctaaagttcttccaaacagactttgtaaaggagttgaaagtagtacccattgcattcaattgtataattgcatcttagtagtatccatgtgaactgttgaagcacaaatgaattaaaatgactttctgttcagtttaagcttttgattgaaacagaagactcatacataagttctaggagtacatattacttttttcacatcaaatggtgtatgctcctgttcatatattcctatgtcctcgtttactggtcactgttgacccgctagtgttttaactttgatcattaatagtttttaaaggattaagtattaacctatgattagtgaaagttatatagttgtattaatggtatatgtcatacttcaagtatatatatatttttttcagaaaaaacaaacggccaatgttttgaaaaaaaacaagtgacaagtatatacaaattttgctacatgacatcgtgaccacggtttaagtagtaaggcatcacacaaactgactttggggaaatacactattaagagtgtcttcccccaaaacttcgcgcggtgttaaaaccgtgaaatcataatgtgccataaaataacatgttatagctgctaaagcacaactgcacagatgaaactacccatcctttctattcaatttaaccttttggccgaaactaaactattcatacataatacctaaaatatttcttttccatatatccttttagtgcatgttactgtcacccatcctcctttttattatcactagacacaaaaatcccaacaaaatccaattataatccaaatagtaccccttcttttcttttttattttttacaggtcaccgttccaccacatcgcacatattcttcgtcgctaattagcttcacctgcgaccacacacacaccaccaccaccgccgcgtcgccattccacaccgcgtcaagcagcgcacgccatcgccgtctcctcctcttctccggcgtccaagaacccctcccgtgccccggccatgccgccgccggagccggacaaggacaagccgctgccgaagcccaagccgcccaagcccaagcccaagccgcccaagccggagccggagccgaacacgcgctcggcgccggagcgcgaccagacggccgccccgtacggcacggtgccccccgaccccttgtcctgcgccaccgactgctcgccggactgcgtgttctaccacctgtgcccttc

SEQ ID NO: 68317 - DNA, 22122 bp, Oryza sativa
  unsure (1)..(22122): unsure at all n locations
tccaccggtgggcggggggtagtagatgcctccaccgccggtgctgctgccgcctccaccgccgctgtaggaaggtggcggcgaggtgtacatgacggtgcctccgcctccgccaccgcctccgccgaggggtagaaaggtggcggcgggcactgcggcgtgggggtgacgaccggcggcgggggtggcgggtagtagaaggggttgcaggggttgtcgcaggaggcgcagagcttgcaggtggtgccgtccttgagcacgatggtggtggcgccctcgtcgttgggcggcggggcggcattggcgagggcgaggctctccgcgaggaggaggaggaggaagaggtggagcgccatggcgaggagagagtgagagagacgagggggaaggtggtgatggggatgggagtgggagtgaagtggaaggagggggggggggggggtattaatttggtggaggtagcagcgcaaagcaaggtggcgtggtcggctgctgctctctcctcctcggctcagcgattgcgctcttgtttttttcctctccatgtttgtgtaaagaaatggtgaattggaagggaagatgactcgacgagtaaaaaaaaccaaggagcagtttctcacggagcaaacgcgtacgctaacgctagatggccttttcttctttttttttttcgatcgtcgtggtacaatgcgtgcacgtgaacatgtacaacaaccatcgtcaaagaggataggaagaacgacatactactgcagtactagtgcagtagtgctacgcatttccgcactttttactcttcgtgggatccgtccgggcagttggatccttccagatccatccgcgttcgttcacattgactctggccttggccttactgcgtctcacacactctcatgtgcgctcctgctggcaggcagcaacgaaacacacacacgacgggcacccgcaccagcacgtgtcggccccgttccgccgccccatcggacgtcctaccaccaccaccggttggattcttgtgcagcggcgcggcgcgcgtacaagcggccgtgcacggtgaacgagacgggagcacgcagcggcggcaggggggtcagtttccacccggaggaggcggaagctgcgtggaggtgtcgactcgaacgcacgcaaccgtgcacgcacaccgctagatcggactcatcaaccccggcgttttccacatgcgtgcgcacgggtactctcgctcgggcggccgctgtatgggcggcggcgttggccccgcgcgcgtcaactcagtagtcagctagctctcgtggctggatcggatcggtcgccgccttgcataccgaccgttcgccgtgaggagagatctgcgttctgcaattctgcacgcatgaagtagctacaagtggggagagggaatagttaattggggtgatataggttgatctgcaacgacggacacgagcaacggcctgatgcatatttccgcgggtatccacatgcatgcgtgatgttgaagtgtttgtgtttagcttaactgccacttgcagcttccgtccattttgggattgcatgtctgtgtagtagtactccgtggtagtactagtactagaatattttggttgttggggaatggcaaattaaagcacgagttgtggacggttgaaacacggtcggtccgaactctgaacatgccgtgagcccgcgacgcggcgtgtcaacactagccaacaatcactgtatccatgcaaaatttgtcacttgcctacccaaattgtacctgtgatctgtcgaagctataggttgtacccttctgtagtactgatcaaaagcaggttttcctcctccagaaataataatcacgtcgtaacaatactaaaagagggaggatgcactaatctttctgccacagctgcaggtatcctctctctctctctctctctctctctctctctctcacagtagctctttacacctcagagatccatcatgatacgaacgagcgatccccgccttccagaagacacattgcacatggggggcagtcaagcaaactgatcaagctgagggcgcagacaacagaacatactacggagcagccaaaaatgacaggccggccagccaccgctctgcccactgccctgcactgcacaacaacccccaccatcccaatcaaactcagttgaggctcagccccacgccgtggtgcgtgtaaaactggtagaaatcgccgaacgggctgatccgctgaggcttcggccggagtaaggtggcgatagtggtagtggggttggtggtgcggtgcctgaaccggaatctccacgcatgcctgtgtcactgtttgtgtgatggtcatacctgtgtcactgtgtgtgtgtgtgacggtgcgttgggcccgcagctcggtcaaacgttgtgttgttcggtctgtttgatggtcggggggagcggacggacggtgcgtttggttcggtagattagtctgtggatgtagggtaaaaacggtacggaaaagggaggaaagcatatttatcgttttcgtttttattttttttaattggaattggaaacctcggatacgaaaacgaaatcaaatattatcgaaatcgaaaacggagataaaataaaccggcgcgaatacggtaacgaaaatttatcggaataaaaaacccctcaaactgataaatccaattctcaagtctcaacggtcaacaatctatctattatatctataaagtaataaaaaaagatcctccacgtccgctctcatggtctagaaattctcacattaataaaaaaaaaagaaaaatagaactagattaggattagtattagttaaaaactgaagaaaggaaaaaaaaaaggcatactaagatacttgaatcggacagcagtcaaaaactttaaaaaggaaaaccaaatcatattatacactggaaacagataatgttatgagaatccgcgtgttcacaccgcttttagaaacattgaaagacaaaccagtactaatcaaactctgccggttccgaattctattgttcgctctcacgcgctagaaattctcacattaatcgaaagaaaatataaggaaatatagaaaagatcaagaccgtagaacatattttgcttcagattatacgttgtagattgctttcgtaggatccaggaaacggacaaggtttctttcgatttagaaagggtgaatagtcagttcagtccttcaacttttgctcagaggtcgaattagtcctttatattttataatgtccaaacaggaccctaaaaattatcatacggcttaatatagtccttatacccacttaaaacgccacatggacatgccacgtcattcgtgcatgtaagataacatttaaatgtccattttaaccttcaattttctatcaaacaaagaaaagaaaataagaagaagcaatcataaaacaaaaaatgttattttttttatctatcaatgctacatatttttgccaatggtcaaaaacttttttttgtgtgtgttttctcaatagtttttctttatttcctataaaaacataagggtgtaaaggacatttaaatattgaatttacatgcatagatgatgtggcatgtacacatggcatgtttagagggtctaaggaccatattgaatcacacaatgaacttaaggtatttgtttggacaacacgaaatgtcagggactaaattgatccttaagtgaaagttcaaggatcatgttgggtattcacccatttagaaaggaaaaagtacgaatcacccccccccccccgaactatcgcggtcgtccgaattacccccctgaaccataaaaccggacattattcacccccaactatgcaaaccggatgaattacccccctaacccaatccgcggtggttttggtctacgtggcgtatacgtggcagtacagtcagcattttatttattaaaaaaatatgggtcccacctgtcatactcctattccattattcctcttcctcttctctctcactcttcctctctctctcttctctcactctcaactatgcaagcagcgggcggaggagctgaggcgagccgcggaggaggcgagcgcagtggcggaggaggcgaggcatcggcgaggaagggccgcgcaggggcgggcgcgagcagcggctgggtggcgagcggcggcggggtgcggcggaggaggcatgtactatcttatcccgagcccaaccattttcgtcacgacccaagctggcatgctgccatttgccactgtgcacgtctgcatcgtccgccaacgagcacgtacgacgagcttacctagctagctgactgctcgagacgtgcgatttttactcctcgcggtaaacgattcttgtgaaggccaggtctccggcgctccatgtagccaccgctccctcgccgatggtagtatagcatggtggggggtttagtgctctcccaggcgcagcaccaggtcgggatcgccgcgagtcgccggcgcaggcgcaagtggcggagcaggccgccttcaggggaagggatcaccgggcgccatgcgagagcctggacgaggcgaggaaggcgcacgcgcgacacgtcaagctcggcgtcgaccgctcgctgcggcacgcgcggccgctcctcgcggcgtgcgcgctcgccgccgactggcccgggagcatggcctacgcggcgtccatcttcgcggcgctcgacgaccctgaggcgttcgactacaacaccctgacgcgcgactactccgcgtcacccgccgctgccgcccccgccgccgctctgtccctcgcctgccaccgccgcctccgcgtcacccgccgaggccgacgctgctctgtcccctgcctgccgcccatgagagagaggaagagtgagagagaagagagaggaagagtgggaggaaaacaggtgggtcccataacttttttaaaaatagaattgctgactggactgtcacgtaggctaaaaccaccgcagattgggtcgagggggggtaattcgtccggtttacatagttgggggtgaagaatgtttggttttgtggttcatgggataattcagacgaccgtgatagttctggggagtaattcgtgctttttcctttagaaaacgtatcggacactaattttgaaaccgtgtgagacactaataaaagacagactaaaaaaccatcatcgtcagattcatgcaatctgaattgtacacaaattacatgccatggtaatatataaatagtacgccagaaatcatctctccacaatccaccgcaacaaaaaaagaaaggaaaaaaagattgagtactatttatgaaactctctaccagccaaaaagacatcaaaagggatccgacttttagcgatgaaaaaattgtgagataaaagcaagtatttcaggaaaatagcaactaactgatgctctaaaataccatagagctgaaacgatatcaaaacaagaaggcaaactcaatctattatcttaataaagaaatagaaataaaaaaaaaggagccaccactttcatagactaaaaatttccacatgaattagagagaaatattaaaaattctaatatatgaaaaaagagcccagatggaaactaatagaaaaaaggagccaccacgtttgctctcacggtctagaaattcccacattaatcggagaaaaaaaagtagagtatataggaatacaatttaaaaatagctaaaattcggtattaaaaataagaaatattgaaagaatagactagagtccatacaagcatacaatttagaattaattaaaattcggaattaaaaaataggaaaactaaaattagaagttagagtccatatagaaatacaattttagaattaactaaattcaaaattaaaaaaagtaagattgggagaagagtcatagtctatatttgaatacaatttataaataactgaaattcgaaattaacaaataaggaatactaagtaaaaaaagtctagcgtccatataggaatataatttagaaataactaaaattagaaaaaagaaatattgaaaaaagaagtctagagtcaatataggaacatagtttaccaacaactgaaattcaaaataaaaaaaataaaaaatattgaaagaagagtttagagttcatatagaaatataatttataaataaataaaaatgaatattggaagagtagtttagaatccatataggaatagaatttatgaacaaaggaaattcgaaagtagagtccatataggaatacaacttaaaaatagctgaaattcggtattaaaaataaggaatattgaaatagtagactagagtccatacaagcatacaatttagaattaattaaaattcggaattaaaaaataggaaaaagtaaaattagaagttagagtctgtatagaaatacaatttagaattaactaaaattaaaaattttaaaaaaagtaagattgggagaagagtcatagtccatatatgaatacaatttataaataactgaaattcgaaattaacaaataaggaatactgggaaaaaagtctagcgtccatataggaatacaatttagaaataactaaaattaaaaaagaaatattgaaaaaagaagtctagagtcaatataggaatacagtttaccaataattgaaattcaaaattttaaaaataaaaaatattgaaagaagagtttagagatcatatagaaatacaatttataaataactaaaattcagagttaagaaaaatgaatattggaagagtagtctagaatccatataggaatagaatttatgaacaaaggaaattcgaagtttaaaaataaggaatattaaaagatgattcttgagtccatatagaaatataatttataaataactatcacgtatatacaatacaataaaaatatcacacatttattagttcaaccaagaatttaaaattatgttgttattttaatatattttaataataaaatgtgaaaatatttaaactattgtataagaaaaaaaatctaacaatgctagcggcgcaatctgcgcgggtcgccatgttagctcatcataaaacacaatcatataggtccaattgttaagtctcaacagtacatcacaaaacgcaatgtacggaataaattatctatgtttaagagagtaacactgttgataaatcccaatacatgaaaaaaatattcttatgtaacttcaaatttgaataacaattatttttaaaaaataacagccaaacaccatggtattcactattcagtgcttaaaaaataatccagggtattttagtcacaaaatttctacaaattccaagaaaatttctggaaagttttcgaccgattccgagtttcgacggaaactgcgcttatcattttcgatttcgtttccgagaaaatatttccgaattcgttttcgtttccaaaaaattctgactgacaaattccattttcgaaaataggttcggaatccgaaaaatttatgtaccgtttcacccctatctggatggaagatgttgctcgattttttttgttgtgtatggttgagagatatggtggatggggcagtccagaaaagaaaatattctctcaatatgatggttgagtgaatcctaccaatttagtcgtatgaatgtaacatcctggcctagagcttaataggattaatagaatactcatatcaacaagttgcaacttcttttccggaagccaatctccaaagaactccaggcctagggcttaataggattaatagaatactcatatcaacaagttgcaacttcttttccggaagccaatctccaaagaactccagggttaggataaagtgtgcagaaaagacatgtgttggtctgtgagggcagtctatgacctatgaaagctatcagatgtaagtgggcctggcctgggggaaggcgggacgttacaatgaagccatgcatgttttggtttggggtgatgtggtctattttgataggcggtggttggtttaattttctgttagcaagcttcaaatgatttttttctcctaaaccgtttatctaattcgtgatccgattacatcattatatttattacaattaaatatttaaaacaagatcgattatattttgataaaaaaattatatcacaaataggcccactaaaaatgttggcttatcccatccatgttatactcttccaaaaaaaataaactgaatcattctatccatacaaataaaaaaaattaatcaccatatccaactaaacatgaatggctatatcctatccacacttttagctagcagcttccctgtagtttggtcggtctcacccggcacgacggcacctggggtcgggtccacgcatgttgcacgcacaaaggtgccacgacctttgcaccactgccgatgtcttcttcatcagccatcaataagagagacacactgtcgatgggatacccatggacttataatataggtattggggtacgttggtatgataatatacacaatttaacatcaaacaaacaaatgggtaagaattatactggtacaatagataacggttgatttataaaaggggcatcggcccagactcgatggcggtgtggcacgggtgaagccgaagggagggagttgcggcttgtcctagactctcaactcaactcatctggttctcttaggcttgcgctgttggtttttgttttgggctattggatttggttacttgggcctaatttttttttaggtttttttggttttttttagggggttgttctctgggttaaaatcagagtaattacagtcaaacggagaggttagggctaatttataaacggatttgtaaaatgttgtcgccatattttatggctgattacagtcaaattggatgctctgtgctggatcgttgttcttgttcacagtccacctcaagtcctcagcatctctaccgattctctctttgcttttttactttatatgtgtgaatctatataggtaatatcaactagataatcaatcattttgaattatttctagccccttacttatggtgtaagtatattaaatttacaatgtaattacacaatacaaatttttactattataaaaattgaattgaaaatatttttcctggtattttggtacgtcatccgtgtttgggtcggtttttaaatttgttcgcttttgaaaatgcatgtccgtgtttgagttggaattaaacacattttcttttgaaaatacaaaagaagttatataagaaatctctttaaaaaaactcgcatgataacttgatatgaaatactggctcctaattgaaatacgggctcctagttatagctcatgattttcttaaaaaatatccaagcgaattcccacgataaattttatcctagctaaaccatataacaataataaaattaaaatagcatttacacgttgcaaagcacgggtattttttctagtatatataatttacaatgtaaaaaaatcactgttttttatgaaaatcgtggtgccataatataggtcgtggaggaagacaggcacagccgtgctgctggctgtagcatccatagttccatacatgatgctagtacacgggaagtgcaggaaagatgaaggccggaagccagtgtaggatgtatacggagtatgctgctgcatattcacctgcgtcgagcccttgacgattgatcgctaggaggaggcgtataggacggtcaatatgggataggagtatataggacgaagcttacaagcgaaggcattgggggtcggagaagaacgcccggggaaagaatggcagagcacgacagcgcctttgctaactgctagattgtgaacttttgggccggatcctttccctttatcagcggccctttttctttgcttctggcctaattagctagctggtctctagattgcatctttacttctaccgcaatctattcatgactcatcgtagaatcagtatagcgctggtttatttcatgttgcgcacatacgtccaatctgtacgtagtagtagcagctaggcagtagtcgatcgacaaatctttgcaaacatcgaacgacgtacgtaatgagctgatgaagtaaaagcacggtcggaatcggtagtatctcttctagatgatcatatttatcatttattatactactaagtgtcgatattaatacgatgtagaaataaattaaaaaaacaaaatttatatatagcccaaaacaacaacgagaacaatattcttataagaaaacggcgctcgatcaatcaagaatttccgtggtcatttttaccccaaaaaaattatatataacccaaaacaacgagatcagtatccttataagaaaacggcgctagatcaattaagaatttttgtgatcattttcaccccggctgatgggctgatggcagccagaggctttggtccacaataatcgaccatgcaatgcatgccttaaatgctgcaggtgatacgtacaccttagttatataacactacttcgatgatgctgacggctactaatcatccactatcacggctaggctttaattaatcattgtaacgaaatggccgaacatctccatacgtcacgtcacgtctggtgatgatcgatcgatctcatttatcagttcattcacacgtcattatccatgcattcgactactcgagagtcatagtcatactgcctccgttctaaaatactccctccatcctataaaaaaccaacctaacactagatatgacatatcctagccctacgaatctggacatacatctatccaattcgttgtactggaatgtgtcacatccaattctaaatttgtttttctcgacggagagagtataagtgtaatcgcgggtatctgtgcccaaaatttaacggttcatgttatttaaaaaaattatgaaaaaaattagaaaattagttacacataaaatactattaatgttttatcatctaataacaataaaaatactaatcataaaatattttaaaataagacgaacggttaaacgttgaaaattaacaatgcagaactatatttattttgggacggatatatttattttgggacggatgaagtagttgttatatatgcccgcctttttaatttgttcaatcttgtgtactaataaactcggccgatcaacgacaaaattgttgaagagatcactcaatctcgacaccggcgaagacagaaaaagaaaaaaaaaaacctaaaaataacttgtctcttttcttcactaccaaaaataattgtttggtgaggtgatgacttgagtcaacctcttggttaagaccaatgccctacggttttgctaaaaaaaactgatgatatttttttcctggttgatgctaagtttttagaacatactacttatgatggattttcagataagcccaatgccctaagcaaccagatactccctccatagttataaaggaagtcgtttagaacaatgtttaagttaaaccttgggaatataaatcataaataactctcaagttgttgaatttgaaaatgtaaaaattatatgaatagatttgtcttgaaaaatactttcataaaagtatgtatatacatatacatacatacatacatacatacatatatatatatatatatatatatatatatatatatatatatatatatatatatatcactttttaataaactaggaaggtagctcacgcattcgcacgggcatgtgctgtacgtaggataaatttgagaaacttataacggcggtataccagcgaaataatatctgcaacgtttcataattatgttttctcatgaattttcttcattagaattgcatgatgaatttaattgttatttataaaattacctattggagattagggttggtaacttacggtataaaagatggtacctaagacatatgactcttgaggttccatagggaaagagaaaaaacttaagttataaaagacattacatacacaaccatatataattaatggctctattgatttatattgaaaaattgataattagtttattaaacaaaatatatgaccctctattttaaaccattatttctaaccattggatatgtagatgatctaacatattgtgcagagtccaactaaccaaattattcgtcttccctcactatggacggtgaacttgttaattcgtgtctctggcagcatgctcgcatcatcatacttagaagaaaaaaaagtgcccctgcatgtatatgaataatacatgtaactatctcagaccctatttagatgggactaaacttttaagtccctatcacatcggatgtttagacactaattataaatattaaacatagactattaataaaacccatccataatcttggactaattcgcgagatgaatctattgagcctaattaattcatgattagcctatgtgatgctacagtaaacattctctaattatggattaattaggcttaaaaaattcgtctcacgaattagctttcatttatgtaattagttttgtaagtagtctatatttaatactctaaattagtgtctaaatacagagactaaagttaagtccctggatccaaacaccacctcatgcccctcttttcatcttagaaaaaaaaattatatacccatgcatgcacaccgggatgcaccggctagccctccaatttgtttactccatagacagtatgttccattgttagtgattagataatttataagtacaaataagtatttgaaatcattttttattagtaaaatatccataagggcagctctgtagacccctctctccttcttcttttcttggtgtattagttggatttgagcaacgtgatatacgcattttgggctataagttaatgtccaacttccaagggattaaagtttcccaacccttaacgccaaacacagcataagatcgttcatttatccttaaaagaagatcatgtcttttatcaaggcattgggattaagtaaatagcatccacatacacattgagagatataattaagttggttgtgagtcaataggcccattgatgctattattaaggttaaggttaacggtttataggttatttgattttattaaaaaaagtggatattttgatttttaatgagaacttttatgattttttatggaatggatgtgggtccaaaatataataattttattagcaattaaatatagttggtatagatattaaacttttgatttaataaaaaaatacaatggttcaaacagatcataaattgaatatataatttaaaatttacagctattgaagattctttatttttcagtaaaacataccgtgatcaatatgtattaggtatattatctatgtctatatttgcaagtgcatgcagtctttgaaagtacgatgaaatgaacttactaatatagaagatattagatacccttcagccttaacttaattaccttagaaaaaaaaagagggaggtgagtaaggaaaaaatcacacagaccctttttttaatatttttagctagcttgcaatgggcatgaaatagtgcctaccattttccacttcgaaatttgtgttacataattagaattttttatgttcgtggcaatttattatgtctgctacaatcatatatataattatatacttaaccatcactaagtataactaatgttatttttctcatctctcaatttctagcacctcgatgattaatctggtggaaagttctctctctcttttgtttcttctttcataaagccttaccaccttaatttttgcttatgatattggatctatatttgatctaaattttcagatcacatcatcttaattgtgtttatagctttttttggatgattaactaaagatgcaaactatacaaagtaacatataagattacaatgtttagctacgaaataaattcattttgtactatgtttctatcattatcatacaacatttctgcagtaatattttcttatacatggttttatctaattaggttagttgtgacttatttttctcgattatcatcaattgctatgttaagccatacttcctctatgcatgacacgatcaaatttcctttttctgtttgtttaggtaatgtcaaactttatttgtgcttattctttgatgtttcatattttaatttgtctacagtgaacatataaaaaattggtttcgatggactgcaacacggcattacggttagtctggaagattttatcagatgaatgatgcctcgctttcttgtagtgagctacgttaaatgatatggtgttttttttttcatttgagtcggaatctctctcgtgcgaacggaacatatatgtggagtacttgttgctgactcatggatagcgtcatcaataggttaagattaagattggatctagtgattgaaaatattggccctaccaattaaagaaaagaaataaatggttagatgtttttctttttttcttataatttattttttcataatttattagagtaccacatggttgtttatgagtgtttttaggattgccacatggtgacttaggagcgtttataggatctaaatttaatatttgtttaagatatgatgcttaaaaatttgctcttaaaacatttatattagaagtctaagctatttatacgtatatgtatcttgaattgtgcatttaattataaataacacaataattcaaaaagaatgagaaaaaaaagtaacttgaatctaaattcagaaatccgattattaattttgatagattaagtgttagctagaaaataggaaaagataggtgaaaaataggagagagggaagagtcaggtgggtggatgaagtacataactaatacgtgtgcacacattttttttcataaagatgtaatgattaaaattaatggaattatctgttaaagttcaatagttaaattagagaaagaaggaaggaaataaggagggatgtatgcacgtagttactgtgaggagaggaggtccaggaggaaagggtggaggagaagatttttgatgggttttgggattttttttaaaaaaaatgatagatctaagagcattaccaacagtctacctatatgattcccaaaactaattttgagggattttagttcaaaaatcaactctaacagatcccatactctcctacccgagttttggagttcccttcccccggttcctcgctccgtttatatgcgggcatgaaagtcgctcccaatcacgcaatcccacctctctccttcgttcccgcgcgtgggagatagcgatctttctgcgtgtgaaagaaaaaaaaacggaattttctcttggtagtttaatagaagggcccacttttaagttttggggattgaatttaggctatctgttggagggaggagttttttcacttcctattttcagtttaagaataacaaaaacaaatttttaggagaaaattatagataatctgttggtgatgctctaacggtgtaaaatattaggtccaccgtattaactgaaaatcgatgtgtagatgtttttcttttttctcataatttcttcgatttctctgatttattgggtgccgcttgttataaataatcgacacatataagcccagccacgtggcatgatggtccagaatcggtaccaataaattggtataggtgtcggttcttgatacaaaaccggcacttacatatattataggtgcagattttacgaccggtgccgatatccgaagtcatccatgccgttatctgggtgttggttcgaaaaaccatcagctaagtgatttctcgttacctatggtgtagttgaatgtgcacccagtccacctggtcatcttgtatgagcacatacactaattaaaatctttgtgattagctggctggtttgcaatcccattggatgagtttctagaagaaaaaaaaactatcgatttttttttcataataactccgtaataaaaaaaagttctaaaactactggattgacgaaaaccaagcagctttcacggtttttttaatcggtaatgaccccgacgtctttttttttttgctccacccctgacggcagtatagatctaatctaacggtaataacaacgggtccatcaatttaaataaaaattaatggtgagattaggctgtgccaagtggcggcctcggaacgtttataggagcgccacgtggcagcttgagagcgtttgtatgaagtttaatggacttttagtatataataatagatatttttatagaaacaagagatcaaagttgtgttttggagaccgtgtcgctgtccaaaacgacttcctttattagtatagagggagtatgattttgcttgttccttttcccattggagaaacatttacaggtaaaagagaattttttttatttttaattttttttattaaaagttttaaaaaataatttttcattttgaaaattgacagaagtggtctcctaccgccctctgggagggcgatttttaaaaatcgccatcccagagggcggtgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatattttttataaatatcaatagttatcaaatttttttatattgaaaactatacaagattaaaatctccaagactggtaaaatacaattttattattttttaggcctatttggaatgttaccgtacaaatattttgttagtgccaaaatataagcaagttttggcactaccaaatatttggtagggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcatactccatccaagcatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagaggagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctacgccctaatgtgcccctgggagtacgtgagtcggtccgggggtacgacacggccaactcgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggactagtcctaccggcgtgagacgaagaggccccagtaccgaagatcccggctgcaaatcctgctggacaaggaccatcagtttcatacatgtatttaatagtattaataaaaagtaaagtaccgtgtgggcgagggatcgacgctccgtaagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaaaaaaaatgaactaatctctgggttgaactgtaccgtgcgaaaccggtgctgtaggtcgcactgctctgaagctaggggcgctcgaaggcaaacgaggtcctgcgaggatggaacatcaagttacgacggggtgatgttttcgtacaaaaacataaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgtaagataaatgaaataattgtaagaactaatacaaattcgacgtacccccacgaagtagtcttggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaagtatcataaaaatttagaaatgaacaatccgaactcacgagtggtcggcagggaggacggtcgactgcacattgcccggaaacacctgcctaagtccgaactgtctcatcacacgctgcgggcagtgaggctcaacgaaaatgtcgaacaccatcggcaggatggtgagccagtaagccgggtcgcgtgtgcacaaggacgaaagtcctagcggtgctctcgcagcgacgacctcttctgtgtacggctcccagatgacgtcgctcggctggagacggtaaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccctacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcactcccgcgtcagtcttcgtgcacgcctcacagagggcatggtacgtggctgctagcacggcagaaccccagctccactgcagcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactttgttgatcgcaaataagcatgtctgataataacaacttatttacttacagtgaattggagcaaccaagccttgctaggcccgactgtagagtacggaggaagggtgttggccggtcctaggtgtggaaggcgcatcacctgctcgaagcgcgcagtgatatcctccttccacccaacaacaccgtcaacgggaccaactggtgctcccgccagcggtagcccgagcaggtacgacacgttctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtagaaggcctgccgcacgcaacctgtatagagcaaatttcaaacataagtacaacacaaagcaaagttgagttgaaatgtgaacatacgcgtaccaaggaacgtgacgggggtcgacacgcaaccactcgcgcgacgtgcgtggacggaaggtgccgagctatgcaccctcgactgctgacaggaacgagcggtggttcctgtcaatcccacggttcaacagcgccggtgtgtcgtacgccatacctgcatcaaatagattggtcagaaacatataaataattagtcaacataagtaataaatgttcataagcgaattactaacacatattaaacaagagtacaaacaaacaaaagtgtcaccatacggaatatttctgattacaacaatagctgcagttacacgatatgagtacttagtccgaacactcatcacgataacattatgatacaacaccgaatagttcgcaatactactagtacaacaatagtcggaggtactcattacaacaacattcaattgaaattacacgatagaagtattttgtccgaacacacatcacatcacaacagcgttttatttcctaaatcgatagcattgttacaccatggaatcgcctgctgcgcgacgacgccttggcctttcgcgcctgcttgttgttccttcaccatgtggtcgcctaccatcacttgcctgtccagatggactagcatctgcgccgcttggaacttctgcattcttcgggcatttcttgtaagtatggccgcgcagatcacacttgctacagcgtaaagtcctcccacctacttctgactcatccatatcatttctgatgcgtctagtttggcgtcgaccctttttcacccttaacttagatggatctggaacataaaaaacttgggcactttcaaggccggttttggntggttaaagaaatnccctttgnnagaaatcncccccccggggaaaaaaaaacccccccccccccccccccaaaaaatttttttaaaannnactcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtatacctctgccaaattggttgtcattatgccataccgagatccatcggtgtcgaacaatagagaccacttctccttaggctcattctcaatccactgagtgaaatttctgatggccgaccctgacctccttctcattgttggtgggtcctcatgtaatgcaccaa

SEQ ID NO: 68318 - DNA, 19452 bp, Oryza sativa
  unsure (1)..(19452): unsure at all n locations
ccgttgccaagctctccgctgccgtcgcgaccaccaccagctgccgcgaccgcccccagccgcctaggcgaggctgtggatctggccgccgatgccagtctcgccgccagatccggcctccgtcgccagcctcgccgctatctccaaccccgccgccgacgcccccaacaagagaagcagcatgccgccagcacgcatgccatccccgtcgccgtcgccgtctcccccgccaccgtcgtcgccttccccggcgccagccgccaccaactgccgccgccaccccgccaccttcaacccccaccgccaccaccaccaaatgccgccgccacctcacactgacccgccgccggcggcctctcctccagatccggccgcggcggcccggatctgggcggtcttcgccgtcccgcacgcggtcgccgtcccgcacgcggccccccaccgcgacgggagagggagacaaagacgagggtgaagccccggcaccgccgtccttgcggccgcgcggctttgccggcagccgctcgggcgatggcgaggcggcggagggaggaggggggaggagcgggcgatgccggtggtttccgcctcccgtgtcgcccgtggggaggacgacgcgggggcttgactcatacactgaataaattcgagtataaaagtgaacttattttaggatggatataacactaagttattgagtggtgtacttattttctgttctaagctacaacttcattgtttttgcttaacacgaagtttctttaaaagtcaaataaatctatttatcatgttctcaataattgataattaattaataatgtgctaacggtttaacttgtttaacgtgcttaaaaaaatccaagtgatgcctctgtcccaacgcctgtgtttaattcgaacccacgaaataataaaaaaaatatagtattctatttatcctgaaatatactactacactgttccataaaaagataaacactagctacgaatctctacacacatatgtctaaattcgtagctaggatcgaactttttttacggagggtactacctcagtaaaaaaaattaagatgggacctaacctggtactgatgtttttcagagaacataattctagaacggacatctaggggtgggcgttcggtggggaccgaacattcggtccggtctattcggtcttttaaaagttcggactttcaaatgcacaaactgaatttatccccagagaaatagagaccggagatttggttaaccgaaagttcggtttcggtcttggggcaaaccgaaggcaaaagagacgtgagtaggcaggcttcgtctccaacaatggcaggcaactggtagtgtcaaaacaaagatttcggtaatacttaaaaggggtggctatcaagctaaaaaagtggatgggtttaaagacaaggaattttatacatgtttaggccttcttattcaagaagtaataccctactcctgtccggggatgattccgccgagtgtattattgatcgtatgatctggggaaaaaaggtcgtcccgagaggagcccggacccctccttatataggggaaggggtccgtattacaaaatacagtccatattcctaatggaatatgtgattacagataaaatacaatcgtaaccgactaggatctcgggtatttccttgacatacaagttagaaactaacccgagtcctcgtaaagatattctatctatatttggtaccatgtatccaactaaactataactgccgtgtagatatgggatatccatatctccacagtagcccccgagaccattgcagtcgacgaaatagctttcttagaagaaaaagcaataatccgagtgcttcaattcttcctgctctggcctgccgagcactaaaatcaaagactgtgaagggcgaaaataaaacatggtgcatcgagaagatgcacctaataggtgtagcccccaactatatggttagttaaaaaaactaaacatgtagttaagaaccaagtggttttacaaccaaacgtcatataacaaagcacgcatggtattcagtaaaatacccagccgactgcttctcagctttaatatatcaagaataaaaattatgaaaaggcccgagtgacaaacactcaaaaggtccacaaaaatacatgtttgactagaatccgagtatgaaactcttaaaatgatccaccaaatatgataaaaatcatggtaattaagaagtttaatagcctagactataactcttaccataatcaaaataagcatataacatgccaagaaaatgactcttaataaactagtcatctcgaatcaacccaaacagcttttgcagcctaataaagcttgcaaaaatagtataacacctttctgtcgggcacctttttatttgcatcgtggtaattccaaagaattatcaaactgcgttaaaaatgattttaacagcatcgggtcacatcattgtgagcacatattgccaaagcaaaacgcgcctaagtccctagggatcaacgggccacgctggtaataatattgggctaaagtactgtacaggcctaggcccattagcactcccgataccctaacaaaacacagaagtccaagcgacacttcgtcttccccgccgaaactctcgccatttccccactccttgctacagtacaaagctgcgccgacgaagctagggttcatcaatccgccccaatccgttctcagaaatccacgaaacttctccacgcgcctaccgcaccgattccccattcctctccagctatttctcggaccaaatcagatcattcgactcgcatccatggcggaagagagagaaagtttcgagagtcagtgggcgccctctgacgtgacggaggagaatctgaaggaaatggtggcgcacggcgttcttccggcgaaggagatcatcgggtggcgaccggcattcggcgaagcattcccaaccccggatacacacgaggtcgtggtattttctcacttcttttatggtggattttctcttccaacttcaagattcttccgtggaattctgagcttctatggaattagcctgcatcacctgaatccaaactccatagtgcacattgccaatttcattcatgcctgcgaagcttttttgggcatcaggcctcatttcgccttattccgccgaatcttcttcctcaaaccccaaccgaacaggagcaaacaatgcgtggttgggcgctggcttccaactcagaggaacactaagccaaaagtatttctccatgcccttcaagacctcaaacaaaggctggcatgcaaactggttttacgttcaaaatcctgaacccgcactctccgagtactcctgtcttcctccagtttaccaggacacatggaattcattgcctatgggagatgaagctgctcagacggtggaattgatggaacgcatgctaaagctgaaggaacaaggtttgcagggagaacaaatcactcgacacttcatcaaaagtcggttagccccaattaaagagagatcccgcacggcttttgaatttgacggcaaacatgatccaaatcgggaagacccagattcccttgactttaaggtcatgaaagaaagaatgtacaagatcttctcaaatgctattgtcatcagctattcacatctgttgccagtcatgccattcaatgcattcaaccctcctccaccggtatgtactaaaacacttcaaccttcctcaaaatatgatctcgtctttttgttaaatcaattgacagtggaagatattatgtctaggaatttgctctgatgaagtcggatcccccaatcgctcagcgccgatcacctcgccgtcaaactggtcaggggagcgggggaccaaagatccggtccgaagcccagcccaacacctctaatccagccggccagtcagattcccataagaggaagttagtgctgagtgacgacgaaggcgacgacgctgaaaagcctggagatagagaaacaaccagaaaactaccgaagcaggctattccaaagaagaaaacatctagtcgtcctacgccaaagatcaggaagtcttccaggtacaaatcatataatgatcttccttgtattgatgcacacccagcatggaaataatactgataacaaaaacttgtaggaaaccatctgatatagatccttctagaaaggactctgattcggctaatatggaaacaagttcttccaaagaaactgggccgactaccgtggatcacccgagtgacaatcagccggcaaccgataatgtagaaatcggtgatcaacccccgactagaaaccaatcggccgaagctgaagccggagctaatcaggagcccccgactggaaaccagtcggacacagggccaagccaagagattccaaaagttggagcccaagcagacagccctcgcggtcaagacgctagcagtggaccgaaggtctggatctccttcaaaggcatctgagtccacttgtcctcatccagaaatcatcacgggtaaacactttgcctgaaaccacgttgatctaactgactctatttgattgtttgaccgttatccatggatgcattaggaccaatgattggtgatgaagaggaaattctccggatacaagcggccgaagattcacgccctcccattctggtcaagtggtaggatgacgacttgcaaccccaaggaattgtgataaaccggcgaaaaaagacgaagaggtatgcctactggaaaaggcactcggctaggcgactcgcattgtaaatgtaagttctttgacgcctgacctcaaccatcttgttcgccatttagctcgagcgctaataaaattgttttgcagaggattcaccttaggaatgaagtgaaaaccacaaccctagagaaattagttcctcatcttggaacccttgaagccgtcagagatcaactgcacgaggcaaaagagcttgccaagaaagctgagcacggtctaagagatcggattgcccagctccaggagtctaacttcgaactgagtggctcgtcaaaaggtatacacaaaatctgtctaactaacttgcactgtcatctttgtaacttcaattaatcggagtcaatgtagtgcaagccgccaagatatctcaattggagaaacgaattcagactctggaaaacgataaagcagagctggcgagtcagagggactcagctttaaaggacgttgaaggtaccatcaattgatactccaaaagccattgccttctgtatgctgactcgttaatataaatctgttgatgcagactgcaagatcaagtcgcaagcccaattcgacgtcctggtcggcaaaatcaaaagacttgaaggggccgactgtgataacgacgcaacccttgcaagtatcgggccgactgaattaaggctgcttcgcgggcctcttccagccggtgtaggtcatccactaggtcgtctccgtagcgctcttcgcgaaaattgcgaaaacgcaaagattcaaattctacttcactaggcaacattgcttccgctccataaactaggaagaatggcaactggcccgtagcccgactgggggtggtgcgcaaggaccaaagtacatatggcagctattccacccatttgccggcacagggattcagttggtcaaaaactcgtgcatttattccttggagtaccatgccattggctcgttcaacctgcccatagctcataggatgcgctacggaggcatagcaaattttgatgccgaagtcttcacaaaaatctttaaatactccgccagtgaattgagtgccattatcagtaataatccaacaaggtaccccaaaacgatacacaatgttgatgaaaaaaatctctagctttgtccgtcgtgatcgtgatgaccggtttagcttcaatccgcttggagaatttgtcgatagccacaaaaagatgtgtgtaaccgccgactgcctttttgaacgggccgaccatgtcaagcccccaaaccgcgaatggccaagacaacgggatggtttgcaactcctgagccggtagatgagtttgtcgggcgaaaaattgacaaccctcacatgttcgcacaattttgtcggcgtcggacacaactgtgggccagaaaaaaccctgccgataagccttgccaacgatggttcatgcagcagcgtgattactacaaatgcctgaatgtatgacctttcgcaattgccttccctcctccaaagacacacagcgttgcagaattcccgatggacttttcttgtacagctcggtctcatgaataatataaagcctgctacgcctggaaatccgctcagcttcgtctttatcttgagggagttcttgggaggtcagaaatcgtataaggggctctctccagtcggtttcgaccatagctatgtcttgagtgcccgcggcttcagctgtttctctcttgggtacggttggctcatagagatgttcgacgaacacatcagaaggggccgcttcgcgtttggatccaaaattcgctagtctgtcggctgcttcattattgtgccgaagaacgtgagtaagttcgagtccatcgaacttatcttccaacttttgtacctcctgtcgataagcaatcatattgtcgtcgaggcaggaccactctttcataacttggttaacaactaactgtgaatctccgcgaactgtcagacgcctgattcccaaagagattgcgatccgtagcccgtgaaggagcgcctcatattctgccactttgtgagatgcgaaaaaatgtatccacagcacatagctcagtctttatccagttggggaaattaaaacaactccggccccagtgcctgaaagtctctttgacccgtcaaaatgcatagtccaatactccatcttttcctctgacgtgtcctcttggcactcgatccactcggcgacaaagtcggctaaagcttgggatttgatcgaagttcgcgacttgaacgatatatccaaggacatcagttctaaggcccattttgcgattcgcccgtttgcttcgcgattatggagtatatcgccgagtggaaacgatgtaaccaccgtgactgagtggccttggaagtagtgggataatttcctgacggtgattagaacaccgtacaacagcttctaaacctgaggatatctcgtcttggagtcggccaaaacctcactaacgaagtagatcgatcgttggactttctaaacatggccttcttcctcacgctcgacaaccaggaccacgctcacaacctgagaggtagccgatacgtatagtaataacggctcttgtgggtgtggtgaggccaaaactggtagagtagtgagaagtttcttgaaatcttcaaaggctttctgtgcttcgggtccccactggaaattgtctgttttctttaacagtttgaagaagggcatcccccgctcgccgagtcgtgaaacaaaccggctgagcgccgccatgcatccggtcagtttttgaatgtctttttgggaactcggcggcttcatgttgaggatggcgttgactttctccgggttggcctgtatgcctctgtgagacaccataaatccaagcagattccctgacggtactccgaaggtgcattttttagggtttagtttcatcctgaaagcgcggatgctcgcaaaggtttcttccagatccgtaatcaaatcatccttctgcttggtcttgacgaccacatcatccacataggcttcaacattgcgaccaatttgagtcgagaaacatctctggatcatgcgttgataagttgctcccgcgttcttcaatccgataggcatggtgatatagcaataggctccaaagggcgtgatgaacgaagtcttcaagcagtcggattccttcaatcggatctgatgatatcccgagtagcaatccaaaaaactgagcagctcgcagccggcggtcgagtcgactacctggtcaatgcgaggcagcccgaaaggatctttggggcaggacttgttgaggtcggtgtaatcgaaacacatgcaccattgcccagtctttttccgaactaggacggggttagccagccagtcgggatgaaggacttctttgatgaagcctactgctaacagcttggtcaattcctccttgattacgtccttcctgtcttgtgcaaagcgacggagtcgttgtttgatgggtttagcgtcttccttaacgtgcaaagagtgctcaatcacctctctaggaataccaggcatatcagatggtttccacgcaaagatatctttattgttttgaagaaaggtgatgagcgcgctttcctatttacaatctaactcggcgcctattatagcagttttagtaggatcagaaggatctagggaattttcttggtcttggcttcgctttctccactctttgagatcttggccataggcacttctccttcgcttgtcgtggttgcagccagtcggatgtcttctcgagcaatcgcgatctcgcgggtttgagccatctcgcaactttccttgtcacatgtgacggcttgcttgatgtcgctccgtagggatatgactccccgaggaccaggcatcttcatcatcatgtaggtgtagtgcgggacggccatgaatttggctaacgccgggcgtccgagtatggcgtgatacgctgtctcgaaatcagcgacttcgaagcagatgttctctgtgcggaagttctcccgagtaccaaaagtgaccggaagagtgatctggccgagtggtgttgccgatagccctgggatgactccgtggaagggtgcattactcggctttaactcggtgcgcgggatctgcatgtcatccagggttttggcgaagaggatattgagtgcgctgccaccatcgatgagagatctgcgaagcttgacgttgcgaaccactgggtctagtaccagggggtaccgccccgggtggaccactcggtcaggatgatccgagtggtcaaacttgattgttatctccgaccaccgaagatattggggcatatcgggctgaacagcattgatctccctttcagtcagattttgctttcttttagattcgtaagctagagggccgccaaagatatggttgagctccttgcggtgatcttgaaaatctgtcggggcgtcatcatcatcatccttctttttcgacgtgctttgttctccgtcaggggtcttccgtgcattcttggcatattgctctgcaaactgcttgtagacgaagcaatctttagctacgtggttggagttgggatgatgcggacattgggagttcatgatcttgtcaaaagtgttgacgcgcgaacgttgtcaggaggagtgtgtagtagtcgcgatgagttcctcgggcttacgcttgcggtccttgtgattgttacttccaccccctcccgtagtcggcgcgtctttctttggcttccaagtaggacccgactgcttggatgcgataatggcgtcttcggctttggcatactcgttggttttttcaaacatctgtttgactgtcttgggaggcttgcgcccgaacttgccgactagatcttcgtggcgaattcctttggtgaaagcggcgatgatgacgtcgtcggtaatgttggagatcttgttgcgctgttcagagaagcgtcggatgtaatctcgaagggattctccaaacttatgaatgacgttgtagagatcaaactgtgtgccggggcgttcaaaggtgacctggaagttggcgatgaagtggtcatgaagttctgtccatgatccaatcatgccacggggtaatccatggagccaggaccgggcagaatcagctagggccacaggtaagtagtttgccatggtcttgctgtctcctcctgctgcacggattgcgagaccgtagacggtaagccaagactccagattagtggtgccgtcatacttctcgattccagtcggcttgaagccggctggccaatccactcgacgcaggtcattagtaaaggcagctactccatccatgtcgtcgtcgtagcgatctggtgaatggcggtgacctcgtgctgcacggcgctggttaatcttatcgcgaagatcgacaggacactggcaaggtggggagcaaggccgttcaactcggcgctccctgtgtcgctcaggaggtgagtgaacagatcgctcgtcgtggcccctgctcctgcgattggatcctatgccggcgatgctgaggcttggctggtggtaatcatgagatcggagatggggagcccggctgccagtcggcgtgcggatgcttccgaagttaaccgggaccgaagcggcgatcatggtcttggtctggttcaagatgttgacgacgtgatcagcttgattgagtgcgtcttccttgaggagggtgtcgagaagggtgatcgcagcgacagcgttctgttgaggggtgcgaaagaccgctgtcccctcgacgtcttgctgcccgatgagatctcgcgctcgtcgccctgcgtccaaggctcgttgtcgtcggtcctcggcctcctttgcagcccgttcgcgttcttgttgctctcgccgcagccgttcttgctcttgtgcttggcgctcctcttccagtcggcgtcactcggcttcctgctgtacgcgtcgtgcctctgtttctcgggcttggcattgttcttccgtctcgttgtcggccatgaagacgccgaagtagagaggggtgtaattgtcttcaaagctttcgtcgaagtcgtcgaggtcgcagctgtcgtagcggtagccgaattcgtcgtactccacgatctctgttggtcgtgagtcgatgccgggggagctgaggtagccttccagttgatccgtcgaaatcgtgccgagtggctggagtatgatgccgacttccctggagctaggcatgatcggtgttgaagccaacttccgcctaggcctacggggagaagacgcccttgtagtgaagactgcagccaaatcgtcggggagtttcatcatgattggcgggtaggccccatcatcttgatctggtggtgtcggagtagatgggatctcgtccaagtggtttgaagccgactcgagcgagataagcttggagtagatcttggccgagttcggaataccgaacggggctgagacctggttctttcccgactggtttggatctgagtcgaggagagagatcttaccgaagtcgttggtgatgaagttgaggctgccgaaccgaaacgcctgcccgggagggaagacgaagttgtcgatgccggagacggaacccatcgcactgatcggcgagaaacttgacgcaacccctacctggcgcgccaactgtcaaaacaagatttcggcaatacttaaagggggtggctatcaagctagaaaagtggatgggtttgaagataaggaattttatacaggttcaggccttcttattcaagaagtaataccctactcctgtccggggatgattccgccgagtgtattattgatcgtatgatctggggaaaaaaggtcgtcccgagaggagcccggacccctccttatataggggaaggggtccgtattacaaaatacagtccatatccctaatggaatatgtgattacagataaaatataatcgtaaccgactaggatctcgggtattttcttgacatataagttagaaactaacccgagtcctcataaagatattctatctatatctagtaccatgtatccaactaaactataactgccgtctagatatggaatatccataatccccacatgtagcaagcgacagcgcggcgatgcccgacgcagcccctcgtgcggagccgagatggaggtgtggatgtgtagcgtggacggcagccagggagaagtggaggcaagccgcaagcaggccgaggtcggcggcgcggcgtggcgcgaaggaggcaggcggcgccacggcggcgcgtcgcacgtggcgcgaaggaggcaggcggcggcgcgacgcggaggaagggctggcccctccggtggccgggacgaggtcccgtgcgagtcgaggctggggagcatgtgccgtcgtcgtcgaggagttgccgagttgaggataactgaataagatcgagactcccctttttcctttcttttgttcacccggacatgtggtggggaactggagattagtcatgtgggcccaatcgaaatggacggtgggctactagggcagccaatgggctggaggcctggagcaacatggaagttgatactttcggtcttcggtttcttcaatttgtagccggtactgagagcaagtacagtaagtcacctataacgatatatcaagaagaaaaaaagaaagagaagtaagtgggctataaatttaattgccagtaacaacacggacttcaacacgttgtatgtatgaggtgggaccggatattaattgtgtaggatatttgtgtaaataactattgtatgaataggctattagattagttatagatgatttggagctaacatttggctatactattaaacttgctctaaccgaaccggtctctcccatcgtgcaaccgagcaaacgaccgaagaccgctactttggttttttcggtttcggtgtcgattttttaggtacggtattcggttctcggtttttatgctcacccctaatcgtacgtacgctaaccgctgctagagcatcaccaacacatcttaaaattttattcccaaatttttagttatggggatgcaaaaacataatttgaggtgttaaaaattttctcactccaagagattaggtaaaattggtttcctaaaaattaaaagggtgggccacgataaaacctccacgaaaaaaaatatgttttgcgctccttcctcccgtcagatcacgtgtgcatctcttccccgcacgtgaagcgccgtgattaggagccaaaacaagacaacacatggatatattccgacgaaaaaaaaatttagcttattatttaattttttttaaatgttgcacgatgttacaccaggtatatcgaaattgtttcactaagtagatcgaaaatgtttcactcgtttaaatcaggtgttgtttcaccttataaaaaaacaatgtttcagcaaatagcgaaagaatgtttcagttcactgcaacatttgatccatacatagtgaaacattgtgtacactaggtgaaacattttttttgtggaacaaaaaataaaccaaattcccttaatagggggtttccaaaatatgtgagttttttttttgcaatggaatatttcgttcactacaacattagatttatacatagtgaaacattgtgagtacactaggtgtaacatttttatggaacaaaaaataaaccaaattcccttaatagagagtttccaaaatatgtgagtttttttgttgcaaaagaatattttaattcactgcaacattagaaatagtgaaacattataagtaaattaggtgaaacatcttttgtagaaaaatgagagaggaaagtgggtgggccgaggtacacacgtggggatggttgtggaaaaatgggagagggtagtaggtgggccgaggtacacacgtggggaggggcgcgggggagcgtccgatctggctcccccgcgccggtcacccggctacaagtattttcggaattttgggaatgagattagatttggctcccatcggttgccattttacccaaaatggcttatttggcttattagaaaattaaaattaatttataagtaaaacttttgtagatttgttcgtagcgacttaaaagccaacattaacaaaaattacgttaaaagcatttcaaaatcaacttcaaaatcaagttcaaaaattcaaattttggcttattctttggctgtttaggccaaacgatggggctatctgataagatcaatttttttcaaaaaatatcttcagattattggatagagaataataaaccgattctgttgcactgttggtgatgctctgaatccccgccccgagtcctccttgactatccaaaagcaccgcccgccgccgtcgccgngacgccgcctagaaaaaatggacgcgctcgtggtgcggcggctcggggaccccacgctggcccccggcggcgaggcctccccgttcgcgccggtcaccggggaccacccggcgccggcgctcgcgtcgccgacgtccgtgcgggtgcgcgtggcggccaccagcctcaacttcgccacctacctgcaggtacagggcaagtaccaggagcgccccgcgctaccgttcgtcccgggctccgactacgcggggttcgtcgacgccgtcggccccgccgtgcggaggttccgccccggggaccgcgtctgcggcctcgccgccgtcggctccttcgcggatctcatcgtcgccgacgagaagcagctgtgagttcggtttttcgcctctcgctgcctcgtatggtgatctccgtttggaagattagcttactccaagtggctctctctttggaaatccccatttttgggttaatttatcagtacatgccttaattagtgggatacagcatcacgagttatatttggttttctctttcaattgtcggatgcattttcttgtatgtagtcgattagttgttgaagcatttctacatcggcttatatctgttcgctcttctcatgtccgatcgtagagttaaactttctgctagttcggtaggtgctatgcagattttatagcttatgagaagggttgtttgcttttgggagtaaatgtttctttttaaaaactatttattctatgatatgtctaaatatggggatgtgggagtgggagagactatgctggttttcgatgaaaaagatgagaatgttgctgtctgtctctctatagatagttaagccttgatcccctaataaagaggtggaatctttcaattgtcgggatgccttaaaaaaggcgatgttaatgttgtagtgaggactggattgtattttgttttgttatttcagcttgatttcactagcaaacaaagcgcacagtatgtctcctgtttgtttatcttagcaatatgcaatgtataaatcaactaatacaatagctgcacttgtggtggttgcagttgcagagtaaaacagttagcactgttgtgaaataaaataaaggaagcaaatgttggttagatacttgtatatatgtgaatttctgaatttttgtatatgaggggctatctgtagttaccagaatttttttgtaagtataacatgcattttaaatcgttggatcagaatcataatcagacaggcgcacatctcaaagctaatgctttgtgcaggtctgcaggaaaaaaatgaattgtacttggccaataatcagggaacttacacaatagagaaacatcttatttattctggtatgttctattgaatcagtgctatgttctttcgaatcagattttcggtgcctgatggatgtgaccttgttgctgctggagcattgcctgttgcatttggtacatcgcatttggcccttgtacacagagctgaactaaaggctggccaggtgcacccctgtgttaatctctttgtttataaaatgcctataagatatccatttggtacttgtgcattgttcatgttattgttatggacattcatcatggatacggcacaaatctcctttggaatggccatccacattctcggagcactgcattgagtaaatcagcatctctctgctgctgctccacatctctatatccataattactgttagtgtgttaagttatgtggcagtggcatcagtgtcttaccttcgtttgtgacatatcatgtacacacaatattatgagctagaccgcattacctcaaatggctcattttgatggccattattggtcaaacataggccttgtattttatatttatgaaatttattatgtcaattttctatataacttaaattctacagtttctatcatagaggtgaacttctgcaacagtacccaaacatccacaccgttctgataaggtcaaaatgttatggatgcttattcgtggataaggaagggtccacagattgggataaaggtccacagataggataccacttaactattccctatccttgaaaactaaaatcatctaggggcatatttctaatgctacagtgtacaggcactgttcatctgcagtaccgttaccatagcaccattttgttggtgtctccaattaaaacccttccatttaggacccaccatctgatgatctgatacaggggttttgattattttattctcacattaatgaaatctgtcagtactgttctgttttttaatggtactgtagcagtaggactagggaagcatttgccttccaaaataagaatatctatactatattgattaattaattagcttcctggcatagagaataattgtttgtatcctatctatttgagatatggtttattccgaaggtcaggattctaagcttgtttggttggtgacctgggcgtcatgcctgagaaaaatatgtgcctgagtgttgcatgaggtgggagtggttcatgcctgagagaaacttgtttggttggtgacctgtgcctgagaacacttaaaactaatattatctggcatttttctctttttaagcttggagtttaatcataaatccaatatagatacttaagagatttaacaaatatttttttttacatagtctcataacatatctttagctaatcaagtggagagcagttcagcacgtttgccaatcacaagatagtgcatgcaaaagaaagcaaccagctgcagcgtgagagaattactttaattcagcagttagtagagaagtacttcggctaatcaagtggcctggctctgcatgcaactgaggtcaccaaatttggtctcctgactcaggttggttgagctgccggagagcccaggcctggaaaggtatggagcgcaggagtggctcaggcactaaccaaacaaggtgtattttttctcaggcttgtctctggctaggcagatttgtctcagggtggcaaccaaacagcctaaggctgtgtttggcaccgcatgttcccaactcctctcccttctattccgcgcgcacgcttttcaaactgctaaacggtgcatttttggcaaaaactttttataggaaagttgcttaaaaaaatcatattgatccatttttgaaaaaaaaaagctaaatacttaattaatcatgtgctaatataccgctccgttttccatgcacaggagattggttcccatctcttccaaacgaattcagcctaaatcttctaatgggtgaagttactattcactcaaacctgttcagtaatataccaaatcatccctatgaaagggatgcatgcacctctattatgattaagcaataagaagaaataagttaggtctagtttgatcagaaattcagaatccctcagcaatccagcttggcaccaatgagtgcgatcccatctttgtgcaggtcttcattctccatcggtaaatcaatgtccattacagtttcccttctttgattaagagtcagctaccaaagctcctagtaacgatatacatattaagatttctagtgagtgatgcttgtcttagtattgtaatgcaaaacatagttaagacacatgcatatagctttagcaaacataaaggttataatgctcggatgtgctcccagtacattgtcggatattgttaataaaggttgtgattgcaggtgctacttgttctgggtgctgctggtggtgtcggggcatctgctgtacaaataggaaaagtttgtggtgctgttgttattgcagttgctaggtgattggtgtgatgagataattgttgtacggttgctattgcatttcaccaatttgtgttctcttcctaaatatcccctttttttttcttgactttaggggaactgagaaattgcagtatctcaagactataggagctgaccatgtaattgactcaagcaaggaaagtattatggaaagtgccaaatcttttttaaaagccaaaggcctcaaaggtgttgatgtcttatatgatcctgttggaggcaaattaacacaagatagcctaaaacttctcaattggggtgcacatattctgataattggatttgccagtggagatgtaccaattattcgagcaaacatcgctcttgttaaggtaaaccaattttttttgtggaatttccagaatttttacttttcaacacacagctctatgccttatttgtatgcactccattgtagaatcagaatgatttaatcactgctgacttttattcatttctcttaagagcatcatagggaactggattcactgtcatgtaccttgtttttgtgcaccgtataactattttagacaagcttccatttgcttaagaggtgggactggtcctttctcaataagcgagagtctgatatgaattctgatgaattattgattgggcaaggttagcctgaattcattctcattgaaactaatttgaggattaagaatcctatgaattaagaaatacttgaagcagacaacagtagtgtaaagattgcatcagtggaatcagaaaaaataatatgatcaaccaatctaaagttgaatttttagaagactttgaatttgcacgatagctttccagctagaatgtaaaatggaattgctggggaattcagaatatttgattgcagataaaatgtcttcatacataacttttttttaaaaaaaagaaaacgagtaactaattgctgctgtgctgtttcagaattggacaattcatggtttgtactggggaagctacttcactcatcggccacctgtactcattgactccctcaatgaactcttttcatggctttcaaaggggttgataaaaatccagatttcccacacttacaggctccctgaggtaagcgacaacattttaacaaaccttattataattacagttcttgtaacactaaccacatgtcacatgaaacgtcgcatggcccaatcaatcttgaagacgacacataagtcttgaatgcaaaaaacttacataaatttcattagagacagctctgcacaatatttatatataactcccatgttctgaatggatctttcatttgtaatgtgagcttttcatcagctaggatagcttaaagttgcttggcactttttgcatcatttggctgccatattggtttttgagattacgatccaatcttgttgatacttataaagtcaaagtagttccagtatactaaaatgtacttatgaagcaactaggcgtgactgcctgagcatgtcaacacggacacacgtggtaatatatgccagtggtgcatcttatctaagaaaatggtactgattttagtcaatttctggctttgtatgctgatcaactgcccagattatactgtactgtcagccagtcagaataaggaccaactacgtgggttttttaccatttgtaactactgttcatatct

SEQ ID NO: 68319 - DNA, 1024 bp, Oryza sativa
atcaatctggggttcgccttctactctgtgctgcgccgtcgctcgtagattactccatcccgctcgccggcgtgcaccggcgatcgggagagcaggtctccggaacctctgccttcgacgtcctgcaccgggagaaggcggcaataaggtttttgggagacgagggagagagagagaggtggcgttgtgcctgtttgccctctctcagatcggcgccaccgccaaccactcactcgctatcgccaagatcgaaactgatcggctgcacactcgctctcccttgcaaagatcgatgccgccgcacctcatcttggcgatcaccctattttctcgctcaatatgcgccaatcacctctcggacaaatccaccacaacccctccctcccagccttagctactccaagatagccgccaccgctccttcccacaaccaatttgataaagaaatcaatgcaattgtctttttttttttggtttaatctaccacaggtaatgctccacttccaaaattacctgacaactacaacttactgtttttgaagatagctgctgcgttgaaagagtctggtcttggatcttcttggttttgacttgaccaaaagcaatggatagtcaggtctatattactgtttcatgttgcacgcactagttgtttcttttaagactttctatcaattgtacttgagtatccgttttaaaattctatcaattttaaacaaacatttttttctgctgaatttctgcaggcacatattcctttagaagaaaaatcttcgcatgctttgctttgttgagttgataaactgggtcaaaacgggagacctaatgtgcaagccttgactcttcttgacagatgacagattttgtaactatctgaatttgtcgtatgaaaactacagatttcattctcacaggcataattgcagactatcaatactttgaaagggtagctttgtccagaggttcgtagtaggtataacatttttttctcgagtacggtaggtcgatagcatttatctactca

SEQ ID NO: 68320 - DNA, 21179 bp, Oryza sativa
ccatttggcgtaaaagaatagactaaaaaccgaaagcctgatgtttcaatagtttgtcattttgtcattgactgtgtattttgatccatcaaattgagcaagagaatatattttttttgtgcttagatcctaaaattaacaagtccatcacttaccgtatgagtattcccaccaggacggccccatggaccagcagtgtgctgatgcccgctcctgtcactatatgaaaatccgaatgattcgacgtagtcagaactacatattgccacactttcaagtcgacatggtaacacgtcgatgtcgtgtgcctccccttcatttgcaccccatggcccaatcttaacaaccgcagcctcacaaatgcaaatagatgagaagccaaaagttagaacggaaataaaaaaaaaatgagagagagagacaggaggtgtactaatcaacagagtacctcatcttcgtgtgttgcatcctgattagggttcacatatatgccaaatgcgtctacataccaacctacacgtccaaagaaaccaacaatgctgcctttaatttgtataggaatctggaatggggttcctcctacttgaccgtaaggtccgtaagtacgggtatttgtgaccaaagtaagtgatgttataataacaccatatggtgagctagcgattgttccagaaattcccgttagatactctgataggctgaactgaatctgcaagcatttcaaggagaaaacatggattatagcagaagaaacggaaaactaagcaattagcgcatatgcgcgcgcttttcttggctttcttgtgagaattcggaactaatccctctattaaaaatcatcgcaaactttttaaagtcaatgagacgtggtttcaactatactccgatttaactcttgtttataaataaagtattttacataatgacatataatatatattatatatggtgttggacgtacgcatgctgaccgtggtccgacgactatatattttggtgtaactctgatacatcattaacattcataagcccaaaacatgaaacaacattcctttttacttattaacggggtaataactttgaccaagtacatttactcttaactgtatgtaatgaattgtctcttaatataacagcattccttttgacttaaggcagtaataactttggctaacatttacactcaccgtatggttgacacctttatcaggtccatcaccgccccatggacctactttgtgctgctgtccattgtagtcgtagtatgagaaggcaattgagtagatgacttcaccacaaccgatcatcaagcttcctagacggcagggtgccacctcaatatcacgataattacctccaattccaccccactgcccaatcttggcaatcctcacctgagcatatggtaatgaaaaattaatgtactactacgtcgtaagacaaatgggacagctagcaatgccaccacacactttttagtggcagtactacttaaaaattaacactaaaaagtgtggtataaattaatctatatttttcttcagaagaagttaatgtatattgcgaagcattatcattgtcatggtggaatcctggtgcaggactatccaccaaaatttaaatcatggtccacataattaaatatggttgtgtacttgtgtgcagctagccctagttgttatatataattgctttcttttttttttacctagttgttaaataaagagaacgaaaattatcgcttcactatccaaaatagaaaaaaaacatacatgggggagataatttatactccttcggtctctaaatatttgatgccattgactttttcaaacatgtttgaccgttcgtcttatttaaaaagttttgtgaatattattaaagaaacttgagtagtagtagtatatttaacaatgaatcaaatgataggaaaataattaataattacttaaattttttgaataagacgaacggtcaaacatgttttaaaaaatcaacggtgccaaatatttagggacggagggagtatatagtcgggtataacatttttgggaagtctgctatatgaggttttcagaaagcatgcctagaggtttagcaatacggtgcgaattataattctttttagttcatttgttacgacaatctgttgcatgccttttgcatttgattccgtttggagtgggggcacttttagtagatgatcatatataccttgttccaggatgacattgaactactagtttcgtctatctgtttcaattcacgaataatatcccgcatactaggtctattctttctctccacctccacgcaacgtaatgctatttcaatgcatctttttaatcgttggcaatcttcttcggttgatgcatagtttgatgttgcctccatcctatccctccatttcttgcatacctgcaaaattgtaatacaagctatagatgataacatataccgttgtttttctggacaaagtaacatacgaaatgtcttgtaaattaaattagcaaacattcgtcgcctgcccatggggtagaggctgtagtacaaatcctgctacctattatatataaaacctatcatgcgaaagtgtaacgtaataatggataatatttgatgaaataacaattggatctttatcaaaggtaaaaacttttcttacaagctcaataaattgttgggggggcatgtcatcacatttggaatatcccaaaggacctgctattatctgcaggattataacacctaagctgaaaatatcatacttatttgagatttggcgtctctgtatatactccggtggcatgtaatacctgcatggtagcataaatgccaagcagaatgcggtgtataatttcttaaacaggcactgtttgactgattacataaaaattaagaagattgagtttaaataagaaatttactaactcggtgcctttgcaattcctggtggtatgagtttgtgttccaccgaaaagccttgataaaccaaaatctgcgatctttgggtccatgttcttatcaagcagtatattggcgggtttaaggtctagatgataaattgactctttcaatcgctcatgaaggtaatataaaccttcacaagtccctttgattattttgtaccttgtgcaccaatcaagtccatgagattcttctgcacaagtagacaaaatgcatctaacttacgtttttgtaaaataggtaaaaccaaacctctgcatccaaccggatggacacagccaagcaaaccaactaactacaaggtaaattgaagaaatcatgtagttctttctgtaatcaaagtgcaacgtaccacatagatgcttgtcaaggcttccattctgcaaatattcaaagcagagaactctgtatatgatactggaaaaaacaaattctcccttgcgctcgatatgcgttttatgtacttgataacaatatccaattaaccttacaatatttggatgctgaatcttcataaggttattgaattcattcctaaattgtgtatcatcaatccctgacatatgataaagcttcttgacggcaatttctgtccctgctctttccactccctgtttgtgatatatatctaatagattagtatcatatatactcctggacaactttggctacactttcttactttgtggccacctagggtttatccaatgactaagccccctgtttagatcccaccctaaaattttacaccctgtcacatcgaacgtttgaacacctgcataaattattaaatatacgctaaaaaaacaaattgcacggattgtgactaatttacgagacgaatcttttaagcctaattgttccatgatttaataatatggtgctacattaaacatttgctaataacggattaattaggatcaataaattcgtctcgtggtttactgacggattctgtaattagttatttttattagtgcccgaataccccatgcgacacccaaaacaatatccgatgtaacacgccaaaactttacaccctggatcaaaacactcccctaaatatgcactgaaatttggtttcaggttgaaatcataatggatgtgacgtgttgtcgacatgcatgggtgaaacacagtggcgcatagtgtggaatttatccataataaacatacaatcacaaaataagttgtaccttgtaaacttctccatacccaccactcccaacttttctgctgtctgaaaatccatctgtaatttcttctaaataacgtaatggtaaatcacgtgccgtcatccgtgaatgatttcacttccccctggttgttattataacagtgttatttatcagccggccgctttcacaccctttttaaatccactagaaaatatttcaaatatacaagaagataaatgcacgatttgtgttttttctaggtaaaatgttgcaacatgcatggacctttaattgctcataagcaaaatcatcattaaaccatgtctctacgctaaaaatgttgcattcacagaaaaaaaaaatggtcactatggaatgctagatacgtgttaggtatatttcgggaacgtgcgactaattcattcttcgccaactcaactaggctgaaccgctatcaatactacaaaacatcaaataaatatcagcactataggtaccgaaagtgataaaacgacacatataatgtcttagccacccacgcgccgacccacgcgtccgtgagcccggcaaaataccaagaaccggcatctttatatcctaataggtgccactttataaaaaaacagcatcttttacctttgtcagatatagaaaccgacatcttttagttggtgtgagacacaccctagacacttttgtgggaaaaaaatagatgactgttcctttgtcagatatagaaacgggtatctttaagttggcgtgggacccaccaccatagaagcggcacttttattgggaaaaagaaatagatgacggttcttagaggaagtttaatagtatagccaactactagctccaaataatttatagtgaatgtaatagctaattcatacaatagttgtttactatactattaatatctaatcctacctatcataaacacattacgtcttggagtccgtgctgtagctggctacaaatctatagcccgctgcttttatctcttttcctttactggattgtttagcatatactaaggttaaaagaaaaagaatataataccccttaattaataatacatagttggatgtgggatggtggttaggggtagaatgaggagaaatttaaattggaagtggttaatgtgacatgtagtacttcaaaatgacaactattttagaataatttttaaatactagaaagccaagtatcgtgggacgtaggaagtatgcttatagaatgctattgtacggtacctgctcttagtcaaaaccgacgcttttcatatatactgtgtttagtttccccctattcccaactttccatcatatcatatcatataaaaacttttttacacacgtaaactttcaacttttttttctaaactttcaactttttttagaaactaaacacacccataatccgttggtgtctggctgtaaagtcaaagtggtcaaaggggaggggagatgtgggtcccgcgggtcccacttccttttctcttctttcttctagtctcctgcttctttccttcctcccttatctcttctctgcttctcgttcttttctctctctctctctctctcctctcgctctttctttctcttggccgagcggagcagcaggggcgggctggcacggcggggcggcgcggaggggagagggaagggcggcgccgggcaaggaaggggaggaaggtgggggcggcggcggcggtggaggccctcgcggccggctcgacctggtgagctctctctctctctctggaacacgaaatgtcgtctgctcagcctctattagggcatcgatctgatgagggcctccaccaccactttgccgagttgggatttatttcagattctacacgtacctagccctttgtgttagagagtatatagaatggaaccctataatatatagaatcgaaccctttgtgttagagatttaaaatagaatgccatctaatctgtttttctgatcttgagagatctgtcgatttttttatatgatatgatgaaaagttttagtgtcagcaggtatcaaagattattgtgatctaaatgcagttgtctaccttcatccaatgtttctataaaataaattatgggctgcactagctatgtagtgctagaagtgaaccatttaactttcgccggattgaagtgaaccatttactctgtaatggctttggtttagctagaagtcaaccattttactttgtaaggccttattcggattagaggatttctagaggatttttgaaggaatcctgttcaataggaatttttcctttcctatcattcggatagcaaaagtggatcacaggaaaaccaagggaaactttccaccgcccttgattccaagggagaaacgcaggaaaaaatacatggactctgacctctttttttcatttccttcacgtaagaccgaggaaatcaagccctaatcagttggagtgacatgatgggactaatattttattgcttaattagactataatctatgagattactgttgattggaaaattcctatagtttatatattcctgtattccgaacgctccacaccatcaaattcctatgtttttcaatcctacgttttgcacatacaatcctatagtattcctgtgtttttcctattcccatgtttttccaatcctttagtccgaacaagccctaaatgtctttggttaagaaaaggttggtaaccattaaccaatgctccctgtatttaaacatgttgtcatttaaacagctcctattttgtcatgtcctcactataagagtaatgattatgtcttatggttaaatctaatgctttgttgttcagcgagagtatggatctttaattttattcgcccacatatgcttattggtaacgctttgttggactcctgatagggcgcgcaatgcgtgcaaattgtctagtttaatttgtgttttatttggttggccttggccctatgcacttatgcagttaacgttttctccaatgcgaatttgccacgtatttggttggatgtcaggatgcacattgctgggattaatttaagggatgatgactgactgcatcacttcagctttgacttatgattttgtttaatttggatgttggcacaggggccgagcatcccgcattgcaataagcagacaactggactagtccaaagagttgtacatgagctttttcaatctctacaatcatcagaaagcatcgctatgtggagtgtgaagttgccgatggtaaacgttccagcctcatgttctgaatttgaacccacatcactaaatctttactcacattgatatgccatttctcaggtggagtatctggaataagtaaggtcagtgtttgtcatgggcattgggctggaaggcagagacccataggcagcccatatcaattaagttaggacagcattatttgttaagttgaagataagattagattgagttagagataagattagattgaatccttacttaggggtcaagctatgccatctatataaggatgggattgtgtctattatcatcaagtaatgaatatcaattagtctaacctctccatcccaataatgttcttctccgtagcctagatctacatcccttctccaagagccgacgccacctggctatcttcccggcagtgtttatcctgtcatggcctcgggtcatgacaacttggtatcagagccactcaccatagcttctgatgccgagtgagttctccgtgtcacggtgagtcatctattgtacccggtggatgagtatctactccaccaattgtttgatggctatggagtagaaaagaagattgaagtgcaccagatgggaacatatgtggaagcctctgttccgtttcaaactcgagcagccgctgagcatgcttggaacctcaacggccgtgccatctatgatggttgttggttggacatacagtgggagcaaccgtccaacaactccacgacaccggtgacatctctctccatgatcatcacggagtggaaggaagacatcaaggagttgagggctgtcctgcaggacttggtagcatttttgcaggaggagctggcaaaagaaaaggaagaagggcggcaatgggactaacggtgacgccggcgcttgatatgccatcaattcagtcaatccgtccagtggcctccatgtcgtcacaacttcaagatctccaagcgagcagatctgcgtcacaggccatgccaaggcggccatcgacctcttggagttggacttggcaacggcgtcatcgtcggcaaggtggagtgatggaggcgagcagagccgttgttgtgggcccacgaggacgacgaatgatggacgaactatttccgcgagctctagatgcggcagcggcggcgctgatcttggaggtggcagttggtgggttggatgggcggcacgtcttgctgggcgagaaagaaacacatcaacgccattcttttcacacagtaggttcgcgtcctcattgtttggaggcgctacggacgagagaagctgacgatagggttttttctctgcttctaatgggccgacaactattcatttgggtcgatcaagtggagtggccttccagtgccgcaactcatggcttggctgttgggttggccaggtagacctcggctgcagactaacgggcccatcttggatgtgagaccttggcccatctacaacatccaagatatcatgtgagataagtagtattaaatttaaatatagaaaagtggtgtttgttttgaaagagtagtgtctagtactagtttcttgatgatgtggagtttatgtaaactatgtctagtgtcttgggttgggactagccgtagaatttatatggagttgcattggttccaggcttgtggcacggcatggcctcgtcctttctttacgagacgtaggacgggatccacctcctgctagtagaacatattttttcgtattggctttatcttctattccaattaatctaataagtcgagatgtaaaaagcttatgttatcttagattggagtcatttgagtttagaagtccgtgttgcagctcgaggacgagctgctcaaaaggaggggtataatgtcattggcattgggccggaaggaagaggcccatatgcagcccatatcaattaagttagatataagattagattgagttagagataagattagattgaatccttacttaggggtcaagctatgtcatctatataaggatgagattgtgtctattatcatcaagcaatgaatatcaattagtctaacctctcccttccaataatgttcttctccctagactagatctacatcccttctctaggagccgacgccgccaggctatcttcctggcggtgtttatcccgtcatggcctctagtcatgacagtgttgttgagaatattttcttatgctttctctgtacagattcgaatgttagagagtatcaaactttatttcattgtatctcagggaccttcttgacttgtccaaagacaacctatagatcaaggagagtaaaactcaagggatctacatttctagagcaacagaagtaagaaaaaagtgcttaagatatgtccttgtgttttcaatttgacataggaaatttgcacctaggaatttagacttaggacatatatatgcaaatgttttcaatttagacttgggaaatttagacttaggaatttctgtcttaggatatatttgcaaatgtttaggatttagacttagaaggttttgaacttaggatttttagacttaggtatatatatttgtaaatgtgaatgatttggctatgaatatgaatgtgcctatatgcaaatgtgatgtgaatgtgaatgtggctctttgttggtgaatgcatgtgaattgtgtgatttggattatgtggttgtgaatataaagcatattggaattgtcaggtgctgctatttgtatgtgaaattgtcaggtattgctatttttaatttttttttacccaacatataggtgccagtttttcattacaaaccaacacctattatgcttgccacgtgtcccttttgggctaaaaccagcacctatatatgggatttataggtgccggtgttttaaaaaaactggcacctattaggacaaccacatggctgagttggaataggcacatttctcccctaataggtgtcggttctaacctaaaaaccggcatctattacatatatagatgccagttttgaaaccggcaccaatgaccgaagtcatcggtgccgtctccgtggtgccggttgggaaatccggcatctattagggttttccaactggcaccgattagggtttctgtagtagtgtatgtgataaattattcgctaaatgatgttgatatgaggattacggatagcatgtgctaagtttcaattacggaattcgaaaaagaaccataaatttatattatatatcattagtaacaccaagtttcacttaaaatctaaaaagtttagagtacatatttaattactcatacatttcatagctaggaataataataataataataataataataataataataataataataataataataataataataataataataataataataataataatatataaagaaggcacacgactataagttatcccatttatacacgtaccaaggacatgtttatcaacttatcattcattatcattgttgtaaccactatctatagcagtcttatctctctagttatagagagaggagaggggtttcgtctttttaggtctctgaaaagccagttcacatgcgatccaataaaggaggcagtacttctgcctgaattcctctagatcctacccgtcggtattaccgtggaattatgagaagcaactagttggtagccagcttctaagaatctgaaaatgctggttttctcagcttctggcttctaattaattttttggattgtacaactatagtttattaaaatctagaaaaatactgaactatttggggagcttctgattttgggagaagctacagctgccagaagttctaccaaacataccgtagcgaacgctaaatatttgcacctaggattaattcttgcctgaatatacaaaactaaagctgatttcaataattcgtaaatctttcttgacattaaccatgaatgtaaaccctacgcccgacatagctaaatcaataattacgcaaacaaatttgcagggaaagatctcttttattcccaccacagatagtaagtaggtggaatccggccagaatgagcggtcgggctagatggtacaggtgaccatactattcctctcctcaatcttttatagatgctggtttgtctaaaatcaactcctataaaaaagttttcattttttattaggattaaattaaaaacgggtacctataaaccactcactgtatttatttcagacagtattccataggacagcatttgagtgtctcctatggaaacttttccatgatatgtacgggccgtcacatacagccaaggcagaaatagcagaaaacggactagccaaggcgtaaccgcgtgagtcaacaaagcaagcgttatagcggatactaagtctagtggccgaataatccataacaaatactgtagatatactaagacttcacgactctcttagcacaataagataaacacactgagtcacattgaaaaatagcggatactacgtctagtggttgaataatccatcacaaatacggtagatatgccaagaccttgcgactctcttagcacaataagataaacactaagtcacatattgaaaaattagcggatactatgtctagtggtcgaataatccataacaaatactgtagatataccaagactttgtgattctctttgcacaagaagataaaagctgagtcacacattgaaaaatagcggatactacgtctagtggtcgaataatccatgacactgtagatatgctaagacttcactactctcttagcacaataagataaacgctgagccacacattgaaaaaaagcatgtgttgcatcactacgtataaaatgtggaactaattaatgatgaccagtacatattaacatcttaattgttacctaaagaaattcaagcaaataaatcatctatattaagctagcagcacatcggtacaaagttcatacgaaacagtggccttgatctcattcatatcctagccctattgtgtggccatcctgcaactggaatttggtattgcattcaattataatgacatactcctatgtagatatcttttaattaaacttggaccatcagtattttcataaatacatagtttaaaaacaaaactaatgatatacgtagatttgttttggaaagtgctattacaatatggtattggactttacaaacgttggccctgttcgagaacccaacaaagggggaataaagttttggatcttcgtggcacgtttttcaaactactaaacggtgcgtttcgtacaaaaaatttctatataaaagttgttctaaaatatcagattaatccatttttcaagtttgtaataattaaaactcaattaatcataagttattaccacctcgttttacgtaaaacacttaatcttcatatttattttcacgagatttaaacaaagccgttatatcaaatccattttgttaaacaaaagataaaatcttagaataaattgcacccacggtgtatcaaattgacaggtgggtgcaatttattgcaagaacttgaaaaataagcgttccagtgcaacaacttggtaggtaagtgcaatttagtataacaattttataagtgaccacataaatgcaacaacttgcagggtagatacgattttgatataataaataaattgttatgcggtaacttaattatttgcagtatatttatatttttatcctaataactaataactgaaagtcaatttaactgaatgtagaaattattatatttggttgatatttgagaaggtgaagaaaacaaaaaaaatcttaaaagataattgaatgtaaattgtatgtgcggtataattcttaaagattaaattcaatattataaaataatatccgtaggattactatgtgatggcatattgacatcgtgaaaaaaaattcacctagcatatgcttagtcaaattgatgcatcaaaatattataaattgttaagttcttgtactagaacgtacctacttgtcaagttgttgcactcggacgttcaattcttaagtttttgaactatatcgcacccacctgtcaagttgttgtaacatatatataatttactcaaaatcttattttcaacgttaaaattaattcagcagagggaaggagtagcaacaaacttagagcaggtagaacgcgcgagtcatgaaaattaagaaccaaaaaatttcgcatcgatcgacaaaaactgagcagcaagcaaatgtgtggaattaataacaactaagtaagaaggtaaaagctaagtacaaaagtctcaccggactaggctaaatcaaggcggagcgtgcagggtcggatagcgcgacaaacgaatgcaaagttgtatatataaatacttgcgcgcggctgcgatggggggaaaccgccaggcaaacacgcggggggccgcattgccttcccaaaacgaaaattttcatgctgtcacgtcaaatatttggacacatgtatagaatattaaatatagagaaaaaaaccaattacacagattacgtgtaaattgtgagacgaatcttttaagcctaattgcgccatgatttgacaatgtggtgctacagtaaacatttgctaataactgattaattaggcttaataaatttgcctcgcagtttcttggcagaatctgtaatttgttttgttattagactacatttaatacttcaaatgtgtgtccgtatatctgatgtgataaccaaactcaaaatttttccgcaactaattaacaaggccttagccacgcttctctggcctgacgctttaaggggacgaatgcaaaaatgagcatatttttttatgcgtcctctaaaaggccacataattttcacatacggacccctaagtgatacaaatgcaaaaatacactcttttctccatagattttttttctcccctccactctcttttccctctcaacacttcaaattttttttcaactcctcccctctctccccctgtcctctcttgattattctctcctttctctttctctcttctcctctccgagcaggagcagacgccggcggccaagagcagctgcagcgacgacgaatagcagatcctcacgacggtgtctgcgaaagggtcggatccactgcccttgggagcagctacggcgacggcaggcggtggatctggctgcgccaccctcgggagggccggatctgtcgccctacatagcggctatgatagcgggctgcaatggcgccgatgcagattagagttttggatttttcaaatttttatttttttcatcaaatttattttcatagatctttgagtgcatgaggatcacccgttcacatgaaaaaaaaaacacttttgaccgttcgtaaaaataatttatgtagtaatgaactactcaagagcgagacacagtgatacatctcctcagtgtatgtcgcactgtacgtcggtagtcgtggtgcctcacggttatatagctttatagagtaggctatggcttcttgtaaatcacaaattccactgtcacataagacaacaatcttaaaattatacatcataataatactatgaatttagacagctcaatcctacattgctatataaacgctgagatagtagtaaaatacaagtaaatttcccgttatctgttattgatttgagcctttagttgaattagttgatgtatataaatcaatatgatattagacacataatttttgagtttaaattttgacctgtgcaattaaataaactttttcagcctactttcattccacgtcggatgattgatacctgcaatataagtgtattgcccgtatcctgaaaactgagttggagcataattgatgaattggtcttttcttgtaagctcaaacttttgtgtgtgtgtagggctgtcaatgagctgagctcgagcaagctcgtctgcccaagctcgagctgagtctattgcaccttcgagcttctaggcaagcttggttcgagctcgttcaaacttgagctcggctaccaaactcggccataagtagtataatatatattttaatgataatctcttgataagtataattattttctagttaatcatactaataaaagagtagaaaatgattaaaataaatatattgtactaacacatgctaatttattgtgtaaatagatactaatatatatttatatttatctattagtttattatattaataaggtgaacatgcaatataaactatacacagtcaagctcggcctggctcggtagaagctcgagctcggctcggtaaagctcgcgagctcttgcttaggctcaggttcgactcgtttggagctcgagccgagctcaaatcgagcctaggacgagccaagcttgagctgctcgcgagcctcgagttttttttacagccctatgtgtgtggatcttggttagagtagtaccaacattagacattgttaacacccaattttagcatctatgtatgaaataggaaaacatttccgaatttagaaaggtggttttcatcacggtgccagtctgactagtgacatctgagtcgtactccgagcccaattacgtcgggtcttgggtttttttccttgggctgaggttttttttttaagttctaattgatgtctgctatgagtaagatgtggagaggaggtcctgtaggcagcaaaacaaacccctttgtaaggctatggccggtttaattgagcacacaatctatttccaatacaatataaccaattgaattactttttttcaatattgcatctactttttgtctagttctagcctagctttcgtttattttcattggtttgtgctaaaatccctccgttccgccctcgaaacgggtatttatccctattcgtctaaatcggctccgctagctggttttaacttacataactcatcttgatttagatttttctagatcgatgtggtaggcgacttcgtatgactgcaacatattaggtgtttctatcttgattggcggcgtgaccaaaaagttgccaacagagatcacatatcatgtctacgtcatgtatatgaaactactcgatccctctgctctaaagtacaagcctttctatgtgttcctcaaaatatttcgaatagagggatgtgcagatatatgttggaaaacccgtataaatgcttacatgttagaagaaaggaaaaagtaagaattacccctctgaactatcacaatcgatcaaattacccccataaactcaaataccagatatttcaccccctaaacttgtaataccagatacccatatattctgtgcgctcccagcgacaccgctgtccgtccactccaccgtcctcctcggtgcggaccaccgcttgccgcgcccttcccgcgacgccgctgcccgtcccctccaccatccgcctcggcgtggcccaccgcctccaccatcctccttgcccgcaacccgtcgcgccctccccgtgacgccgccgtccaccgctgtcctcactggccacgacgctagagagatgagagagggagagagcagaatgaaaaaggaagagagatgggtgagggggagagaagctgataggtgggtcccatcgatttttttttaaaaaatgctgattggactgccacgtgtacaccattcataacgaaaactgctttagattgagtcgggggggggggggtaattcgcccgattttacaagtttaggggggggggtaattcgatcgattgcgatagttcagggggtaattcgtactttttcctagaagaaacgatgttcaactttatatgcaaagcttagttaagttttactactgggctacaaacagtttgttggtttaccaaactactaaaaaaaccctgaaagggattggtcttataggtgtcggttcaataaaactgtagaactggcacctatgggcattttcccacctccgcacgatgaaaaaaatatagaaccgacacctttaagcagtataagtgtcagttttaaagaaaaaccagcactaatattataggtgctatttttttaaaaagagccaacacctgtacttgtattattggtgtcggttcaagaggaaaaaaccggcacaaatagtataagtataggtgccgttttttaacagaaccgacacctataaaataagtataggtgtcggttttaaaaaccaacacatatttaaaaaaaccggacacagagctaggtctttatccactcagccacgccagccacatctctctctctcccctcctctccctttgccttccaacggagggagcggcggtggccgacggaggacgggccgtggccctctcccagcttggggcccttcccccttctcacctactccagcggctggcccaggtgggggcggtcgacacggaggtcggcgcacgcgcggccaggttgcggcggcagcgacggtggtggttgtcgtggaggaggcgccagccccctctctctcccggtggccctccctcctcctctccgccgctctcccccttctcctcctctagatccattggcggcagcggcggtggtggtggaggaggctcgtgaggtggaggccagcgcacgcaccgcgaggtggcggcggtggtggaggaggctcgccagttccctccctctcccaggggcctctttcctcctctctctctcccaccctcccccttctcctccttcagatccgttggcggcggtgccgttggtggtggaggaggctcgcgaggtggaggccggcgcggcgcggaggcgggcagcagtgtaggtgccatcgtcttttttttaaaaaaatggtataggtaccggctttagaaccaacaccaataagattaaggcaaaggtgccgatcaataggtaccggctgcgaaaccagggggcttttaactatttgtgtaacatcccggcctagggcttaataagattaatagaatactcatattaacaagttacaacttcttttccggaagccaatctccaaagaactccagggttaagcgtgcttggcgtggagcaatttgggatgggtgaccgaccaggaaattcttcccgggtgcacacgagtgaggacaaagtgtgcagaaaagacatgtgttggtctgtgagggtagtctatgacctatgaaagctatcagacgtaagcgggcctggcttgggggaagacgggatgttacaaaatggtatcagagccgactctcgcggtttcacgggcgcgtgtgtcgcagtagcgcaggcatggtgcgcatggctggtgtagaccgggagtggttacacagcatggcacatgcgctggcactggacacatggacgtggccaagagaggacgttcctggcctagagttgatcgacgggggcgtcgatctctcttaagggggtgagggtgtaacatcccggcctagggcttaataagattaatagaatactcatatcaacaagttgcaacttcttttccggaagcaaatctccgaagaactccagggttaagcgtgcttagcatggagcaatttgggatgggtgaccgaccgggaaattcttccgggtgcacacgagtgaggacaaagtgtgcagaaaagacatgtgttggtctgtgagggtagtctatgacctatgaaagctatcagacgtaagcgggcctggcctggaggaaggcgggactttacaatttgccactcttaaaccagttcccaaccggtgccacttgtttatcggacgtaagcgggcctggcctgggggaaggcgggacgttacaatttgccactcttaaaccagttcccaaccggcatctctaaaggtttttctactagtgccacttgtttatcagacgtaagcgggcctggcctgggggaaggcgggactttacaatttgccactcctaaaccagttcccaaccggcatctctaaaggtttttctactagtgccacttgttttttctagacactaattatttccaatgctattttggttgtttcttgataagttggtttgtgtgtttttatagtgtctaaaatacaacacgtgatttgccttacacctcgttaactcttgccatatcgaacttattctaaatggtaggctattattaagtaacttctacctccgtcataaaattaaatgtaagcgttcttagtttgacacgtgtattaaaaaatataaaaataattaaggaaagactattattaattgagaagagaaagtaagcgaacaaattaaatagataatataattatgattagtggaatagaataacccgattaaagggcaactcggcattttacgagttatgaaagtgcattggatgatagatgagagggtgatgaagaaataacttactttcaaaacaaactacttcctctattgtaagacatatttattttatcattaagaccatggagaaattaactcatatctcatgtaacaaaacaaaaaactatcttacaatgcatataaccaattagtattaggatggttttttgagttctgattaacattaaagactacaaatatgatcatctcgttcttttgaaaagaaaaataaaatatgtttaatatttttgaatgaagggtgtagtatgctaaaaaaaaattcattttaaggacggatgtaataaatcaacacttgctaacactaggagtgctcttcgtaaagaattggtgggagaaatcaacgctagtctgtggtcaaccgagaaaagcaagtgaaagctatcctgatgtcactctccataagaaatttaatgagagcactacaggagaaatgatatttgttaggtcggctgatttccacaatagtgctggttctaataagaactgggactaaagattatttttagtcccgattagaaaaattttgatttgtaactccaattggactaaagatcagttcatcacctgtgagaggcctgtcagggggtcgaggatctttactaatctttagtctcagactaaaaatctatctttagtcccggttggagttaccgaccggagtaaatatttctctcccatctctgatcggttaagtcccagacaagactttcctcctcatcgagatatttagataaagattggatcgatctcatcccctctcctgctaacccttcagatcctcttcctcctcctcccccctcctccccttcgtcctcctcccctctcctccccctcttcccctcccatccggcggtcggcggggccgcgcgcgggcgtggtgagcggtggcaggcggggccacgcgcggaggcggccgtggtagacggtagcaccctttcattttttttataatttgtgattcactgagatgtataatttctttttttttagaatttgtgattcattgcatggatctgagatgtatttgatttgtgtaatttttttagaatttgtgatgtatttgatttgtgtatataactaacttaggatttgtgatgtgaatgattttggatgttactttgatttgggggatttggtgtttgatttgaggatatgcatggcattcgatttgagagaaaatacagggattaactctgtcaattagtaaagaaacaatgaaaaaaagaaacgggaaccaaccgggactgtccctaccctctctttagtcccggttggtgttaccaattaggactaaagattcaactttactcccggttatgactaaagatggacatctttagtcccagattcgtagtcccggttagaaaaccggtactatagggggttcccaaccgggagtaaaaacggtttccctagtagtggaggttgatgggagtattttcttatctaccctataattcaccaactcacttttacacctacattactcattcatcaaatccaactgcccat

SEQ ID NO: 68321 - DNA, 2456 bp, Oryza sativa
cagcttcacacgaatgcataataatataaaacttgaagttgtttggtattagacaatgatgtaacagaacttagcaataaacactcatttggaataccttatggtggaattccaagtgctaaagttaaacaccacgttataaagcaacataaatttattttgatatatacgccatgcagccctaccctacataaggattaaataaggttcatgtttagatatcagaagtgttctgataaaattttaagtccatatgttatatttgtgcacaaaccaaacatgcatctcaatccaagtatctaaatattgatacaactaaggcatacttcaagtgcatgctaattattagcatttagttacataagacgattatgcaagtgaacgtaaattgtcacctgctaataacataccacacaacttaagcttaagcaacagttgtttacctgaacttgggaaaacccatcccaaggatagaagcaatatcaagatcagaagctcggatcacaacattttcatccatgaccctgcatgcctcattaacaactgggaagaaaatcatctccaatatatcttgatcagataaagtaacaggctgcaagcaagataatgtctccatgtcagaaattttttccatcaccagctgggatagcatgggaatttttaaatgaaaaatccatgactcaggcagggaaggagggaaacctttccaccaggcattgtctttgcacatcttctgtactcgtcaatcacaacctgaacacttgggtcaggcttcggcttcccacccttctcataaaggtaataacctttaccattgctctttcctataaaatacagggaaatttcacatcaattttttgtttgactactgtttcttgtccaatccatcctatctgctacaaccaacagcatcgcaggagcaaaagcaggctaggaagcataccctgccgtccattctgtaccatcaaatccaccagattagagtccagattccttgttccaaaggcagccgcatagatatcctttactgccaatgccactccatatccagccagatcttgcagtctgcaggagtgcagagggaagagggggatttattagatataaaaacccttgggaatgatgattacagaaaaacaggtcaatcaacaacggaccagcactgcactgttcatttaaataatctaggtaaggcacacaacaatatctcactgttaattgttcatgcacagaaggtatgcaatttgaggtgattagatatttatgcacaaaggtataagtgacatgttgcattacaacaattaaaggaaatgtgacctccattgagttattgaggaggcatccaatcacatttcaaaagatgtagcttactaaagcccacaaaaataaattgaattggactaaaaaatgttcactataagctatatacaaataaataaggcataaaacgcaaaccatgaatttattcaaactacatatttcctatcttattttgtctatttaaacaaatttcaatacaaatactaatatttgtgatgataatctagtgcgacataaagatgtataaaaatagagttgaacacttactgaaaaggtcccattggcatgccaaagctgcttattactcgatcaattctgaaaacgtcgatcccaatactaactagaagatgagaaccctgtgtgtaagggaaaaatgtacgattgactgcgaagcctgtgcagttcccaaccacaacagggactttctttatcattttcccaactgtgatgagatcaagaatagcttgcggtgatgtcttctccgtccggacaatttcaagcaaaggcataatatgggcagggctggaaataacataacatgagcaattgaacatggtgtctcacagtaaacaagtacagtgtgattgtttgatataatgtccaaaccagaaaggctaaagagaacttattgttatttataaatgcctatatcctgcttctccgtacattctatgtgatgctcatacataagttactactgtacatatcccaaataaaaagttattgcaagtttgcaaaagctactagcttatgaagtcataggcatctgacttagaattaacttaagccatactgatctgccgcttgcctttcggggatacaatgatcagtttgacatggttaaaatgaaccaattattcatgcatttcaaggattgacttacctatattctgttatatctactgggtttcgcatgatatcatgattagccatgcttttgcagataaaagtgccataaacaacaatcaacaactcaacactgaattttcagtgaccttagataaactatcgtggggaaaattaaaagtgaacattcatctccctatatcctgcaccccccccccaccccccaccccgctccaaaaacaagagtacgatagagaactttcacgcagggtttgtaactttgtatgtca

SEQ ID NO: 68322 - DNA, 1169 bp, Oryza sativa
ctggatttttcacattttggtccttttgaaaaacttatttcgcaagtagacccctagaaaaacttatcccaaaaatggttctttttggggcaccagagtggctggcgccgttgttcaacaggacggcgccagcctctttggcgccgtccccctgccgacgtggcggggcgatgctgaggtggctagggggaatgcgccagagtggctggcgccccccccccccccccgaaattttttatttttgttttatttgtttgatatttttttcacgcttagggacacacaagaaccaaccatagaaaaattgaactcaaatgaacgtaatatgtgacatgtagaatttttcctctcctctcctctctccggactagtgcagaggagagagatgtgcaacttttttatttttattttatttttttgatattttttttcacacttaggaactcacagaaaccaaccatgtaaaaaataaactcaaacggacgaaatatgtggcatatggaattttccaaagctccaccgaaaaacttctctcctcgaaaacacaattcttgcaagcggaatttggaggttttaatatcaccgaacccggcaaagcgggggagaatcggatgtaactttttctgtagatgtccgtgcatatattatttgcctgattccgagtccgtatgaaaaagttatacctattttaatagatgacatattttgtctatttcggtagagttttggaaaattctacatgtcacatattttgtccgtttgagtttattttttatacggttggttcctatgttctcctaagtgtgaaaaaaatatcaaaaaatgaaataaaaataaaaaaattacatctctatgtactgtttaacttatatgtcattttatgtggttatattttaaattagattaagtaatttcatatagtggtagagtgcattatgtttaacatgctgatcaaagggttttactaaaagagttatggtctaattttattgaaggtgcaaagtagactaagtggtatgctagatattttcagacttagctaagtggtagtttgagtttaaattttttttgtggttggttgtatcgtgatcctgagtgtgaaaaaacatccgaaaaaataaaataaaaatgacactgttgcaactctatatagggaaacaggaatggag

SEQ ID NO: 68323 - DNA, 692 bp, Oryza sativa
  unsure (1)..(692): unsure at all n locations
ctccgcccggacctcaagcgcggcctcctcacngacgcgaagaagcagctcgtcatcgacctccacgccaagctcggcaacaggtacccctttttccatgcatatacacacacctacgttacttgctctacctcgtctagcccacacacgcaaatgcatgcatacaaacgctaatagatttttcatgcatatgcactgtgccatcttaaaccatataggattttcttttgccgggtaaccatataggattttgatgtggatagagctggattaactctctatacaaataggagtagatcattaaaaagctcagtagtactagcagtttgatagcggtaataactaacaccgtatagtaatttaataaggtccaagaaattgagagaactactactagtactgtatgttagctacctgcatgcccattatttgatacgaagacgactgacgacatgtgtggctgtcatcaatgtgtgaggtcgcaaagccaccaaattacagtactttgacaatgaagctcataggtcgtcaatcactcatgtgaactaattaaataagtgtatatagcgcttacatgtacgtgacatcacggtcacgtaggtacgtaaaccttcatcactactactactgctgtcatacgcaagctagcagacttgtctccatgtgtactacgtcgccaagaaagtatctta

SEQ ID NO: 68324 - DNA, 2263 bp, Oryza sativa
taaaaataagcaatattgaaagaaatttccatgtaagaacccaatacgagattaatcaaaattcaaaataaaaataaaataaaatccaaaattagaaaaggaagggagagtccaagtaggaatacaatttaaaaatagttgaaattcggaattaaaaacaagcaatattgaaagaagtttccatataagaacccaatacgagattaatcaaaattagaaataaaaataaaataaaatccaaaattagaaaaggaaatgagagtccaagtaggaatacaatttaaaaatagctgaaattcggtattaaaaataaggaacattaaaagaagagttcatataagaacccaatacgagattaattaaaatttggaataaaaataaactaagtaacaggcctataaaggagtagagtggtggcggttgatacgacatataaaaattgttaataaaacatcaaatagaatcctaatgacgattaaaaaggagggacgtcaggcagcccgtgaagcaaacgagtaaggcggttgccgggacttcttagacagtaaaaaaacaaaccgcattgataatcgtattcgatttttaaaatctcaatgataataaaaaggagaagcagcgggcggagtgtataagagtatagttgcagagccaccgacgtttgacgggacttctagaaaataaaaaatgaattccaacgatagttatgttcgatttttagaatcacaatgacaataaaaaagtaggcggcgaacatgctgtagaggggcatagtggcatcgtttgataggacttctaaaaattttaaaaaatgaaactacaagttatgttcgattttaaaatctcaatgacaataaagaatgaattacaatgatagttatgttcgattttaaaatctcaatgacaataaagaaggtaggcagcgggcgagccgtagaggagtacaatggcaaagctattgacggtttggcaggacttctagaaagtaaaaatgaacctaaacgataattatgttcgatttttaaaatctcaataacaataaagagtagagacaatggatggcccgcagaggagtataatggcaacgtttgacgggatatctagaaattataaaaatgaaacccaacatgacaataaactctaaaaactacaaaatccaatttttaaaggttccaagaagaatgaataaaaatagtggtagatcgagcaagcaaataaagaaggagatgacataagggggtagcaactggtgtgacttttaaaaactatataattagaaacacgaggatgataaggtttggtctttcaaagtcttaagacaatgagatagctattaataaattttaagtaaaatcatactaaaaaaatatatgattttgtttgggtgctagccgcgcaattgcgcgggccacccagctagttatattattaaaggaatagaaaaagaagcctccacattcgctctcatggtctagaaattctcacattaatcggagaaaaagaaaaggcagagtccatataaaaatacaatttagaaatagctgaaattcggaattaaaaaataaggaatattagaagaggagactagagtccatatagaaatacaatttagaaatagttgaaattcggaattaaaaaataaggaatattagaagaggagactagagtccatatagaaatacaattaggaaataactgaaattcggaattaaaaataaggaatattagaagtagactataaagtccatatagaaatacaattaggaaataatacaaattcggaattaaaaataaggaatgttagaagtagagtatagagtccatatagaaatacaattaagaaaaaaaaatagaaattcagaattaaaaaataaggaatattagaagtagagtacatagtctatataggaatttaaaactaactaaaattcaaaataaacataataaaattaaaagtagagttttgtcacgccccgaactagccccgaacggaactagcccgtgacgctccaaattaacctgttaatcgataccagtcccaggaaacagtgctggtatcacaggaagacataatatcacagcaacagaggtctctttattacagagtaggagtacagtcatgttgggctgcggacagatcccgagctcacaactgcattacaaaagggaaagcggaagccaagacttggaccattcatcacaggcgcgacttgggaactaggccgaaaccctaaaactcatcggtagccgacttgctcctggaaga

SEQ ID NO: 68325 - DNA, 23193 bp, Oryza sativa
tgactgttgacttttcttctggatttagagtttcatttgtttgtcggacattgactgtttgagggagagattgatcaagggctgaagccgtgggcatgctccttcgctaccttgactcttctcgttattatcagacacatcaggtcattcaaaagcaaagaaggctcaagctcaacccaagtcataaatttatatcctgagtctacacagcccaaacaactatctcatcttgtatgttggtaattaggagagcacgaattagaaggtgggaacaatcatcatcctattaaactaatcttttgggttgtagacttacctaacattgtaactccggttgaacctgtgatggagcaggccgatgtaatctgggtggctcataattggtaggtcgggctacacactctaataaacatgactgttttatagtagcaattattgtttggtggatgtaactatatagaaagaaatgattggtcaaggaaaaagaacggtattcttttttaaaaaataaaaaagaagcaaaagaggattccctcaccccattttggcggataagattatgttattctgtataaaaaaatctgtgttcacagaaaatctacttctcaccataggaatttacaagcatagggtggataggcatccagttcttctgttaataaattatttttttagtacatatcaatacattcgtctagagttttagttttttttccttttaccttgatgtacatactcgccttaattaaaattatataccgtggggggctccctcactgttttcagtttaaaaaatgtaggaaaatgcctttgagtctagaggaaaataaggtatcatgtatgttagtttctactaaacgtatatatgaacttgatacatggtctccgctaagatatcagatagttttagccttttagcaaaagaaatacctagaaatcctattggacttagctaaaggcctaagggtgtgttcggaagtcctagttccaaactccctctccctccacgcgtgcttttcaaactgctaaacagtacgttttttaaaaaagtttctatacgaaagttgcttcaaacaatcatattgatcttttttttaaaaaaattagctaatacttaattaatcgtgcgctaatggatcgctctgttttccgtgcgcactgtttccggttgggaacgagcacttccgaatacaccctaaagcttcctatcaacatagagccaataagggaaaaaggtttcagaggacaattaataacagatgacaaccgaacctaatagcaatgaaaggtcagctcttttataaaacaaagaaatgaaattcgataagattaacaaaagggcaaaatcttctgaatgaagctcaaaatgcgtgtcacacacctcaaagattcaagcttagcaacctaatcaccaccccaactaaaaattgaccagcaagatctttacaaaaaggattatgaaatgcagtgagtgttaacggtatctattctgttcccatttaatgatgccttgcattattataaatccatcctcatccatctcccctctccaaacaaaacaaattctcttcgcaagtgtgctttgttctgtcctaaaaatagtctggattcccgtggcttttgccttttggtctcttcccagaattcagaagaacctgccctgccctaatgttgacaagatcccatatggaaagagactgaaggacatgtacagttccatcagcggtatatgtatagctggatgaccttcaagtgttcatgcacttttgaagtcctaatcaggctttccttgccccttccccccggtaaaagcggttacaaattaccaagcaaaaccgatgaaaaccagacattactacaaacttattttttaaaagttcttttgaacttggtcgacataacgaacaattgctattaccgtacacatgcggtaagcccagttaccatggtaaccgatggtaagaaaaccctattcctaatttgactatctataaaatagaagccttatagtggagcctattatagaaaaactagaggaccaaaatgtaacttattttcgtcgaattaatagtggtattctcacaccttatcttttatgaagtccactcactcatatccgatggcagtggataagactataagcagacaactagaaaagcctccaccttacaaaatacagaaagagagattcttaacacacaaaaatttacacgaatgattgccttgccattactaaaccacatagactgctttacgaatttgatacgttaggttgtagatgggtatatgcagaatagtttcaccttttgtctttcataaatactataggggtgtgtagacataccccatccaacaccaaacgtgtgcatactataaacaagctttcaattttgtggaagtgtaggggccttgtggcatcatggtagaagctaatgctgattggtcattagtcagaacaacaccttggccccaccactaatcccctttccagtttccttaatgtgagtatcacactaggatctataggtggtcatttttcttattgagtgtactcaattacattgcagtcaaggaaaaattattgagtgtatttgcatttgattgaattaaaagacggtacaattattggtcaaacagtagtcaatcgtagactttatctttggcacctttcatggcttgcaaaattcaatttgggtccatatgcatacagatacatcaaaacaagaacgaaatctggacgaaatttcatcagaagcttccaaatctcgtagaattttttgcccttcatgcgttcagacatgggtaacaatctgacactgatatcctgttcttctgcagtccacatatccatgtttatctatcatgctaattaacttaatttctcccttataatgccttctagattctttcaatttcatatgctcctctctctatgctcctttctgaattttttttcttccctgtgattgatgctgctggagatcatcatgcacaggtcatcatgcaacatcatccagtggaacaggttagatatgctgttattcgaagtagactgcaaagaataaggtgaacttttatgctcatctttctctgtcccatctgaacatttctttctcatgagttggatactgtagaacatcatgcacaagtcatcatgcaacatcactcagtagtcagtaagcaagttgatatatactacagggtgaggtttgtttggatgctcctggaaatgatctgatgatggagatgtaacaacagatatggccaatcgggagttcctatcagggagaaactctgcatgaactgaactgacatcagaaacacacgcgcattttcaggcttgaatggggcaatgccaaggttgaaaaccagcaatcaacgtagaggtttagtatacgtaagatcaagctgtaagcaacaatgattttagccagttggagctcagtactgagactgaaccaacgtcaacatacctgcccccacagcaagacggagggcatgttcactttgatgtcattttcaactatactatttttttttggcaaagttgtcaagaaatggctacatttagtttgttgctaaatttggtcaatacactagaaatcatgccaaaattttagcaatattatcatcttaccaaaatattggtattgccaaaacttggtaaggtttattttggctacaatctcaatctgaacaggccctgaaattctgaaaaggaatcattggtgagacctatccctgtaattctacagtacaaaaattgttgcgatccagaaagcagtatatatagacagagaaactaaatcactaagtctggtgatcaagtgacagtgctactacaagctctgtaatatctattgttagtccaaactctgaaattctgaatgaagtagtacaggcaaggactgaacaagaagggaaggaggaggagcagaaaagcacgaggcactttggatgtggttctcatgcttattaaagctcagtaataagttcaatggaattgattagttctgcatgagtacgaattaaattgactaaatattcaaaatcctaaatcactggacagatactctcctaggtcagagatgacatagaatgtacatcaactcatgaaatcagcaagttataatcctcaaatcccagagcaatcaattaaccggctcctctcttggattttcgatcatgttcatgacattctttatgcatcgtgaacagtggtcagtggtctccggtcgtcgccgtcgtcgtcttcttctctgatctttctcatcggatatggccatatggatggtgaaacgtgaccatggcacgaagacgacgaaagtgtgaaacagtgaggcagccgcgagacagatcgtcaatccggcgtgacgacgatggcggggctacttgcaccaagatcatgcgcatggtgatttgatggttgatgctattattaaataaaatcgatggagaaaagcaaattaaatgccaattcaatcataattactcaattcgtttcatattataaattgtcctttttcattaaacttctttaaatttaaccaaaaaatatatcaatattttgaacacaaaataagcatattattaaaatatattaaatactaattttaatgaaactaattttggtgttatagacgttaccaattttttctataaatttaatcaaactaaaaaaagtttaacaaggaaaataattagaacaacttataacacgaaacatgcaaagtacctcacaaaattttttttaaaaaatattgaatgctactttctccattttatattataggggcaattgcttatttgaccctgttttgaaacttaactaccaatatgaccctactttttctagtttgcttatttgactctacttttttaaaatgaacactccgtttggccctgttttttaacacagttaagttttcattttttaaaaaagaaagaaatgcaattatttttcgtaatgaccaaaatacccttgaccaaaccctatccatatctacgtctctccccgtattccgtctctctctctctctgtgctggcggcggcggcgactcgtggagggagagcggcggagaccgcgaggtgcagcggcgatggctcgtggagggagagcgccggtgaccgcgaggtgcggcggcgaccgcgaggtgctgcggcagcggagctggctcacggagggaggagcggaggaaacagcggtggctgccgtggggggatccgtgccggcgccgccgtcgtcggtcgtcttcctcgtcgccgagccgccgctcctccgccgccagcggagggccgcctcgtcgccggtcgtattcctcgtcgccgagctaccgctccttcgcagccaccgccagcggagggccgcctcgtcgccgagccaccgccgctcctccgcagccctccgcatccgccgccagcggcggccctccgcgtcgcgccgtcgagccgccgctcctcccgccgccctcctcgtcgccgagccgccgctcctccgccaccagcgcctcgtcgccgagctgccgtcgctcttccgcatcgcgctgccgagccgccgcttctccgcagtgctctggagagagagagagagagtagagagagagtggatatgaatgagtggtagagaatagatggatgtattaggggcattttcatcattttaccccttagttaacggtgttaactcgtcttaacggaatagggtcagctttcctcttcgattttgaaaagcaggtcaaataagcaaactgaaaaaaatagggtcaaattggtagtttgctttcaaaacagggtcaaataagcaattggccctgttgttttgtttggtttttttttttcaaattttgttaagtttgatcaactttatagataaaatagtcatatctaaaatattaaattagtttcattaaatctaacactaaatatattttgataatatgtttgttttatattaaaaatactactatattttttataaatttaattaaacttaaaaaagttttactaataaaaaaaattaaacgacttataataattataaaacggcgggagtacccgtattccctacatctcgacgaatccctgtgcttcgtactgtgctcgcaccgacgcctgaatcctctcgatcacctcatcggccttctcgaagcacccgccggcctcgaaccagtcaccggcgatctcctccggcgaggccgcggggtcgtcacgatcggccggcgccgtgaacacatagccgaactggtggccgaggttctctcgtcggagggagaggaaccaggccacgtccgccggcggcagccgcgccatcctctccaccgccgccggagacggaggagagtcctcgctctcgccgccgccagccgcatcggcgggaggcttcctctctaccccctccgccatggcttcggcggtgatgctcaccgcactttcgcctcgccgggttgtgagttgtgtgacgccacgccacctcagcagcgggagatttgggagacggttcagttgtagagtccaagtccaggaagcttccgacgagtgcgcgtgggccgtgagatccatatcttactgggccctatttgagtcgctactaatagggccatattgggctgattctatcgtgcgggatcagtacggaaacaactttggttggcccgtatgatcctgttggtcataattaaaatatttgaaaagtcctgattagaccccccgaaccattggggtcgatcgaattaccccttgaatttaaataccagatatttttcaccctcaactattcaaaccggacaaataccaccccctcacccccttgactcaatcataagtggttttggttctatgtggcaatccaatcaacatttctttttaaaaaaattagtgaggttcacctctctcacatgagcctctcacaatcccattccccaccacctctttgggtctatttgtgggagcttctagttttgcatcttctcccagaatcaaaagctcctcaaacagtccagcttttggttcagattctgagaagttatatctatagaatcctgaaaatgaactagaagcctaaagcaggaaaatcaagctttttcagattcttagaagctagctaccaatcagctgcttctcagaatctttaagctcccccaaacataccctttgtttcctccccttgctgacccgcagcaggggctagcccgtcgagcttgctaatcgggcaagcacgccgccaccctactgctctcctgcatgcgctcactcgacggccagtggcggagctagaagtcacttgggacggcgctgcggcagagcttgagctagcgcggtggcgactgcaacggtgatggagcctggaggcggtggaactgaagctaggatggaggcagctgcaacggtggtggagctggagctcatgcgaagcggcgaaggtatgccatcatctcgagttctctcggcgatatcctctcccagctaggggtggcgctatagccatgcattgggccccactgaccctgacaatttctcatacccatagtccctaacgactgtctatccatttgtcgggtgatttctaaccaaaaatcacccgacaaatggatagacagtccctaaaaagactagacgccggtatagatggccaaatgggccgcccggcaaggcccgacccaggcacggcgggactgggctgaggtcagtcgggccggcacggcccgacctacacgccgggccgtgtcgtgctagcccacgggctgcacacacggcccaggcacagcccagtaagacttggaccgtgccgggtgttggtattttttaacgacattactagaaatataattcccagcaatgacgcagaaatactcctggtatattatggttacaaagttcatccgcaagcgcacgtatataccattgtagtatatcacccgagagtattcgaagggtatcgtatttatttaatcccgtgggaagatcatagtagagagaaccggactaataatttataagttacttgtaataatcgtagcctaagcaggggttaagataatccaagggtagagtgacacacaagcagggctactcattctcatactaaaatatctaagctaagtgaaaagaaaatagaaagagaatatattcttatacttctagtatacatagtatacatacatcctagttatctatcatactagctaataccctctatccgatgccctcctggtacttcaagaagccacccctgactatcgagttccttacgacagcccgtcatgaccatacaaccggggctaaatacggaggagtaccctccctagaaaattaacttaggactgtatacacgcgcggaggaatacccgtactgagctgtcaccattagcggcccacctctcatccgtagcatataaccctaaataatgatatcccgttatctagacaccacacctaaactatcagatactactctaatgccatcgtcatgacatagagtaattgcataagcaaacactatacccgtacccatgcatctcccagataagctagtataattagtgtacatgaacataatgtaaagctagcattcatatacttggaaagtatttcaataccatgaatgtatatagaagagtattctaataaaagtacaaagcttacaaaagagaaaagaagagctactagagccatacccgaactcttccgaaggcttccggacttcgatttctactctattcctattccactagcttgagaacactaaactaacttgagagaatacgagagagctcttgcttgaggtgtgtgagtgaagtgaggataagagctcattttataggcaggtaatgacggttagaaaggtcggtaataccctccaactgtcattggggatcaatcctagccgtccatcaaaaccctgcatccattggctccacgggaggtttggccgaacccaatggttctcccgaaccatgggtcgggctggcctggcccaaaatcggcaggtcgtctcctcttttgctctcatacgcagacttgtgaattttggcccagttcatcgtgtcaattctgagttcttggctcattcatgcataagtctgattcacgacatcgtccgattgatttattgtctgagttgatgtcgattctcctccactttatggttattctctacaaaaggtaagtgaaccaaatactagtggaatattattattctaacatggatatgcattacaagcataattagttctcctctatttcggtaatattgacggtcgaaactgatcgctaacgacagtcaacaccgggccggcccaaaggcatgacaggccatcgtgcttctccacaaaataagtctattttatattcctcttctctttgggccttgccttatatggttaattaagtctattttacatccctctactatttttttcgcgtgccgtgctaggccggcccatcatgccaagggagcggcccaagcatggcctggctgtcgggccgggccgacacgagcacgagtccagtcaggctgtgtcgtgcttgggccgggccacagccctcgagctatatggccatctatagacgccggtaagcatgttttgttacagcccgattagcaactagaaacgacacgattgaaattagcaggcaacagatagaaattagctagcgctaaagattttatgtcagcccaaaggcctaatatacatatatgtttgagatttgagcccacaaccacaaggcttgtagcgggcagcccacaagtccacaaattctacctgttgcatcgttttcgtttcctccgagcgcttcgcctagcaccgccgcacgtcttgacttctcatcttgtcgtcccctagtcgcgcacacgcacatcgctgccacatccaagattccaggaggcagaggtgtggagagacaaaggcaaggatcggcacttcggcagaccgcagatggctgacggcacgagggcaattggcaaggtcgagccgccgagggggcgagctgatggcgagttgatgggtaaccgattaaccctgtcataatttctagattattatcacaatttggaaattagggttatgagatatgaattttcgattcctttatacttaagttacatggtcatcagtcatgtgcgaggagaatattaaaacatagtaattttgttctttccagcagagtggaatataaaaaatcaataattttagtaatcttagtcgtgagtattattacgcaacccctcctgctaccgaggtagtccaagagggattgcataattctacaaaagtggagacacaagatataagggtgtggtatcctttctcattcatccattgcattctcaagtgtacaatcctcctctctactcctctatttgtagccattccctcttccaccttccatgtttagtgatgggcccaattagtgggtaaccgggccgggccttcatgggccggcggtttcctaacactcccccttgggctctcactgtgtgatgcctatgcctcattaaaactccacaaaaacccagtgggaaaaatttggagaaagagtacatagcatacgcttgcaatgtcgtacgaattgcctcgttaaaaaccttgataagaaactgctaggaaaacttatccaagggaaaaagagtacaatccacccaattctctgttcaatctttctagattgattttgggtacttgattttctatatcaagattatagaatgagtcagcgaaattctccccctgaattttgcatttatctaagtctcattattccgatttctctgacacacgtattcaagagaagatgtcaataatgagttagtggacaaatctgtaagacttccacatgacttagttcgtagctcctatgtaattcatgcacatagaaaagcttgggggttcatgtgtttagtgagtatgcttttcacgtaactcatttgcatatgtgcgacatatgctgctttagtttcataaatggtggggttgagatagtttccaaatcgcgattgatgtcgcgggtaaccatctctcaaaaccatgctgaggctctgaatagttcaacgatgtttagttcggtttagttcaattagcctagtatttgtgtgctactatgacacttgtgtttgggaattccgtcccattttggcgataattgactaaccaaagctatgcaccatgaacatttctaagtgcggttggagtgatgtactagactttcatctgtcgcatgcttttagctgcaggtgtgagcatgatttgggtttggccaaatatttcaaaattaaacttaaattcaaaacgaacgagtttgcttcttcgattcttttctggtttattctttctatgttggttcgggacctagtacttcttcatgtactattatgcaagtgtccgatccaagctcctgaaatgcattcattgattctatcttcaatgcttatcaatattcaggttgagttcttcttttcaacttctagttcactaatttcattcaactccaggttgactgccaatgacttttgttgtctaaaagagacatttgcccataaacagtctcattgctaacttctattggttgcatgagactctatgtgaatatccatggatatacgaggagatgcattttcatatgcttcatcttcttctttgcttaatacttcttgatgtgggcatgtaccagcgttagtgtgcactccaatagctggttttcttccttgatggaaggtgcggtatgcctattctgaggtttcgtaccgtttgccagatctcaactggctctccttctatttggtgggggtacatttcgtgattttgagtatgatagtccctcttgccctgttttcaccagacgtctccggttactttaggggcatgaggagccagagtttcttgtccaattctttttgttcgaggcctctagacaagacgaggggtacctttactttcttcggtatcaccctcctccggtgcatttcgttcatgcaacttagtcaaactcttcgaaatcacaaaagtatttacaaagtggtttggcagttttaattctttatgcaaactgcattcactagtgcggtgtaacatgcattagtcccgaactatcatatttcctgacatttcctatctaggggttcattctctccccctaaatgactggaaataattcttatttgtcaaggaatttaggcttcataactatctccgtaaaaggtttccgactttcggagagagcctattgcaacgcattatgatagtggaatatgcacataaactaaacagatgcaatagcactagttgcaggatggatgttcatgccgatggtctgaatttgcttttagagtccgctgttttcaggactacatgtccttttctactgcggtattacaacaatgatatagcaaatattgcaattcatagcttatagttagtccgattatgcggatatttggtatttcgtgctgccagttcaccaatcatcaaatgcaatgctagcattgtcctcgcggacttctgaagatgatttagtgagttctattggagttcacatgatcttgctggatcagtcttggcaaatacacggtgtctaagagacactggatgtttgctgcttcggaagcgcatttatccatacagtaccaaatggaagccgcatatattcttcgcaatccagttcagggatgctagaacaatatgcggtttatgcattgatctcctatcggtgcatactggcacacaaatcttcatgatttaggaaaattatacatatatgtgctatgaccatacgagttgtaatatttatgcctataattctaagaccgaaaatggctgaaaatccattgctaaaagggtgtaacttaaaacatcacactttttagagagtttaacggggttgacggacaatagatgcttctaaaaagtgcacaattgttccataggtaatatgactgtggtgcattctaggccgacaaattcagttgttgctgctagcaacggtcataatattttccagttctatagggtctggaaataccttcttctcttaaagtgttatttgtggttatgtggaccacaatttattcttttcttttatgtttgggtgctacacaaaattcaaagcattgtaactatgtgctataaaagagcaacaaaatagtaaatgccttaaatatgctattttatactagaaatatttttttattgcggggaaaaatgtgtgctctacatgggcaaaggccatttattcaatccaatattctatttcacaattgcaacaagtgatgacgaagtatattgattcaacgaggtattctggtactgcggattcaattaacttcatagcgagcttcttgctggatagctatggcaattatttattatcctaacatcaattttagggccgatccaatatagcataggagattcttcgtccatagccatgcaaataggctaggagctctccccctcaattcatgatgagtgtgctattaggattgtccttttcttttagtgttcatagttctagattgtttcaccttgacctatgttctactcccccttttcttcttctccgttgaggtaagtgcaccaggctagctgctagtgttgaattcgttatcaactgcgctagttggttttggaagataatgctcttctactgaacactatcccgaacgttacgcaattccattatcaactggtaaggcatacttcttgtatgtgcactagtgatacttgcgtgcaactttcgtcgtgttcggctagaacattaagagtttcagcggtattcaatgcaatttgatgcatcgtgttaccatactctctctgggtcatctgctcggtgaatctagttgaaaatacccattcttgcttataattcttgctctatgagaggtagggtatgtaccatactcttctaaatactaacacgcttattcttctagcctactcattcatgagagtagcttggaggcactggcgagagtttgaaatgctagatcaaactcatcgagtcaatgcctatagcgcgattggattaacggtaccatagagcttcttgctctactgtaattaaaatatgtcagagatactctagattcaacaaattttctaatccgtgatgccagtcatctttcgttattcaaaaatatgcgcaaattaaatgctggtaaaatgcacaagtgttgcaatataatggtacacaaaattcccgcaaacaattccagtatatactatgaaattctattcattttaccgcaacgatattaattaaaagtaataaaagcatcacaaataatcaataatcgtaaatgcgatagataaatttcataatcatatatatcagcaataaaagtacctgaaatacaaagttgggttcgaaattcaatgtcccgtggctcttttatgcgagaatatgattttggtgatatttgcaaatttcgaatgccactcaaacaaaaatcccaatacagagggttaattgtgtattttctgaaaaatctagggtttataaaggcaaatttcctatgcagtagaatatgcacttaatttctaaaaaatacgagggcatttgcaaaatcacgggaatctttccatttttcctttttctttccttctttttttttctttccttttctcttccttatgctttccttgttttctcctcccccgattgcgtcgcctgccatacgcggcagtcggccggcggcgagcggcggcagtgcacccgtgcggcggggcgcggccgaggcggcagcggcgcgggcgcacgttggcaccgggcatggcgaaccaagggcggcgcggcggcgggggcgcacggctatgccgcggagcggcatggcgcggcggccaggaggcgcggtgcggacgcgcctgtgcggtggcggtgcggccaggcggcgcggccgtgcggcggcgggagcgctggccggcggtcgcgatcgtgcggcggcgcgagcgcgcggcgtggcggtggactcgatggcgcgcggagcggagtactagccggccactcagtggcctcggcggcgtgcggccgtgcggcggcagacgtcggtggcgcgacagccgaccgaggcgaagggcgcgcgcggcgtgcggcccttcgtgggcgcggcggacggccaggcggctcacggcgtgacgccgtgcggggcggcatgggagcggtctgggcggcacggggccgtgcagcggcggtcgtgcgtgttgggaatagtcccacatttgaaagtttagggggagtggcaccaacttaaaaagggaggggtccctcacctcatgagctagcttttggggtgtagaaaggctttctcccggttgggccaacgtctcccggttttgggccaacagtgcgagcgcaaggcagcgaacgcggccggatgcggcgcgcggtgggcttgccggtgcgcgacgtagcgacctctgctcgggatcgaccgggcctctgcgggtggtgaggcacggcgcggcgaggccgacggccggcaggggggatggtcgtgcggcggctgcgcgttcccccctttttcctttttttcattttgttttgtttcttgtttcctcgcggtgcagagcgcagatcgacgcagctcacggcggcgcgttgcggacgcggccgtcgtggtgtgaggcgtggtggccggtgcgcggccagaatggcgctgcttgtcgcctgggtgttctccccttttcttttctgttcttctttttctctttcctccatggccggtgccaagagtagcgcaagcggcggagcgacaaccgacggcttcgcagttcgtcgcttggcagccctgcggtgtgatgctcggtgttcaacggtgtgttcgaccatggcagccaacggcgagtccacgcgatggcatgctctgttgcctgtccccgtctggcactgtgtggcagaggcgcatctcgtgcggatagaacaccccaatcggcttgtgccggtgactccaagtcggcaatggcggtgttcatcgggagtcaaagaaaaccagaacgagaacacagagaggaattcgttttcgcgattgaatcagcgggatgcaatgcaaatcttcgagttattacccttcttctttctcggtctccggtagaacatcgtgctgataacgtattacgcaacccctcctgctaccgaggtagtctaagagggattgagtaattctacaaaagtggagatacaagatatgaggttgtggcatcctttctcattcatccattgtattctcaagtgtacaatcctcctctctactcctctatttatagccattccctcttccaccttccatgtttagtgatgggcccaattagtgagtaaccgggccgggccttcatgggccaacggtttcctaacaagtatttgtgcatttaatgtctactttatttacatattactatgtccggtttttaataatttatacatatatccatgccttgcaacgagagattcaattttctattagctaatgattgctcataacattatttagggtgtgttcggcacccctttttcccaaaccatctctctcgttttccgcgcgcacgctttttaaactattaaacggtgtatttttttcaaaaagtttatatacaaaagttacttaaaataatcatactaatctatttttttaaagaaaatagcaaatacttaaataatcatgtgttaatggactgctccgttttcatgttactgttccgggttgggaaccagcgtatgcgaacacacccttagttttgttgggtctgctttctccagtttttttttggtttttttataaggggcacggtatgcgcatgaagtaggtgagaagggtggatgatcaactctgtttttatgtagtagagataagtaggcaagcaaagcataatggcgtgattcttaaacaggaaaatacacatattttagaagatctaacaatgcatcaaacactaggttagtactaaccctatacaccatttatcctagcttcgcccatgtcccagcatgccgcatggatgatggtcacgatgaaggcaccaccaccttctctgcccggaccactgccactgccatcttctccgcctaaaccaccgttgctgctaccttctcctcttggaccgccatcgtcaccaccttctctatatggaccaccaccaccaccaccgccaccctagaggaaaggggagggaattggaagaaagaaggagaggggaaagggcatcttgcactcgaggaggctgcagagctcgtttgctcctcagcctccgccggcacgcgttccctcaagagttttgaatccactccccatatatggtttataactctagatattgattccataataaggcccaattccaacatactaccttgcaaagataattctcagcagctggtaaatatttccatgaatgatattatatatgtattatatgtattgaggaacgagacaagaaatataatgcgacaattgtaccattatacatacgaataagaactataaaccatgtaagggcgtgtttagttggagggaaagaaaatttttaggtgtcacatcgtacgtttcaccagatgtcggaaggggttttcggacacaaatgaaaaaattaatttcagaactctccgggaaaccgcgagacgaatcttttgagcctaattaagctgtcattagcacatgtgggttactgtagcacttatggctaatcacggactaattagtctcaaaagattcgtctcgctatttccccataactgtgcaattagtttttctttttatttatatttaatactctatgtatgtgtccaaagattcgatgtgatgtttttgggaaaagctttttaggaactaaacgggccctaaatgttaagatcaagcaatatgcatagttaagactagggtgcgggctgtaacctcttctcggcgcaattgatgtcagctgtttgtgcgccgttgttctgggccacccaagcgtcgttgttcttggccgcccgagcgtcgttggctggttgttgaactcgggatggaccctgtgaggattgtccggctgcggcaggaaagccgagttgaggtactgcatttgtctcgcccatgcatctccttccggaaaggttaatggattgaaagtagtcttcctgagcaaggaaccaagtgcattcaagtgttgggctggtgtcggttagagtcttcaggttcacgaggatcccccagatcatccgaacggatttcgccctcttcagtcttcatgcacgtccgccacaacgccatcgatcatgttcacttcacttgaaaagttggatcttgaagactcttgatcgttgaggctgtgtatagcggagggctcacaaggatctatgctggcatatgcgatcatacagtcttgggtcctgcagggttgtcgttgttcacacgtgcagctcgagattgatcttggtgtcggtgaatcacacaacaatgagctcgggtcgtagatctagtaatcatctagaagaccttgcagctagtaagggggtgactttttggtttgtgaatcaggcaccactccttctatgggatgtgcacgggatagctcgattttcgcaggccttgagttccgctttcacatgaagtatcaccttgcagtcgatcaaagggtgctgcgatgtctcgtggatcgagcaccaggtgttgtcgttaggtggagatttcctcattggcaccggaccattgtcagatgtcatgggcttggccgcttttggaattttctgtagagctgaagttgtcggcgccctcttttctgactggatgtgaggagcggccagcgctaggttgtcttccattgtccttgcaatgttgttctcgatcctaactggctttggggaaggcgagattggagttgcagtgaaaacagggaaaatgatgcatccgacttgagtccatgcaaacattggctgggtaagatctgccaggccaagaggactgtgggcatacactactacaaaaaccctcatagagaccagctcataggtgccggttcatttaaaatcggcacctatagagctttccccactcctcgaggctgaaaaattgtagaaccggcacctttaaacactgtagaatcggcacttatactataggtaccggtttttttaaaagaactggcacatataatatgttataggcaccgtttaattaaaaaaccggcacctataatatattataagtaccggttaaataaagaaccggtacctatagctttgagccgagccgtccagccgatcgagcccatccgcgcggatccacacccggcgtccttatctactccctcgagcccatccgctctcgcatctctctctcccgcatctctctctctcgacatctctcgctctctctcgcatctctctctctctcgacatctctctctctctcgctctctccatccgcgcgagctcgcaggcgatgggtggcggcggcggcgccctcccctccgtcggatctggagggaggggaggcggtaggcggcggcgccctcccctcccgccagatctggtgggaggggaggcggcggcggcagccgccgccgccgccgcccggaggaacggaggcagcggcagccgcccggaggaacggtggcggtgtcctcccctccgccagatctggcgggaggggaggcggcggaagcggcggcggccgcccggaggagcggaggcggcggcagccgctcggagtagcggtggcggcgtcctcccctccgccagatctggcgggaggggaggtggcgttggcggcccggcggcggcggttcgttctttggtttttttttatgaatgttgttttcgatgaatgtgatgttgatgcattgtttgaatgtgatgaatgtgatgaatgtgatgtatggatctgagaaatctttgggggaaatttgggatttggggaaattttgggatcggcttgacggctcaatgcatcggctcgatgtattgagccgatttttttttgctcatgggcgcctcaaaggtgccggttctatttttgctataggtaccggttgctagtattggtgccgacctattggtgccggacggaaaaccggcatattgccagtttccaatcggcatcaataggcctttatgtactagtgatagttgtcggaaatccttgagcttgaagccatctcagcgaaaccttgagcaccaagtttctctagctggtgcgccattgtcgacggggacacccgtagaccgtatcttgagggtattagggtatatcagtacgaggatctatatgaaacgatatcaaggactccctaaatagtactctgactccgattcggggagatgatttccttatacactgttaaattccattatctctaaggtaaccttcccgtatacttaagggtatccttacccatatacttcattacacaaggatagaaggtatgccttatttgtataacccttaaaatcatctatatgcttaagtggatattccgatgttgattttgctggttgtcgaatcgacataaaaaatactagtggaacatattattttcttggtacatcattagttgcatggtcttctaggaaataatctagtgttgctcaatcaaccactaaatctgaatatattgctgctgctagttgttgtttatagattttttttggcttatatcaactttgaaatattatggtcttacttttgagaaagttcctctcttttacaataacacgagtgttatttaatattgctaagaattctgtacaacactcacgcacaaagcacaaagttgggtttcaagtttagtcaagagttttgtgaggagtactattgttgcactttgtaaacatgaatagaagtaataaagttcaatctactttgagatatcttcgatatgtgtttgctcgtgtttcggtagtcacaccgacgagtgtacgacggtccgatcggcggcggcgataggcgacttcggcgcatcagccggtcagaccggtgaatctactccgatcagaccaatctacatcgtaacgagagtaacttttaattccggtaaaagtttggttttttagtagttcgatcattcacccctcatctggttggcttaattagttctttactatactgtggcgatcccacattagtagtgtgttccacttaattgattgttgattgagtgatttaacaagtgattatttcatccattcattcgcatatagtacaacgtaccggagagttgatcgatctagcatgcccgcgagagcatgcttaggtcaccagttctcaaattagcaattctctctttaccacataggtaaagcatatcaaaccttctatcgatgcaaaataaacactcatgtgaacttggcgcatctttaaaaaaatccttagtccatatcatcgaattggttcaaacttatttatgatgtttgtattatatttgggaagtataggcacatgagaaatattcccggagagatgaaaatccatctatgacacaaagtcatggctgtgtttagatccaaactttggatccaaactttcaactttttccatcacatcaacctatcatacacacacaacttttcagtcacatcgtaccaatttcaacccaaacttccaactttggaaggaactaaacacaaccaaaaacagaaggtacagatggtcgatatgatggaggtacactcaaacaggaacaacatagaaaccaattgcgtcaacatacgacgaggtgcgtccaaagaagccaactatgctgccatcgctgtgcattggagcctcgaaacgagttccggttccttgtccaaaaggtccatatctatcagcattggtggtaaagtggattgacgtgataacactggagaatttaccaaatggaccaattgtaccatatactttcgtcacgaattcggaagggccaagctcaatctgcaagaacaagattatgaacgtggttgaaatactttttatctgagtttcaagaagaaatgaacgtagaacactgaattaatggacacctaccttatgaattctgcctccattcccgccccacggacctgcagcgtgcttgtgcccattcttgtcagcatatgtgaatgcaagtgagtcgacgacagcaccacaactaattgttatactctccagacgttggggttgcatagtgatgtcgatgtcctgagcattccctccatttccaccccacggcccaatcttggtgatcccagcctaacaatcgattgcaaaaccacatagtgaactttaaaaatatttctgaaacatatatagtgggaaaaatagtctaaactctcaaaagaacattccctcgttgtatgcatgtcatccaaatggttatgaaaaaaaaatcaacaagagattaatatatgataaatcactctacaaacttgcaagttaaaatttaactttacaacttgcaacgaaaaaacaaatttgactgcgactatacgttaactagccatagtttaatttgtttttttcattgcaatttttagaagttaaattttaactttcaaaatgtttgtaaagtgatttatcacatattaatctattttgttgatttttttaaaattttttataatcatttggattacatgcaaacaacgaggggatgtgtcctcaagtgtttagaatccacacccagatatcaatgataaaaaggaaaggaagatttgaatcaaagtatatgtgtgtgtgtatatatatatatatatatatatatatatataatataatatatatatggctgtgtctcaaatggctgaattaagtctatgttggatccctcaatttcttttctttgaccgtgccatgccgagccagcccaccgtgccgagggagcagcccaggcatggcccggctgtcgggctgagacggcataggcccaatcccaatcgggctgtgtcgtgtctgggccgggccaaattcctatgccttatgccgggcctcgggcagaaacaaacacacacacatatatagacacacacacacctacctcttgttcgatcttttcttgttcagggttgatatagacgccgattgcattgacatacagatctcctcgaccgaagaagccaataatgctggcattgttacgcattggaacctggaaaggagatccttctacttgaccgaaaggtccgtaactacgggcattagtgatcaaagtcagcgatgttacgacatcttttgcaagggtactggatggaccggttgttccagaaaacccaatcagaaa

SEQ ID NO: 68326 - DNA, 2053 bp, Oryza sativa
cccccacagattgttgccgccgccccctcagattggcgctgacttggaccccctcaaagcgctgccgccgccgccctccaccacaacgagtgggcgccggcggggcagtgcttgacgccgccgccgccgtcccctcagctcgccgccaccgccgcccccttagctagccgccgccgcacgcgtaggtcgtcgccgccgctgcacgcacgagtgagagagaggtgagactgtgagagtcacgcacgattgagagagagagagagagtcaaaatagggtttggagggtattttcgtcattaggaactcttgaaacattttcttttttaaaaaaaatcaaaccctaatggagtcatcaaaagagggtcagacggaagcttcgtactcgaaaaagagggtcaaataagcaaagttcaaaaagtagggccaaatcggcaattacagttcaaaacagggtcaaataagcaattgtcccatatatatttgtataaatccgtatgtcacttactatagactcgagtaaaggcaggttctaatttaggttgagaaaaaacagtacacaagattatagtgcttgtattatcatgcaaagaaaaaaaaatgatggcactaagagttatgtcactttggtttgctagttttggttaagcatgttcattaatattactgtacaccgttgctgctactgtcctgtctacatgcatatgactctgctgattcctaagaatgataattaattactaaatattcatcttaattatctattgtttactggtggtctggtgcatggggcatgcaatagaatcagcagattgggggtaattaagcaggtgctatgccttgatgcatggcttgaacccgggcacttgcccatcctagccgggcctcggctccgccagtgcttctaatatatactcatatattaatattgacgcaagtaaatatttctaatatgataaattataaatcaatcagtttgcaagttgcaatatagtaatttattcttgataaataataacgataatataattgacaaatgttttgtgagcacccgacaaatgttttgtaggtaacattgcaaaaactgaaatagtgaaattgcaaagtaaattatacaacaataaccatgaattgaaatgatgaaaattggtatatagtgaactaattgattagcacaccgccctctggcctaggccctacgcaattgcacaaccaacctaggcccagggccggccctgagtaaactaaaaaacttgatcaagtggcataagcggaggtaataatagcaataccttcccgctcatatttgctatctcactaatagtagtgatacatgtgaaaacacacaaaagcatggtctgcaagccactgatgcacaatcatcctagttggctctatgaacatccttgacacataatatgtgcacccctcacgaagtaggggatgtaaacgatccacttggttatcataaacaatagcagcaatctttgtaccctatttataatagataaagtcaaatgctatacagatatcattgcagtgtaacatattaaagcataaaatatatagtaaatagggtatatagtgaacaaattgattagcacaccttcaacagttcagcttcaagagtcaacctcgctctccctggcgtgcgcttaggactcgcacctatgctgggggtgggccccctctagcctgggccataggcggttgcacaaccggcctatgcctagggtcggccctgagtaaactaaaaaacttgatcaagtggtataagcggaggtaataagcaatgtcttctcgctcatgtttgatatctcactaatagtagtgatacatgtgaaaacacacacaaaagcatggtctacaaatcactggtgcacaatcatcctagctggctctatggacatccttgacacataatatgtgcatccctcatgaagtagggaatgtaaacgatccacttggttatcataaacaatagcagccatctttgtaccctatttacaatagataaagtcaaatgctctacatatatcattgcagtgtaacatat

SEQ ID NO: 68327 - DNA, 7133 bp, Oryza sativa
tctatagggtgtcgatctcactgtcgtgcatcttctctatgatcttttcagctctcacatctccggtaaaaatccatagcacatctctcagaaattttgcatatcacatcgagccaaatccttttatttttaagttcaaaaaaaatccttttatttttaccttttcactttgtgttctttgggttgcttgctttccttttcgtttacccctttcactcctttttctggcaaacaagtttgtcaaaactatagaataaaaaatgttgtcttcatcaactagtgccgtagtatatatgtaactttatttgtccaactcaactgcaccgttgaattagggatacctagctacctactcaatcgttaataactatcattaagaaacagataaataaccatcatgcaagtgattaattaacaggttataatataactactaaaacctcaccaactcttcacagagaaatgttctaaaaaatagattcactaattaagtaaagtaagcaacacacgtgcatgctttgcacataagaatgtaccctacaatatctgaactcattagcagcacatacaccattgtatatatacacaaactagtgagctaatattattgtacattacccacccacatcttttattgaaaacatgtataggtactacaccaacaaatagttctatctctccaaaaaaaaaacaaagatctaagtatctccatttgagaagtaataacacttctagttaatggcacaaacccccgaatcaatctcaaggggaaaatacacaacaacatgcaccatctacgcataccctctctcaaatgcatcaatcccaaccgttgattggttttccgaagagcaaaggcctcgacttgtgatcaccctccgatcttggccggccatgcctagctgctttcacaatcttgatgcttttattaattatacacttcacttgattatctacactgatagcaacacaattaagtaagctgctgacatcttctagctagaagttggacccatttgagctgttgaccatggaggcatcgaccaccaagctcgagtctcccatcccaaaatcttggtagtcgagcagccagtccgtcgtcatgccgacgtcccacggcagcgccggcgtggcgccggtggcggcgatgctactgaactcgtcgacgtcgttgctggccgtgaaattgagccatggctcgtcaccggtgggcagcaggtcctcttccagcagccacttcaccagagggtcctggtgatggctactgctgctgctgctactgccaccggcggtgctggcggtgttagtgctcgactccggcgggctgtcgccaccggcagacacggacatgtccctgacgacggcgtcgtcaagctgccggctttgctgcctggtcgcctcgccggacttggacgactccgccgtgacggtggactgcgaggtggtggccgggctctcctgcttccggtcgaggggctcgtgcgtcaccgggtcgatgcccatcttgatgagcttcttcttgatgtgcgtgttccagtggttcttgatctcgttgtccgtcctgcccggtagcttggcagcaatcttggaccatctgcatagacacaattaacatcaacaatagaaaagtagtagtgattaagtttgtactagtagtaattctcacggagacatcatgcatacgtgcatgcttaagtaagaatgaaaattatttactgatgggaatgtttacgtagcacacgactgaaaaaaaaggaataatgtcaatttcgtaacagtagttaatttggatggagaaaccagttggtgatttcagccgggtgcgctatgcattcacttttaattatatttctaaaagatagatagaaataaaaaaagcaattcatccttgtcaatcattttcgcaggtaccccggcttgctgatgaaacattgaaaccgcatggaattaccatttctacaccatggaataaatggtgcagatgcctgttctgttaatcattagagtttgagggagacatggaagtatgatgactgaccaaactttactttctccataatttactgcctaggagcatttcttatgcaagtttttacatagccgtgaaaacatgccaccactttcataagcaaatagaaatattttactgatttgaagcgcaactctcaattaactagagatcacaacccatctctatctcatttgtttctttaagctatctaaggagtagccttttaattaagagtgacaaaacaacaaaggggttggtagtgtactttttaaaaagctttcttccattttccaatgaggcaactggacctaagaggatgctttctatttctgaatcaacgtgtagggttctcttagccacagaaatcaagctagtgggagccagcgctctagaatgcacatcaagaaagtgaaacaagaaatttccaatgttcttctgcgagactattttccatggctacgaaattgtatgccacttggacaccatataacagctaaggatatagagttcagcggttgtgtctaagagctgtcatagaaaggcttttatgctactctctagtttacaaggagcatatctaatatgtgtaaacccataattaattcagtgttgacataaaaaaatcaaaacaataaataagtaacattaaatttggagaaagaaaatattgtggatctcattgtgtagtacagtccttttgtttcttctacattttttttcaaaatatcggtatcagttggtacgacagtgatttgcacaaaaattagctatcttctgccaaaagtaaaagtaggcacttaattaattctccataacagggaccacaattaagcatgttcatacttggctaatcttgtacatctcccctccatcattgagaaactaatacacgcatgtgttgtttgatgtttcctcgtactatggcaataggtcaccagcatgtcatatgcttctcctaccagtgtggtgctatcttttttaaaaaaaaactttacaaatctggaagtaattatattattatttttttgctccaaattagattatttattaaatttccattttagttgattgaagaattgtgtgcttaatttttcttaagagcattacatgatggaatcaagtgctgttcaaactccaataaatagcttctactatctaatatataactcatcagattcttctaataaagaatctaaacaatgaatgaattgcaagcggccagtcacttgtattttctttacaatattgttctttgggtttaaattaactgttgggcttacaatattgttctttgggtttaaattaacaaaagcaagctagctaggtcaacagtgcgcaactacaattatcgtcgttttgcacacttctagtttttcctatcagatagctggcatataattaacttttgctataaagaaaatgcatacgtgctaacctcgtgtttggtttggatcatacaaaacaaagatagatagaaaatagtgtgattctagataaggttttccattctgtcttctccacgttatatctatgcatggcgatcgaaagttctagattctgactggccggccttcaccagtgtagaaagtctcgtttcttaaatggatttctcgtgcaagtagggttactatgtgctactgctaaatattccaagctatgttttgtctccttcaaagcaagaaacaagtaatccacaccttagacagcgacatgaaatgcatgcgagttagaggccagagtctacccttaatttggctgctaacctgtgatggttacattagggagttttcttccatggttttaccaaccagtggacagtaattcgtacgtttgatcctgtgtgttgacaaggaacgtacctacgcgctaatccatgggattaattacttcatcgtatactgggtaagatactttcttggcgacgtagtacacatggagacaagtctgctagcttgcgtatgacagcagtagtagtagtgatgaaggtttacgtacctacgtgaccgtgatgtcacgtacatgtaagcgctatatacacttatttaattagttcacatgagtgattgacgacctatgagcttcattgtcaaagtactgtaatttggtggctttgcgacctcacacattgatgacagccacacatgtcgtcagtcgtcttcgtatcaaataatgggcatgcaggtagctaacatacagtactagtagtagttctctcaatttcttggaccttattaaattactatacggtgttagttattaccgctatcaaactgctagtactactgagctttttaatgatctactcctatttgtatagagagttaatccagctctatccacatcaaaatcctatatggttacccggcaaaagaaaatcctatatggtttaagatggcacagtgcatatgcatgaaaaatctattagcgtttgtatgcatgcatttgcgtgtgtgggctagacgaggtagagcaagtaacgtaggtgtgtgtatatgcatggagaagggggtacctgttgccgagcttggcgtggaggtcgatgacgagctgctcctcggcgtcggtgaggaggccgcgcttgaggtcggggcggaggtagtttgtccaccggaggcggcagctcttgccgcagcggagcagcccggcgagcttcggcacggcgcgccagcagcaatggccgttggtcaggatgaagctcatcagcttcttgtcctcctccgccgtccacggccccctcttcacccccagcttgtcgcagcacggctgcctccccatcctttatatatacacacgtactgctcctcctccgctgccggtgatcgccgccgggaaagtcgaccacggcgagctggagccgctgctgtttcgaataggcagaggcgaggcaggttaagttaattgattagctaggcgtgcatcaaagcaaagggggtgggggcgtgacaagtgcctcgcaactgcaaccggagcgtgcgggtggaagggcgtatatatagctaggccctcctgctccaagctctttttaatctccggtgatggcgacggcggcgacggaggcagctcgctgacttagctgcgcccacaaggctaaacaccaccaccacttgcagtgctgcacacacacaaaaaaaagaagagattttgatacgtgtagagggctcaaggagtagtttgcggcttgtgtcgcacacctgcatgcaccccgcccggcctggagactgttcctcgatcgacgctctcctgagaaagaaagagtaagagatcaatatgtcaagatacattggtacagtctcaagctctcacgcactcttgagtaagggaaaaagtgactttccagatgatgctacagagcttgcacgttaactttggtgcgttatcgatggatgaaaatgatttttatggtaattattcaacataataaaaaaataaactattgattaaaaatagttctctgaaatattgatggaaaaagtttctataaaactcataccgtttagaaatactagtaaactaagtaaacatgctcacaataatccataatctgtaagctaccgagaatgccccttgaaagatcgattaaattattattacactaatcctccttccgtaacttcttagaatttttttctcaaatataacaacatagtaaaaggtgatttttattactgaactatccttagttatattatcgtccaactaatccagacctataggctataccaccacacaacctttactcctcctttaatagctgtgtaaatggttaaaacttattatattttgggacggagataatattattttattttcttaattttgcatcaatctcaaggcatgttggatggtagatcaatcgtttacctctgcttcaataagctgctgcatccgcgcgctgcaaattaagatttcctttttcagagggtaagtgtaaacatcagcaataacgtacctccaccacacaaaagctacagtccggtgtcgctgaaggctttgccacttccgttccccacggttgcatgtctgcctgcccgcccaccttgccgtggttgcgcccttacgcaatgatcccatcaaccattccgtcagccacaaaaaaccacggccccggcagaacaggcatgcaaagtggtagatgcaatgcaagcctgcaactcgcagcgctcagcatgcagcccagccaacctcctcggagcaagtggcatcgtcgtcgacgtcgtagacggtcgccatgagcaagcaacctcgctcagccgtgtgtccagatggccggaacgggtacatgctttgtacgacggcgacctctggcccgggaaagaagactcgacgaaccacagctgcagccagacgtctcgtgtcagccataccgatacgatccgtcagagtgtcaccttcctccggcctgtagttactgactgattgacttgctgtaattaacaggcaagacagccggccaaccgttgttcctgtgtcagtatcaagaaacgacgtaagataaggtgcaaagatagccagacgatccatgaaatactgtaaaactgtagggaactgttaaatgaattcttaggtggttaggtttcactacttcagctatgctattccagcaaactgaagaatgattgaatgaatatgtagagatgggccggtcatctgcaacagctaatgctactgaaaaggcgggtcaccatttacaagtacagatctagtttctaagtgcacttcagcactgcttgtcaataatgagcactggaattccttaagaccagttttattattcaactacattattaagggcacaaaccaaaaacaagaagacagggagctcattcatgatcaggttcagtatttcagaatcatgaacatggcggatactggtgcggtgtggttgaaaaatagtgctaccaatgcctgctaagtcggcaggagtctattttatgattatcttttactagcttctacttacaaatttacttgatgcgaagttggaaggtgcgaagaaccacggagaaacaaggtgacatatcagccatacttagcgaacacctccatagaacctgcatactgtagtactaattgacatcctaaaattggcaatccaaccagggtaccgagctcgaattcgccc

SEQ ID NO: 68328 - DNA, 631 bp, Oryza sativa
ccaatcaactgccagcgggtccgccagcttgagaaggattgatcagccgcgcgcgcgcgttgacgttgtgagttttaggcccataaggcccatgcataacctgcggtggcgcgtatacgtgaggcggacggcgcccacgtcctgtattttttttccggaaaagctaacatatgtgtttttttcgtttctttttgccatgtttttcgtgattttttttattttagaagttgaacctttcatgttgaaattttgaatttgagttgaaattttgaattttgagatgaaaattttcaaatttgagttaaatgttttgaatttttagatgaaagttttcaaatccaagttgaaagttttcaaatcttgacttgaaaattttcaaaactagatatggaagtttcaaaatgtaagttgatttttttaaaaaaataaattgaaagtattcacttgaaaattttcaaatctaagttaaaagttttttaaaaaatcttgacttgaaagttttcaagtctaagtcgatagtttttaaatctaagttgaaagttttcaaatttgagttgaaagtttttaaatctggattgaatgttttcaaagctgggttaaaagtttcaaatccaagttgaaagttttctaa

SEQ ID NO: 68329 - DNA, 5595 bp, Oryza sativa
tgtggtttttctaccattgaaacatgctatgaaatagtaaagtgtgttgccaaaatttagagaaatttgataatttgacactttttcgttgcccatttgtattaattgacacttgtgaggatgacatataggatcatctgagtgaatgaaagtgggtcaagatgtcaaataatcgaaacacattttaagaagtgttaaattatcaaatctctcccaaaatttattggtgatttctgtgttttgttcccattttttaaaattggttggttatttcggtcatgaccaaagaacgaaccaaaatgaccaaaaccgaaaagcctgctctgaccgtatgccctactgccagtatttggatcttagtttaaccgtgtttttaaaatatatttttaaaaaaattcaatttaaaacaagtcttataaaagtacagtaggtacacgaattgaagttgtttgaaggtccggatcctaactgtcgtaggtacacgaaggtagtactaattccttgggtagctgtagctcgagtggtacacgtaggactaatcatcacacaattattatttgctatatatctatctattatattattagaacaactttgaaaggaggcaccacgttcgctgtggggactaaaaattcccacactaatcagagaaaaagaaaaaaaaaagaaaaggagagtccaagtagaaatacaatctaaaaatagctgaaatttagaattaaaaataagcaatattaaaaaaagtttccatataagaacccaatacgagattaatcaaaattcgaaataaaaataaaataaaatccaaaattaggaaaaaaaaagagagtccaagtagaaatacaatttaaaaatagatgaaattcggaattaaaaataatcaatattgaaagaagtttccatgtaagaacccaatacgagattaatcaaaattggaaataaaaataaaataaaatccaaaattagaaaaggaaataagagtccaagtaggaatacaatttaaaaataactgaaattcagtattaaaaataagaaacattaaaagaagagttcatataagaacccaatacgagattaattaaaatttggaataaaaataaattaagtaacaggcctataaaagagtagagtggtggcggttgatacgacatataaaaattgttaataaaacatcaaatagaatcctactgacgattaaaaaggagggacgtcaggcaggccgtgaagcaaacgagtaaggcggttgccggaacttcttagacagtaaaaaaacaaatcgtattgataatcgtattcgatttttaaaatctcaatgataataaaaaggagaagcagcgagcggggtgtataagagtatagttgcagagccaccgacggttgacgggacttctagaaaataaaaaatgaattccaacgatagttatgttcgatttttagaatcacaatgacaataaagaagtaggtggcgaacatgctgtagaggggcatagtggcatcgtttgataggacttctaaaaattataaaaaatgaaactataagttatgttcgattttaaaatctcaatgacaataaagaatgaattccaacgatagttatgttcgattttaaaatctcaatgacaataaagaaggtaggcagcaggcgagccgtagaggaggacaatggcaaagctactgacggtttggcaggacttctagaaagtaaaaatgaacccaaacgataattatgttcgatttttaaaatctcaataacaataaagggtagagacaatggatggcccgtagaggagtataatggcaacgtttgacgggacatctagaaattataaaaataaaacccaacatgacaataaactctaaaaactacaaaatccaatttttaaaggttccaagaagaatgaataaaaatagtggtagatcaagcaagcaaataaagaaggagatgatataaggggtagcaactggtgtgacttttaaaaaatatataattagaaacacaaggatgataaggtttagtctttcaaagtcttaagacaatgagatagctattaataaattttaagtaaaatcatactaaaaaaatatatgattttgtttgggtgctagccacccagctagttcttattatttcctcgaaaaaaatattgttagttatttagcgcaggaggatttgacttctgaaatcccggaagattctatggtttgcacccatgcattcgttttggtttccccctgaaaataaactcgagataaacacacacacagattttaaaataccggtaagctgggcgcatacgcacacgggggctctaaagaagacgcacaaacgcgacaaatcccgtatgggcaggggcccgtgcgtggcgttacggagcatggcttcacatatcggggacctgcatgccgtccggcggccacttctcccatgccggcaacgaccacacaagcaaagcaaagccattatccgtcatcgcccaattaaagcgttttttggatgtggttttgtcttagattcctacaatctgtccgccagattaggcttcaggttttgtgcttatctatcgatcccttattaatataccctgattaattaagtgcagtactttgacgaccaaggaatgatatgtatgcaattttgtggtgatatacatgtatgctgagatcggtgcccatgtcaccgggtgatcccggcagctagctgcgtactgtggatgcgcgtatagtatatagtatcaccaacgtttgcatggtggatgcgcgtcgttttccgcttggaagtgagggcgaaagtgcgatctaggagggatcgatcgaaccggttcggaggaaagactgcgatcgatcgagccgtaggatggaaaactagggaggatctgatcgaaccaaatctcgaatctgggaagagaaaggttaaatcttgttcatcacatattgaagggagaggcccctaagttaatactccctccgttccataatagaagagattttgagtttttgtttgcactatttgaccactcgttttattaaaaaaaattagaattatttttttacttactttattatccaaagtactttaaacataacttttcgtattttatatttgcacaaattttttaaataagatgagtggtcaaacagtacaagcaagaactaaaaatcccttatattatgagacggatagagtatatgtgggagacaagtgggattgataatgcgaaggatgatatgagatcgatcacctgcgaattctctagattgggaatgttgggaatattaccccaacttaaatataaagatcagatggtgatggaaatctctgatgggatataaaagctgaatgggtaggggggagctatgatgttagtgtgagtggtcaatttagggtctacagtctccccttgttggccatagaaaatggaaagttgtgtctcaaaaatgaataacacaagagaatctactacacattctaaatgtcagagcacttacatattgcggtgggaaagaatgaataatctataacctcatcagtattttttggaggtgtataaccttattgttcaaaacataccatgtgatttttacatcaaacacgtaattcactttttatttacacgagcaattgataaatgtttacacatattaactaattatgaattttaactcatataaaataatgatttttagaaagctaactaaaaagagaacaatgcatggaaaacattaacatttcaaaattcagtgagcaagacaaaaaaaagtagaatgacacaggtggtgtgatagcatatttgtcaccacgaccattatattccttttaaagtagcatatagttttttcttcgaagaagtctgctccatcatttgcttattattttatcagccgcaactgaaatttaaattttaaaacataactttaaagttaatttttttcatcgtagtttttttaacattttcttttaaacatctatgaacatggatatgaaagttctttactcacaaatcacttttggttagttgtttcatttttttcatggtttatgagccacacaagtatacaacaaatgatgagaagcactagtatttctattgaaaacacacattgtatatgttatatttatgggcaccagtatttgaatcggataggtaaagccaagaagaatctacaactccaccaccggactacctgattggctcaataatatataatttatttataaatgtagtttttcccctatggagaatttcttaataaaaatatcaaacatatcttggaagcaaataatatctggtgatacttttcttgtgaaattatgcttttcagtcactgtccttattttattttttttattccttcatctatttggataagtacggagtacctaacatagttttagggagacattatttaccaaaactaaagttgccaaactcgaaatatactcaaatggcattgggtccagccagcccttaactaaaaattactaggcctactttcttaaaaaagggaaggatagctagccggcctaaacgagccaagcatttcctttattccacaaaggaggaggaaagaacatcttcgatcgatcgagcactcgatgataccttgaataaacctagccaaggagtgaatgattagcgtgctaatcctctcatttccgcctatccttcattcctcaacctcttgctcgtctcgctggcacccatatattaaataaggacgggtctttaagcctcctatctaatcatgattattatagtgtcgccggtatcaatctaccaccttactccatccgtcaaaaaaaaaaaaaaagacaaaccctgattttcgtgtccaacgttggaccatccatcttatttaaaaaaatatgaaaaaaaaataaaaagacaagtcacgtataaaatattaatcatgttttatcatctaacaacaataaaaatacgaattataaaaaaatatcatataagacggacagtcaaagttggacatgaaaacctagggtttgtcttttttttggacggagggagtatatatatccgtctaatcaattacctaaatccacactcccttttggaaattcgaatggaatcaagagccttttttgcattggcatggcgacctttgctccggagcaagcgctgctgctccaattctttttgctgggaattacgcgcgccaccaacctcagcttctacctccatcattctctgctttagttgtgaaagggcaaattaccttaaatataagtgcgagagtccctcacctcaatggttagtttttgggggtaggaaaggcccttttacgatcctacaattcgtatcagagtctggctagtttaacatctctgacccgatagacagtgtgtgaaggactgatggaccgtgggtgcctgcgggacccgtatacctgagggaccgtgatgaaatgatgaagtactgagggacaccaatgtatgaagggggagattgttgaatagtcccatatttggtgattgtggaccgtggtgaaacggtgaagtaaggactgagggacaccaatatatgaagaggaagattgtaaatagttatatattgattgtgaaagggtaaatgacctaag

SEQ ID NO: 68330 - DNA, 2663 bp, Oryza sativa
gagacacattcagtgaaaaagaattggaaatggtaatattcttcttattcaatgccccatatgcaatatggatttagagcgagtacattatctaaccaagaattttgagcaatcttgttcaattatgaacaattgtgagcaagcatatttgctacactggagaaaaatgcagatgtgctaaataactggagtagtagttgtgctttctagtaggctagtagtaagtacaagtgctctagaatctgttatgcagttgatagtcaaacatttgactgatgacaaggacaagatgtcatatccataacacaccctagcgttctcagtaaatattgtgttagtcaaaaactcaataatgcaataattccagagtctcttgcagttcacagtcaaaattctcagattgattccattgcctcttctaatgccagccacatatgaataactgatgtagaaaatatatacatcaaagtgtaaaggccttaccttcggaatcaggtgtagcaaaatattgtatataccccagtaataacagcccaaaagctattagtttcatacttccttgaaaattattatcaatttgtttaattttcaggaacagaagcactcttgaatacactgtgtttgctttcttgatggaaaatagaagcactttggatttgaggtctgcactaaatagctgcatcaccgaagaataaaataaattgtgtgagactcacaaggcttaaagagtaaactgagaatacagatattgaggaatcttcataaattcctgccaaaattgaaaggaagtgctttaacccaaacaaggcaagaatctccttaaaagaacattcagactgtttgggattctttctagagataattattttatttttgttgcaaaccatttttgatttcttgcatataaaaaacatgtgatcagtcacctgactgtatgagtcttgcagcggtcactaaacctaaccggatttctatagttacactgtaatcgattgcctgtacaaatatggggtggtccaaaagaccttaaactgtctaaaaggttgtccttaaatatgaaaagtatgttactattgaaataaaggttgtcttaaagaaataaatgtaaattctaaaccattactggagaagttagaagctcaaaaaaaaagcccaaaatgatttaggggaataaactgagcaaaaggaaaaacagagacagacaagctgtcctcttctctttgcagttacgtagcagcttctcaaagttcacaccctgttctgaatactacttgcaaagaacctcaagacgcgcaaagtaaactcttctctgaattctctcttgatttccgagaaattttagctctggagattgcagacagaaacctctgctgttctgcagggtgtttgagctaacagcaaagcttcatccatccctccaatggtgatgcctcttctccccaagtcccaacataaacctccccaactcaaagaaccattaaattgagaagaaatagaataaattcaccagatgacacaggcaggtgattgaagcaaacaggcagagaagagggtagaagagaacagattcagaagtcaaccatgcttgctgttgctgtactaccacatatattagagagtggcaagaacttaccaagaagagagggagaaggactgtgtgctgctcctagcttcctaaaaactttcttctttcgtacgagagattggaggaagaagacgacctgaggtctcagagactgagctcaggccttatagacaagtcatggagctcagctgctgactgaaatcttgtgtgagcagtatttatgtcatgagagctcatcctggaggagacaatggagacactgtcattggagccatctcattggatgttgcaagtttgcaacggacggctcagatcagatgcaacagagaagattctccactgaacactcgatctcagccgcccaaaagggaattgtaaaactgcagataccttgataactttcgaagcaccgaaagactgtatttactagttgattaaccgaaattagccgaataatagaccatctacatctcctaacattttatagagaccctcctctgtgtgtgttggcatgagattttttcttagtactttttttaacgaactggaataaaacagtgtcaatttcactctgtacagatgtcaaaaagaaactttgtgtacaagcgtgaacgaagagttctttttgttagtatttggtgtggacatagggagtgttgaacttaactgttaggaatttgtgccttaaatattgttaaggattctctgcttccttgaccccgttgacttaagaaaggtgattacccaaactaccctgttcattctttaagcaacacgtactctcagtcaggtcacactcagggtgtgtgtttagttcgtcaaaagaaatttttcgggtgtcacattagatatttgaccgaatattggaaggggtttttggacacgaataaaaaaactaatttcataactcgcttggaaaccgcgagacgaatcttttaagcctaattaaaccatcattagcacatgtgggttactgtagcacttatagctaaacatggactaattagacttaaaagattcatctcgcgattttcatacaaactgtacaattaatttttatttttatctatatttaatg

SEQ ID NO: 68331 - DNA, 20956 bp, Oryza sativa
  unsure (1)..(20956): unsure at all n locations
cttttcacccatggaacaaagggtgtgtttagatccagggtgtaaagttttggcgtgtcacatcaggtatacggacacacatttatagtattaaacgtagtctaataacaaaataaattacagaatccgcctgtaaaccgtgagacgaatttattaagcctaattaatccgtcattagcaaatgtttattgtagcaccacattatcaaatcatggcgtaattaggattaaaagattcgtctcataatttacacgcaatctatgtaattagttatttatttaatactctatatatgtatcaaatatttaatgtgatagggtgtaaaattttatgagggatctaaacatggccctatatggtttttactgtatatttcttccgaaagtgcagtgcagagagcgggtggggggctcagcctcgggttagcttggctacacgcctacgccaccacccctcggaactcggagcccattgcttcctcggccccctccctcggaaggaaggcaggacaccgaggcctctgcaaaagccaacgtgccgagtgccgacgagcccgacacgtccaaacgacaggaggcggcgtgccgcaacacaatgccaccaccgcgccccgcctacttaaccaactgcgggcagcggcgcacatgcccaacaganacagccaccccgncccccagcnncccncaagnccacaaanggngngcccccccccccccccccacccccgcgcgcgcgtgttgccccgcttgctggcgcctggcgactgtttggtttgctccgttgcctcggctcagctaccctgagacagagagcgcgcgcgagctagttggcggagatcgaccccggtgcccgcgcgccgccgtgtctcggtgagacggtggctggccccgtcgctgccggaaacggctggagaatttaaggtacgcccgccccgcggcccgccgcgaatgcagtgcactctttgctctcgtttttcttgtcatctcgcgtatagctaccagttatacttgtagtcattcagaaagtattcaacgccggttacaattaaatgggagcaaatcgtagtggagttgatgaaatttatataatgcaatttatgtgtttttttagatgatgagaaatatatgtgcttgaatggttgaatgttccatgtaagttgtttagttgcggtcattatcctttttcctcgttttggtttagctgagctagcagggcgtaaatctatcctagcttttgcttctaaaggtgtgatcagtgctgtagctctctcttttaacttcaaaaaaaaaaaaatccgtctggcattgagtcgtcaaattcttttatttttgctgaaaaaaagaggtccggttgtttataatctgcatttggcccttagataggctggccgtacatgggtttgaagtgggactacatgagatgtatgggacaaagcacattgttatgggcctataacacaggttccaaatgttggttgattttatcggctaatgccggttagttaggataaggttaaaatcccaccggttttcctatcctaacaagaaacaagaaacaaactaagagataaatctgttttgtgtgatcggtacaaaatagattcgaattttagattgagataaacccccgagccccaccagtgtcgctatataaagaaagaggagggaggctgggtgacgacttaactctctccaaccctaaaccctaaatcaatcgcccgatcgattagacactggaaggggttcgtgaggtatctcacaaaagaagaagaaagaagagaagcaatggcttcatctcaggtcagtgataaattaatttccgcataagcagaaggtgatcatgtttaggctaagactcaattaattagttggattaaattccaacattgtggtatcagagcctaatcttagctacttgatccacttgatcccatcatccctgattgaagccactgtgccaatgaagtgatgaaccctaatctgttaagcccggcatgatgccatgattaatctgttaagccccttattctgtttattagttcttaaagttgctttgtgttgagcattatgtcatatttaagttaattagatcgaattagggttcatgcttaagtaaatcatagcttcggctagaaatcagtaagggaaggagaaattcaatcagagagagtttttttttctctcaaattttactaagcggagaacgagtgagataaaccagattgaaactctcattgttcccaactcataaaccctaggttcttatcatataagaacagtggattaagaagtaaattggggaaaacagggtataaactagattgaaattccccactgttaagcaaaagggaataaacaagattgaaatttcccagaatccccaataagccggatccaatcggcctaaaatccccaaatgaggaaccctaatttttgggggaagaaccctaagtcacaaatacccgaattaaatccaaattcaagtcaaaattaggttttgagttcgggttaattaccggatttagaccccctaagcttgccggagctctccggcctcctcagggccgcgccggttgaccgccgtgcgcgcgccgccttggagctcgtctctccaccgtccctcaccggggatgggaagcgtcggcttggcggctgccttcgtgctccgcccccccccccccggcgccgacgaggtccggccgcatagacgcttcccgtcgctagcgcgccgcctcgccggaccgccgacgctgtagcacgcggcttggcgtcgccctcgggcgcgccccccagccagctgaggtggagccgctgcggcgctcgccgccgcacgcgcgtgccgtctcgccggaccgcagtcgcaacatcgccgccgattcgctcactcgctcgccggacgccgaatcgggaagagaaggggacaagaatgagctagggttagggttacacccattcccccctggcacgcgatttcttcggcgcgggcgaaatcttggccgtccgtttgatccgacggccgtcctcgctcccgcgtcgggccgtcgccgttaatgggccgagccgatctgggctgcggccacctcagcgccgcgcaacaataagtggaccggtccgttttgggacggcctcaccaataagagtgggctcttattaattttaatcttaagcccgtgaatttaatgttttatttatttccataaattcatttatgagctttcttagccatttaaaattgctagaaaattatgatcaattatttggtcactcagaaagaaattaatgatatgatattatatttgaccaacattaatatgatttcatgtcaatatttattaagattattatttccttaagccaattaatttatttctagttgaatggaaatttaactagaaagtatttatgatttcatgtcaacatcattatgatagtcatttccttaataacttaattatttatagtcgaatggaaccaacgagaaattcgactagaaagcattaagatctgaagatatatttaacccacgttattataattgcatgtcaattataatttttttccttagttattttctaccaaatggtgatataattaaggaattaattttaagattactcataattatttatgaccaatggtgttttgactatgaaattctaagtttattttgcatatgattgattaagccatagtaaactaattatatgcaattatcaatgcttattatttaagattagttggaataccgagtaaattatttctagataaatggaaccaacgggaagtttatctagaaagaaagatgatttcattaagattgttatttccttaattatttctgcccaacggtgatgtaattaagggaagaaatctaagtattgtcaatcattattttaattttctctgtcattttagccttaatggtgatatgacttagaattttatttatgccattagtgcattaattccttttatcacttctaccttgcggtgatgtgatcgaggatctaatctattagtaagcttaattcctttaccatttctgcccaacggttatatggctaaggattttaattttaattctatggcatcactaatggcgtcatttcctaatcatttctaccgtatggtgatttgatttgggattttaaattatttactttatcacttctaccttttggtgatgtgacttaagacattaatgtttattccctaatcatttctgcccaacggtgacttgattttggattataagtaatttcatttattgattccttcgttttgtctctgcccaatggtgatacaaagcgaaataaagattaagttattgttgtgtaagttagtgtactattgtacgtaatttgcacaagcaaccacaaataatagtgccacttaattttatttatcagttaaagtctatggaattattattattattcctcattgacttaactgagcctaaggcctatttgagtatgacttagcattaacaaaggattccttgtgactcccgcagctaatgtcactaatttttcctaaactcaagaggcatctttagcctgggagaaggccaatataatgctatgtttcgcatgtcactcataaatattgagattatcatccctgttagtgttaaggggagaattttgagcatgacattgcgtctagcaaatgttgagatgaaatttagaagtttgtcaagactaatgcttagtacaaatttagtgcctatgcacatttgccgccataatttaaaggtagcacaagaaataaatcacatggcgtgcaaacttagtgggatggacattgcacatttcaaatgcgccacttgtccatttcatatgattcttctcccattagactacggtcattttcagagttgtaatactaagacaaagtggaccataattgacttggttcatcattctgcaaatcaataagaaatatagaagactaagaggcaaactaagtaagatcctgttaatcttgcatttgatggcaaagatggagcttcactaaggggaagtgttgcaacttccaaatttaatgataataaagctcatattcctcgcaaggggaattcaaattgcctcgatgtcctatgtatgctactcttgaaatattcttgtgtaagctctttgcaagaaatagggacatgcttaatgtcctgatttaatggcattattttgggttgaattattatgagacgttgtcgaaattatggccttattattcggccacatttctaggggagaatggacgtctcattgagatcgagacacttcacccttagaaatttctgacatctattattacttaaatgctaattcactaagtaaaattaagtgattcaagtttatgaaaaataagatagtatgcttccattaaataaataatacaatcagtgggagctcatcaagagctctaataagagaagattattctacctcattaatgactcatagctccattatgtggacgctagaattttgcatctcttaatttgtgacttgcacaattaaatatacataacatgacttgggggttttgttatggaaagacaagtcacatatagggtgcagacttaagaaatccatttgtggacttaatcaaacattgatgatgttttaatttccgctgtgtcattagtgaactaagcttaaataacaatgaggagaatatttattctataatgatggaagtaagacatcattgaaattgtgtcattgtcgcttatgtcacatacctaggggagtttggaacgtctcatgagatagagatattctttctcttagattttaatggcgttgtttagctttaagtgaaaattttatgaagttaagatattagccaacaaatgatttttatggctatgtttacctataagcgacctccgatttcctttaagaaatttaagacactaatgctaaaatcaaatgaagttatgagatcggattatggtggtaaacactaaataaagcttgttcaccttataagacattaaaaataagcgttcatccaaatggttttcgaaccatgtaagagtaaattgagatggatgaacaaaataagacattaaagtgttcatctaaatggttttcgaaccatataagaataattgagattgatgaacaaaataaagaatggttttcgaaccatataagaataattgagattgatgaacaaaataaagaatttagtagaagtttctgaatgagtcaaaatattgggccatttaagtgggttaataaaattaagcctgactctgatggaaatttcgaacaatccaagtgaggtggacagctgcatgaaaattaaaggtgggaatttcattcactggtactctatactaatgaaattttattgtcaagcaatgcatattgctgttagaaactgagaaaatttttccatgaattattttggtctgaaggagtactgggcttatatcagttagtcatacattgacaagaagaaataatttgagagaattcaattaaagttaatcaagctgaaattaagttataaagataatcatttatgattcagctgacagaagcttgagattggctcaaatctggatgcatatagatttggcatatatttttactgggaatcttggcagtatttaattaaatccagactagaccactggtattaagaatgttttgcattattgcaagacaatctgaagtaacatgctcatatttctaaagtccaatgatctcagaagtttagagacatttggacacttattttgtgagatgtttggatatttataaagattattcagattaagctatatccacacataggggagtaataaccatggaaaagctccaaaataatctcttactgcatagtcgacgatgcagttagattttaaagcatgttatgattaatcatatttcccagaactaagagtggtaaatagcgctcataaaccactcaaaaggtgtaaaccactcaattatactgtgtgcaacacaggtttctattctagtagcaacatgttatgtgttttctgcctaacacattgacatagttgtgaaagatatgtcccaggatcgaattattattaagctaagcttttgctcatggatccatactctaaaggctcataaagttaagattaattaagatatgttctggccagtacgtgcataaataagagcctcactaagatcctggatgagggggacttaatttttcaatcaacacccactaagttaagcttgagtttatttgggtactatagttcactataggtcttgttgtctcggtgacgcataatgttgttgaagacacattgccttggggaggtattttatttgataaactcgtcagttagtctcaaaatcaaggggagaatgttggttgattttattggctaatgccggttagttaggataaggttaaaatcccaccggttttcctatcctaacaagaaacaaactaaaagataaatctgttttgtgtgatcggtacaaaatatattcaaattttagattgagataaacccccgagccccaccagtgtcgctatataaagaaagagaaggagggaggctgggtgacgacttaactctctccaaccctaaaccctaaatcaatcgcccgatcgattagacactggaaggggttcgtgaggtatctcacaaaagaagaagaaagaagagaagcaatggcttcatctcaggtcagtgataaattaattccgtataaacagaaggtgatcatgtttaggcttagactcatttaattagtggatttaattccaacacaaaggcttttaaaaggaaaaaaaatcagccttggcccgcctgaatttcacatgatcacatcgtgacttcttgttcaaccaaagaaaaatgcaagaactaacaacagtccagggttctgttgttggtaaattacaattgcagtcgaaggaaaattatggtgtgttgcacaacctatagtaatatcgatgcaagtgggttggtccatggacactcatattggcctacgctagataatttggcttgcagtttcgcatccaatatgaacaggtcgggtacccatgacgtcatggatacatatccaatatttgcatccctaataacacacgtataatttctgcttaccttttgatagtagtttaatcttctaggtaaattggttggttgtgcatgcaactcaatgaagccaagagaaacttgtgttagcacaaaaaaaaaccccttatgtatagacgttttgtaatttgcctctaaaatcatgagttttatagtgtagagaaatttttagaggcactttaaaaattgtctaaaaacttttactctaaagacactttagaaacattttcaacacattttgttaaattttatctcgtagatgcattatttttgtcactttaaaatgtgtgtgcctgatatgtaaagatattttcttgagacattttaaactctgtagagacacttcttagaatacaaatatatactaatggaataaatataagtacataaggcacaaacacaacaacaatgataggaggttgagttggttagtgcattgaagataacattagtatacctaagagatcttgagttcaatgattggctatagcaaggggaaaaatactctatttttttgcattggttcgatatggttatggtacaatttaataactctggaaaatgtctccaccctcttacatgcataaaaagtgcctttttcacatttgttcttatagccataaaaaagtgcctctttcgcattggttcttatagacataaaaaaagtgtctttcacattggttcttatagacataaaaaagtgtctctttcacattggtgtgcagtttaatatcttaaaaaaatgcctctactctcttaaagacataaaaaaagtgcctctattaaaatgccacaagacatagatacattttataaaatgtggtttgacataaaaaagtgtctctttcacattggtttgatatggttgtggtacaattttgatatctctaaaaaatacctctaccctcttataaacaaaaaaaaaatgcctctattaaaatgccatagtccagattcgtagggtttgttaacgcactcaagctaagtcggcagaatgaggtatctttcgtggcggccaccgtcggctattgaaaggaacaaaccgcacgccaattaagtcagcacgagtttgtcctttcacaaggcccttatctcatggatgtattggcgatatatcccacacaagctaagctgcaagcaaatactccgaaatggacacgcctcctcgcatcctgtctatccatagtgaccggtccttttgaaaactgagctatagtggatatcacttgatttttcttcttttttaaaattatgactttcctttggacactgacacactagagggtgcattcatgttctcatgaaactctatagaaaaaattggcaattactaatatcggcttgaaataacaatgttctaaagttagctggcacatcacctattatctgattgggagtgattaagatgccatttaacctctcctacccgtcatggttcagccaaagcttatgtccaatatttttcttaagaaagaaagactcacagaaacgaagatatgttcaatcgagatataaagctttggccgagtttagttccaaactttttcttcaaattttcaacttttccatcacatcaaaactttcctacacacacaaacttccaacttttccatcacatcattccaatttcaaccaaacttctaattttggcgtgaactaaacacaaccaaactagtgcttttaccatgccttaggtactaccatgccagaatgacaaactagtgcttattgtcgtttgcaaggtgggtgacggtagtgaagcccctcgccgatcacatgtgcatgccaagtcgcctacggaaaccaccacaatcaggggcgaagctacatgcagctatgagggttcctaggcacctgggtaagagaaaagttttagctatggttaccccatctccaccatatatgcacccccctcatcccaacaatgtgtacccccaagcagaccatcaggccgagcaaaggtaacaaggccaacagagaagcgcacagccatgaggattttcttgtggtgcagcatgtttagttgacaaatttgccctgcataacagcgttgttaactacttcaaggtgaaacagaatgcactcggtggccagccacagcctatggtcttatcacctattaatcgtagcaggcaaggggtgacgtcaaaagaaagttttgcaatttgctttcatagtttcattccattttttcgataatttcaaacgaaaaattaagttgttttgtctttttttttccttgagatgctgatgttggacgagtagttctccaattttggccacctattggttgtgattttaatcttaacttcttcaggacactgcgctgataagtatcgtcattgggaattcccattttggcaagtagttttataatttaccgctaagttttcgttcttatatcactcgttcatgttaatgtagatactgaaatcaatggttttactattgtttaccataatgttctttgataaaacatgataggtcgtacgtatatcattttcgaacatggtagtatattgctactatagtggtgcaccaccctctgttttgctctagcttcgccactgaccacaatctgcgaacatggtgacgcttctggtgtagcagcatccaccctccatgagactgctctagtcacgcatgtgctggtgccgcccgtcatctcctatggcttggttcaaccaaaacttcgtccttgcagccaaagatgacgaaatctctatcttcatctttaaaagtagtgctctggtgttatgccactccgtacaacaaaatataaaaatatcattttttttctacaatgatgattgttaattacttctgttataaatattgtttgaaagaccagcaatattgtcaatatccaactttcaagctagcaaaatgtatgcatatatttttttatgaattacctggcaaacctatctctagttgtgtcatatacctatagtcccatagtgtgacttttggatgtacatcgttaatctttagaaaaatataatgcgacatctcagtactatttcggttggtcacaagaaaatcatattattatatgtactagatttttcaattatacaaagaaaataagtagtcaaagttgatttttgtaaattgtgccaattttaaaaaatgatacattttcatgactggagggagtatacttgcgacagtttagcaataccaaacaagaccaacaattcaatgcacttgaccaagtatttgaacccaatacactttgtatgaagcaagcactttaaactaatacccacttcagctatttcagatgtctagtcaaatggccagcaaacgttaaatgatagtgtaattatatttatattagtacctcatcagtgtcttgaagtccagaaaaaaagagggtgagtccaaggtatacctccatccgaatgatgctatgcctgaaaaccttcaacaccgtgtgaattatggtgagagtaatttcgccctacgcaaattatgccagtaacgttctctatgcattcaaggcatccatatatgtagcattcatgtgagcaacacattttttccatatcatctatgttaaaataaagcagtatgaaagattcatcaagaaaataaggcataagccaacttccaaacttgggagtgcttatctggttatctaccatccatacgtaatcgcctagaacttcaagccaagcacatcatcagttgcacactcttttaataaagtacatatgacaaacaacacacctaccttaagttttttggatgcagtcatgttacacctttcaaccctcttctatgttctaacagccaacttcgtttttgcatcacaggctataaaaaggggtggcatccatagctgaagggacacacctagaaaatttaatagaactttacaaattgagtgttatagtgagatggcatcggagatgagcaagaacgtgaaggtcaccgatgatcaagaggttacatcacaggagcgtgaccaaagtggtggtacaaaagtaggtggggaggaggaaattgctccactggcgcggcagtcgtcaatcctctccctcaccttggaagagctacaaaactccttgtgtgagccaggacgcaactttggttccatgaacatggacgagtttgtggctaacatatggaatgctgaagaattccaggctaccaccggaggttgcaagggtgccatggaggaagccaaggtggtagacagtggaagcggaagcggtgatgcaggaggaagcggtttatgtcggcagggatcattttccttgccgctaccgctgtgccagaagacggtggaggaggtgtggactgagatcaaccaagcccctgcacacacctccgctccggcctccgcgctccagccacatgccgggagcggtggtgttgcagctaacgaccgacaggtaacactaggtgagatgacacttgaggatttcttggtaaaggccggggtggtccgagggtcctttaccgggcaagcggccatgggatctggcatggtcaacgggccggtgaaccccatgcagcagggccaaggcggtcctatgatgttcccagtaggaccggtaaacgccatgtatccggtgatgggtgatggcatggggtaccccggtgggtacaacgggatggcgattgtgccaccgccacctcccgcccaaggtgccatggttgtcgtgagtcctggatcatcagatgggatgagtgccatgacacatgctgatatgatgaattgtattgggaatgggatgatgattgagaatggaacaagaaagcgtccccacagagaggatggctgcgccgagaagacggtggagcgccgccaacggcgcatgatcaagaaccgtgagtcagctgcacggtcccgtgctagaaagcaggtacacatgttgctccgaaccttttagtttctatgtatcgttaagacattttgcatggagattgaaatttttatgaataatgctacaggcttatacggtggagctcgaagctgaactgaactatctcaagcaggagaacgctcgtctcaaagaggcagaggtattaaagcaagaaacattatccactcagctttcattgtcattcctaaacagtctcgttccttccttttctgtaacattgaactgataaatatacaatgtctatattatcttccttttacagaagacggttctactgacaaagaagcaaatggtattgtcctctcccatgtggcaatccccattccgcatagtgctcatcgttttgtgaaattattaaatacatatttgttattcatttatttgtgtgtgtatatatgctcatggaaatatgtcgtgttcctgtgatttttcagctggttgagaaaatgatggagcagtccaaggagaagatgaatgcaaataggggtggcagccagctgcgccgcagcggcagctgcatgtggtgaaacgggcatagcggtgaccggcgagtggcacactcatcctgcttctggtgtggcactagcctctgaggctctgaagaggatttgcacattaagtcttctttcagactaagtgatgtgaaggtattatggtagtagttgatatacatatatgctgtgatgcttgtaaacctgcctggacccacatgtcttgccatcgtgttcaccggtccttgctgcttatatggttacatgtcgctgtttgtacaaaacaacgatgaataaaattatacaatagtatactagtttgtatctgtaagtttgttctcatgtcatatgcgctggaaaaagaaaagctacagtataggcaaaccttggtagtatcgattacggcccaaatttctggccgaataaactggaaaccgaaacaagctgatgatgatttgggctttgcgatggcgaaaagttcggcttctatgatccgatggaaaagttgacgcgaggttacacggtttgctagtttgtgggaattccccgatcctcggttaatctcgccgtgttgccgtcgcttgagcaggagcagggatgcaagcgggacaggcaagcgggtttttttcccgcttatcccacttctagtctatcttttttttaaattttgtactactataaaaaaaataaactagcaagcaggtttttatgcaggtagcgggattacctacttacatccctaagcacgaggttgccagcatcgggcttagcgtctccactcgtgttcgtgttggttcctacctctccaagtctctacaagtctaatactctcaatctcaatgaccaccataacaatagcgtgcatgacgacgggagaataaaaaaatatattgataactagagggtgtggctggacatgcaaagacgaagcggagggacggtggtggtctcattgagaaagagcggtggtggcggtccgtggagcggcaggtagtgattactggtggtccgaagagtttgctatcgacacaatctctaatcaagtttattgtatttttttctctaagtagtgctaatatgtgagccaccaattattataaaaaaatatttcctcagtgtttcttttcccatggcctctgactatgacattatttaaacaagttttatactgagacactttctagtagattttggacagatgtgacacttttatattttggacggatgagacactttctaatagattttagacggataggacatttcagtaggagaaagtgtcatatttgtttaaaattagaacagtggaattactaagccaggtttaaagtaagaaaaaaagataaaggcggagatactcgagtatcttccctttccttgcgtgtaaaagaaagtctcccgtctcttctctcccgctccttgcgccatctcgcggctgaaccggggaggggcgccgatctctatccgacgagcagaccaagggaggggaggggatcctggtgagcatctgcatcctctttctgattcatctctctcaccgggagtacttttgtgtaatttgcttgcgttaaccctagcttatcttctagatctggaagaagctctcctcttaatttcagagccttaaccttaatacaaataacagtttgttgtttgttccaccaaaagtttgggggttcaactgaacccccatgtcccaagttggatccgcccctgggtgtaggtgtaatattgcgatagagatctcatgattgattgctatctcgttctcgtacttactgcttcttagtttcttgatgtgatcaaatagctgccagtcctttccatgtaaataactgcagatttcttgtttattacacgttttgaactaattgtgggcttcacattgtcgaattttaaggagttaatttgaccttgggtggaactgagtttaatatacaaaattattctttccgattcaagttttgcttatattgtactccatccctcgatgatgctagggttcacccaaatatttgaagacccaagcgtttggtgattggcaaagatgggttgggggatatcccggttgattggactgaaagcagctgtgttcctctctgtggcttatttcttccatagattggacatgacactgctttcttttcccctcatatatgcctctgtgattgcgatgcttgtttctattgcttcacatccatcaattgaccttcctttgctccttggcaaggggtcgaatggaagctttcctgtgtggtcatggatcatgttctcaccatttcttcttttcatccatctgtttgttctgttacgaagatttgtgaaaaatgagcccttgtacactgagattgctgatggagtgtatgttggagggtggccctcttcagttgagcgcctgccccctggtgaacctgcagtcatagactgtacgtgcgagctcccaagaagctctactatatccgagaattcatatttgtgtgttgccacctgggatacaagggctcctcaaccatcgcagattgagtctgccgtgagatgggcactgagaaagcgttcgcagaacaaagctgtatatgtccactgtgcctatggtgagcttgctattctctgagattttgcttagctcttatgtggtaacaatagtgtgtttccatacatgtctttttttcttcaaaatagtaatattaacgatcatgtttatgcatttctagaaccacttttaccgtctcaacttgatgaagatttttgtattttcacacaataactacatcgtatcattttgattgtttagtcacaaacataagtgctttgatgttttgattatgcatgcttttcaattatcacgtcatgcagttattttagcatttctgatttatatcacatacaaatcgacatgaagttaagttccctcgcatagactaaggcaaaatttatggcataaaacaatatccattatgattgccatgatattcatgtatgctcatatgtgcaattcagatttcaacgttaacatataaatgacgggaaatgtaatgatggtatcatactttatataacaccaagtttcatgtaacaacaggtgttgtaagtgtaggccacagaatcacaccattcatcactgaccttttgttattttgtaacaggccatggaagaagcgtctgcgtgatgtgtgcacttcttgttgcattgggattagctgaggattggaaagctgctgagcaaatgattcgtgagaagcgaccttctattagcatgaattctcttcatcgtaaaagtttagaggaatgggcaaaacacttgctcactccctcaaaaagaagtggggaatcagatgtgagttatgcgattctttcggatcatacccgaaaaaggcattgatctcgcaagaaaactaacttgctcagtggctgtgataattgagatgaagtttaaatgctctggcattatctactgttatcctagtcatgtccaaggcatttcattctctaagttaattgtttgggagtatgttgtaaaacttctactactgtggcttacaacgccagctcttttaggcgctctgttggctgcgtttgttgccctgacttgggattagggttcacagatggaatttcgcgaaaaccaatcggatttcttgaaactgctaggtctcggtttatgaaaaccggaccagttttgtaccgcattgaccgaaagtcatcggtttttaccggtttttggtcggatttcggtaaaccggtgaggagcggtttttacttcgaaattgaaaagtaaaacccttgttgggaacctttccttccccttcggcacaaaaaatagagcaactcattagcgcttgagcaattaagtattagctcaaactaacttaaaaaatggatttaatatgatttttaaaacaactttgctatagaagagttttgcaaacaccatttagcaatttgaaaaacgtgtgtgtggaaaattgagaggtataagttgggaaagctcgttgccgaacgcagcctaagaacaagttttataatagagccaactttaagtttatagcttatattagaattaacatgtatagtgatgagctataaggttatctctctatttttctcctctctctatctctctcatgcatatgcatttaatgtatttatcttgaagtatgtgaatagctatctcttgcataataagagccaatctttttcattttctaaattctctttcctccacataagtttatttgccttatagtgtactattaaacttgctctaatgatcttccctgtcattgaatgcttgccagagacgtggtattgtcggatctctctttctgaaaaagaggggcctctgctagcctgctagattctcatttatagcgaaatgtggtatgtttttcatttttggtagtttgcatctatctctctgttaggttcttttcatctggcctgaaataaatgctcaactattcaccactttgctgtacccctgtattctgtggacatttcatacttgactcatgaaaattttcatgtttgtatctcatgttttgtgtgtaatgatcgtggctaagctgtagtgtactcatcccatcatgctatcttgtgtggagtatgctcttctggccttttcataatttttgccatttttctgcccttgtctcaagcaccagtttgccagttgatggatcaaaatcaagagctgcactattggaacaatctacatcctacggaaagtcgcatgcctggcaagaaatatctcaaatggtcttggtagatgtcacatgacaaaagggttgcttttcacctttctagttctttgatcttcttatcagttgaattcactgatctgccctttcttccatttatttggtctttgaaaaaagggacttccatctatttgtttcttgttttactaataagcattgtgacattccttgtgacttgcgttgtttttctgtgtcctgttttttacatgtatttcagatgtacctcttagtgacaactattttgtctgtcaattgatggtattagatttgtcctccgtgatttcagagttcagacagttatcatctctcttccatcagtgccattagtgccaggttgggaaagccttatttgctggcacgttttcttttttctttttttttttttggtagtgttgatctgcgtcatgttctgttgttatctgtagatgtctattttcaaagtaagcttgggaacatcctacctttaaaaaaaatggcttgttcagcagaaatattagaggttgttttatgcatcggcttttgggaggattttgtctgctcaagtcatgagcagccacgcatctcctgcctttgcattgctctggtctgcaacaattatttctgtgctaactcttcagcctgttcaagagccattggaagtttggaacaagtgagccagtgaccagcattgcattgcacctcaacaaatttttgcctcttccttttcctagtgatgttgctttctcaatactttaataatagaacattacaacccctctccctctcccaccctctctttctaacatcacttttggccggagtttacatcctccaggagaagctctcaaaatcctgagtactgattctgctgaggctgattatgcatcggttgcagctcggttcctgtgggactgacgctctcggtgccaatgaagttcctgttgcaagagaaaaaagagtcaatgccagccatgttcatctgtttctccgactagaagagatattgcacgaatatctgtcctcgatataacacatcaaatgatcaaatcaaccatccaccctatgaacactagtataattcatcgcttatctaatgactcgctggaggtatttcactcaaattttctttcttccttccagtacaataatgtggctgaaaaatgatttggaaatttagaacagtttatttgatcttttttttcttttcagataagcagttctgagtcttactcgcgaggacgtgaagaccagaggttgctgagagcacggaggcggcggtaatactccccaatggagaggaaacaccgagccgcctgccgggttgttagaatccgccgcagctgatgcaacgtttgttgcctcagattgtcagcctgcacatttgccaggttagtcacctaaaagctggaattgaatagcattcctgaaagaaaacgacatgtcgaattgtatagtaattctgtatcttgtctgtcttagctagaaattttacacggtatggttctgccattatcttttgaacaatgaggcatcttcagataatctaactgtatattctaatgtcatgttgttttctctcctatattctactttggacacattgaaatctagcttcctgtaggttctttctagaataacactaggatggtcttttctgataaccttttggacttttcgatagtgtaactgtatataccaatcaattgtatgatacttattattttctttctttgcacacttaaagggtggtaacaaaaataaaagagcagcaaatcgatgataaaaacaatattcggtggtcatgtttatttcgagtcatttttatatcatgcaaaagtatgattagcaaatcattatgcataccttttttctcatgcaagtatatctaacacaacctgatctattcaccatgcatcgtagaggacttgtttttgcagaatgatcactacaatcctgaacctgcaattaataatttgctgcctactttgccaatatctaatacaaccaataaaccgcaatcaacatatctgaaaaggggccaggaggaataagaagggtcatgaacaaaccaaaatggaggtctcagtctccttttatcccttgaggccttgagaaagagacagagaagggataacccatgagaaaggcaaagaccattttcttccagacttctgatggaacagcaagctcctatccatggagctgaagtttaggtggctgtgtccttttcctgaacactattcatggattggaacccttgcaacttttgcaaggcatggaacatcataaatgggactcccaattattttttgctatgcttgtgggcctctgttgaggtaccagcaaacaaaagagaataaacaagagatatagccggcacagggggtagaggcacaaagaacaaccgtatgtattcgtccattgactttataaagaaagagacaggtttgtacatgtagagtactgtatgtaatgccagtacaagtgtacaacaacctttgcctcctatggcttggcccctaccaacaactcctttttgaaaagcatccaataattggtagtaccagtaatccggtatcgttagcttgttctcagttaataacaaggtaattatgcatgctggaaagtgctaatgatgcttatctgaaagtgttaagctggagtagtagtatagtacttctttctgacaaaagttggcctgtcagggagaaggttggac

SEQ ID NO: 68332 - DNA, 18883 bp, Oryza sativa
actctgtccatgacttcacttacgacagatactttggtgactcttagtaggcttcctgagcttttctctctcattttttcacttgatgcagcaaatggtatttcaaatatcctcaaaactgtgcagaagaatacattggagtcaggtggtaaaatctttgtgccggatggggggtttacaaagttgaggttgctccgttttacggcaccagtgctaccacctctgagcttcctagaaggggcaatgccagagcttcagaggcttgagctgaggttcagaatcattgagtttgtatacggcctggaaaacctttcaagtctccaacaggtatttctgacctttagcagccaggcacctgaagatgcgaaagagaaggtctctcagatcaaaggactggcaagcaagattcgaaaggctgattcctccaacattagtgtggtgatagatgagtacaacgaattatcaaaagaacaatagattacctagtcatgatctccacagttggagggaaccagtgtgttatcgatgtgttgtacctactccatctacagtctgtttttgttttatgattttcagatctatttacaattttttgtactgtttttttgttgagctgtggcatctttgttttgtctgctgtactcccaaaactctgctagtgaaaaaaaatatatcttctgttttcctaagaaaactaatcaatataaaggtgtttcaccaattctaataccattggcctacttaaagatgctatttatttgcctcgcaaatttcaacttaaaacaaatatctgttttcagtctctaatggggttcactgatccctgacaattaattattgcctgtagaaggattcactaatccaagttactgccaaaatttttttaaaccaaatttaatttctagtaattccagaattctaattagttcctgtcaagaaaatgaattctagttaaccatgtacttgtgtttattctagtcaacaatgcgtgtaacatgcatttgtttctacatccaaatattccgtaagaaaacaatgtatttacaaatactctaccttactggaatcaacttgtatagtgtcttgattttattttcaacgctaggagttctgcagttttttatttcattggagtgtaacattttttagtttatctattcctacacacaatctgttttacatcctcacagacgtgactaaatcaaccgtcttaactaaatatcaattttagtttttctctgcaattttaatcaggtggttgtggtcttgtggaactgccaacatcaccaattcatttcagttattttttttatgttgctcattttgcaatttcagttcatgtggtgtgtagtttcctagcttgctctgtatcaacctagtcgattaaattactcccttattattctttcgataatgacctctacatccagcatgtatcagaccataaattacccccttgtgttcctagccaccacttagagtagacaagcaaaataagagaactgaatcaatcatgtgtctgcatcgagatgaaaaacctagtaagccgtggtcctcctgatgagccatggtgctcgacctgccgatggttgggtggaggccgacgaaggaagacgtgaaaaggggatccgacctcggaggaggaggaggtgcatgcgcggagatgtagcggcgacgccggcgtggacggcacagggatgccgcgcccgcgcgtgggcaggaggtggagaaggggggcgccggcggggaggacgtgcgccgtgtccctccggtggccggagcggaggaggaaggagaggcggagcagatctgacggcccagattgatcttgcgatattgggccttcaagtgtctcctggcatgatggcagcacccttaaacgggcctccttcatgggcttttgttttggttgtctatgtgggctgtaatttctgtgggccttcacatttgtgggcctctaatggccatggccgtcatgtaatccgtgtggtgagagatgctcgctctcgccgttgccatggcctccaccgccgccgctctccccttatttttcacgaccccacctcctccagtccggtgaccggagaaggggaagaaagaaagcctagaagatccgacggcggcacagattggttggcgctctctcacgcgagtcatacatggtcgccccgctttgcaatgcgtcgagtgggcgaacaggggtgtccggatcgggctggagacgtggagatttgactacgcgcacaaggtgtttgacggaatgacgcacagcttcctagcagtcgaactaccttctgttctggaccttctggtcagtgttgttctacttcgattttactctcagttttgagttgactttatactgcaatgcattccacaagtttgaactgtgtaggtagattttggaacttcaggtttggtttggactttcatgtagaaaattacgactcaatgacagtgtaacacactctagggaatgtaaatcaaatcatagtttacaacagttaacatgatattgaagataaaaaaaatggcacaacagcgacacgcatgactgaacatttacgatatatatcttttttttaagggaaaacagcatatgtgccttttcattaaatatatatcacaatgacataatttataactatagttacatgacacaatttaaagtttatagatgcaagtggctaacagtaatacagaagcgaacgcgagtggcaagttgtgtttcttggctgttcttgtctgcaggctgctattattgtcccggacgtccaatgtatagcaaatcacaataacacaggaatctgttacagattattgacttattacacacgcaatctgcagcatacagctccgaaacaatagtattactcgcagaatcaactttgaacgaacacagcgacacacaaataaaaattacatatacacagtttgctcctgatcatatgtaattacatatatacacagcgaccaacaacaatacagaagcgaccatgagatgtaagagttattatctcaccgctctgtgagatgcattgccatttgccaacaacagtacagaagcttgttcctgctgtctgctcctgaacgagctgaagcaacgcaggctgtcctattgtcttttgacatctctctcacctcaggagtcaggagaggaggacgtcattccctgtggcaacaagtaattaagaagaagttcatcaactaaatttggagttagtttgcaggtagcaatgctagacaggttagcgtgaacagtgattaccttttcaataggagctaggcatggcactctgtttcaccttcatcttctatctcgctctgaaactctgtttctctcctcggtgccgcttcatctgctgcctgaacaacatcctccggcgaattgacttggttgaatcttgttgcaccctctgcctcctcctcaccagcttgattaacttctatttgcatgcctctgatgaaaaggtcaatagggttgcgatgcttggcgacctccttgctcactgcctctactttcctcttaatattggggctgttcatgtaccgtacgttgtagcaaagagctacctctgaaagcattttaaggtttccgatacctgaaggaacactcatctcgctcataggggatgtgtgcaaattcagtcgcagatatgtgagcttcggcatagcctcttcttcgaaggtcagccgtgggacagggcaatcaagggagaatttctctagttctttgaaccctttgctctcaatcactatagcttcttcaggaatgaactccaagcctagtatcaggcgctgtaatttgaccaagcccgcgaggatcttcacatcacctgccacttgtttacagaccgtgatctgcaagaaagtaagatgctcgagcccttcaatccattggggaacattggcgaattttccggctgttactttaaattcatcaagaaatttaggtggatcacttagagaacgcaggaactccatggaacaaccgagcccacaatgaatggttaaggacttaagttgcctccattttcctaaggatgacaatagggcttgttggtaggctttgtcattgcactggtgaaaggcccatgttattgcgaggatcttcaagtcgtgtagatcaccgagatactttactgacctttcggagaattcacttaaatcaatgagaaaatgtttcaacatttttagccgcacaatttgctctggcatgtgctttatttgtgtgcctcttaggtccagcatccgcaaagatcctggctcgcacacttctgatgggatctcacttatgtgggtgtggctgatgtccaatgcattcagggtgcgcagctctttgatttgtggtgggagcttgctgacctttgtgttactgacgctcagataactcagcacaagcattttgcatatctgcagtaggtcctcatccttcaaattctcccagccttgaagatccaacgacaccagatatccaaacttgtctagagggactgttgttctgttgactgcaccagatatgagtagtgaacgagtatgagacaaatccatttcttgcagcatttctgggagctgtggatcgggatggtggagagctagacgacgtgctatccgagtgttcttgccaccacctcttggtgctgagttgagagttgcgctggtaatgacataacccttctctgctgctctgtaagcaagaaacctcagtatgaaaggattgacctgccacaggcacaagtcatcttcatcaagattgtgtccacagttccttgctgctggggtgattatattcctgtcaaccatctcagagaaatgcaactcagacaacagcccttcgtctagccatttcatgacaagacgatccttctcaaacacatatccctgtggcaacatgcttaggtagagtaacgattgtctcaactcatcactgtaatcaaatgatagccagtgttcaaactgtttcagcagcaggcgtacttcttccaccctaggaattgctgagctgccgtgttgctgttgatgttgtttcaaccaatcagccataccagttatgaacgatggtattcctctacatttcatcaatatttcatcacataatagcttcagattttctggagggcaatcgtccatggaaccaaaagcttttatgtggagcagcttctctgaatctgagtgactcagaggcttcatcttatgcacaatcccattataatttgacaaacaccaccctgctatccgctcatcgccagccgtaaacaatattctgctaccacagttattattaggaaatgcacccttgatcaattccaaatctgattcgttgaatatattatcgatcaaagcgaagtatctggagggacaatacgaagagaaaatattaacagaattcgagctctgatgctgtactgtaagagaagtcgtaaataagtagtgctatataattatagcagctgaattaagcaagcagtaaatgttgtttacctcttatccttgaggcgttctgatatgttgcgagccaacagctccaggtcgtcccccaacatcgtgatttctgagctgtttggtgatgatggtgcctccagttgctctatgatctgcttcaggatggtttgaggaacaagcttgctcccgtgaggcctccgggagaagttagccacaatgtggcactggaaatgagtttggcaccggagtcgacggtggagctccatggcaagagtggtcttgccaatgccggcaggtccagcaatggccatgacccggaggctctcgtcggcggccatgagccatccgagcagctcgtttgccgtgccgtcgatggcaacaagatgatcatggacggtacaggcctcgacttgggctgcttgaggcggtgatggcatgagctcagagcgtagaccattgaacacaaggtagagagggtataccttccgcggaatgtcatagccgaatgaccttcggcggcggaagcgccgcgtggcttttcgcagcggcacgcaaggctgattagatagaaatttcacgatagccgtgaccgtattccgcactccgatcagaacactcatccaggtcatcaggtcataatgggcaccatcatcatgatccccaatggaaggcgacatcggcatcctcaggtatgcgacaatggcgcccagttccatctccaggaacgccaaaccgtgcctttcgtgggcgtcggtgaagcgtccactcttcagcagcttagagacactctcaaggaggggctccaactccttcaacgccgcctccttcttctccatgatggaagttcttcccatcgctccctccgacatgatccccggccgcacgcctgcaacactgtacggtaagtactcaagagatagctagctagtgcggcagaacaaaattactgcatcatgtaaacaactgtattgcagaatgcagatgcatgccgaatgcgagctaggcagatctatctctagcttgcctgagagttctgctacttttacttgctttgcctcttctctgctctcccttgttgtctgtcatttccagcttgcaaagcgaagtagtagcaattaattaacactgaactctgcatgcatctcttctcaattactccagtagttttcttcttcttatagcactttacacattattcttgccatgtgcatgtcacgttactaaggatgatgactttgcttccactttcgttcattcctccggtgctatgttccaaaagaagatcctccagtgctattatcaaattaaaaagaagatcctctcacacaagttcttttccaggaaagtaccactccggcaagttaaaaggcgcgcgattggacacaaaacctctccctttggcaacatcaaggtacattggcattgccatttatcaactcctcactacaagccatgcatacacatattcgtttcttctatctcaagcgacacattgcgtaactagtcatgcatgttgtgtgcacctgcgacatggaaaggagtgaagagcaaacactgccgtgaccaagaatggcattcattcccttgtgaaaagaaaaaaatccacatgagattgatcgattgatttggccggtgattaagcgagccagatcgacgatggacctcgtcgtcggcgcgtcgagcgaagccgtgaagtcgctgacagggaagctgggcagcctcctcgcgcaggagtacaccctgatcgccggcgtccgcgacgacatccagtacatcaacgacgagctcgccagcatgcaggccttcctcagcaagctcaagcgacgggacgtcgaccacgacgagcagcgtcaggactggatgaagcaggtgcgggaggtggcctacgacatcaaggactgcgtcgacgatgtcggccaccgcctcggccgcgagccgcgggggagcggcgcggccatctccttccaaagggcgtggtaccttctcaccaccctctacaagcgccgccgcatcgcagccgagatcggcaacctcaagctccgggcgcagcatgtcagcgagcgccgcaccaggtacggggtggagaacctccagggcaatggtggtggtggcggcagcggcagcggcctcggcgtcggagccaacgctcctagagaccgtctagctcctcttccccggctgattggcaccatggagcctgtaggaatggatgctgccattgatgagctccaggagtggttttccaaagggaaggatggcacccagcagaggtacctcgccattgtcgggttcggtggccttggcaagaccacgctcgccatggcgttgtaccgcaagcttggggacgaattcgattgccgagcattcgtgctcgcgtcgcagaagttccatctcccgacggttctgaggagccttgtcaagcagttccatgagaagcaggcagacgcttctgaggataccctccatggaattgagggttggggtgatgaaatgctgaagaagaagctgcttgaacaattaacaggcaagaggtatgattttgggattgctaatatctatctcttcaccacatttttattgtactgtcttactagtcatcactccgtgcgtttgcatactcggaaaacctccaaattattgtatataaagatatttttttttcgctgagaagaccgaaggaggccatccgaatgtattaagaagaaataaaagttacaagaaaaaacaccacaatgcaccaaggtgcatgaccacacaccaacgcactaccacctaagcacaaaccactgagagtgaacgccgctaggcatacggcaacaccacagagacgagactccgaaaacgatgccaccaagatggtcacaacatctagaatgtcaccactgcccatctaaaaagatgtggttttctcccagaaaagctcatcaagaaggggagagggtaaccctcgacagtgccccaaggaggttatgacgcccgaaggcgtagccgctgccggtctggtgaacaccggactagcctttcgcctaggaccctataaccttgacagcagatcgccatccaccacacagaaccaccacatagacaaaaaaggtagcacgtagcttccaccaccgccggcctcctcgtcagttttggtcgaaggagaacccgggattgggtggcactgcttcggtagtctgagcttcccccgttgacaagctgccgcctcaatccaacctaggaactccccgcaaagaaggggaggagatccaggaagggcgagggtgctgaccggcaacgaggaagacgacccaccgccgccagctccctttgcactaccatctaggcatgtgccgacgccggatatgctgccgctccggcaccggcgccacccttcggcgccccctttgtccggcctctgcgccccacctggctgctaagggcaccgcaacggcttcccggctgcccgggcatcgaggcctggccgagccatggggctgctcgcgccggcaccagcgagacacggctgccgcgacccacgccgccgagccgccaccgccgctcccaactgtcgagccgccacacccgggttgctgcaccagcaccacaccgggcaggctgcgccagcactgcctccacgcacctccgcacgctgccacgccccacctccgagcacctcacccgcacgctgccgagccgccaccgccgtgcacctcgcccgcacctcgccaagccgccaccgccgtccctagccgcctcgcgccgccaccacactagatccaggcgcgggatggccggatccggccttcaaggcactggatccgccgcctccccacaccgccacagcgtcaccacctccgaccgcgatgggggcttcgtcgttcaccccgtccacgtcgcgccgaggagggagaagccaagaagaaaggaaaatattgatattcctagttggaaaattttgattattcatttgtgcctggaatgagcactataaaacgttattttataactagctaattacttccaaacaatgcttgaagcaggtaccatatcttggtagatgacatatggtctgtatcagcatgggaaaacattagggattcattccccaagagtgataagggtagttgtgtagtggtgactacaaggtttaactctgtagctgaagcctgccgccgtcaacaaggtcatgtgcacaagctcaaacagctcgatccagagagctcctacaatttgtttcttcagataatatctgctaatgatctgtgtcccattagacctattaatgctcgcattatcatgaaaacgtgtgggggtctgcctttggcaattgtagtagtagcagggctgattgctagtaaaatgaaatcaaagattgacctgacattggatcagcatttggttgatgtagatgaggctttaagtgcagagttgggaagcaatctcaccaccgaaggagtaacgcaaataattaaccactgttacaaaaatctgccacctgatcttaagacatgcttgctgtacttgagcacatttcccaagggccgcagtattagcaggaagcatttgataagaagatggattgctgaaggattcattactgaagagcatgggaagactgctgaggaagttgcagaagacagcctcaatgaactcattggcaggaacttgataaagcctatcaaaaacagcagcaacggcagggtgaagagctgccaaattcatgacatggtcctccagtacattgtctccaagtctagtgatgagaatttcatcgccgttattggcggccactggcagacaccacttccaagctacaaggtacggcgattgtctgtccataaaagtgataagcaagaaacagacatggtagagaggatgaaattgtcccatgtccgatccttgacagtattggagagtttcagtgctcttcattctactatgctcaagttccagatactgcaggtattggaccttgatggctgcaaggacttgtcccacccacatcagctcaagaaaatatgcaacatgtatcagttgaagtacctgggcttgcggcggacagatattgacaagatcccgaagaatatagggaggctggagtacttggaggtactggacattagggagacaaatgtcagaaagttgcctacatcatttgcaaagcttcagcgaatgacccatctacttgctggcaacaaaagcaagcggacagcattgaaattaactgaggaaattacaaaggtcgtagctctacaaacactttccgggattgagatcagtggaagctcaactttagaagaagaccgggagcagccacgagatatgcccatcagacactctacaaccaccagagccgaggagagaggcaacactgccttgcatggtccacataaagaagctagcaaagtggaccttccaaaacagctgcgtcctcttgaagccttggagaagctcaccaaccttaagaaacttgccatttacaagcttgtaaagttccaagcgaaagacgatgagttactgctctctgctattgagcatttgagcagttgttccctcaagtttcttgcaattgatgacagtttcacaggtttccttgaaagctcactgagttcttcgcaagcagcaccagaacacctgtacaccctcgagctttctggcatgttatctaaagcgcctggatggattgaccgcctgcacaaccttgagaagcttactctgtcattgacttcacttaagacagatactttggtggttctgagtagcctgcctgagttattctctctcactttttcactccatgcagcagacaatgattcaaatgctctcaaaataatacataggaatacaatgaagtcaggaggtaagatctttgtgctggatgagggatttgaaaagctgaagctactgcattttgcggcacctgtgctaccttctctgagctttctagaaggagcaatgccggagcttcagaggcttgagctgaggttcagaatggtggactatatgtatggtctggaaaacctctcaaagctgcaacaggtatttttaacagtcagcagccaggcacctgaagatactagggcaaagacatctcatatcaaacaactggcaagcatgattcaaaaggctaagaattcccctaaccccagtgtggtgatagatgagtacaacgaactagcaaaagaataatggatgatctagacataatccgcaattgcaatgtgccattgtattatcgatatgttgtacctactccatcagttgtgcctttttcttttatgactttctgatctatttacaaattattgtactttttttttatgatctgtggcatctgtatttcgtttcatctgttgtaccctaaagtctctgcaagtataaagacttatcttcagctttccttagaaaactaatcagtccagaggtgtaactagttctaataattatctttctaactcaatgtgctattttttatctctctcacgaattgcctagtataataaaaaaaaactttgtcttttgtcactaaggaagtagactaattcacttatttctatctacttcaagaattaattagtattgtaacaactaatcttgaattcttgggtgaatgaattatgattgagaatcaagcacctatcctttcctcctatgtcaagtacaagaattgctcggtggcagcagctctgcaagattatgcttgggtggccactggccaatatcagaggggggttatccttgcaaggtactgccgattatttcaagatttgggatgtggtctcagagtatccctgtgccagggattctatgctctggttggcataggctaatggcgatttctctgtcaaatcggtgtattcgctgctctgtgctcggtgaacaaagtgtgccttgggcagaattgggtgcaaatccagggtgtcggcacgttgcaaattcttcatgttccttgccatgcgaggagcttgtcttactgccaacaacttgcagtgtcgcaggtggcatttggtgagcttctgtcaccttggttgctgtgatctggaaacctgcttgcacatctttcactgttgcgcatgcacggtgcatgtctggaatgcacagccgcctgggattcatttgcccacagcctacactgcatttgcttccctggtggctcgcagtccgcaagacgatctgcaagcaggagcagagagccttcaatgcaggtgtgatcctagtgacatggcttatctggaaggaacagaacgcccgtgtttttgaggggaaggccactatggtgtttgcgctatgtgtggtcatcatagatgagtggcggatgtggaaggtggctgctctttttacgctgggcctggggtgcatggggcactgcgtgttctgatgtgagaatttttggcattgttgttgttgcggtgttaaaatctgtgatgtggcttgtttcgttctctgattgttagggcgtgctccggcgctttggtctgtaagccatgtgtcctgtaaattctgttttctcccattcttaataaacttcggccagtttctgccagcgcggaggaaaaaaaaatcgaattcttgtctcaaggattcaaccatccctgacaacttcctaaaaagtaccatttcgaccagaatttcatttttaataattgtagagttcaagtgaactctgtgtgtaacttttatatgtttatacatctaatattccttaaaaaattaaacaaaaactctttactgcaataatcttgtatagcatcttgatttgattttcagtgctaggagttctgcactttttagttcaccggaatatgacttattgtttattccgacatccaatctgttttaaaactaaatcctgatatggcaattcctcacagatgtgaacaaatcaaccaccttaactaagcacaaaaatttagtttttccctgagattttaatccagtggtggtggaactaccaacattaccaattcatttcaattaaaaattttctgtttctcattctccattttcagttagctggtgtgcagcttcatagcttgtttctgtactaaacatattgattaaaattacccccttatgttcctatgatgtgttgaactgtcaccaccatttagccacaagcaaaacgagaaaactgaagttttgcatcagatcagatgaaaaacctggggagcccatgatggcctcttgaagtcttgatgagccctgatcctcgggctagctggtagctaagccgcggcagttgaaagatgagagaagaaagacgcatcacgccaaataactgtaattttacttccccatctggctatataactgtaatttttagtgtttttttcttaatctcttgtaataaacttccttcactatgtatttatatatttatggtacactcgttccctacattctcctaaggccttgagtaggcttctgtgtaaactgaaatcaagtagaatgaaaagtaaactggaattagttgcaggagttaatatgaggaaacttacatccaaggcagaagcaaagggtcggtttcctcctcggcattctatcaaacagttcgtgggcaacaaatatttgtagccttcagaccatctgcaactgcaagctaggccccaaccttcgatctgcagaatgcatctgcagcagagacgagcgaatcaaacattgagtgatcgatcggtcggtcgccgcacgacggcggcaacgcacagcaaatcgggatggacgtgtgtcgcctgggtgagaaaagaggttttacctggagatacatgatactcctggaagaggcaagatagcctccacattccccctcctccgggcacacggccgccggtcaccggtcgccggtgaggtagccgacgcccgacgcggacacggcggcggggaggccggaaggccaccgccggtgagagtggtattggaggttggaatcgacgtttcgtcgtagccgtccataggaaaacggacggttcagatcgtggtgtacgcagaacgacaaatcaatgctgatggttaattgagttttaattgttagtattagtactataaatttataaaaatatatttattttatatacttttaaatatatatagatatatatactccatctgtttcacgacgttttgagtttggtcaaagtcaaactaattttatagaaaaaatagtaatatttttaacccaagacaaatatattataaaaatttatttaattatatatttaatgaaactatgctggtattgtaaatattattttttttaaattaattaaacttataataatttgattttaattaaagtcaaaacatcttataacctgagggagtatataaagttttatcataataaaaagctcgcggattaattaagttttaattgttatagatttatttgataaaaaatctatatcgttttgtaaaaagtatactactactaccgtttaacagtttattactaacaaaatcaatctatatctaaataagaaaataacgggaaagcagcattctgcgtggagagagagatgcttgctcgccgttgccatggcctcctcctccgccgccgccgccgccttctccccaacctcccaccactctccaccgccgctatctccaccccgtctccgcctccgcctccggatgctaccctcgatggtgccgcgcccggcgaccccggcgcgctcgcccccgacgacgccatcgcgtccctccccaccgtggcggactccgcgggctccgcggcggcgctggcgctgttccgccgcctcgcgtcgcgcccggacctgcgccgcctcatgcggctctacgtcaccgcggccaccgccttcgtcgcgagggggagcctcccgatggcgcacgaggtcatgcgggggatggtggccgccttcggcgaggccgggaggctccccgaggccgccgacatggtcctcgagatgcgcagccacgggctcccgctctgcgtcgagacggcgaactgggtgctcagggtcgggctggagaccgggagcttcgtgtacgcgcgcaaggtgttcgacggaatgacgagggccggtgtgtgccccgatgagcgcagcttccgggcgctggtcgtggtgtgctgccgggagggaaaggtggaggaggttgatgccttgctggcggcaatgtggcgttatgggttctcgctggataacgcgacgtgcacggtggtcgtgcggtcgctctgtgagaagggacggttcaaggatgtgtctgagttcttcaggaggatgttggagacgggcacgccaccgaacgtggtgaattacactgcatggattgatgggctgtgcaagagacgctacgtgaagcaagccttccatgtgctggaggagatggttggaagagggttgaagcctaatgtgtacacgcacacaacgttgattgatggtctctgcaagattgggtggacagagcgggcgttccggcttttcttgaagctcatcaagagtagctcgtacaagccaaatgtccacacgtacactgtaatgattggagggtattgcagggagggcaaacttgctcgtgctgagatgctattggtgaggatggttgagcaggggttgaaaccaaacacaaatacatacactacgcttattggtgggcattgcaaggggggcagttttgatcgtgcatttgaactaatgaataagatgaagcaagaaggcttcctacctaatatttacacatacaatgctgttattgatggcttctgcaagaaaggaaagattcaagaggcttacaaggtgctccgaatggccactagtcaggggctcaagtttgataagataacatatactatactgataactgagcactgcaaacaaggtcacataacatatgctctagatttgttcgatcggatggtggaaaatggttgctgtcctgatatagaagcatacactagcctcatttctacatattgtcagcagagacaaatggaagaaagtcagaaattttttgacaaatgtcttatgataggactactgccaaccaaacaaacgtatacatcaatgattgcagggtactgcaaagtgggaagatcaaccttggctttgagggtctttgaaaggatggttcaaaatggatgttttgcggactctataacttatggtgctctaataagtggtctctgcaaagaatcgaggctagaggaagcaaaggctttatacgaaggcatgcttgataaacgtttggtgccatgtgaagtaactcgtgtcactttaacttttgaatattgcaggagggagaaaacaagcattgctgtatcagtcttggatagattggacaaacggcagcaggttcatacagtagatgtagtagttagaaagctcagtgccttgggagatgtggatgctgccagtctttttcttaaaaaagttttggacgaggattatgctgttgaccatgcaacttatactggcttcatcaattcttgttatgaaaataatagatatgccctagcttctgaaatgtctgaaaaattctcaaagaaaatatctagctttaaagaaaaaagatgatttagcaacagccattgcttgatcagaaagggtggtgcattgcttctactgatacagacaagaaattctacagtaggtcctcaatctgacttttttcacatgctgccatattaatcagtttttggtaaaaatgtgtcctttcttatttctttactgtgctcctgttgaagaaatctttcccagttctagttggtcaaaattttgttcttatatacttactagtcttaaaatctccagttcaaggtatagacctgactttctcaaatggagtgggggagaacttgaagatagtaatggcatcttctttgcataaaattctgtgagaactgagaagaaacaaggtcattcgttgatttgatggagaaatggtaacagctcagcacttcagtagtgttttagtttgatcctagtgtttattcttctaacacatcattgtatcatttgcctacagaagaacaagtctttcttgaatacttgggagatagtagtcactaacaaaatccatctgtgcattgtataatgaaggttatttcattaaccattatactggttctgaacaattagttcaattttgtacttaagcaacaaggatgttgtttcatagaaaagttatccattattcctaccatctgaaagtttctgctgtgtggatggttaacaatttgattttatgcttattccagctattcatgtatattgctatattgttgacaagctttctaggttttatcattacatggccaaactccagtctgttttaattcttctttttatttttctttagtaaacatgaaggcatggaatttttgcatgcaccatagactacagctgtcagctttaacttgttgccgttcatggttttctatttttacattgtatattacttacaaggaatcctcaggttatccaatttccctgcattctgtttcgacaaagaaaatgtccaggtattcgtaataggagtcacactattttgaagataaattatttttacaataatctagaaatgatatgtagaatcaggctccacaatacaatttacaaatctgattcatgcagtgctgcaggtatgttacacatcaacgttcctgcttattttcattctactttctgtagacctaaatcttatatgagcagcactaactttttcctgtcttcagtggttctggctgtgtgtggctggatatggcttttaaactaccctgtctacccacaatatcagggtgtttgggactataggtatcaggctatcatctaatgtcctgcaaaaaatggggggtgattagttatgttgtctgttaacaagcaatacagaaatttttttagatgaaagctcaaccagaaaactgaccaaagctggtgtggatgctggtaagtccaggaaattactttccagctagcaaaattggtgcttgattgtattggttgtcaaacgtgggctgcctcgacgatgctgaagatgtctgtcttattttgttatccttctcttattggttctcatgggatatttctggcctccatggatctttctgcatcttgtttgtttccatgcacattgtcgtatgaaatccactctccaccactccaggtttgtgccttatagtttcattaatttttcctctctttctttggttgcatatttgctaatggtcagcttcattagtcctgtcacgctcacagctttagcaaaaatctgtgagaaaaactgttaacttcatttctttggttgcatatttgctaatggtcagcttcattcctcctgtcacgctcacagctttaacaaaactgtttacttcttgagattttattaggtcatttattcagttcacactttcatacttgtctggattttaaaaaacgtgtcatgccagaaaagaaagggaaggccaccaagacagttccggaaaccaggttaaaaaaaaaaagct

SEQ ID NO: 68333 - DNA, 30425 bp, Oryza sativa
aggatagggatgacaggtgggccccacccgtcagcgagggttgcgggcggacccgcccgtcagcggcgcgcgcgcggggagaggccgagtgggccgcggggaggaggagagagagggagggagatgggccgagccggcccaagaggggaagggggaaaaaaggactttttagggtttttcttttcataaaacctttttaactttgtttatttcttaataattattatttgtgctctgaaaattcaagtaaaatttgagggctccttttagaccaaggagaatttaacaaaaattctccgggccgcatttgaatttttcttgtacgtattttagtgtttgccaatttcttttcaaattttaattaattctattattccttttagcgaatgatttttaattcgggatgaatttatcaggacgtgacactggctcaactctaccatcctcaaaaccaaagcgggctggtgcacgagctgcacggcggggacggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcgactgacgcgaagggaccggcggaacctgtcgagggccggcagcagcacgggccgctggcggtgggggagctgggtagtggaaacggaacacggtggaagaaccaacaacacgcttccgcgcggtgcggataaagcgtaggccacggcgggaggaagcaactgggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaagagatagtgtcaactaaggtgacaccctcctcggccagacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggcgtggaagctgccggaaggcggaacctccgagacggtggctgtagtcgtgggccaggcgacaaagcgcagtccaggagaggtcctggtacgcgatctggagagtgggcctggccacagtgaagtggtgggggcgaaggccagctccgtgtatacctccacgggggtaaaggtacaccgagagctcacagtgagggggaacacggtccacggagtaccccgtgtactcgggacacgagaagccaaggaaacgggagaggtctcgaagctgagcgacgtggtgaccctcaccaaaaccgtgggaactgaagctggcgttccctgccatctacaattttgaaagagggagaaagatcagtaaccgttttagaaacaaactattgaaaataaagaaaacaaaagaaaccttagcttttcgcaagtagttttgaacttagtatccttagggtcgtcctaagcgtcgggtttcgccctagggccaagcctgtgctctaataccatctcttgtcacgccccgaactagtcccgaccggaactagcccgtgacgctccaaattaacctcttaatcgataccagtcccaggaaacagtgctggtatcacagggagacagagtatcacagcaacagaggtctctttattatagagtagaagtacagtcatgttgggctgcgggcagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactggggggggattatttatatggagcaagggtgagtacgggagtactcagcaagccaggggaaataagtgtttaatgcaggcttcaaggaaaggctgttattttcgtaattgattttgtttgaactcttttctaaaaagtctaagtgagtgcttctcaaacgacacggatgagacagtgcgtctcgtccagtcggagtatgtgcaatgtgtcagtctttaggattgcaacaaggttggcacccggccaacagcttttcaaacggccacccgggccaacaacttttcaaacggccacctgggcctagctgatcccatcagctgcagatttttcaaacatcgaaccccttttcacaacagcaatttcacaagcagtaatcaaacaaaactacgctaggaatcacctcacatccgcccatgaccgtgggcacggctgttcgagcagtttgttaacctctgcagagggggtacactttacccacacgacattactaacccagatcacccagcccgtggggatcagccacgtcgggagacccccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaagggaatcggtccttaagtgcgagagcgggaaaccgtacacccggtacgttcccctgtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggcgcaactgggtggttacaaggggacatggtataacagttaacaaaggaaggatcaaatgtaacaaattaggtaggtctgccaatctgccttgcagacgggacaacagattaagtgtgatcctatcaatgcataatatttcgcaagcaatataattaaattccaaatataggctcaagatgttcaaaggtggcttgccttgctcgagatccggagcttgatcctcgaaatcctcgcactgcgggtctttgggctccgaaactacacgcgaaatgggacaactcaacaaacggcgaaaataaagccctattaatgacctctaagcgtgccattagatagatctcgagatttgaggaattttggaagttgaacggagtcaatcggatttacggttgggaagatattgaatttctaagattattggatttttggtctaaaggaaaaaggatttatttaaatccttttttggaaaagaaaaagaaaagaagggagggagggaatatagacttttctcggacggctagggcgcggcctaagagaaatggagcggtctggccgagctaaatgggccggccggcccaaggcggcccaaactcgcgcgcgcgcgggagggaggagagagagagccggtggaccgggctcaccacgcgcggtcccgggtgggacccgcttgtcagcggctcggctcaccgtgcggagggagcacgcgacgcacgcgcgcgggtggggaagggacgcggtgcatgcgcgcggtccgcggtggacgcagctgcggcgggcccacgcgcagcctcacggctcgcggtggaacgcgcgcacggggagggactgaccggggtcggctcgatccggtctaggctgagctggcgccgacgtggcgcctacgtggctgccacgcggtccggcgggaggtagacgacgacccggccgcgaatggacggcggacggcggtggcgagcggcggagcgaaccacggtgatacgggcaaaagcgtgcacaccgggcggttgcacgtgacaaggggagacgagccaacggctcggattcgccggaggttgctcgacggcggcgggagaagagggaaacggcgacgaggtcacgagagaccgattcccggcggtgagagcatccacgcgaccacgggaatctgatgctagcgtcggattggacggagctacgccgagcgaggctggcgacgtgcgggtgctacggagctcgagcggcgatggcggcgagcacgcggcgagcgacggcaacggtcggggcggcgccggctagctacggggagtctactcgagctactaccgtaagctagggggaggagatggggcgaggaggaagaacggagggaggcatcaccgagatgaggaggggcgctgtgacgagaggccgacggcgcgggagtaatctctccggcctcgggccggggaagaggaaggagagggcgcggccgaagtccccttccgcgtccttgctcgtgccgactccttcgacacgcgcaacaacgaacggcgacggcgaacagagcacgggggcggcagctatggcgaggaggcgaaaacgagggagattggaggggaaggagctggggtttaaagggggcggcaatgtcggtttgggaaccgacttagggcggtcaaggcgtgagctggcgctcggcggtcgcggccaaagcggcgacagggaggatgacgccggcgggggaaaaaggggaaaaaggagggggagaaaggggcttgcccttttgccgattcgggaaaaaggaggaggggagcgggggcgacgcggcagagggaggaggggcgctgcctccgtcccttggcggcttgcgcgcgtaggggcgggggccgggcaatgacgacggcgatgacggcggtgcggtttggagcggagcggcgacactggcgacaggcgcgtgcagaggctgacggcggcggcgaccgggcggtcggccaccacggcacgcgcgtgcgggaagcaacgagtggcgtccgcgcgggcgcgcacacgctggctcgcgaggacgagcggctgcgcggctgcaggcgcggcagagcgagaggaaagggagggggcgctcggcgcgcgcggcgtgcgggcgaggccgagcggggggggggagagatgggagagcgcgagagagagagagagagagagagagagagagagcgcccggggagagagggggccggggaagaggggaagatgggccgagcgagattcggcccatcgacctcgggggaggcaaaatagacttttgcggaggaatttgattggaaggatttggattcggaattgaactcgacgatagatcggggattgagatcttgagatggcacggacaatagacaacaagcaaagaaacaaatttcgcaattagggtttttaagagataattttcccgctaggcgccaagacggaacgggcgctacatgaagcaaacgagtaaggcggttgctgggacttcttagacagtaaaaaaacaaactgcattgataatcgtattcgatttttaaaatctcaatgataataaaaaggagaagcagcgggcggggtgtataagagtatagttgcagagccaccgacggttcacgggacttctagaaaataaaaaatgaattccaacgatagttatgttcgatttttagaatcacaatgacaataaagaagtaggcggcgaacatgctgtagaggggtatagtggcattgtttgataggacttctaaaaattataaaaaatgaaactataagttatgttcgattttaaaatctcaatgacaataaagaatgaattccaacgatagttatgtctcaatgacaataaagaaggtaggcagcgggtgagccgtagaggagtacaatggcaaagctactgacggtttggcaggacttctagaaaataaaaatgaacccaaacgataattatgttcgatttttaaaatctcaataacaataaagagtagagacaatggatggcccgtagaggagtataatggcaacgtttgacgggacatctagaaattataaaaataaaacccaacatgacaataaactctaaaaactataaaatccaatttttaaaggttccaagaagaatgaataaaaatagtggtagatcgagcaagcaaataaagaagaagatgatataaggggtagcaactggtgtgacttttaaaaaatatataattagaaacacgaggatgataaggtttggtctttcaaagtcttaagacaatgagatagctattaataaattttaagtaaaatcatacttaaaaaaaatatatgattttgtttgggtgctagccgcgcaattacgcgggccacccagctagttatattgaatggagactggagtaatggacattacaatggaacttgcgctttgcaaccgcatgcatccgtaatccgtttgaggcagtcttgcacgagcatattcccttgcacatcccactcaaaattttcacagacagtttcaagaaattagaagaataatacaacactgatacaaaagtgcatatcatatatcagaaatttcaagtccaaacaccttctacacataaaaagaaacagattcagctgaatctgataatgaggttaaccggccatgtacaatagcagggatgcaaaaggagaagattcagatggatagtgatcatatatgccatatttttaaagtgggttctgagtggatgcagattatttccgatgtcggaaatgatgcggagtcgatgcaagctcggttcggaaatggattaaaattgtcaaatattacatgtatatgcattcaatacaacatcaagttagtaatgcaatgcacaataatgcaataactgtttcgttgtttcatttgttatacatttttttctgtacgtacaaagtttgtacatataaatttaaaatgaatttaaaaattaattcggaaaaaatgaaaggtattgactatgaggcccttgtgcttgtattacagctctattaatattcagcctgctcaaaaacagaggaagacaaaccagaaaaaaagaaaaatagaccacccgcaaacaagtccaatgacgaaaatccacgcgtccgaaaattagcaacgggccaaaaaggaaggaaaaaagctaatcgtgctattagcattttcgcaatcctttctaatccctccccctagcttggggattgtctgaacaagtcctaaagactaggtcaatgtaccacataggtgctacataggataaaaacatcgcccacaccgctaagaaaggaaaaatgagccggtttcgatagtggagggagtctttgggtctatttggcagggctccaactcttaaatttgtcgagatctcaagttgcacgtacctgtgcccctttacgctaatcacgtgtaatcacaattagcataaacagtgacatttctactaaattagtaggcaatacatagtcgacttgaaagttttaactttagagttgaaagttaagttttgaattgaaagttttgaattttggagttgaaagtttcaaaacttatgttgaaagttttgaacttttgaattgaatttttcaaattttggagttgaaagttttaaattttgagttgaaagttttaaatcttacttgaaatattcaaaaagtttacttgaaagatttaaattttaagttgaattttttaaattttggagttgaaagctttggattttgaggcaaaagtttcaaattttgagttgtttaaaatttgaattgacagttttgaaatttttatttgaaagttttgacatttgagttaaatattttaaagttttaagttgagtgtttcaaaagtcgggttaaaagtttcaaattcaagttgaaaattcaaattatgctttttttcctctaaattttgagtttaaagttataaatttagcacataactaatccatggttataaaaaactatccacgtggagacattaattacttgatgctaatcataatattggttatggactctgaatctgacagcggcccacaaggctcagcaagagcaagcgcgcttgtgcgcgagcaatgcttatggcacacgagcgcgaaataggaaaatcggttgtggatatgtctaaacactacttcatctttctagtttattttgtgagaacacttcagctactccactctctttttaagtagcgctgaaactgtttggctgaacttgtattccaggagacgttgagctagagctatgccaaacaaactttagaagaggttgagatagagttctgtcaaacatgcctttatattatttttacggttatatctgattccggcaatagttgagagcatcataatggactttttccctgcacaaaaggccatatcctgtttgttactactctaatattggcttactttcttcggcctatcaaactgttcggcccatacgaggggagaaattaaaacgagaaatcgcatactgatttgcacaaaagagcctgttgcaaatattgtattagcaattaagttctatctggttcgatacttggatactttctccgtttcacaatgtaagtcattctagcatttcccacattcatattgatgttaatgaatttagatagatatatgtctaaattcattaacatcaagtctaaattcattaacatcaatatgaatatgagaaatgatagaatgacttacattgtgaaatggagggagtaacattttaaaatggaagtacttttcttcaatatagagatacctcctgacgttaaacatgtgtatgagtatctctatctattaaagctagaagatacctattaaagaagtgcaaaagaattctttccaaggagatccttctcggaaacaatatgtaatttaccaacttcttgaaaaacaacaataaatcgtaaacaatagatagaagccatgagtgacactagtcggctgggcgaatacggagtactccgatcgataggaggctgtgactcgctagttcttttccttctccttgttcttggaagggacgcggccgtcggtcccggcgagtatgctgtacttctccttgcgcgttatggcggtgcactcgaagccgagctggccgctgagcgtcttctggatgtagttggccacctcgatgggcgacttgccgccgctgcaagtgagctccttgggcagctggttcaggaaggtgatctcgtacgtcggccgcgggttcatgaagaagaagtaggggtccatgagcttgaagccccgcacggtggagccgtggaacatgctctccttggtgttgatcgccaccggcacgatgcggtcggtgagctcggcgaagagcgcgctgaaccgcagcaggaacggctcgcggcaggtggtgccctcggggcagatcaccaggtcgccctcctccagcagccgccggatgttctcggcgtccttctcgcgctcccgcgacagcgcgacggccttgatcggcgagatgagctccgagaacttggagatgctgtacgtgacgcagctgaccttgcggcgcagcgccacggcgacctcaaccgggtcgagcacggtgcggtggttgcagacgaagaggacgccaggatgtcccttcttggggggaggcggcgggttgcccttcacgatgaggcggatgcccatgagcttgtaggtgtagaagacgatccgctccgggagtggcaggttgacgtacacgcggaggagcgcgagcgcgaagccgaacggcatccacaggaaggtgacgagcgccaccagcggcgtcggacgctgcacgaggcggccgtcgtggaggatgagtgggctcagcagctggttcttgggcaccgcgctgtacttccttgatgtcacgaggtaggcctcctgcacagacacgcagcatgcatgttacaaacacttcactgatgcaaaaatcacagcatcaccatcacttcttattttatcgaatatataaatgcttgttcatctcgccatgtacgccaaacctacatcctaccacgattacaattcagtacagtccactactgatggttccacagatgacagatcttcacatgcttaatcaaaattatgttttttcggagttaaactgttggatttaagttgacgtgtatcagccaatcaataggcgagagtagaccagagcagtggtaaagaagtacagcgattactgtaccgcaacaactgcaagactggcgcccataaatgggtgatttcccctccacgagagaaattcgttatacccccggggcagtgacagaaagacgggtcccatggagaagggaaagaaggggcaagaccatgaatggcagtatttatttcagtggttctctgcattaccggctggaagaaaggaagaaagaaagggaaagcaagggcagccgtggatctggcaggcacagccagcaccagctctgatgtctcacgcgccagccggccgatctccttcaatgcggccgggacaaggcttgaattctcaccaaacaaccgtaaataatggagccagccagccggccggacggactgactcgaccgtggcatactggcatgagtgaatccacgcattcaatccggcgggccacgggcgagtaaaaaccatcggcttccttccatgctctggctctgcccgcctccagattccttttctgatcatttgctcgagctttcgagttgttaagcttcaggtgaggatctagtatgtgcgacgtagacgttttgtgagttctgataatgaccttgatccttattattagtttactgattaaggatgttggtggaacagagcgaccggtcagtgcaggaagcttaaactgggtttcgcataatgggctgagcaacatctacagatcagtgtcataaatggcctgacaatgactatacacccctgctgttcgcgtgctcgaccactgtggcatactctactctgatctgaaaccactctactctgatctgaaacctctgcatgtttgtacagattgcagaatttatagtaggcggtgttcatagcttcgtcatagcaaaaatcaattgtaactgatgtgctaattccacgttatgaaagtaatatgtgtgatggagactatacttaattccaattttcatgtttcttgtttggaatgcagtaattccgaaataaacagagcattctatacggaatttatgtacaagatggtctaaccagttcgtagttgccagtaattggcagtgctactactaattcgtcgcaggacttgatcactgcaattaacaatcaacacgacagtactattactatgagcaaaaaatgagtttgagggggcgtcaaatttaccttgcatatggacatgaagtcgaaatccgtctccctgtcgcccaagccgacgtcgggcaccgcgtcgcgtagctccttgacgacggcctgcctcttgtggtcgcccacgagcactccgggcttcaccatgaaccccgtggccttgccgttcttgccgacctccagctccgtcccgaccaccttgtcggcgccgaggaacgtcttggcgaagtgctccaccatgatcctggggctcgccgtgatgatgtaccgcttgccgaaggagttgaacaccctccagctctccgggtgcacgtcctccgcgtagaacttgggcagcaccgaccgcgccaccatctcgatgttcctcaccttgagccccgccacggagatgtacaccagcgtgctgatggccagcgactcggagaagaaaatgtaggtcacgtagacgaacggcacggacagcagcagcacgacggcgcggagcacgctgccggcctcgagcgcgacgaggaggtagtacgggaaggcgctccgcgacctgaccagcgtgccgtcgaagtcggcggccaccgtctgctccgacctcccatccgagctgcactcctccacgggcttgaacctccgcgacaccatcgtcgtcgtgccgggcgtctcgatggatctcaccaggagatggcagctagcgatgcgaccgctaggtgctcgctgatggtgtgggagtggagtggagcagcgggagagggagttaatatatccaaggttggttgtgacatgggaaggggaggcggagacggtgtataattgcaggcttagctcgcagctaacttaagaggctattacttccagagagcgacactagtgcgatcgatgctgctagcttcacgtaacgtagtgggttttcttgactggtgcagtctaacacgcaggaggtaatccctgcggtaagctacgtaaacaacagcaaaaacatgttttctcacccaaaatgttgaattcatacatgggacggacaagttgcagcatcacattttcacgtgatagataccggcaatgtctctgcctttctggcgtgtctgcaattcccttttccccgtgcatcgcatcccaactgttctatccaccaaaggaaaacgctcacagttttacaagggtaaagtgcagcatgcagcgttgggcgattaccattggctttaataaccgagttggaatagttggttgggagttagcttcttcacagagctcgcccattgattagcacggccacggcgtacgtagccactcgttaccttcgtcatggagcaggtgcaagagtcaaccaagtaccagacagctgaaacagcaggctcatcacaaccacaatagaatcacatgctcaatactcctcacggtatgatttcaagatctcctataggccggacgccagagtggacaggaaaagaagatggtattcttttttcgtttctgctgcatccagtgtgtataagtagtgtagcagtgaatgctgaatttttactgaatgctggggatgtaaccggatggtgatagaaatggatatcaggggtatactaccttattagttgcatatagtaggtactcccccgatcctaaaatataagggattttagggattttcatgtagcctaaccatctaattattagggatcgaaactaaattagttaccaatggcgacaacattttaggaacagaggcagtataaagtctacacaagtcatgatgttttatgatacatttgtaaaaccaacagagtaaagacgtggtcggttagacaaacactagtatttgcattgtttactccaaaattgtaatagtaatagtagtacagtaaaacgcaaaccaccatcaattttcctcaaaattaatcttcagtgtaaaaaaacattattgcatcccgaatttgaaacaattgagagaagcatgacagttagataacatgtttccttaaccataacaatggaacaagttataatgaatacaagttttagttttccaagcaacttaaaatcaagcgcagcgcattacagcaactgtatctgtactaggccatttctatatagatgatggatgaaactgagtttatgacaattatttggggcacaaacaaatgaatttaatattagaaagtggaaattttgttgcaaaaatttctcaaagaaattatgatgaagaaagtcttttgcaaaaaacataccatttaggatcttgggaatccgtcaacgattagctcaaaagaataggcctccataagctgaaataagtaaaacatacctgcagaaaataatagggaataattgaaaaataaaattcaaggaacactactacaatgctcaaaagagttcttttctctcataataccgtgatacttacaggtctcgcggctgaacagatcctttgcggcagaatgtgcacaaaggcaaacttcaacgtctcattcaacaaccgtcgttgtttctgatgttctggtggtgttttggcaactttcaactgtactgaaatctgaagaaccgcatgatagaaaatatggtatagttgaacctctgcaaaagtttactctccaccagaaagggaaactcttacaacttacctgcttgagttgcgtatttgtgtttattctgcaagatagagtattttttaacatacggcagaatgaagatagaaattttacagcagtacttggttcgatgtggcaaatttgcaatactgctcctattatcttcttagtaatatccaacatgtctgatacacgatggtgcgcctctatggatcccatcttcgaacattatcgaagccatgtagtcagttgagaagctgggagatgaatcgacgtctccattcaaacatgatcaaggccatctgttctgaacattgccccaattctcaatcaccgcagcaacagtattgtgaattctttgaaaagaaactaatagatatttttgtagttcttctaatggcatcgtttgctttagttccacatcagcacccattcaacaaccataataaatattgctgtttggatttatgctctgaattctgatatgtcactgtcaatttccaagtctacctttaactctgctccttggcagtgaagaaactggaaaaagagtgacgcccccaactttttgttgggaagaaaacaaaatttcgttatcatgctgacaaattaagcagttcataatggacactctttacatgtcacagttatgacatgattgttgggcaacatatataccaggtctaggttgcaccagcataacaattaaaacaagtcttagtaatcgtgcaaactgattactgaaaacttgcaggttcagggtgaatctgcaacacaaaaggatgcataattaaatgactcaaccctgagcaaggattaaattctgagtacatacaggagttacgcactcactgtaatttttcccatcatttctgctttgcttatcccttttgtatgttcatttgtccttaggagtaatgagtctatttggcgttatattggaggtcctaataatagtactttttgacccctccatagtgcctacgcatatctattagtattactccacccgacgcagagtcgcagatgaaaacgaactactgagcccttgttaatccatctaactttgctactcatttttccacattaatgagaggatctctaaatcttcagtcactctctagcaactttaaagaaaaacaacgcgacgatctattttcttttagtacagaatcacttatacattaccctccaaacagaaacttctcgtagccaaatgctttaccctttccttgagttgttagacagtttgttagatgttgatattgtgaaacaagtattcttcaatgccacgagaatgttgaaaggcacatgtcttctagtctaagaattgtagcatacttacaaatatgagcaggccagtaccatagaggaaaggaatagtggttctgcatcccccaatagaaatctacacgaactgtagtacattacaaatttctagtcagtcaactccttaggataactttagcattgtctcaatgagctggtagtttctgtagtataggagaatgaaattatagagaaacagtgatggaaaaactgcattgcaaaagcttatcaaaattaatgcttggtggtccaatgaaggaaatgtactcataaacatatgttatgaagattttaagatcagtggtcctaaatacaactatacaagcctgaagcctccacagaacacagaaaacaaaaggtcgttttaacgattttagctaaagattagaagtgatagtttgcttaagatgatgcatacagattagaggcgacagattggaggcaacctggatgttcatcgatacaatgttcatagaagaatcaacgtcaagacagatcagtatttcctacttgccatgctaacttcaggaaacatcttggtacaaaaagaaaattgaaggaacaacaaacgtgtgttcatgctgagccaacatttttttttcgtttacttacaagtagcggctttattatccacaaaagttgcaataatccaaaacaagcacacgactggaaaaaatcttgtctatcgtcacaaggaaatgaaaggcaaaagcagggaggaaaaggactttcactttttcgcaagcaaattctcacatggaaactaagcaagttgtgggccggtgtaactaacagggaaacgaggcgcaggcgccctgactaaaccttgcagttcatacgggcaattgcataagagttaggttgagaaaatcagaatgatcaacaaatttcaacatgtatttttttttccaaacacggaaaagcttcacaatcaagcggaagggcaaccacacattcaaatacgcatttcaaggactagagaggactaggggatgctaatacttggtgaaaaatgactgcttcacatatactaggcgtccccatcttaatgaaatttggtcgccgttcctttcggccgacccggcagaaaacatatactaggcgacaagtggagtacttgcaaacgaaacgggcgaccgtacaaaactttgccgtattggtgagagtatccggtgaagttactagtactccatcaaattgcctagactatttcagcagggaatcgagaattcgagatctgtaaataactttctctctgcttaaaacatcagcaaagtctggctcggtttcaaaaaaaataaaaatcgagatctggaaaacgcggctcgaacttgccgtgttagattgtaccgagagagggaagagcaactaggggttttagttacctcgccggactccgagtgtagattggtcggccgccgtcgtgttggcgtcatcatggcgtgttgccggccgaggaggagagaggcggaggcggactcgcggaggaagcctcttggcccttggggcggccggcggcgtgccgccctagttgggtccgcaggtcgcgggttcggggtccctcgctggctaacttttactccagtgggctttggcgtgcggctcttcccttcatggcccgtatggcgatatggaattatcgggccttagttgatgggccagcaaggcaaaacggaaagtaataagttcatttgaggtcccttaactttacaccgaatccgattttcgtccttcaacccaaaaccagatacaaccggtccctcaactgtccggtgcaaataagatccctcggcggtttggaaggcagttttggctaacgtggcacccacgtggctggtttgactatgtcttcgtccctgtaggatcaaggaggccgactagaggggggtgaataggcggttttaaaacttaatggcacttaaacaaaactaacctaagttgctaggcaaggtgaggtgcaaggttaactaagcaactaagttaagttttgtaaacctaggtgatatgggctcaaatatgtctctatgaaaataaattgcacaaatgtaaatgcaataaataaatgagacaagagacaacgaatttttcaccgaggttcggaaactcgccggtttcctaatccccgttgaggcgagcccaactccaccgctcaaccacgaagctatcgcacgcccccttcgtcaaggggtgggcaaggtgggagccggcccacggagaggactacccaagcctcgatcactagggtagttcttccttcactccgaaggtggtgaactccaaaccactcacaaacggcgccagacctcctccacaatctcctcggagaggtcaccggacaacacctccacaagccgtctaggaggcagcaacctccaagggtaacaagtctaggatgcttgccgagaatgatcaagtgccacactagcaatgaagcaatgcacttggattggcttaactcactctctaacacctcactagataaactaagtgcacaagggtgtgatagctcttgaaaggattcaagataatgcaatggagtgccaaaaccttacccttactgctggggagtgggtatatatgcccccaaccaccaaaactagccgttggaaccgaaatccccaactttatgctctgccggtcagaccaccgttgtgaggccggtcagactggactactttgtaacggctataaaagtagccgttacagggcaatcattgagcccactcaacctggccggtccgaccgcagtgtagtggccggtcagaccatccacggctcggtcagaccgccgtcggctcggtctgaccggttgcggctctggcggctctgtatcgccaccaaaaaccagatcagtgcaatagaccagtggggccggtcagaccggccttaccatgccggtcagaccggctaacagacctggtcagaccggcctaaggcccacggtcagaccgcatgtcacttttcagctcaaccgaccgttagtaaaacggcgatatctcttgactcgggtatcggaattcggcgttcttggactctatggaaagcttattcaaagggccatccaaaccatgaaaaatccatccaagaaacacaacttaagtcaaggataaagggctcacactccaaaggatatccaccggacatacccacaagatgtcactcactcctattggacatgcccacttatctcttggtttaggacttgagaaaactcatcacacttggttagacaagcccacaaaatacacctacatgcatataaactaatatggcacaagttcatccacaagctcgcttcatagacccctcttgatagtacggcgcctatctagcaaatccggtctacaccaaacaccaagaccgggaaaagactaagaaaatattcttagctacattatacctttgccttgcgccatccatcttggggtcaagcttgagccgagatcaacacttgtgaccatccggttgaaccatgtttatgccgaggtcttatccatcctttgtcaagactttattctcatcacaagtttgacttcattcttaccaacatgacgatgtccttggcttggtgaccactaacccatggtgtcattcattagcctcatcgtagtgggacctattccttttcacacctcaaaggagaacattagtctcaacaaatcggttgtcatccttcacttgatgaccaaccggttgcatatgaaagatatgtatatgcttgttgagtattcattaacattacaagtgtcatatactcgtatgcaagctcaagtgtaaagatccgatataaataataggtgaacaacatggatctggaacatgcacaataaatgtataggatttgctccccctaaatatatgcatacaaataaatatacaagagattcaagtgtatgcataattagagaatgaccaatgggggtttatcctatacatatagagaaggcatatgtactaatgatgtagaccaacataaaacatataccttcatgatctccatgttctcaatgtaaatgagactaaataatataacattcgagtaaacattagtctcacacttatatatcaataacatagaaatcatatatatgaacctatcaaaaagtaggagataagaagtggtacatatcgttttatctccatgcatttcattcttgtcatgattaagttccatcacaaaagaatgcatgtcttccacatctcattatcgggaaataacctagtagacaacttatgcaaaagagaggttaatcccataaacatcggtttatcatctatcaccaaagtaacaattacacaaattgtttaatcgaagatctttcaatattttctctctttggtgatggataataacccgatataaacaatatagagagatgagatgaaaaatgatttcaaatcaagatagaaatcttataataaacaaaatatagaataagctccccctcaagatgtgcatacatatggatatgaaggaacgcatatgcacataatcaataaagatcaaataggaagctcacactatattttggatctacaagagagaccaagttagaatatgtgaagtttaatacatacctctcatcatttttactttcatatccaaatgagactagtcaaagaaaggctcataaaaatgattagtctcatatagttagatttgtcattaatcaccaaaaccaaatttaaggcacttgaacttacagtcccatgtggcattgacgtggcgctgacgtgacaattctatccttgaaaataataaaaatcgttggccccaaatgtcagctacatagaaaaaatcatttacaaatagcaggggccacgcgggtcccacatgtcagctagagaaatggtggggcccacgcggcccccacatgtcattccttcttccatccctcttcttcctcatcacgctgtgtccgactgcttctcctcgctagcgccgtggcgccgcctcacggccatcgccgccgccgttgtcgtcattgcagtccccgtcgctgccgacggggcgttgtcgtcgttttagtctccgtcgccgccgacgggggatgagggagagggattggacccacggcgacgagaggagaggggagaagggagaatgaggtgtcgccgtctgtgggctagccactggttgcgcgcggaaatccacggcggtgaaaacatgcaacgtcaaacatagcttaacggcaaatcctgcgttgttccctcggttcagaataaattccgtccacttattctgtatctggacgcgttcccgttcacatgcattgcttgagccttgtgcgcgtgttcttggattcgagtcgctgcttcgacttaggtgtgtagacatttttaggcgacatacctcacatgttaatagttcaagttggttggattgtctgttatggtgctacgaacttcgtgtctttggcatattcttttgagtatgggtgaaaatggtgacgaaaatttccatggaagcaataatagaaagtgacaaaataagagaaggaaacgaatacgattttattgttctaccgactgtttccctcattttaccgtacttacatggaaaatggtgttgtcataatacgataattaacatattcctaaggagaccgtttcccttaattattgcgacggtacgaattacaatatcaattcaaaaatagacatcatttacactcaacttttaaaaccggatgagcccccatgactcactcgagaacggttttggtcatatatggcttatgcgtggtagtccaatcagcataaaaaaatcaaaacaatttgtgggagtccacatgtcaattatgcttcttcctctcttggtctcctcttccctgactcatctcggtcgctatcgatctctgcctgcctctcgcccaccatccgcagtccatcacctaaatcttgcccgcctctgaagaactacaatccgccaccgacatgtcaccctacccgcagcatcaaccttggcctggttccgtcgagctcatgcagcgccaaatggaagaggcagaggcgaacaaagaggcggagggagagaagaggtgatgaagatggcgacaaatggacccgagctctagttggatctgtcaccgccccaagctccacgtggatccggcgtcacctcaagctctgtttccaaccgtctccatgttgcagcaggtctcttccccgcaaggccatctgacttcgccatctcgttgaccccaacctcaaagccaagcccttgccgcttgttgtcatcatcatcgccgccattgagacccgtcacacccaaggttgaggacgacacatccgcccctccctgggtcagggccactgtatctttctaccgcatgagcatgttgccgtcactgagacctactgcacctgaggctaggggcatgctacctccccgacaattgggctagcgattttttttagaaaatactagactattgtcacgccccgaactagtcccgaccaggactagcccgtgacgctccaaattaacctgttaatcgataccagtcccaggaaacagtgctggtatcacaggaaaacagaatatcacagcaacagaggtctctttattatagagtaggagtacagtcatgttgggctgcggacagatcccgagctcacaactgcattacaaaagggaagcggaagccaagacttggaccaaacatcacaggcgcgacttggggactaggccgaaaccctaaaactcatcgtagccggcttgctcctggaagaactcctcgtcagcgggatccgcttcatcttcttcagcaactgggggggttatttatatagagcaagggtgagtacaggagtactcagcaagccatgggaaataagtgtttaatgcaggcttcaaagaaaggctgttgtttttgcaattgattttatttgaactcttttctgaaacaactaggtgagtgtttctcaaacgacacggatgagacagtgcgtctcgtccggtcggagtatgtgcaatgtatcagtcttttgaattgattaagattggcacccggccaacagctttcaaacggccacccgggcctggctgatctcatcagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgcagaggaggtacactttacccacacgacattactaacccggatcatccagtccgtgcagaacggccacgactagagaccttaaggctttcatgacaaggcatttcgaaagccgacacaggttcaccatatgccaacgagaggggtcccagaccaacaccagattaggtccagaccatattgtgccaggaagcccaggggtcctccccgacacaccccggcgaatccacatgtctcttagcatcatggctcccccaataagctagttactcagccaggggtgtcccattccacccatgtggtcgtacttgtcttatgttcggatgaaattctaaggaaatggtccttaagtgcaagagcgggaaaccgtacacccggtacgttccccggtccacggttttggaaaatcatttagttcgcaagcaccgacccaggtgtcgggttttccaagtcttttgtaaaacccaagttttacccaagatgttttttagattttaagtttgaaggcgaccgtcgatactcgtgcagagtgcacgattaccgaggcgcaactgggtggttacaagggaacatggtataacaattaacaaaggaaggatcaaatgcaacaaattaggtaggtccgccgatctgccttgcagacgggacaagcagattaagtgcgatcctatcaatgcataatatttttcaagcaacataattaagttcaaatataggctcaagatgttcaaaggtggcttgccttgctcgagatcttgaccttgatcctcgaaatcctcgcactgcgggtcttcgggctccgaaactacatgcaaaacgggacaactcaacaaacggcgaaaataaagccctattattgacctctaagcgtgccattagatagatctcgagatttgaggaattttggaagtttggacggagtcaaacggatttacggttgggaagatattgaatttctaagattattggatttttggtctaaaggaaaaggatttatttaaatcctttttgaaaaataaaagaaaagaaaagaaggagggagggaaattagacttccctcgggcggctagggcgcggcccgagagaatggggcggctcggccgagcttaatgggccggccggcccaagaaggcggcccaaggcgcgcgcgcgggcggggaggggagagagagccggggggctgggtccaccccgcgtggtcccgggtgggacccgcttgtcggcgactcggctcaccgtgagcgaggtgcacgcggggcgtgctagggttcagggagagagacgcggtgcacgcgcgcggttcgcggaggacgcggatgcggcgggcccacgcgcagcctcacggctagcggtggaccgcgcccgcgagcggggccggagggagcggctgaccggggtcggctcgacccggtcttggccgagctggcaccgacgtggcgcctacatggctgccacgcgggccggcgggaggtagacgacgacgtcggccggaacggacggcggacggcggctgcgaaaggcggggcgaaccacggcgatacaggcgaaagcgagcacaccggatggttgcatgagacgaggggagacgagccaacggctcggattcgccggagggagctcgacggcggcggattgcggcggtggcaaccggcggcgagggaagggggaaacggcgatgaggtcacaaggggccgattcccggcggtgagagcatctacgcggctacgggaatccgttgctagcgtcagattaggcggagctacgccgagcgaggccggcgacggtcgggcgctacggagcacgggcggtgacggcggcgagcacacagcgagcggcggcaacggtcggggtggcgccggctagctacggggaggctacacatgctactaccgaaaactaaggggaggagatggattgaggagggagaacggggagatgcgctaccgtgcggacggggcgcagtgacgatgggccgacggcacgggagtgatctctccggcctcaggccggggaagaggaagaaggcgagcgcccggagttcccttccgcgtccacgaacgcaccggctctcccggtgcttggcgatgaacggcggaggcgagtcagaggggcggcaatggcgcggtggcggcaagcgaacgggaggaggaatcgatgggagggcgccttggtttataggacgacgatgtcggtttggaaaccgaccttgggcggtcaaggcacgagctggcgctcggcgctcgcggccaaaacggcaacagagacggatgacgccggcggggaggggaaaaggaaaaaggaagggagaaagggagcttgccccttgcctctttggggaaaaggaggagggagcgggggcgacgcagcagagggaggaggagctctgcctccgtcccttggaggctagcgcgtggagtggcgggggccgggtcgtgacgacggcgatgacggccgggcggtttggagcggagcgacgacacgagcggcaggcgcgggcaggcgctgacggcggcggcgactggccggtcggccaccatggcgcgcgcgcgggaagcaacgggcggcgcggcgatttgggcgacgtcggcaggaaacagcagcgagggcgggggggcgctcggctcggcgcggctcacgagcacgcgtgcgcagcgtacgggcagtgcgggggagagggagagagagagagagagagagagccggggagggagggggagatgggccgagagggattcggcccatcgaacccgagggaggcgaaatagacttttgcggagggatttgatttaggaaggatttggattcgggatgaactcgacgatagatcggggatttgagatctgagatggcacggacactagacaacaagcaaagaaacagatttcgcaattaggatttttaagagatagtttttccgctaggtgccacgacggaacgggcgctacaactatcagttatgataaatgtcgacgagtgatactcgtagaccggatgattagggtattggggtacgttggaacgaggatctacgtaatacgacatcaagcgaacagaagacaaggattttactggttcagaccccttatcaggtaatagccctagtcaagttttacatgggattaatatggaaaagccacaaaatacaataggagtagatggatccgatgataccgacgagatcgtaatcgatagactcgacgaaatcccccggtgacttggctccgtatgctctggctttgtaggctgtggtggtgtgttggcgatgagattcgatgccttgcacccctcccaggggtcccttttataccgttgatcatcttgatctctaagtaagactcggagacattggatctcatatgatacaatgaaagctctatccataccgagtaggactttgtaaatcactcgacccgtagagatattttccataatccgtgacggattcctacgacgcatacggaaacaacccgtgttataccatactcgtatattccataagtcgtaaaataggaggtatgccttattcgtaacattgaccaaaatcactgtggacttacttagggttgtcatttgttccgtttgaatagtcgatggtgtgaaatgactggtatttgagtttagggggtaattcgatcaaccccgctaattcaggggtgtcattcggactttttttttctatatataaatactgtaatatctatgatccatatatataaataccgtaatatgtgcttttatagctatatatatctatatataaatactcttcaaccaaatatcacaagcccgaatataattgatgatattatatagtaatgttaagctaaatatgtgcttctatagctcaatgttttcgatatttattaatggtattcatttgatattgaattgtttctgttcatacaatttcatttccgactttctgatattttggacactgttttcgttttgggtcttttcattttcgattttgtcttcgaagaaatatggttatattaccaatatagtgaaggttgtttgcatccctacttccaaacgagaggaaatgaaaacgcatatgtgcagatattattgtcgtgagggtgtgtggacactggaagccattcaaatgaaacatgatatgcagattgaacagccatcgatcgaggataggtgccgctgggcgagatgtaacaggtacggtgactggatcgtttggagactagtcagatagggtgtttaacagcatggaagataagaagggcaggagtgcaggacgtgagacaagaggaggacggccgggaaggcgatagcgaagagggccagtgagaaggtccggcagacttggagataagaggggtggcgttggaatgttggatcgctggcacgattacacacctacggcgtccctgtcagctgtcaagaaaaaaaaaatggccagtgatgttcataagatctccacctttttttttttgggaaaactataagatctccacttattcggtgtaagtgtagattgtaggacatgtttcatcgtctcatgggtaagttttctgatgattttgtctacttcaggctcgtatactaaacagatcttaaacctttccgtgcaatgtttggtaagctagctacagcaagcagacagtgcttctacagttctactgcacatcaggacaactgtagcggtactgcgcgtggaaacttgcaacgtggaagacaagggatgtgttgttggctagtgtgaccattgcctgctgtttagaaaatatctgacgtgctaaccttcgtatgctgactgctgactaccgaataaaatttctatgtgaatttcagctgtgagaaagcgaaaaatctagacttgagagtaaaagcttgaaggtgaacatgtcatatatttcttctgtaatctgtgtctatgagcataaacttggtttctcatctgtatattccgaactctagttatatcctgctcttaaacttattgcctgtaaactttggcgcatgcgtgaaacttgcctgaattttattcagggtagctatgaggaacaatatgatgcagcagtggcggagccatacattatttaaaaactataactaattggttgttgcttttgtccaaaatttacataataatttaagagatttaaaattgatttttcaagtcctagctgttctaggtctgcctccaccactgtgatgcagagatagtagtttgaagacaaatatcagtagtcaacagcatcatcggtgacaccatgctttaccatcgcaagattgaacgtcgcaagtcgcaactaaggtttgttccttgggcgaattgcctttaaatccacgccgatctggaactcattggcaccatctcactgtcatttcttcctctagctggtcgcgttgaacatatgctggatagccgaccgactgtggagtcggggattgccgcatcccgaccgctacattctctgtgatcagcaggatgagagcattaatcatatcctagtcggctgcccagattcaaggcagctttggtggtggactttgagagcaatcggccaccccaactgcctgccggtgaatgaagcttcttttcaccaatggatgtgcgataacagaatggtgctaagtgagtcacatcgtcgaggcttcgacacggtggtgacattggtagcatggacaatatggaaggaacggaacggttggatcttcaatcagcagtgtagatcttgggtggatgtggccagagggatggtggacgaagcctctctttggcgtaaagcaaacccggcgatccctgcactgcaattcaggagggagtttggtcgccaaaatcagcgcgagagatagacctaggattgtctgttattgtcctgtatcagtcccgtgctgtttttctctttcaaatgtaaataacttttatttctcttaatggaaacaaatgtgctccttgcgtattcccgaaaaaagtcgcaaccaaggtagaagaaggggttgacaatgtgggtgcctgcgggttgtgacactgcaggatacctagtcagctagccaaccgctaaacccacattatcctcatccaatgcgtcacagttatctagttaattatagagataaattaatttcctctgtccataactataagtatttataggttgtttatagtacaaattaagattgagaagaaaagcactttgacacctcatataaaataagtgtacctgcactatagtgtgattgtattataactatatttataattataatagatgtacgcgaaatcgggattgttcacttggctaggagcagatgcccgaaaaaccgaggttgagatatctgcccccggcctcggcacacttttgaaaattttcaaaccttgctcgcacgtatcttgatgtacatccgatggtccacaaattggcacttctaaagattttccaaacttgctcacacgtagatacaaatctgatgatctgcaaatacctcatggtaaattttggatcggtactattggtagaaaactagaaatctggatcaaatagtactcccggtgtttggaacgaactactacagctacggagtaatactttttgcggtcctagttattttcaaactaatccctctgttcccgctgtaatttcgtcgattggttagcctttgttatgttgatgaaagctttcgcgccctcttcagggctcggtcgtttaatccccaagataaaggaattggagtagattgaagggaaataaataccctctaaatccttctcaatcctcttgtgggagggataaccgaacatggcctcaggaggatagcgagggaatccatgtcttcatcgctcgtcatcacgttcaggcggatgtacaagatcatcagcgacctcttcgcagagaccagcttgagcggttcgcccagagccggtgcaccaccgcagctgctagatctgctattcatgttgttctgtgtaacgctgccaagctcaggcgagccggtcatgcacctatcacgcttttttttagaattagggccagagagcccccatttctcttactagaaatgaacatatccttacaaagtcagggaagcaaaaaacaaatacgaggaaagaaagctaaagagcttatccagatgcctcatagggctggatggctgaacacgaatacatcattcggtcatcaaaaggataaaacagatcacaaaaaactaataacatcttcatccttctatcctcctgattccaggtctccatccatgtctcgagcagaagatgtcacttgccacctgtcttataagtctggctcccaactgcagtcttcttcgatttgcttccaacttctgcaaagatgcccatgaatccacccaggaacaagccataaagaccaaatcagtaggatctcttggaaatttattttcaaaacaagctttattcctggacttccaaattgtccaaatgattgcagctaaaccaatcacaatcaagtgtttcatgtttttatcatgtctatccagccaatgtccaaaaatatcctgacgattcaaagtaggcagtatatccaaagcacaacacatgatattccagagaagtttagccaaaggacattcaaaaaacaagtgttgtatatcctcttttctatcacaaaattgacacttttcattccccttcctccaaccttttttatacaagttttccatagtgagaattttgtttttaacaaacagccaaataaagactctaattttcagaggaatcttaaatttccatattttcttttgagggaaagacacctgatgcattttaagggctttgtaaaacgatttcacagaaaagattccatcctttgtcaaa

SEQ ID NO: 68334 - DNA, 587 bp, Oryza sativa
gcccattcccgcaaccatgcatatggaaacccggattacacatcccaatgcaatgcgtgggacggatttgtttcaatttttgggtacaaattaaggctaattaaaccccaaggcaaaattctatagtttcgcctcgatcgatctggcaatgatcgatatatttacatataacacacactcttaaatttctctaatctctagctcacatgtagctagcacactctgatcctaattctccgttggtttcttcagagattaatttgaattttgaagaagttcatctcatcatcaaattataggtacatatatcgatgtagctaggaatgatgaacctgatgtgaagcgaaggatcaacgatgatatggatcatccatcgatcgatcattgtagctagggcagcaacagaagatgaatgagaagatcgaagaggaagaaaacgaagaacaagtgaagaagaagaagaagaagaagaagaagaagaagaagaagaagaagaagaagaagaagaagaagaagaagaaggcgccggggtgatatatatgatcgatacgatgcagctagctgcgcttgcgtgttacctcgtcttg

SEQ ID NO: 68335 - DNA, 3097 bp, Oryza sativa
  unsure (1)..(3097): unsure at all n locations
cctagcgaaaaaaaagagtaacttcgtctatctgcacaggagaacctccagtctctaggagccaatgggccatggcaaaactaccaaacggcaatgaaatacttggcgacggatcgatggaagtttgtaccggtttcggcgtttcgacagcagggtgacaggacagagtattcatttcatccatcgaagtagaagcacgttttttcccttttattccaagaaagaacaagaacgaaattattgtcctttgcgggtgtgattgaagatctgtacaatgaacgcctacaaagccgatgggctctgcagcagctagccgaataaaccaaagaatatgaaaacacaaacgacatttgcaatttcagtccattagagcaaactgatcgaatcacatgcttaatcaacatgaactaaatcacaagtaaagagttctgacacgacgatttttttattttgtgtaattattgttttattatagcaaaagaactttagcatcatttagaacagacatgatcgatttattagctaagttaccggttttcttgcaagtcgttctccttcagaacatagaatgattatctagaaaaccttgacgacaatagtatttcctcttccgtgctactttctgtaattgttttgtatatcattggtaactccttcaattgacatgtaaagagctgaaatttgattttcatcgcatctgctacttgatcgaatattctctttattggaggggcctttctttgaaactatgttttcgagtaccatctctacttccctcatcgtaggccgctcttctcctttaaatttagtacatgttgcggctagtgttgctacttcctggacttctccatcttcctcttccctaacttgagaatctattatgtcataaaggttaccttttgagacaagtgagacgaaatgtgaaacaagaccatcgccattatcaaatgtaccaccaattggtttcttccgagtaagtaactccataagaagaacaccaaagctaaaaacatcactcttactcgtaagtcatccagtataatagtacatgagatccaagtagctaattgttccttgaacggcagtagttattcccatttcatttatcgagatataccttgaagctacaaagtcagatacctttgctgttaggctgtcatcaagaagtatattcgaatatttaatatctctgtgaaatattggcattgatgcagctgaatgtagatatgaaagagctctaacaacttcaaaagctatccttaatcgatcatcccaaggtaatgatgatgacaccgtgccttcaatatggagatgatgttaaagggttacatttgaaatgaactcataaactaacaatggaacttctgtctcaaggcaacatccgaggagttttaccacatttctgtggttcacttgggaaagaattgcaacctcatttatgaattcatctatttctctttggtgtggcttgtaggttgtggaggagcggagcatgcgaggggtaatgggataccggtggttgtgttccctaattcgaagtctactccagaggggatttctactgatgagctgttgaatgctctgaggttggttgctttgatctcaccttcaggctttggcattcgatttctagtagctttgtagctcatctgttaggtaggtgttaaaataagtggatttgcagaaacaatggtagacacaaggcacacaacatctgagatttttcacacttgccttaagtcttgtttgaaaaatgcatacatgatacattgttgtgttgtttgctgataaaagttttctaatccattcacctgtcttatgtgtgcgggtactgttgttcgaagccgtcaaatgaagatgaattgataactattttaaagattttagtgtctacttattgaatgtgtgtcactaccttgttttgccagatgaactttgatatcagttttatgctctgggttgacgtttagtcaggaacctattggagtgtgttcttcatcagttgtacggtgtgcccactcagtcagtcagattagtttccattttgttattgcctagctgatatactgtaatgtaccactgttgatttttttcacgaatagccactgcatgttttatggtgtttgtagatttacttatatcctcttctacaagactggctcgcctactgcggagatttgttttggttacttgcaataggtctcaatattcggatcaatctatccttatttcttatgtgaaatagggaactcagggtagacttcattatacttgctggttacgtgaaacttataccggttgagctagttcaggaatatccaaaatccattttgaatattcacccttcactactcccagcatttggaggcaaaggttattatggtttgaaggtgcataaagcagccatctcatcaggggccaggtacttcgcaatttctctatcacccatcacaagcaactgctgtgcagtttgcatatctactcaatgctatttccatggaaagcaatatcttggcaatcaatttgagctgatacctcacattgtagaagaaaattaaatcttgattattaacttaattggagaatgatctttgtttgtactctaactgttaagtgtcaactatacacaggtattctgggtgccaactgtcgccactttagtggtatgacgcactatagacaccagagaaggcactctacgcccaaaaagaggttagtatcctggtgcgtacgccatatgtatatctcccagacgcaanntntggctgccaanngagctctcttctatagagagtacacatatcnntntatagctccgcnntaagatnnttctttagaantgataccatgnngnctatgcacatanntttcacttaangcatgccaactgacanattgatgnnantacacgcttctttatggcttcatttatnntaccccttatttttcaggaacatcaggtttatgttgaggcagttgctgccctatgtgatgaccgaattgtgtggagagaagatggtgttccacttattagaagtcatacaaaccctgacgagtacacttaactcatagtactacctcaaggattgctgcgcag

SEQ ID NO: 68336 - DNA, 1819 bp, Oryza sativa
aatatgtaccgcaaggcgcaaacactggaaaatccattattcccccacaccgttttgaacatgaaatttggtctcaaatttctacattatactcgagaaattttcctcacgagagcagctagagggcattataactcacatgagcccttcaattttacaaaactcttgacaacatggccatttttgtacaagcgtgacaaagggaaggcctggatcttgctatgttcagcggacaggagaaatttggacagttctcctttttgaccctaagacaaaaatgatctcccagacggtatcacatatatctccagtagacgatcagatgataaattaagcgatgaaaatcagagcctggacaaatttctcaatgtagaaaccttgctaagagatcctctttatgctgcatatagtagtatgccaaaattgcaagaataataaccagtatcatggtccatatacttatacctgccagaacaaagcaaacatatttaggaggacatgcacgactggcaagtataaaaaacaataacaaataaagatgtggcataccacgactcttaggtgatccaattgaagtcaccctagcagtagaatcgaaggaagtcgacagcaaggtcctgatataaaatagaataccaacattgagaaatcacatctgtcacgtttgtaaactccaagcagatcgagagtctacggcatatatactgaccttgaatcttgagagaatgccaatgtagtaataatgccaagatgtgcctttttaactgttacaagcgaccgcatattttttgaacttagtacaataatgcttccttcaatagttccactggatatggaaatgcaaacaaattaggcttctagaaggtgcatccacataatctcaataagcttaatcataaaatgcagtaagctgttgattgaatttgctcacattgcaagaagtgtacaatcaggcgagacagcaaatgctgaaattgcctcacgtgttattttatttgacccaattctcgtccacgaggtcgtattccaagatattattttcccataatcacctaaggaacaggtttatgttactgtcaggacttaccctagcagatagtattcgatctataacatggttaaataaagtcttgggttaccttgcatcgctgtaacaaagaggatctgactgttgtcagtctgattagagaatctgcagaaaccaaatatttctccctggaaatgtgaaagcaagaaactcacttaaaacaaacacaatacaccaacatatgttttcaaaacacataaacacacacatactcactgcttctcttgggagattagctacaacttctgctgacttcaagtcccatactctacatgggccactgcttctgttcacagcaaggaaatgttcatcggagctaaaagcacaacacgaaacagaggaaacccatcagtatcacgcaatcaataatacctaagttgcgagaaaagaaagagaatttttacctgaaggttaaatccttcactgatgttttcgtatcgggttcttcaagaatggaatccatggaaggccatttgaagacccttaaatgaccatcctacataattgacagaaaattgatttggcaccctaagtagaaatcatcaaagaattcccaaggcacgattgtatagtacagaaatcaaattttgtaatgaatattttgccttgaaaaaagtgacaattggaaatattacagctatagacacaaattaatatagcctcgtaagtgtcccgatttgcttttaactaaagtgaaggtgaggatgctacacataaaacaacataactgaa

SEQ ID NO: 68337 - DNA, 12100 bp, Oryza sativa
gagcaagtcaacaaacacagatgaatttaagaagtaatgaggtattacatattctcaatccgtggaatttttttaactgtcacgatgcaaagagaagagggccaaagacacttaacaacgagtaagggagagacaaacattgtgaaatcatgaaacaatgttgaggacagcaattcatgaattactctataaagcaaacaaatataaatgttaaagccaattatttacctccaaatctcctggttgatgcatgagtggttacagcccctggcagtgagcacgtgacaagtgttgacatggaggacacttttaagatctacaatcaagcaacataacattgtcacatatgaaaagaaatgaaatgccatgccaaatgattgcaaaatgaaataactatttactacagagtgcataaatacatggcatctcaaacctgatttgactgcttgagaaacaacacagtatgctcagggataatgttatcatgcatataaaaataatacttcctccgtttcatattataagactttctagcattacccacattcatatagatgttaatgaatctagacacatcattaacatctatatgaacgtgggtaatgctggaaagtcttataatatggaacggagggattaagtcacaacacaggtttgaaaagtatgatacttgtcatacaactccgatatcaccatagtgcttttaaaagtgtagtcgagatcccaccccatatgctcaacacctcaatcgtcccgacacccattagttttaaacaattgggcagctaacaatcatcaagatgatggattttatccaacagatagtgttacccccataagtaaaaaacaaaaaaaaatctataacagtaaccatgatccccaatttttaacaatgctaaccactgccgtcaacacgatcctgtttttgcagggttctacagggagcacggttcaggaaaatttcccaataaccaaaaaaaaatgatcatgaaggggattagcatgatctttgtacaggttacctcccaaaaacaaagaaccgctgcggcagattaaaccctattctccaaactaaaatcacaaattattccccccccccccaactaagtatcgaaaccacgtctttatcaaactctccaacaggcaggatgacatgcccacgggatgaaatcatgaaatctctaataacccttgaccccctcactcacctaggaaccaaccaaccacgcgacgattcggcggccacctttccgcgcctcgccccccacaagatcgcgttggggatcggatcggccggcctggggtggcgcgagggtggatcctgctgctgagggcgccgccgccgcctgggaggaaagggaggagaggaggaaggcgatgggagagaggaggaaagcctcgtcgtaggcggcggcgaaggaggaggcgtgccgtgcgtctcgcggggaagaagaagaaggggaaaaattatgcagtccttcaccgatctgtgggacccctctcctctggcggacacgtggcggaactagagagaattcaatattcaatcctactgtaatggtgaaacaaaatggtgaaacgggatgaggtttttcagatatactgggaacgagaaaaaaacaattatataataaataacataaaaatccatattgttccataaacgattggctgcgttctagaaaatattcctcgtttttcatatacacgaaacggttaaacggtgtgtttttattaaaaaaagtctataaaaaaattgattaaaaaattatactaatctgttttccaactgacaacctcaatattttttttctccttctcatatatacccttaatactactacgtccgttccaaattagtagtcgctttgacctttttttaaacatttgaccattcgttttattttaaaaatttttgcaaatataaaaggataagtcatacttacttttgataataaagtaaatcacaaacaaaataaataataattccatattttttttaataagacgaatgatcaaaagttatagacaaaaactcaaagagacaagtattttgagacggaggtagtactacatagataagtcctcccaactaggggtgcaggtgggtttgtccgcgaacccgcttataggcaaaattagtacataacccataggtttgaccagcgggttacctattaatttgatctataaatagatttatggatcgacccacttacatatctagatacagcaaaccagaccacgacgcgaaaacccatgaattatcatttatttgacctatgagtgaacttgctggtcggcccgcttgcatccctactcccaacatgtaaacgtgagggtaaaaagtcacgccaggaaaaaaaagggaaatgcagagagttccgaactccttaggggctgtttggatcggagactaaaattttaagtccatgtcacatcggatgtttggatactaattagaagtattaaatatagactaatgataaaaacccattccataactctggactaattcacgagaatctaatgtgcctaattaatccataattagccactgtaatgctacaataaacatgtgctaattatgaattaattaggtttaaaaaatttgtcttgcgaattagtttatacagttagttttataattaatttataatactctaaattagcgtccaaatattcgatggatccaaacaccaccttaatgaatcacaatgagaaaaatagtataagtagatcgaaagaagaaaatgaagaagaatagaaacggctagatccgggcggcctgtttggaggttgggggcgagtggatctaataaggcgacgaagctctgggactcatctccaggctccagctatataggtcttcgggggcgagaacggcactcatctcccggaagctactgccgcacaagcacagcctactcgcccgcccgccggagcatgcggaaggatgttgacgaccggctgcgttggttcgagaatgagcacgcatcaaaactagccaaatactccctctccaaaataagtgcagccttgagtttccgtgtataaatttgaccgtccgtcttatttgaatttttttttatgattactccctccggtcttgaatttgttatgttttggagctgggttgtttcgcttcaaaagcttgacgttttggcctccccacgctcactttagactagtatacccctacgcatgcttacaaaccgcattaatagatgttgatgcattgtaattaatatgggtaaaacaaaaaataaataccttaattaatcacttatttgtatctgaaatcatgtccaaaacatcaacaaatagagtaccgagggagtagtatttttattgttattatattataaaacatgaatagtacttgatgtgtgacttatgttttttagatttttcaaaaataattcaaataagacgaacggtcaaagttcgacacggaactcatggctgcgcttattttgggacggaggtagtattaggttttttaggatggaaccaaccaacctaaattaatatcctaaattaaactcatggctacccaatatttttcaccctgtcacatcaaacgttagaacacctgtatgaaagtattaaatataggctaaaaaataactaattgcacagatggcgactaatttgcgaggcgaattttttaagcctaattgctccatgatttaacaatgtggtgctacaataaacatttgctaatgacggattaactatgcttaataaattcatctcactatttactgacggattttgtaattagttttttattaatacctgaatacccccatgcgacaccctatataatctaatgtgacacactaaaactttacacccttagatctaaataccccttaattattcttctagtatgtgtattcatagcgataagcgtgcacgtgttatgagcgtctacgtttgtattgtggtactaaaaaaatcataatactaacatgttatgtacgggaaactctcaccaataattttctagtgtgtccataacgcactaattttctaaccttaaatcatcctggccgttctcaccgtgggacggcttgagcccacaatgcagttgtcctcggcggccaccacttacctatcttcgacaagcagtgctatttacactgggaccaaactgtatatgtaattttaatataattataaattttgatgtcatatttactttatgaaaaaaaaatcccgatgctacaaaatatttctgtcttaaaaactttgcacaaatcttttaaaagctactgttccatccatccaaaatatttaaagctaaacatttttaactttaattgctaaaaatgaaaaaaaataaaatatatcaataacaataagaataatatcacaatttcattagatttattatttaacaaactactctacctgtcccaaaatataatatttaaaatctagacaggaatgtcaagattcgtaacactagcatatattatccaattctaaattattatattttagtacggagatagtatcataaattcataatagctctttgtatttatagcaatttatttttataaatattattcgttaaaataacatctcaaagatcctgctaaaataaaaaaaaatcttatattttaggatgaagtgatagcagaaaatttaaaattttaaacgatcaattaatttaagggaaatggtagtataatttggaaaaataatttgtaagtataatttggaaacggaggcaaagggtggacggctaaacccccaaacccccgaacagccaaacccttccccaccttgtaaccctcgtccaaccttggtgagaaaaaaaatggcggtctcagccgtcgccgcccgatctagggccatagcccgcgccgcctcctcctccctcctcgcccgcggcctcctccccacctcccgccgcgccacctgcatcaacaggtaccgcacgcgcgccaaccctcgccgcgctctgaaccaatcccccttttttcctcacgctgttagtgttacctgctgcgcctcgggtgggtttcgcaggttgcctttggtgtccgggggcctcctctccacgctgccgctccacagcgccgtcgcgtcggcgcggttacggtccgcgatcgcgcccgagtcacagagctggggtttagtcccccaaggtgaggttcttggtcactgcacgttctaagtgcattagtgtactttgggcccctgatttcaccatgtttacttcatccaggaacggaatcggttatggtttgtaactttccagtttagtttattgtaattgatgatgttagatgaacgtaaatgacgattttttttgttataaaaaattgaccaaaataggcatcagttttgttgcgatttgttggaaatctcggtctctttattctcatgggaggcagcttgtacatcttataattgcattgtgtttttagtactcggaaatgatatgagcttgtggtttgaaagaaagtctattgagattggtcactagacccgaagcacattgtggtgttatcaggttgctgctaggggaacttctatggttgctcatctgtttgtgaccaaggttatttgtactcgatattgttttgcatccatacacaatagggagctttatgggcatattgactttttatgcttttcatatgtactacctccatcccaacttatatgtactacctccatcctaacttgtccagctgcatagccagaaataaagtatttttgatatttttgggatgtaggtagtatgttttatacactaagcttgggttgactagtccaaattcctaaatggcaatgacttgagggttttgcttaaccccaaaggattcatagtatcgtagatggatattaagttgcaagttatagatccattgattgccgagtatataagcacagtataatagctttactgattggtgatttggtgcacgtggggctttacacatcatggaagttgatgccgtccagtatgtggctcatgcatccaactgattttttagaggaagtcactttgttgcaacactggtgttaatgctgcaagcagggtgctttcctaaccattcataagaagataaagcacttctgataaatcacaagacatagatgtaaaaactagtttcattgctcacatatttggatgtcctatgtttattgatagttatgagtgtatactggttgttatgttatcccaggtcaggtcaacaaaatcggtctgtttgcttttggacagcatttgctttcccttgcaggtttgcacaaacaataatgtgtgacactccctcctcttcttttgcagggaactccatgcctttatgagagcaaagcttaccttttccgttgtaactgcctaaacaaattgtgaatgctttgaattttcataatgttcatttcgctatcagaactatgaatgagcttacgagaacttatttttctgtggtaagaatggtttggtgggtaaaagtttggttgttttctgctatactagctatttttctgtgataagaatgcttatttgacttggctgatttggaattttggatacatttgttaccaagtgaacatatttctccatctattggctctacttcctgaggtgcagtttctggtgcaatgttctcaatcgatcatatggcggcagttcagtatcattatttctttttcagcggcaacaattattgaggcgattaatggggcatccgattcttgtgatctgtcatcttactgtttgggttggtaatggattctgatcatgagactgatggattcatggttttgttctgtgaacttgagtttcctgaaactatcaattttattttctttagtcttctggcttgttctgctctatatttgcatgcgagctaagtgtataatcttgtctagcagttgttctatttccctagagggaatggtgtacatgtctagaaaatagcaatatgacaagtttacaactacttgagttgagatttttacaacgataatatgtgggtttcaaattttcaactatatagtgtatgttcattggtggtgaattatattttgaagattttggttgttcaaaacaatatagtagatgaccaaattgagtaacaagaaaatgtagccctttttggggagcttctattgactgcaacttcttctaaaatcttttcctctggaaatctagcttttttagattatcattagctgcttcttataatatcgagctccccaaacatgccctgtatcacatgagatggctgttgcgcgaacgttcgcgggaaggagtttgcacgaatggacacgtgggctgggctcattctagaagagtgcatgcaagtctatctgatctgaaaaagtatgatgtatacatgttcctttctttcaagctggaaaaacatgcatgtttaagtatataaaataattttgcatgcgcatgtagtcataattataatttctacttattgagtgattttatcatataataaaatggtgcattttgtgtataatttttaaagtcctatattaacaaatatttaattgttgtagaaagtttcctaatagaatatttttcatgtataaagtttatgaatataaacattttccgtagaaagtttgtgaatggattttttttaatcttacattttttatttttttaatcccatgagttgattttttttaattaccgaagaaagtttcctaatagaatttttttgccatgtaaagtttatgaatataaagaattatttttgtacaaagtttataagcagagattattttaaaaacttttgaataggctttaatctgaatggcatgtttaaaatttaggatataaattattgaatataatgtgttgctattaaatactgaaaaaaattaccacgctaattatgctgggctttctacttttgtatgcatatggagctgaaatttcttaataacacctacgtatgctaatttcacggtactaactgatgagtgttaattacacgctaattaggtgacgggatccgtcggatcggagacattcgtgacaggcgaatgcttgcgagctagactcacccctcctattaagtatcaacttaggctgtgtttagttccttttaaagttaaaagtttatgttgaaattggtacgatataactgaaaagttgtgtgtgtatgatatgttgatgtgatgaaaaaaagttagaagtttagatctaaacacagccttatacatactcccaattaacattaagaactcgtctggaacatacgaatcttacaggagcttgacttgtccttttgcagcatttgctaccatgaattgcggtaggcttcaagggaaacagattacttactttggaaggttcattcggcgtctttggggcctcgtttgtaatgttgcaattttacgtgaattttgaagggaaaaaactgtttcccatgaaagtcacgtagaatttcttattagttcaaaagtatggtctctgaagtttttcctacgctggatgataatttgtatgaagtaaaaaaaataatttgagcaaataggtatgctgtagcggtaggtgagaatgaactagaactatcaagggcggtctacacaacttatgatggaaaatccacccgacattgtacaaatactagatcattagatttactttgagatttgttccatctccttctagtcagcctccccccctcccctctcccctcaagacatcgatgtcgaggtgccctgccccatcgtcttctctgtctgacggcgaggagccctcggatccgctacctctagtttgttgcttctaaattagtcactctgatttgcccttgccaccaaagtatacgacatagttggagggacaagatcttataagttggttctacccttgttaaactagtaaggtggtactccctgcgtttcagactataagtagttttgactttaattaaaatcaaactttttcaaatttaatcaaatttgtagaaaataataataatatttttaatcccaagataaatatattataaaaatatattcaattacagatttaatgaaactaatttgatgttgtaaatattactatatttgtctacaagcttaatcaaatttgaagtagcttaattttgaccaaagtcaaaacaagttataatttgaaattggagggagtattaaatatgagcacacatctctcataggccgcacatgtcaaattctaattgggtaaggatgtcacacccctctagacccttaggaaaacccttcttttcgtgcttcccaaacccaaacacaaacactaatctatgtcctcttttgttcgtcggcactggagaaagggtggaggtcaccaaagttagagaaggagcacaaacacgaatcacggtttagaatctgtaaagattttgttcctaaattatccgccgaatgtcatttagcaaatccgtgaattaactggcacgcgtgtatattagttcatgtgatagaatttaaattttaaaacttagaaataaagctgagaaataaataggattagacggtaaacccggccgctcatgcatcacagaaccttatcctgttcgctcctgaccttcgttaaaacctcacccgctgctctcccgctgcgatggcagcgcgccatggccatggcgcccctcttcgttcctcctcctcatctcctcttcctcctcccagccaccacctcatcatcccccgctgcttccctcaggcgactcctcctcccgccgctctcgtgccacgcgcgccaggtgctcgacgtaatgccccagggagaccgcgtcgccggcccgagagccgccgagggagctggcgctaaaggcgcgacggcgcaggtcggcgtggccacacgggaggccggcacggcggggcggcatgggcggggccgtcatggcggcggcgcgaggccgtggaggagaggggaggacaggcccgcgcgcggaggacaacatgccgccgacgacggggaggttcagggaacgaggaggggtggggatctcaaacaacgcagggagggcaggcgctggacgagaggcgaaacgcaagcgcgggaatctggaaaggctggaaattcggggagatgccagagtaacggtagtggtggcaatgccagcaggaaggggaagaagaaagccaagggtggtgagaacgaagtcaagctgagagtcgagctggacatgtgctcgaagaggggagacgtgattggagccatcaacctgtatgattctgcggtgaaggaagggatcaaaatggggcagcatcactacagcgtgctcctttacctgtgttcttctgcggcgcttgggtttgtgcaaccggcgaaaagtggcaatgccggtagtgggattgctagtattgggcagttacattcatcgtctactcaaagcgtgggaaatttggagggagacgatgtacaatctgaaggccactctgaagatcaggagggaaacaagaccgatttgtttgcttcggatgatgggacggagaaaccgagtcgaattccagtgagtgatgagctgagggagtatgcaagaactcgagggtttgagatatttgagaagatgcgctcggaggaagagaaagttcccatgaatgagtctgctctgactgcagtggctcgtatggcgatgtccatgggcaacggtgacatggcctttgatgttgtgaagcaaatgaaggatcaaggtattgcgccaaagttgcggtcatatggtcctgctttgacggcattctgcaatagcggcaatgttgagaaagcatttgaggtggaagcacatatgttggagtctggtgtcagacctgaagagcctgagttggagacacttctcaaggctagtgtggccgcacaacaaggagacaaggtttattatttgttgcataagttcaggactactgtcagacaagcatcttcaaccacagctaaactacttgaggattggtttcagagcccaacagcatctaaagtggggaagagaaaatgggattcaggtgctataacaaaagctattgagaacaatggtgggggttggcatgggttaggatggttaggaagggggaaatggaccatatcacactcgcacatcgacaggaatggtgcatgccttgcttgtggagaaaaattgactattatagatcttgatccaaaagaaacagaagattttgccacattggtggcaaaattagctatcaaaagagagaggagatcaaactttgataactttcaggtcatctatctctgaacaccgtaaatgctatttttactaggctgtgcatttaccaatacatgtcatcaatattatgccttgattaaattacactaaatatttccgtaagtgtagattgaagccaaggtttacagcatgaaaggatacaaaattagatgggttttcaatattgagtaaattatgtatgctcagaattatatccaattgtaaactaaatataaatataacaattctccatctcattttgtatatttaatgaatactgtgcattattttattaagcagtgtgcaaactagaaaatttcatatgccacaatatcttagtttctctttattgcaattaatttttagccaacttgcagcctctttgttggaaaaagaattatcatctttaaatcataaatagttcttacagcgtgtgaatcatgatcaatagagctttccagtggtgtgtgtagtccatatcctttctcttaattaaccatttagcttgactttttcgctgtatttttctatattcagaaatggttggaaaagcatggcccttttgatgcagttgtggatggtgccaacgttggcctttttagccataagcatatttccttgagtaaggcatgtatattgtgataaatattttcttcttcttgtataacatatatctaaaatactaggcctctatctttttttaactggacagattaatattgttgctgatgttatacggcaaagatttcaatcaagaaagctccctttgatagttgtgcataaccgacatctcactggagagcgcatgcaaaagccttctaatcgtaagttggtggaaaagtggaagctttctaatgctatttatgcaacccctactggctcaaatgatgattggt

SEQ ID NO: 68338 - DNA, 11544 bp, Oryza sativa
ccctttgaccaacacaaagtcaccaacactatatacacttctggtaagtgacctcaatctctaatgaatcattataaatagtaaacagaggcacgcattgctattgtcaagttcccatgcgaattccacaatttggttctcttaatcatgtacacaaaattgttgctcatgtaaaccttatcataatttgcttgccaaattgtttctgcatgaagctctgaagtagatgactatagtttattacatcttctttaccaaagacactgtaacgtttatggcagtcagattcagaaagaaagtttttgtgtgcataagcaatggccagtaaaaagtgaaaaggaaagaaatttagcaaacgaaaagaaggcaataaacagggcatcttccaaagtatataggccaaagtacctatagggtaactggctacacgaggaatggaatacaaaaatgaaaaaagtaatgcataaagaaaataataatctctaatagaaagcaagttatatccacttacctcaccaccagtcgcaagtattgaaccttctccactgaatgacacagctaactgcaaaccagcatcactcaactctgtcagtgcctcctgatcagccctcaaagctatattatcaggtccctctccttcctgtgattcccatcgaaataacctatatagttgttacatggtcagaaatcagaattaagaagtgcaaaataaccaggaaaaattctttacaaaagttgaaccttctctcctaaaaagaagacatccactatcatcgcgtaaaaaggtacatttcggagctaatactaagatataatctagcaattcatctacagtaagcaaataacaaaaatatgacttctgacatgttatgggcgttgcccataacaaacaattcaacaagttaatgacaagacaattaatacttacaaaagcaggaactaaaatctacatgccccaattctagcttcatagtaaagcacggtctgtaagttggataaagaactccacaaacttgtacccagccgtcgttgtccaacctcatcataatattggtttctacaagcctctcagaccacacatatataatcttagtgtttacatttacatgattaaatcttagtaataatggaaaaggtctacagtaccccctctctcctctaattcttcccgaagttaagcttcaaacagttcaacccttaaactggataaaaaaaaacaccctcaattttcaataccaaatagattacacctaccgtaagcacaaaacaaggcttgttttgtgccacgtctactgccacgatggcaccaacacaaagcatgcgcagcagagggacctgcaagctgtaactacatttttctttccctctaccatcttcttcccacattcttcgttccctgaatccctaaccgcattgaagaggtgacatgaagagtgatcccccgtactcacgtggcgttcgttacggagaacctcaaaagttgttcaaaatgtggttgtatgtagacagtacgagttatctgagtcatgaattgaattgacaccttttgaagcattttgaacaattgggctaactagaattcatagccaaccaataccacccccagctggcactggcggcaccatccgcagtagtagcatgaacacaggtagtagatggtacagaaggacaaatttgattcgagaggagagtaacctgcagccattggggaatgcgcagaggacgccgtcgccgcgcgggtggacgcccatcctgtacggcacctgctcctccgtccccatcctcaacacctgcactccccacccccacccccaccaccagcaacgtcagatcagcacgggacgagatcgagatcggcgtggaaatctggcggagatgaagaaaccggatcgctcaccgggtcgggggacagcgccgccgccgcggccgccccagcggaggtgtcgagcgcggccaccaccagcgcgttgggcacgccgctccgcccctccccgccccctcccccgagcgccgccatgagcggcggaggcggaggcggcgtagcgggggactccgacgaggccgcgcccgcgtccgcgtccgcatccccctcctccaccggaggaggcggattgaggatgtgggcgaggggcagccacgaggcgcagtagatcgggaacccgtacgtctgcccgccgccgcgccgcgccatcgccggagttggaggtggtcggcggcgcaagcggatcggatcctctctgactttcgcgtgcggttgggctcttgaatcgaatgcgcaatccaacggcgagcagcgaacaccggtttattccggtttgcagaaaaaaaaccgagaaaatatcagttcggctttcggtttcggccgaagaaaaccgggagcacgccacctccgcacggccagcctccctccgtcgcgtgaatggctagaggctaattttcggttttatcggtgggtcggtttattagtggagttgaaagccgagccataaaccgaacacggaacagaagaaaaaaaaaaaaaggcaaacaacaaccgctggccaaaaaaaatcgaactcagaacaaccgttggctggatacacctggctaccatccaaacacgcccacgtattttcttcgaatttaaactccagtgcagtgtagttagcactagcatgctaagaagattgtgtttcatacaacttgatggtctttgattagatcttttggtgtgtgtatttaaaacagagactgaagatctactacttcatttcactgataaaagaaaagatacagaccgatcgttcacacacacacacacacacacacacacacacacacaagaacaccgccctacaagcacatcaggaactccctaaagctacactaaatactttctggaaaaaacaaaagcaaaattctagcatttttgtgccatcgtgcaagccacctgatccgatcggactgttaagctttgatacatttgctactcattacatgctgatcaactactgaacaacagatcatcctctgactcatcttctgacgatgatggcgaggccgtactgtcacaagtgaaacatgagaaatcagaatgtagctcacaaatcctatcttactataaagttaccccccactaactacttaagcttaacatacaaggatgccacatcatcatccactaacaagatgcatgccatatcatcatctactaacaatcatcacatttaaatatcatgcaaacatgttatatctttatagagcttttcaaagacaaacatgttaaattatcatccaatataattcacataatgtttcagtgtatatctttattatgttttatgatatcatatatacttatatagttcatcatcacttagttaatgtttaaatgattaatttatggtccaaattatctttctctttttttcctcaaattaagtcatatcacatcaattgtttttagcctttagatgattaatctacggtccaaactatctccctacttttcttcttccataaagtcatacctccttactttttacgtttgaatcaccattctacatactatttaaatttaaattatcataagccacattaatttacttaatctgatgttatctagctatcttacacgttatttttttttcgttgttatcatactaaattcccgcagcaatgtgtggggtttcacctagtactacaattttgaaacccagtcgctagaaaaatgaaattatttcgggacagagagagtactaaaataaaaagtagtgtagcgacaagcgagagacgatgaacatacattgcttttcggttctgccacgaccactgcagccacttcagtcgagtttccttcgaatcgaatctcttgaagacggtgcggcgtgttcgtgaccttagtagctctttggcaagatgatactgctccgagttcgcgtcaaccccgtcctcccttaaggtcttcagcatttgaagtctctcatctcgctctctctgaattctgttgattgattgttgaattatgttggatatgcgaccgatgtggtattcgatgaatgatctcttcttcttcttcttcggttcaaggctgtcaaccacttgctccttcgcgtcctgcaattcctgttcattcaggcaagaattttgaaaatacaatcagtagactagactacattttgtgatttggatgaacaaaatttgggttgtgcgtgtctgaatgcaattcgcacgaacctgtgagtaataacaatacttgatccaagttcagcaagactggaaaaaagtagcacatacaagggaacatgaaaagctagttcagtcaactaactacgtaccattctaatcgaaacaaattcatttttaactttaacaggaaaagctactgtctggttgtcttattttccagcaattcaattttttttttcaggtagaaaatacatcggcatggcctccacattccatttcagtgttgtgtatgggcagtttttctttcctcaatgcatagttgaaggaattaaacaaactattgaataatttgatccaatggctgcaagatacttgccgtagtagcgcggtggagacgacgagcaggagtcgaacgcaggctgtagcgcggcggcggtttaggaggcgagcacgacgaggtggaggacgccggcgagctcacccgccggcgtggtgcctggcgcaatctctgacggtggggaggcctcatggccgtcgacctttgtgatgccttaggcgccaacctctgcttgcaatgtaaatctgcagggaaagaaggatttttttttggttggtgattttggggctggattgtttgcagcaaactggagcaatgattcacctgtgcattttgcataatgcatcttatttactagtaatacacaatgtgtggttcatataaacaagttcagctctgccaaactgcggttgtactgaattaatggaaaacaaacttgggctgacacaatggctcaacattaactaagcaaagttgtgcactgtcatacattgatacatacattactgcgtgatgcaacttcaattggcactgaattaaattgtgaaccgatcgaaagaatcaagtggagcagaatcttggatctccagcaatgcacattggaccaacgacagagtacacatgcgtttctgccgaaggacaaaacgcttatcttgcctgaatggggtgttacctcgttccggctgggatgtggtcaccggaccaccggcgctggcgacggagcaacggccggcgcggcgttccgccgtcgagggaaagattgagtgggggattggagccgaggaggcgcctgtagcaatggaatggagtggtggtggcttcttgaataagctttgcccctctctagaagagcaacgttaccctgatacggtagattaccgtcgtatcagtatctgatacgcctccggatacggatacgtgcgggatacgtccggatacgtatcccatacgtatccctcatttttcttatttttagataattaaaataaatatggatactctcccgatacggtgggatacggacctgatacggggtaaccctaaatcgcatcgcacaggaacaaaacacgctctccttctccacccgcgccgcccctcgctctcacaagtcacaactcacgctgcccctctctcctcgcttccccgatccccatctcagcgccgccgcctacgccgtcgctgcgccgcctcgccgccgctagcggcaggcgccgcgctgctgcctacggccggcacagcgccccctcctctgcgctctcctccgcgactcctcctccacaaggtgccgcgccgcccgctccaagcctccaaccggcgcccagcaccgtgttggcttccttcgatcccggcctccgacgacgctgaggatccttaggtaagtgaatatcccctccaagtttgatctgcactgtgcgtagtgttccggttcaatttttcttagtataattgctgtcatctttggtagattcaatggattttagaagtggaagctcgaatgatagtggtagtgctagcaatcctagtggtaatactggttttgatgcatcgagaccatctagtgggagtggttcaacaatgggagggcatgcaaggagcattttgaatgctgctcgtgtgattccacccaatgatgatgaaaagaagcccttgtggaggtatgttgagctgctggaaaagacagggaaaggtcaaggagggaatgcaaggttcagatgcaggttttgtaaccaagttatccatgggagttactcaagagttaaagcacatctcttgaaaattggaacaattggtgtggctacatgcaaaaaggtgacagtagatatacttgggcaacttcaagatgaaatgactagagctgaagcaatctctgcaaggaatttgcctaaggacatcccactaccaacagagagtgtgagtagggggaagagaagggctgtttcagctattgagtcaagcttcaatttagatgctcgtgccaagcttgatgctttgattgcgaggatgttctatacatcaggtcagaatatagcatgttttttttcagttctaacattatcaattttgttttgtttatgacgtgcaactaattatatgtgtgcatttggtttgcaggtattcctttcaatgttgcaagaaatccatatttcaggaaggcttttcagtttgcttgcaacaaccaacttggtggttatacccctccaaatttcaacaaattaagaacaacacttcttgttcaagagaggacaaatgttgagcgcttgctgaatgctctcaagtcaacatggtctactaaaggtgtgagtattgtatctgatggatggtctgatgctcaaaggcgaccaatcttgaattttcttgcagtgacagaagatggaccaatgtttttaaaagcaatcaatactgaaggagaaatcaagaggaaggaatatattgctgagaaaatgtttgccatcattgaagaggttggcccaaataatgtcgtgcaagttattactgataatgcatctaattgtagggctgctggattgatggttgaacaaaagtacagccacattttctggacaccatgtgttgtccatactttgaacttagccttgaagagtatatgtgctgccaaaaactctagtggggatgcttttctagaattccaatggattagtgaagtggctacagatgcatctgccataaagaatttcattatgaatcactcaatgaggctctccatgttcaatgattttagtaagctgaaatttcttgccattgctgatactagatttgcatctactattgtgatgcttaagaggtttcgtgctatcaaagagaacttaatcttgatggtggctagtgaaaaatggaatacctatagggaggacaatcaagttcaagcacaacatgtcaaggagaagattttaaatgatttatggtgggataaagtgaaatatatcattgatttctgtgagcctatctactctatgattcgtgctgctgacactgacaaaccatgcctccatttgatctatgagatgtgggattccatgatagataaggtgaaaaaaatcatctatcgtcatgaagggaaagaactagatgagcaatgttcttttttctttcatgtgaatgagatcttacacttccggtgggcaaaaagtactacccccttgcattgcttagcacattcactaaacccaaagtaatgatgttctacctcttttcaatttttatgtgcataatttataattgttgctagcagctcaataatcttttttacaacatgtaggtactactatgagacttggttggaggaggctccaaaccaccaagcccctcatatggatgaggagatttcagatatgagaaataagtgttttagaagatatttctctggggatgaattgagaaagatcaaacaacaatttgcagatttctcattgtttggcagtgggtttaattcctttgactcaattgaggatagagcccatatgaatgcaaagcaatggtggggaatctatggtaactctgcacctgagcttaaaaagttggcactaaaattacttggacagccaacatcatcttcttgtgccgaaagaaactggagcacttatggtttcatccatagttcaatgagaaacaagtttagttccttctcttacttatttagtttcctgtatgttagtaatgcatgaaattaacacaattgcattttttttagtcttaggcctgcacgtgctgaggatttggtgtttgtgcaccaaaatatgcgtcttctttctaggagatctgaagaatactacagtggcccatcaataatgtgggatgttgcaggagatagatatgagttgtttgatggtggtgctgattttcttcaacaagctgaactgacacttgatgagcctgaccttgagagactactggaagatcttggtgcattggacatacaaggcgataacgggccttcatccacttcggttccaatggatgaaatcaacaatcaatttatctagtcttgcaatctagttattgagttgaatttgaagtcatggacaagttaattaattctaattagtttagcgctgtggtgatgctctactgttgatttatctactatgtgaacaattttatctaccatctatttgaagaacacatgtgttgtgattcctattttttaagtccatatttcacacttagtttttttgtatttttaaattgtatatatgtatatattcgcgtatccccgtatccatgtttttaggaagacggtgtatcccggtatcaccgtatcgcgtatccgtatccgtatcagcgtatcggggtaacgcagtagaagagtcggcggcttcttccagaatccacagacttctcgtctgcaagcagtcatagttcaaatttaaacttcaacaaacttaaattttaaagttcttttggttttttaatcatagttgattttttacgttaactttaataccagttaaatatagaaatataaaaaatttactgcaaacttttttcttcgtttatgggtgtgtttagttgaggaaaaggaaatttttgggtgtcacattaaacgtttgaccggatgtcggaaggggtttttagacacgaatgaaaaaactaatttcagaactcgtctggaaaccgcgagacgaatcttttgagactaattaagccgccattagcacatgtgggttactatagcacttatggctaatcataaactaattaggcttaaaagattcgtcccgcgatttcctccataactgtgcaattagtttttctttttatctatatttaatgctttatacatgtgtccaaagattcgatgtgatgttttttgggaaaaaattttggggaactaaacaggccctatttctcaacgataactctatctcaaacgattggggtatggtgacaaaatttgaagagaaagaaaaaaaataatttaaaaagacacttctaatattcgaaattgtttgtgacttggaatatggccaaaatttgtcagcgttgggagatttattatacaattgattaggtctataaaatgtcccatatctctctcaaaattcaaaatccatccatttgctccatcgttatattatttgacaaaattaaccatctccattcttttacctcccatcaactttcataactactctcaatcttaaaccagaaggacaagaattactctcatcatagtgattactacagttttattgtgccaacccttgtaaaccttcacaaattttttttttagagttgtcactcacacgttcatcaactatcaactagcaagcgcaggatagcccgccacaatcacctaaaaagactagagcccaaaaatactatatttcttcgtcccggaaaacttgtcgttttatggttgagtgaacaaattaactacaagtaaaaattaccatattacccttatttaatcattgcatttgtcacttcagataatcacttctagtagaccatctatcgcattgtacacacatagatagcactagtagtggcacggttgtatagggaaatagtatgccaaataaatcgatggaatagactaggctcagctcgttggtcaagatgctgtcaagatgctagaacgataaattttgtgggacattttttgaatagcggaatgacaggctttccgggacggaggaagtattccacttactaaataccaatatacctaaatctgagaaaaatataaacccatactagtcgaataaaaactacattttaaccctacattttatctgtttatcttactttttcatcacatcaaaactttcctacacacatgaactttcaacttttccgtcacatcgttccaatttcaaccaaacttctattttttgtgtgaactaaacacaccctagttcgaagatagaacacacaagctcatgggtgtgtttggctgcaaactgtggctagtagccattggctgtgcgccgcagccgcatacactgcgtgtagcagcagcagctgtttggaaacttgcagccaaacacaacccatatcatcagtacttgagtcggtctcactgcttataaaaaaacatgcaaatcttccccgacctctcattcaagagttgcctttatgcaataatgttggctgccataatcaattttagttttttttttgtctcctctcttaagagctatcactcatttcatataggttgctttattgtttctgattgcgttttataccacttctcttatactatactcagatatgaaatagggaagatggataaatttgataggtttcgtgatagcgatgtcagtaatttgacgagttttgtgataatgatatatatgtagaatgatgtgttttttttactaagacaattcattagtactccatccaatgtaagtcattctagcattttccacgttcataatgatgataatgaaactatatagatatatatgtctagatttattaacatcaatatgaatatggcaaatgctagaatgacttacattgtgaaccggaggaagtagttgattaattaaatgccaaattcatagtaagccatatgatagaagattgaaaatttgtgaaaaagggaagcaatttcgcctcgtttttggatgcccacaatcttaaccaagaacttcaactcgtgcgcccccaaaaaacccccacctttctcttatcccctctatccgccgctcgccggccatctccctcccccaccaccaccaccaccgccgcctcctctccggcgagatgctgacctgcggccgcttcctctcctcctccgccgccgcctccaccccctccctctcccccttccggaacctaaccctctccctcctccgccgtccccatctccggctcctctcctcctccgccaccgcctcagccgccgccgccgccgtagagccggacaccaagggtaaatatcctgaaccttcaaactcgagggaacacctcgcggtttgacagcgagagccgttctgagctgtgggtgtatgggtggtcgcaggtggcgcgggtggcggcgccggcaaaccgcagtggaaggcggc

SEQ ID NO: 68339 - DNA, 1030 bp, Oryza sativa
gcaatacaagttggatggataagatttaagcttgcgctgtaaaattataatgcaaagctcgtgattcgcaagacttttaaactgttggataagacttttatggagcttgtcattgactcattgctgctgctgctgtttgtagtttctgattctgctcttgcgtgactgcctgcaatagaagttggatgaattaagattaagcttgcactgtgaaattatattgctttagtttgtgatttccaagagttcaataactgttcgagatgattgatagaaaaatttgcaactttcgtgtgaacttagacatgaactggttcttaactggcctattcatatggttaattcattggcatgtgttatgttactttctgactattagtgagttgtgcctattgcaaccttgtaattttgggggtagcaaaatattaggaagaaccaaaaattgaaactagaaactactctttttggccagtagtcatggctattaattggttatttcgttgattatattggatcactgattgattctgctttactgatcttgtgaactcaaaattactcatggcttcatggacttatccttgcctggacgacacttttgtttatggcgtaaatatgatactgtgttactgcgatttaacctattttggcatcaatgtctcattgttctaccgaagacacgtgtgtatctgcttgtgtgtatgcttgcagtgattgaacatagttggttatttaattctggactgagatatggtggcaacaattcctaattatgacagatggcaggaagttgaacggctccgagctgaaagaaatgcagttgctaataagatgaaagggaaattagaaccatctgtgcgtcaagcccttgttgaagaaggtagaatgtttatgaatttattttctaaaaaaaatgaaacagcgataccaacatagtaatttttttttataaaaaaattggattgttgcaggcaagaacctgaaagaagggcttattgccctagaagaggaccttgttcagctgactgat

SEQ ID NO: 68340 - DNA, 609 bp, Oryza sativa
ctgtgcgcgagccgcgcgcacgggaagctcgctcaagcccaaccacgccttaacgtggggctcgcttgcccgcgatgccggccggagcagggctcttcgagacatgggttttgcattttgtagtttataggatggactatttcacgcttatcctacagctctttgagacatgggtttgcattttgtaatttataggatggactattccacgcttatcctacagaattttctcaatacacaagcatgcgggtcctaaccccaaaagcaaagaaaaccagagctaatcatggtctagaattctaatcgatagcaattaggtgtgctttacaagtcagccggccctttgttacaagaacgtgcgatagtccgatttccatagcacagttgtatccgaaaaggtaccggctaccagaagttaaagccgcgagtgtcaacttgacggcccgacggctacgaggctaaaaaatggcgggtcccgacggtttgtccaaagccacgcgccacgcgactttagagctgagacccggtgctaccactggttggcccgtgccgctgaccgagtcgtcacgcggccggcctccctggaccagacaccgacccggagcaaga

SEQ ID NO: 68341 - DNA, 8352 bp, Oryza sativa
tagtacaaggaaaacttgttggtatccgcaatcaacgattgcataaaaaatgagtctattcaacatttgtttatagattgtcattatgcaaagtttatttggagaatggttcagttctcttttggtttatacctccctagaagtatatctcatatgtttgatggttggcttcagggtgtggacaaggaaaagagtaaactgatacttgttggtgcctcggctttatgttgggctctgtggttgtgtggaaatgatagggtttttaacaaatcaccatctgtttcctatatgcaggtgattttcaaggcaacatattggcttagactgtgggctcaactacaaaagtgtgaggaagatggagaattcatgtctgttgcatgtcgtaaccttgagtcaacggttatgcaactttttaccaaccatggatggagattcaccaatagactggaataatgtttttcttgtcatgttaggacttcttttatttttggttggtgtgcttgtttaattttggactacgcctttttagtgtgctacttcttataataattggttgtagctctcatgagcaaaggccgggatgtttcattccattatctaaaaaaaatccgcaatcaacgaagatgcataattgtaactaaatataacttagattaattataccttataggagatcacacctttgaagcaaccagcaaacagagaagcagcaacgaaactcagcaaagctatgacccaatccacaagcaaaacaacttgggactaggaaagaaaccctaatctttaacttcactttacttctgtcaatctcaaggataaagcatacatccatacatcagtgatccctgtaaatttgatacagcaagattgcatactctacaagaaaaattcccttatgatctcttctgtttcttttcgtaatatatcatgattaacaggagtgtacctattttgatcagttctctctacaagctgcaccagttccactcttcagatcttgcatgtttcagtgccaatagaatcatcatctcaatctgtccttgcaggaatgataacacatcggactcatcaggcgatctgaactgagttattaatgaattattactactcagtcaccttgtattggtgcactgacaatgtataactgaatatccactataagtttagttaactgttctgcatattacatatcagtttggcagatccatagtgataactgaaaggatcacttggaactaggactactcctaacaaagctagtaatatttctattcgtagtgctaggatgtgtcgcatcccgtactatgtttattattatttttgggacggagggagtataagttattacacggacagtacaggactgcagggaagtgccaagttctcaagttttgttgaaatcgcacgagttgtggaggatcctactgatacagcttggaagttccttgcaattgcagatgttccaagagaaacttaaaaaaagaccaacaaaacaaaaaatcttatgagctggatgagaaacaagatggtcaacgaggaaagctcatagatgaccagaattcctcctccatactgagccgcctgcttgagttgtgataaccagcgtcaccaacagcaacgatgttggaatcgctctcttcagtcaatggagaattcaactgaactgcacgtcgacctctgatagtgtttacagcaccctgcaacccttcaagtttcacctcaacctgccgcattgtcggcctgtcttcaccctttaagtttaagcacataacagcaatttctgccacttctctggcttcttcttctccctgctccttagtgatttgactgtctactatttccaagagcctgtcctcactaactagcaagataaattgttcggttagattgaagccttctggtgatatgtaggaagttggccttcttcgtgttattagctccgcaagtatgacaccaaagctgtatacatcacttttctccgtaagtcggcttttacggtagtactctggatctaagtatccaaaagttccctggatagtagtagttacaatattttgatcaattgggatacctcgagaagctccgaagtcggatacttttgctatgaacctatcatcaagtagaatgttggtggtcttgatatctctgtggatgattgataccgaagcagctgaatgtagataagcaagagacctagctatttcaagtgctatcctcagccgttccttccatgggactgattgtgcagagttgacatgaagatattcatgaagtgttccatttggaatgaactcatagactaacaatggaacttctgtctcaagacaacatccaaaaagcttcactacattcctgtgatttacttgggaaagtatggcaacctcgttaataaatccatcaatttctctcttaatagcatatcttgacttcttgatagcaacaacacgttggtcagacaaaatccctttatagacggttccatggccaccaccaccaagctttcgagactcgtcaaaattgtttgtcgccttctcaagctcttctaagctgaagatcatcctttcagcgatatccttgtctacaagttgatgaagcaacaatcctcggttttgcttgaagaagaattccttcagttttttggcccttcgagacttgaactttcgccttacgacaattccagtaagaattagtaccacgatgattagactgccaccaagtcctattccaatgatgagtcctggatttgtaagaaaatgtaaattttaaatcgtttactccgttaaattgatctcaacaagaaacatagtaatgaacagtaccctcagacattgactgaactttctttctgttacctgaaaatttaagtttgcttgaaacacatccattttgtatatgggcgttaccagatgtgccacctggacagatacactcatatgatcctactgtatttatgcatttcccaaagcataggggtggatttggcagcatgcattcattaatatctgtgaaaaaggaaataaaaattaaattgtgcaaagtgatcacgcaataaggttaaatgtatctgagctgcattttactgtttaatctgggtatgtgcccttgcatgcttctaagttataacctctcaagtgtcgatcgaatagttctgaaaatttcttaactccaaaactgatacacgtatagagaaacaaaaggaacaaattaaacctatgaaaagtagaggcactatttatagccagttctgttgttacaacttgtagaaaacttgtagtcttgcacgcttgtggagtgatatgagacaataatctacgctctcaaatttttttataactctttaagtgacatcaaaaccatgagtgcacatactgacatatctgcagagagtatcataccttggcatccatttggcatgtaagggttaccatcatatcctgagcggcacttgcacgcatagcctctccctgcagggccatcaaaacactcactgttgtcactgagacacccaaaatcactcaacttcttagcttccacgcacgatgagttacccagcatccagttaaccacagtccggacacccacattccttgcagcatccggcgccccagcgatggcacccagccttgacaggacctcttgctgcagcagcatggcattgtctgccctcctccaccactcccccttcaccaccaccatgctcgcgttgaacggcaccgcccttggactagactgcagggagagaagcttgatcgtgtaggagttgtggtcttcaaccaccgatgcgttgcagcagccaatgccatagcatgtgccatccgttgccagtatggggtaacctgggcggcaattcgaaacgcagttgctgctgctagtagcattgtctcctgctgctgcaggagaactacctatgaagaagtggaaaccacaacccagggtgatgaaaacattcatgtctgccgatacccggaagagtttgtcatccaagtcgaggatccatttctggttgtagctgtctccccccaacatttgggtgatgccggtatcaaggtgcagaactctacgtgccagctttatcttgtgaacttcatatccagggccgttcatgaagagcttggggggatcataagctgggtcgcacactagtttgaagccctcgcggaagcaccgttcgtcgccaataccgaatgggtaaggtatggttgtgtttccgcatgtgtcagtgcaaccaggcaatgctatgttatatgaaagtatcaggggtattgctgctagaaactgcagcaagtgcagtgtggctatggcaaaaacatgcattttactgacatgaataggtgccctgatcagtgtggcttggtggtttggacttaggacacagttcatgtcacatatataggccttgacaaagcatttgcaggaactggtcttttgctaccttggaaaatttcttcaccggttatatattacactataaagatgttatcagattgcaccgataattgttgcgtatcaaatcagggtggttatatgtcactttatcaaccttaaaggacaggacggcaggtttaaaaagagtcaatctaggacatgaaaggaaccacaatacattggaaatttcatttcttttgagttttgcagtttggagctccccaaaaaacaaacctgaagaaagctcagacatatttatctacttctgtatccaaccacagaaggcaagactatgtccagtcaaactgctgacctcattagattgcagaaaattagattaattacattgaagtgttgaacatacgttaaaatggaaaatgaacggcagtgacaaggacggtccggccggcaggccaaacatgattaggaaacttgaaaacaatttccacccgttcaaacttcagatacgcatcaccattatgaactattttttgaacacaacatcgccatgatgaacttttgtttaccacaacatcaccattgtgaactagatttatagggtttgattctcaaacagacaaattttgcaacaaaaaaaaaaggagggagaagaagatgtcaaaatgtcatggcgtgaacagatcgaacggttaaatttaacaggtattgcacttcgtaggtatgtataatgcagaatcacctaggaattttacattagtaagattttacccaactatgccacagtggtactactaaaacctaacctaaatgcaacaatcacttagagcatgtacaatagcagactataaaccagctgcaaccatatacttcctccatcctaaaatgtttgacgccgttgacttttttaaaaatatttgaccgttcgtcttattcaaaaaatttaagtaattattaattctttttttatcatttgatttattgttaaatatacttttatgtatacatatagttttacacattttacaaaagtttttgaataagataaatggtcaaacatgtttaaaaaagtcaacggcgtggagggagtatatttttaggagataaatgaagaccaggaacggaaccgcggcgcggcggcgtgcatgggcggctccgatggaaccggtggccgctccggccgcgggctccggctcagccccacctgctacgcggaaacggaaacagcggcggcggggggagccatgagccatcgaggggaacgacgctcacaggggcgctgtcgcggttgcggacgttgaagcgagcggcggcggcgtagattccgtcggcgggggaatcgaatcgggcggaggtgccatgccgagcgccggctggttgtgcgccgacggcgtcacgatcggatcggcgcctccgccaacttcggtgtgactccgcgctctccatcgattttaaccaaggtttcgtaatcatccccccttgtatttaccatagcatgagcaatttgagcagccatcgactttgtgaactacctttgcatctagatttatttactcttccaactgaaacacaagtcaagattcctactcatagtcatcgaaagcatgcaaaagattaaatctacttttatagttttatttatttataatgtaacgaccacgtggttgaatgatgcaaatgccccttaatttttatcttgctactagctgttgttaattcttattttgaattggagtcctgtcgctttctctgaaaaatggggagtgctgtgctgtcctatttgggttgttagctgcagggaaaggaaggttgttcaacttaatcaaatcgtgttgatagtgcccgaattcctcgtagtttcatttggtaggttggatgcataagggtagagtagtggttaattagcttggggaatggagactacaagaagctcaagtgccatctgcctagtcagtggagattgagagagcatcagttcaacatatggagaggttcgcaagtatgagagttgtgttttcgctatctgtacttgcagttctgctgctacagctgctgttgggtgtagcaacggcggcagcagctaattgcagcacccactgtggcaacatcggaatctcctatccatttggagtagagcctggctgctaccacgagggcttcaacctcacctgcgatcgctcgcacaagccgcccaagctgttccttggtgatggctccgttgaagtgctcgagatctcgattcctagtggcacggtgcgcatcaacagcagcagtatcgttccagtatcaacatcaagtgctgttggaactggcagtgtcaacaagacagggaaataccacacatggggtggactgagaaagggcggcccgttcttcatctcgccgtacaagaacaagttcctggttctatcatgcagcaatgttcaagttcttcttcttggaggcgataattccactgtcaatgcctgtgctacttactgccctccagcccccaagaaaggccaaccttttcagttcccaatgcgcaacgagtgttctggtattggctgctgcagtgcggccatccccaaaggctacacatcctatagcatccagatccaacctgccaatgaaatttcagagtttgatgcagagtcctctgtgtacatagctgaggaggggtcctataatgccacacgccttatctttgaaactgtcagtgcactcccagctttgctggactgggctattagcaattcgacatgtggtacgaagccatctgcagcccctgcacctgcatgccgcagcagtaacagctattgtcaaaactatacaagctatgtctacaatggctatcagtgtcgctgcaatgctggttatcaaggcaacccttacattccaaacggatgccaaggtaaacaagtcaattcaacctgcttttattttctttaagtcatacaaagttaaaatggaaatcagttgaaaacagctcggtgcttcgataagtatacatctatgtggctattttcccagtctaattacatgcttcttcattatttggttagacattgacgaatgttcacactggaaactccactcatgctatggtacctgcgtaaatatgcccggaacatttcattgccgctgtcctgatgggacttacggcaatcccttgatggaagggggatgcatcaagataaagaattcctctcaaggtgacaatcactccctaattaccttgtactcatgccatcaactctatatgtagattttttttagtaatgagactggtggtaatggcatctacatagctggcagttggtatccagtaattgatatttttttgaaaggaatgttcagtagtttttattaattctctgccaattaaacatgtctgttgctctgttctatcttcattacctgagtgcaaataattgcgcattccagttgtttttcgtttgtttctctgaagaactgttttattcattttacatgagctcttcaattatttgtttcacattctgctcttacacgtcgcagcacacactactatttttttaaataaaaataatagcctttgtatttagaagcagattgttctgcactttttcagtaaccatttgtttatgatcaccactaaaatgtgggaagctacatgattatgtgagcttgagtggttacttttaaaggaaaaacatagttgttcactttgaacaaataatacggcactgtggtgatatgttgaataaactaaaagtagactatgtgatttgttatgtaattttgttgtgttagttctgtacctaaaaaatcatgatgtgttgcatcaacagatcaactaaagtagactgtgattcaccgtatgcgcattgcaactaattttgttgtgtcaggtttgtacccgaaaaagcatgatattaatatttacaaggtttctaccactatttattatgttctttcttactatcctgcataggatctttactggaa

SEQ ID NO: 68342 - DNA, 756 bp, Oryza sativa
tcctgcagccctgcgagatgaaagcatgtatcagcataagaaagattttcggacaaaggggaaataaatttatggccatgataacaaagataaagagcagttgacactaagttaaagagagcatggtgagagtcataattatcgagagtttccaatacaccaataagcacgtatccagagctaagtgaaattttctgacctccatacagtaggatatttaggaaaataaaccatgcagtgagaggtattcgatattattcccattctttctagtcaaatatcctatgaaaaccaaaacttgaataggtctcgaaactaatagtttcatggaatttaatcttaacttctaaaggaacttcacaccgaggttttaagccatgagggaagtacctggactcctctgtggagaggtgactccaatatctcctatcatctatgcctgtgattgccatagcctttgaggaaatggatatgcaaagaccacccttgttcttctccatccaaaattcctacacacaaatatatttttcaattagatcattgaaacacgacatacaagaaaagcaagaacaagcatcatccaacatagacaagcaaggcaaaccaaatacacatgaaaaaaaattcctcaacttccatatgattatttcatattttactactagtgctccgatctatcctactagcgctccgatatatcaaataagatgtttgagattctcaacaatcaagtcatcctaattctaatatcaccat

SEQ ID NO: 68343 - DNA, 8163 bp, Oryza sativa
ttgaataagacgaacggtcaaacatgtgctaaaaagtcaacggtgtcaaacatttcgaaacggagggagtatctttttagatttctctaccatcggatccatgccaagattattggtggatgggtcctcctctggctcgagcgagctcctcgtcttctctgttaccagtgatactccaactatgacagagtacatacatttctaggtgtagggttagtatcctaaatttcctgatttttgtatttgatcaagtattgggagtattatttgatgtgatagttgaatttaaatttgatgttctaaaatcatgtggatgttaggaattttagtaatcgcaatattgttggaattatagctttcgagaatattttgcaaagaatagaaagaagagtgagaattaggaggatttataagggatatgaactttggggggggggtagggggtttcaaattcaatattttaatccttcattattccatggattcgaggaaaggatttttagtgaggttttggattttaaatgagtttgaataatttagaaatgagaggaagaaacaagggatttcaaaggagtttgtgttgattgggatttcgaaatgagaatggaccttaaatttctagtaactcagggcatggactttagaatgggacattggggacagggtttgaatcttggattaatttggttaattttagaaggagtgggatcaagggaattttatggattttgaaatgtatttttagtagatttaaagaaaggagtatcatgacagggaaatagaaggatttcaaggaatttttggaatgactggatgtttggaattatttgaataaaaatttgggggaaaagataagaaggagaggacttcaaggatatttgaattcaatttaatattggaaaaccttgataatctaatagggttcaaaggagtatttcgttatttcagaaatttttcaatatataggatatttgaattcaactttgaggttttattaaaaaatcaaatatcgtatttttttaatttatttaagagagtacgtatgatcagtaaatccataaagaatgctgacaaagaccgctttcaactcttctcttggtcgttacgaaacctaactactccatccgtttcaaaatgtttgacaccgttgactttttagtacgtgtttgatcattcgccttattcaaaaaatttaagttcatatcatttgatttattgttaaatatactttcatttacacatatagttttacatatttcaatatttcataaatttttttaataagacgaacggtcaaacatgtgctaaaaagtcaatggtgtcaaaaattttaaaatggtgggagtaataaactacatataagaccctcgagcgagcatatctgagtattgacggatcgattggtttcaagccggccgtacgtacaattagaaatcacgacctgcggcaaagtcgtcgacgtcggtgccagttgacctgtatatcgaactatcaatatcccttcattttgacgtgtggtttcgatactactactccgtgtgctgtcgtttacctacgtaacctagacgtatacgacctccatttgtcccataggccataaaggaaaagaaagtccgcaaggaatggtaatcatgtcgtggtattctcggaattaacttgcagtccagcgaccaagaaactattaaatatagttttcatacttatcatatcgtatatatcgtatagaactacgtataaaaactatatattcaattgatggtgtattcaaattaaattcttatcaaatcacctcttctctttttattcacatatcccctagtttttattcttagttattgtgtagagatggtttcttacgttagaaatgatttcttctttttaccgctctttattattaactctatcgtcacatcatatttttgctttgtgacaatatattaaatgatgtgtacactagataatatggagagttaagcatgaccttggttctcttacgttgttgatatgtgggcctgttggaaagagtgcccacgtatcagtgacccacgtcatatatatacaaaataaagttgtgtaccacaatcccagtccaactctatgcccagacggtagagcagtcattggtcactgcatatgtagcagttagccgacggcctgacgtggtttgcacaagcgtcatcacgttggaattaatgcatactccctccgtcttaaaataggcaaaatttgctaaggacatccaaaaatcgtgtaattagccagtgggtaccgtaagatcacgaattcgctgcagggcagcaaaaaaaaagagtaattagctggtggacactcgagccattattttattatttccgaaggaaaagaggtgagagaatttttaaaatgccaagaattcccccggtgacgcaacaccttatcccgactgggtccggtcgaaccagacctaatcggtcttgtcgcctcaccacatagccgaaccacagccctagccggtgactaaggtggccgcggcggcgaccaagatctgcgacggcgagggcggcggcgatgaagctgtgagctgggcacggcgttgcactacacagcccaaccacaaccctagccggcgactgaggcggcggcggcggtgacccagatctgcgacaagcgacggtgagggcggcggcaacccagaccggcgagcagaggcagtggcttccgtggctgcagcggtcgagcggtgcagaaagatggatggctcggcttcatcctcggtggttcgtcgccgcaatggtgagttacccttatggaagtgcccaaggtgtgtgacacagctagaggcgcgaacatcgaggacaccaaagaatccaaacaagaactttgtgaagtgtccttaccttgaagatgtgagtatatgattttacggaacttttggtttacttctgtaggttgttgtcgagtgagttaattcaatgaaatttgcctttgtagacaccgtatgcgtgcagatttttcatgtgggaatctcagtatgagcagtatttggcggatggtcgcgtaggagtgggacatcagtcagggcgagaaagtcatgttgaagcaatggcatctatggggtttggggtctcagaattgaagggatgcaatgcagtgggacagattttagtgtacattagagttttgcaagctttattgctactattgatattggtaattgtcattagcaagtaagcaatcaagtaatgagtagttgataggttgtagtgatctgtgaaggcatgtcatttcttaatgtaatatggatatctgaatggaatttaattttctgaatggaatgcaaatttatgagttgaatgcaaatgtgtcttccagtgagaaaatttggcagcaaatctatacattggaatgaaatgtgtgttgtaatgacaaattttggcagcaaatctgttgaaaatgttgtcccaaattgtagctgtacaataattagtgagaaaatttggtagcaactatgtacaattcctgaaggcatgccattcctaaaagttaaagagccacacaacatcaaaatttggcaattacaggcaacaactttactgaatatgattcaacagccacacaacagcatttgattcaactttcatcagtgattacacaatccagcacacttataagccaatatggtcttaaacaaaaggcagacataacatggtcttgggtgaccttacacaaaaggcaaacattcaggaaacataacattgtcttaaacaaaagccaggttttgctacctctaaaacagttaagttatttggcattcttgcctctagtggtctggctcctagtgctaggactagcaacttccatgcttagtgatctagccttgctccttgtgattgggctactttcggtgacctctgatgtttctggaacatccaaatccagtgaccttgccatgctcctagtgtttgggcagctttgggtgacctctcctgtatctgcagcatgcatgttcaatgcctttgcactactccttgtgatagggctgctttggttgacctctgatgcttgggtacccatgcaaaaaaaaaagcagaattgttaatttacaaattgagcaaacttaagacaacacaatttttttcagaacatgaaaacacttacaaagctgctccaaattggtccgtggtaggatttgtaatagggttaaccacaactttctttactctcttcctcttaggctttggggaagctggtggtggggcactagaatcgtcaactggttcattacatgttttcatgatgtgaccaaattgaccacatctcttgcatctatgcttccttttccctgaacacccttcttcaactcctttgagcctcctgcttcttggtctgccagcagaccttttcaatatgggaggatataacttgaagccaacattcaccttttgccattgtgagttatctgtcattgggacaacaaaacctgcataagcacgcttgaaagtagccacagagtaatagtcactgacaaacttttccaattccaaacccctccttgaaatgataaggaaaattgcatgggtgctaggaattccagtcaattgccactttttgcagttgcattcttgggcaatcaggtcaagagtgtgcctccaagtctttaaatctctgcatgtacctccaatttctcctgtatggctgtgagcagagtacagcttgtaccctaggttcttgctcttagcatatatggctttcatgacactagggagaatctgtccagttaacttatcagctagccttttcctcacacttaacctctccatgatcatttgtctaatcttatccatcaaatcaacaacaggaagtgatttctcatgccttatccaactattgaaagtctctgctatattgtttgtgacatagtcacacttgctagcagtagagaattcacttctagcccacaggtgtttgtggaagtcttcaatccactcaactggtttagggcatgcttccatcatctcattgtagtgaagctcaaaaatatcgtgtctatatgccctagatgctagccacaggttcctttcaaatacttcaccactaaatctcttctgaaaattcttcaccaaatgtctcatgcattctctatgctctactccatttgtgaatactctactcactactgtatcaatcccttttcctgcatctgtggatatgaccaacccaataggtgacccaatagccaaatgcagcttctccatgaaccatgcccagttatctgtagtttctgaatcaaacaccccatacacaactggaaacatccagtagtgaccatcaatgccaattgcagatgctagttgacccctccacttgcctgtgagtacagtggagtctacacctaagtatggtctgcatccatttaagaacccatctacacatggtttcagtgccacaaacatcctgctaaatctgttcaccccatcaatgttgacatgttacacctcaacaattgaactagggcttttcctctccaattcagccttaaaattgtaagctgcagcaaaactatcttcccatttgcctagaatttcatcaagtgccatctgtctgccatcccaagccacaaagtaagatatcttgatcttatatttctcttctagtgtacccttcagagcagaaactccaattgtaggatctttccttagcttgttgatcacacggtctctaacccaagaatttttgtgtccatacagttgttctccaatccagctgtgctagcacaattgtgttggtatggaagcttctttatctgcaaatattaattgaaaagatcattttatttaacagattatgaccaaaatcaccatgcatttaaataatgtaaataacttacctgccatgttctgccatcctgtaatcgtgacgcatgaattctccacttgcacctcttagccttgcaatatgctctgtacctcctcgagtcacaatagggaactgcaagttcgacctcattcaataatgcatattatctaatgcatcttttaaaacattgaccatcttcaaaagttacatcaacatctatgttaagatcttccacatcggttatatgagctacagactcacattcctcctcatcgtcgacagctaagtcatcatcgtcttcgtcagaatcaggctcataatctggatcaacctcctcatcatctgacaccaaatctttatacttctccttctcatcagctacaccaacatactcaacctcatcattctcaccccaagtgtcaactagttttggtttcggtttcggagtgctacacttagtagaaggctgagatggttatggtgattgactttgttgtgtaaacaacactatgtcagtacacacattacccggtgcctcaatcgtgccctgctctacacaaggctctgtcctattctgtgggtcatcactcacctcaacaaccaaagggagcctcctttgctcccagtacaaatcacaagcatgaagtaaagcactgtcagatgctatctgagcaaatctaccagcatttatgtccaaaaattttacacttaattcctgagcaggaccatgtttaacctcaacatcaagatcactcatgagatcaatccaacatatcgtatctttgtctaacacccagttaattttcttagtgacatgaaattctggcctaccgttgtcagtaaactcgacaaatggaccaagctcaacagcaactctgcaagctgagctgccatccatcctatgggaacgcaacaagaacagagaggaagcaaataaaacaaatgcaaacgacatcttcaaccataaactcattccagtaagtcaggacccataaaattagaggaatagaaaagcttacccttcggggacctatgacacatctgtcagcaatggggatccggtggtcctcacacggagcggcttcttcaccgccaacttcttctgaggcgacatcaccttagtgtggtgcgacgccgtgcctagctcatagcttcatcgccgctgccctcgccgttgcagatctgggtcgccgccaccgccgcctcagtcgccagctagggttgtggttcggctgtgtggtgaggcgacgagaccgactgggtctggttcgaccggacccagtcaggataagatgttgcaccaccgggggcattctcggcattttgaaaattctctcacttcttttccttcggaaataataaaataatggcccgagtgtccaccagctaattaccgctttttttggtgccctgcagcgaatttaatgatcttacagtgcccactggctaattacacgatttttggataccctgtagcaaattttgccctcaaaataactcaacctatgttgggattgtccagattcgttgttctaggatggatcaaatctcatccttggttaagttattttgggatggagaaagcatgccggtggtcaggtcatcggttatactagtatcacatagcacacacctgcaagccagctaatttctccgaaggtagagatgcaaataaacgcaacacgtacaagtaatccctttttgagataatgacatgaaagcgattaatctactgctacgtgttcgtctaggtttcctggccggcagatggaatcaccttaaacaacttcaggtggcactataagtcaacgagaccggccgtgtgttggcggttctgaaattgctcaccggttgctgggttagtcaggtcatcacttatctgatactgataattctactgagaaagatttaattccccaaaaatttttccctaaaacatcacatcgaatctttggacatatgcatgaagcattaaatatagataaaaagaaaaactaattgcacagttatggagaaatcgcgagacgaatcttttaagcctaattagtccgtgattagccataagtgctacagtaacccacatgtgctaattatggtttaattagtcacaaaagattcgtaatgcggtttccaggcgagttctgaaattagttttttcattcgtgtccaaaatccccttccgatatccggtcaaacgtccgatgtgatacccaaaaatttccttttttccacctaaacacaccttgtacaacgactctacctgcagcctttctgtcgaaggaatggcgacactatcctgatcgaccgggaatatcccctactatggcg

SEQ ID NO: 68344 - DNA, 6558 bp, Oryza sativa
agggttatatataacttgccattgctgcagtttctactttggtgaggttaccggattagcatccaacattcatcatttacagttcagcagctccactagagttccagaccaccaggaaagcaaatcttgtacagctggagcagcacactcattaacccagttgaccaagatcagctcaaatgataggatagggactactccacaaccactcagaacaacagaccaaagatagcttgatccagttaaaccatacacatctaacaaaatcacgagcaagacaacaaaacaaatcgccgctcgtattacgtcaacccgtacacacagcaatcgatcagtaaagtaaaaaaatcagcagagattcgacgaccgccacaccagaaaaatcagatatttcagttgttgtatacaggtggttaattctctgataaatttttcgcaggaaggtgggtgggggtgaaacgattagcaggaggcctcaccggtgagcacgatggccttgacgtcgtcgcgatccatcgcctccgcgtacttctccttcaatccctggatgactgcagggagcagcaaaaacccccaatcggagcacacggaatcagaaacaaaacgagtaaaccaaaaaaaaaaagaagaagaaatcgaaattaagaaacgaggaggcctactgatgggatgcagcgcattgacgggcgggttgcagatggtgacgaccgcgacgccgtcggcgcccacctccatggtgacgcggatcgcccccgccatggatgacctagggttcttcgttcgttcgatctcgagagagagagggagagggggagaagaggagatggatggaaggtggaggaagtaatctctcggagtcgggagggggagcgtggggaggcaggagttggggtatttatccgggaggctctgaaagaggaagacgaaataggctagttagtagtagtagaagcggctgattgggaagaagttgatgtctctgagaggaagagtccaaatacccagtagcaactactaggaccacgtgttatgtattttaagccctaatcttttattattattcacgtcatcaatgatgtttatcacgattttcactactaatattgtactcataataattaggggtagtgaccaactatcgtaccaataaaaccgagccttatcatttattatgcaggtataatatgtacttatatcttataatattttgtcatcttttttattcgaatgtttttgttgaagtgtcatgatgaaacaagtccctaatgtaaaaaaacatagaaaataatgtagatcattttaacatattgttatcctatattactataaaattgatgttaactaaatctcaccatgtaaatgtgtcatatcatcactcactacaaattatgtaaatatcaatatgttaatatcatgccaatataacttttttttatttttagaactcaatatacaaacaatgtaaatcattatctccacattgtttaaatatatgtatctatcatttctataatttataacgttcgttcatctacatatcccatagtaaaagcacgggatatcaactggggtgatgaagtgttttgttgtactcccttgatcccttcaatcttttctatgacgttggttagctcaaacgagcaatatataaggaaatgaaggcgtattttgtttatttagttgatcgtgaagactgttagctaaaaacggtatttaatcaagccaatccgacctagctaatcacccgaataatgcatgtgactctccctatccaaccaaaatggcctttaaccatcggagaaacatttaggaagattaaaaaaatgaccctattgccaactctcctcatatgcttagcgtatgcaatgacgcaagacgcgcgtaattagacaccacccttcaattctcactatttaaccaggtacagcaaagaaaaaactttttaactccagcatcacagtacccattttttttctcctcgatttaacacaatatatgcatagtactgttccggaaaagacgacttttgctccatacggcaataattcaacggaattgtggaaaaaatacagagaatttcttttttaaaaaaagaaaaaaaaatactagcaggtacttcctccgttctataaaaaaacaaagtaagtattggatgcgacacatcataatactattaatttggatctatctctgttcagatttattgtactagaatatataacatttattctatattcgtttttcgtgggacagagacactatgtgcggtcagacagtcagactaccacgcaagcaaaagcaagtaacaaaaacgataagatgagatgagaagcgagagctcccgtgttttgtttcgtccggaaactcgaacgagccgtcacaggcacgcttcctccaatgcgatctcttctactactacgacctatcccccgccgtccaaagtggatcggacggcccatgttcgacgcaggccgagccaaatacgtaccacgcggtggtgttgcgtacggggcaccgctatatatgtctcctcgtatacgtcgtggcggtagcggtgcagccctggccgtcggatcggagcccccggacggccgcgattttatcgacataggtacataaatgaacatgaaatatcttggttgtcggatgagtatatttgattaggagtgtgacgtggactggttgtgttgctgaaccgtcggaagtctcaatccacgaagatgacatttttcgtgtctttctgacagcaaccttgaggggatcacttgtacaaattttcttccaaaaaattataattatagtataatcatgatataattatattgtacgtaacttttaaaaatctctccgtaaaacgctatttccgtgaaaacgaatcctctcacatgtgtgcgcgttgtgacttttttctttcttcacttgcaaaaaattttgaaacaaatataatatttcaaaattatgtgaaagttacgtacaagttacatataagttatagtgtaattatatcacgattgtattgtaattatatatgtcaaatttttaagagaaaatttatcgctatatatatagcaaaattgtatgttaatcatgtctacaattaccgaattaaaaacagccaggctagtcctataagatacacaaacaaatcgctttccagtcatataatcagtcaggaatacaatatgctcaacccgacaagccaattaagcgatccaactcctaccgtaccctacataaggggggtgtttagatgagaggcgtaaagttttagtgtgtcacatcgaatattatatagggtatcgtatgaggtattttttataatggattaaaccggcctctacacccaaaaaaggatgtatttgggcactaataaaaaaactaattacataatctgtcggtaatccgcgagacgaatttattaagcttaattaattcgtcattagcaaatatttactgtagcaacatattgtcaaatcattgagcaattaggcttaaaagattcgtctagcaaattagtcgcaatatgtataattagtttttttttgtctatatttaatactttatgcaaatattaaacgttcgatgtgacaggataaaaaattttaaggtggaatctaaatagggcggaaaatggttcgacttcggggttcagacctgtccatgaactgcctgagtgacagactcacagatgttgaacacaacaggaacttctgacaagatgttaatttctcgtcacaccctaatttgtgtgcttgactacaaatctacaataaagactgttttttttctaatctaaagactgcacgtttttgtgacaaacatgctgggtccaaaaaaaaaaaagaagattagaaaagaacatcatagcaacttccttcaaaaaaggacgagacgagaccaacaagcaagtcgagtcttcgtcaagtctgaggaattcatatgggaagttgtcataaaaccccagagaagttgtcatgaaaccccggcgaaaccacgcactccgcccacatgtgtgctttcagatcatcacatggcgcacgccatggtccaggcagtcatgttgagggctttcagattccaaaagttttcagactccatctgagaaattcagtgtgaaatccgtccactgactagcatatttccaacatttgagttattttaactttaccaagggaaaacagccgtccaaaagggtcaatttgcgattcaacattccaaaaagcattccaatttcaacacctgcaataatacggtccatttggatgtaccacagcactgaactcacatttccagtagctgtgtccagtgcatctgagcttcctctcggtgaggtcaagccatgatttactacgggtaatgtgaacgaaataaacatgcacggcaggaattcttgtagagttttacagatcaacagatagggtagtgctaacaagttaaacaattattgttggaacatatcattgtttgcatcatatccagcgcgttgccttcgagcaatcaggtttttctcaaactccttcaggtaatctaggagcaacacacaagtgaagagaaggaatccaccgaagtagttgctgccacctccaccacctccgccgccaccaccacctttgccgaaacggaatggaggaaaaccaccgctcccatcatccaattttggcccctgagtttttcctgaaagtcacaggacagaaagtgaaattaagcgattgcgttcctgccacctatagaataaaattcaattagaggcagatctacctttggggtcagatcgtttgacggttgcagttgaagatttccgctgagcactttgggtctgagtggcattgcatcttacgctctgttgtcaatagcgttcgcacaaaaaagcagtcaatgagaagatctgacagtgaagtatgcagataagcaagctagcattttccctttcatcagttttgaagttcagtaactggaggtaaagcatcatgaataattcagaacatatattaatcattgagattgaccatgtaccagggataatattgcttcttttagtactactattaagaaaaaactgcatctataccaccagagtttcagtgatcccaataaataacatcagaacattacatcccctgtcatgctttgttcctatttcggttttgaccccttttttttaccacgcagaatgactgcaatacccactgcttgctgtcttcatcatggaggtgacactacttggcttggctgctcaatctaccgtgctaagagggaagcaagaaaccaggaaaagcatgttcttatgatcttgatctcattaggctccacctaggacctgtgtcaacatctgaggccacctggcagtgcagtcctcagcctggttgtatgcatccacagccaatgctctcagcccagccacactgctcacactgaccctcatggtgaggccgctcagaggtgggggtctcggccaggctgcagacgctctgatgccttgaccgcccacgtctctttgctccattaacttgttgcccacctccagcgacactaatgatgccgccggccactactactggctgctggagagatgtgagatttggtagtgcaacaatttaatattcacgtaaggacaaaatcaataaatcacccttatctaacaccgttgccttcaaatgtaacagaagaggtatttcgaatttttagaccaacttgctggtatatattagaggtgaaatactgaaatgttttgttgataccatcaaaattgtagtggtactgatgcagttttatctactaattaacaattcaaagcaccttatctttaaatgtatgcagcatgcacatgccatggcccatgagatatgcacctattgagcactacgattagtactagctaggaagggtataaccaataaaccaatcaagtatggtaaaatccttatctactgtattttgaactaaaccattttaacatgaatatttcatagttcatactcctcagtcccaaaatatagcaactaggacagaattggacatatcctagtactacgaatttggacaggggtgtccaatctggtcctaagttgtcatattttgggtcggagggagtaacagtaactcctaattcaatttttctatagaatctatatataatcatatataataaaaagagggtgatacatgccaatttggttattgatcaaatgccttattgtcatgaactcacaataagctaaccaaacagaaaatagtaaatttgtttgcaggaattgaacacttaattttgtttataggaagattgaggtagatatgaatctatgatatattccaacttactcttaatactgctttagcagacacttcccttttaaatgagatgcagctagcttgagatgtctgaaattgtgaacctgcccagagaaggtataatgaaaaattagtacataatgaaacattgtttggcaaaagaggatcaacaagatcacaaggtgcctgatcaggagactaagggcctgtttggtacagctccaactcctaaatattactccaggagttgagtctagagtggagttgggg

SEQ ID NO: 68345 - DNA, 9853 bp, Oryza sativa
tccctagcaagtagcaacatagattgataaagtaaaggcaactctttactcccaactaattttgtggcaagtagcaacatggattgataactctttactccgactaattttgttgccaaagttcgaacaccaaacctgaacaagtgagttttgacctgcctgggatggaagagtaggactcaacttctgcagcgactgaccttgcctctttagtatcaatcagagatgcttctaccacgatcgacctccgttagagccatctcagactccttcggcgcggcctcaactgacgcttacaccagctcggactccttcaccatggtctccaccgaagcaacctccgtgggctctgcctccttcgccgcagtctcacttgcgttcgcaaccgccgccgacgaggttggctgcgtactagagggtggcggcgtttcgtggggggcatcatcggcgcggtgttgccgctactagatcggctaggtggggagagaggttgggggcgtggtggctgcgattcacggtggaggcagccaagagatgcggtctcatgggatgaggaagcagtgagagctctgcctcctttgcgggggagttgccaacggtggcttggggcggcatagcagtggcggagatgcggcacacgggatgaggaaacggcgagagctctgcctcctttacgagggaggcgacggcggcggcagcttactgttgcggaggaaccgacaagagtgcgcgaaagagatagggagaggcgataaaacgagaaaagtcgggggtgggaaattggggatcgatgatcgatctgatgaccttgtgtcggttgatttgtcagtccctccaccgacatttgttggccccagttgtcagtgatactaccattgagaatgttttaaagagtatagattatagacagatagtacaaagaaagaaacagaaatgcaaaatgacatagtcacaagcttttaccaataaaagtgttagaaatttgaaggcaaatgctcaggtattgttattccctgcactcacaaatatttgcacaattgagtatcaaacagttaccaaagacacaggaaagtgctagtaatgccatggtagcattctagcaggctttacggaacatacaacataggagtaattgcttttacctgactgacgaagcctggagcagcttatgtaaaacatggctgcaataaacaaaatttacacctcaagatttcacacaataaaacatacagagcacagtatggttgtgttcatctttaaccactccaatattcattcctagcattgccctttaaattcagttcatgaagacatttctaatggtgaaacttccactgaaacaacccaaccaaggaagtaactacacagtacaaaacattaaacattattacaaagcttcaggagtcctcaagcatcgagataatttttattagattcgcttttccagatagcctatcaacacgaagaatctgtacccagctgaaagatattacatttcagtggattccattccgatgacgggaaaggacacgctggtcaccttgattgcgaataggaaacagatcatcctcctgcctgtaaccatggccacggctattgcccaaattatgaggtcgcccatgggtgtcaaatggatgaacatagtctcggtcaggtccacctcttccaatggaggctttgttcaagggcctgtcccgaaagggtgaacggcttctctcccgtaagtctagtcccctgttcatgggcttgttacgcatgggtgaatgacttctgtcccgtacagcttgtccccagttacccctgggagaccccaaccgtggttctcttcggtcaagatatggtccatcgcgtggatgctcccggtgattatagccatcccagtcaaacttcccacgctgtcggtgtggaagttcatccccgaagttgatcctgtccctgtgcatagggtctgccattcgtcctggacgatcttgggacaactgcgtagaatagtccctatgatcatccggtcggaccataccccaaccacgcggtggtgatctatacctttgtttctcccttggcagatcacggccactcggtggaccaataaccctactcggtggcccttgtggtggagagttgaactggcgtctgtcaggactgtagctggacttgtacatggcaggtgcatagcgttccttgttgcagttgttacagtgagaccgccgagcaaaattaagatttccgcaactgaaataaaaaaaataatgagtaataaatttacaagaccatcagaagaatctatttcaacaaaggaaagaagaaacaaatatacattcagcatactcacgtgggattctgacatatccagtcaccttctcttggagacaagtttgggtcattcctgtgcacatattctccattaatgaagatgaaatcttttccaggagcaccaccatccctcctgtgtggtcttcctcttccattgggaggagaaacatattgtaacctttcacctcctttacttgccagctcatatccataacgtgaaccgtcattgaaattgctgctttctactccgcggccacgtggaggtatcatggaacctgagtgcgggtgatatcctgaaaggcgagcgacaaacattctacatgaacattagaagccacaaggagtaacagtcagcaagtaggacttgcatcatgcatgagttctgcaactcctgaaggtgaactgctttcagcaaaggccctcaagagtcaaaccagaaaaaaaatgcattgcagaaataagcctctgaaaataatttctgtcaagtaaacagcacagtaattgaaggtgaactcagcaccatatgatcctgatctcttgtctggtttataaagtagttaaaatatcaacaatgcagcaacccacatttgggctcgccagtcttgcagaattcacatgttcctaaagcctggttcatctctttatccaattcatatcatataggttaggcctcctggagcatgatctaatcctctgcaaggagttccacccttcaatttctacaatccgaagaaacagacggacattccagaaacaagtggtgtcctgagctattttccaacttaccaagcactccttccaccattatttcccccgaatctcaaatgttatttttagccatgcactacaagataaaccagagatctttggacaatagatgaactgaacatctccattctccatgtttccatggatctttttcttgtgtgccaatcgttttgtagtagtgtaagcagtcccaggtaactaggcatctcaatatccaattcacttataaccaagtccgcaataccaaataccttcattttcaacaacattttccttgggcagatgctttcttaagcaactaaaacaccctagtttatttctataaataaggtaatcaaggccttatctatgaggaagtagctataagaagtgaagagctcaaatcccataattctgtctattttgacaagaacttggatgaccaggcaacccagagtagtgattcctaacagaatacttgcattggaaccatttagcattgaacaaccaaaatatagcaaaccaagccattcaaatattgtcaagtgtccatctctcatccttcgttttctttcatgtttacacctccaatcttctcataacttgccaaatgcatgactcggtaaagacatttccaagtgagaagtggcatctgagcatagacagaacagctcagcagaaaaaggcagcaaatagaatacgaacccatcaaataataaatgttcaataagtaaatactaatgtcagaaagaaaaaaaaaaccaccttgacatgttatcacatacaagatatataaaaataaaccgccacagtatattatagtaattacaccagccatggaagccatggaaaaatatagataatacacacaacttatcaaagcagtgtcaggtgttagatatcaacattctagtttctgacaaatagcaaagtaactttgggcacaggaaaaacacatgtaaaagttcataccacttacactacatgatcatgtgacaaaaaactaaacttggtggaatatgtaacataactgaggataatagtagttacctcatgaagaagcaaacagcctttgcttaaacgtagctatgataaatttttatttatagttgctctatacaaatctttatctttacctatttacaaaaaaaaaaaaaatgtttccaacttcttctttttttcgtttgtccgtcttcgtgaatttttttctgtcaccatgaccgacatggattatttttcctctgtcattcgtacggaaatcaggcagcggtacaacacggtgaatccaaactattcgctagagcccaatgggctcatactctggtgctgcttgttgcatggcaggctgtgggcctgcctgcccaaggcaaggatgcagggatatggaataagtccactttgactccctcaaatataggatcaacctaatttgtatccctcaactgcaataccagatattttgaccctccaactattaaaattaaaactagtgcaaaatgactcttggtggttttgagggtggtttttgctaacgcgtctcctctcttagactcctctctctctttttttctctctactttccccacatagcggcctaaggcaaagcggtggcaggacagcctcgaggctcgaggcagagccgcggcggggtggcctcgaccctcctctgagtcctctcccctcttcctatgccatggcggccgccgaggaagccatgggcggcgagcgagcggatccaagcaggtcacgtcatctaccaccggaccacaccgctctccctgtggtgtcagcctaagccactggagcacgtcgcgcgcccttcctgtagggcgagctgtgcggcggcggtcggcattggcaatagggcgagggagctaggagctacagcttatcctcaccttgggaaccagaagacggtgtcctcactgggaaagaaggggtagctggcgatggcgcgctctcctcgctaggagataattttgttcagttattttaaaattgtctttatccgttgcaacgcacgggtaatattggtagtaaagcacaaaaatcaaagtagaaatccaattatgtctattccacagtactgtgcttgctatgctctgggaacatgaatatcaaagtccaaactgtgtatgtcttttcatattttctaagctactatgcaaaatttgttttcggtagataaatttcagctttatttcacagagatagttattggttcaagagttcaaaaacacccctaataaagtccatacagcatagcacttcatacttggcatatagcatataaactttgttgtgctgtttggaccagattgccattagcttttcttttgctttgctttatatcttttctgtagacttcttctaagaagctccatatatcatatgtgtcagccctgattagctctatcatattcctttgatctattctttgctcctgtctcactcaatacacccatcaaggaacaagttatctctaataaatagaatgatatatttttattttatgagttccattaaagctactcaaatatctcgtttggacattatagtgccatttcgtaatcatacacttggtaattactgcacgcaagttaaaaagaaaaaaagaactagagttttttttttgggtcgttgttatgaattgaaatactcaggatactacaattttattttcagtaacttcagccaggatttggcatgcaatgcttggcgtgccagcttcacagtatgcttgttcgcacaactgatgcaacaaaatcaaactcccaaatgagatttccaggaaacctaccttgagaaatactatagtactactacaacgggatcgatcaaacacagaatggtacaagaccgtagcaagtcaacggttttgttctattgcaaatcaagaactaactatccttaatccttctgtagcatgtagtctaaatccagaaggcaacaaggaagaaatcattgccactaacaaggaaaagataggtgtaccaaccggccaatcaatcctcgaagtaaatgataacagaagagtgggtaagaacaagagggtttttcttttcttttccatttttttttcataccttgtggctcctcacggggctggggatacctaggccgaaaccccagggggctcccgcggcggcgagggggaggaggggacgcgctgccgccgcggcgcctcggcgccgcgtgcggctgctgcggcggcggcgtctggcgcgactcccggcggcgcatgaaccctggaggcgagggctcccgcggggggcggcgtgcggcgggcgggggatcgcgccggcgctccagccggtcggccgcgccgtgctcctcctccggcccccgcggctgcagcttgaccacgaggctgctgaggaggggcgcgcgcggcggcgcggggtcggggcggcggcgcgggcgaggggaggaggagcgcgcgtcggcgtcgtcggagtcggaggcggaggcgtctctgcggcggggccgcatagctgtgtgggtgtcgggtggtcgtcgggacgacttggtccgagtcgcccgactatacatacggtggttgggtcaagccggtcaaccccgtgggttttcctcattttgaatggcctgtttgatttttatttttatttttttcgttttggagtattctgcttttggatttttgaattggaccaacaaacgaattcggttttagtttatgtggataaattaattcggcccgaaaatccaactcacgagcaaatgtatccctcctacttccgatgaaaaaaactcggcctaaagcagaattcagcccatttagtttctcacgaaaaagtaagcccactaataatacagtccacttaacagccgtgagaaaatccgtacatgaatttggcccactctgttcaattaaagctaatcagcccgcttaccaattcttgacgaagaattcggtccactagtgaaatccacgtaacatagttccatcaacaaataagtccacctgtcatccctcaactttacgagtacgtatgacattcttaatcctcaatactgggaatctcttcccctcaactgttcaaaaccatgcaaagtagatcccatggctgtaaagcatgggtggtttcgctaacatggcatcctggtcagcatgcagagaatacaaataacatgtggggcccacatgtaagtggcctagccacaggagatttcattgccaagccgcacccaacatattgcctcatgccggtgctcctcctgatcacccacaccgaggctgccgcggcatcgcgatgccctcaactcctcccacctcaatgtccgcactggccactacaccccactccccgctcaagcagcccatcgctaagcacctttgctacggtgtcataaacctcaacaagccatccaacctcttgtcgcacgaggtcatcacttggaacaagaacctcctccacatcgagaagactagccacaacgggacccttgaccctaaggtcaccggtaacctcatcgtatgcgtcaatcgtgctacccgcctcgtgaagtcctggttaggtgctagcaatgagtgcatctgtgttgcgtgcttccacgccattgtgcccgacaaaacgcatgtcgcgtgcgcttgaagagctcattggtgccatcttctatcgctcgccgctcatctccactagtccaccgtcaagtgccagctccgggttctagatcaccactttgtcatgttctagatctcttgcgatgcaggtactacgttcggatgctctgagcagttctggatcatagacggcgaccttgtctccttccgagcaagccactcccctggatgacagtggggatttttccccactagctgacgagggctatagggttagatgcatgcgtaggagggggtgttgaggggcacaactggcgacgcgaaagagggggtggctttgttggcacggggaggggacgacgtggatggggtggtcggtggcagcccattgatatggaggagacatggagaacaaatggggaagtgagggagagaggaggaagaaggagatgccactgacatgtggaccccacatatttttttttattctctccttgttgactaggatgtcacatcagcaaaactaccaatgcatattaccatgggacctactttacacagactacacagttttgaacacttgggcagtaaaagatttctagtattagggattagggatatcatatagactcgacgcaaagttaagcggcggaagtggacttatttccacgtattaccacacaagtggatttggcccacctattttagtctacgaattaggcccacgtaataatttggcccactaaagttggcccataccaccaaatagcccaccggaataggcctctgattcctcgccacctactagttcccccccttcccctcggcctccactctcctgctctctctgcccgcgtcgaccagcgcccaggtctccacctcccgcttccccgcgacgcgagagccaccggcgccgccgtcctcgcccgccgcatcctcgccggtgagcgcgcgcacgcgcatcctcctcctcaccattcctttcctcttcctgcctcaaactcagcttctccggtagatctgagagcttctctcctttttggcttaaacagcagctttgtttcgaacgaaatttgttcagctgaggctccatccatgccgcccgttaggtccgcaccagtggctcctcctccgcctccgccgccgccgcagcagaagaagccggcggtcccggtgtcgaggccgtggccgatgtccttcacaccgcacccaccaccaccaccgccaccgccgtgagaaatctccctctggaattgggattttgtggttttgcatgttggtttgtttctacttttggtataggagatcagtttaggtgctttgaattcttgtagcttgtggtgtgtgtgtccttttccgaaggaatggggtgatgctgaaatatgttctgtttaaacgtgttggttacattgaatctttaagtctcatgattcgaatgttattgtaagcagccagttgttcgactcatatgtgctaactctgtcttttttttttctaataagatttacctaactccgtgtcattttcattggtaagattgcccggcgttcattcctttatctaagaatgttagaaatgagtagttgagctcagatcgaccattagtgtctgatatggtgactatatgccaatgtctataaatgtgcatgcacataagcatgttggtgcttgtgaaaaaacaaatgtgattgtattggtaatgggttatcacactttgccctaagtgaggattgatgcctaagcatttctggggtgaagttcgatacatcgtgttgaaaatttggggatattttaagacctaacatagaccatgttatttcatgtgtctccattgtttcatgtgcttaatgaataaatctatcaaaatgcctaatggtaacttacatatgcgatcaagattgaaagaaatctatttctgagagctagatcttgctccactacaatacatggatgctcttccttttttgcctttcagaagagagttcttagccgttctgctcttttgctcttaacttatcctaaacaactgattcattgtctatttattttcgtttcagaactgtagtgaaataatgttaattgtagatcaactagttaattgataacaaattaccttgaacttttcatagagtaaatgcacttccaagttgaaatcaaattcattaatattttccaagaaatgtatgtgtttcttttgcattgatctag

SEQ ID NO: 68346 - DNA, 4091 bp, Oryza sativa
ttttcgactagaaatagggcctgctttggttgccaagttaccaatacaactgtaatagagtttatatccatgccattataactaataatttagttaggagcagatctaatatagtagtcttggggtaggtgatccacaacttttggcacaatgcttggcaaaacctaattgatgggagaagagaaaatgaaagaggggtaaggtgcaaaatttttgcagtgccgatgtgggcaattttatgtagaaaaatggccatcttggatcatgcccttcggattaaggtcggacggtgtacattccgcaagtgcatgaaagcaggggtgtatataggatatgttgcccttataactaatatttttaattattttcaggataatttaatttgcagtcagttttaagcacttatataaaactagtctctctgcatgcttataacttataagctactatatgcaacacaatggttaattattgtcatcgcacgaaattaattttaacctaaattacggcttgcttaaaagaaaaaaaaaaagatcactgcggaataaaatgtatcattttagttagattacaatgagcttaaaagtatttcagagcgaaatagttcagatggtttcgatgcttgtaggagtaaaaaaaataaaatagtaaaaatgattatttttctttgcaattttcttatggcggatccgcaggtgcatagactaagttttgactatggcatgagcaagacgtgatttttgccgacaaacgatcaatatgtcacgtgtacggaagagcaagtgccacatggtgatatgggagatggagacccacacgaaatagatcgatatgcttgtctgtcgttccctgttccatatgctgcttacgttttctgatctcacggatatactcccttcctgaataacaaaactcacacaagctacattcaaatttaaatccggccggtaagtttttttttaacggatgaaacgctcccttataaacatttgatttgatgtttaacataggattcgtttaaattttaaaaatccgatcatcaataatttcttaattagttagtttaaaaagaaatgaaagtggcataaacatagatttgtatgaaaagtaataccgtaatattctaaccttatgattttgtaaatccattgtaatacaaaaccgacagtaggattttaaaattttaaccaaatcttataataaatgctaaatatatgtggtcattgtattgttgtagaaagatagttatgggaaaatatgtgcgtacttataggggtgagtgtccatgcgtatatgtgagtgttgcatttatactagtatgactttttttatataaaaaaagatagttatgtattattagaaaaataggattcacatgataaatattccaagtcgacattaacgtcagcaactagcggacggcatggtaatttgacaactagaaagggtaagtgaatagcctccacaaacaaatctgatggatgaaatcagagagggaatagtcacacaaattaggagtagattccagctctcaaagacaaagacggaatttgtgggtgtatgcaatttcccacgatattaagatgcaacaaattaatgttacggtaaaaaaaactaagcagtcatgaaaaaaatcgacggcatgtgaggagaccccattgcgaccttggtgccactggacaaggcagaggccagtccactggctagctaggcagtggggattgtcttcagtattacagctgcagtagtagtggctaacaggtgggaccgggcccacatgtctgcgtctactactgctactgcagtactgcagaggatccatgtcccattgtcggtggaaggggacgtaagaaatattctccaaggacaagtgtaactatatcatttgaaacaaatatacatgtaaaaaatattatttatctttatttgtcaagatgattgacggtccaaattagtacttaacgaccgtcaacactaccgctgacgccaccgtaccactaccccgcctcatcatctatcctgaaggcatcaacagcaccgacgaggccccctcggtcggcctcctcccaatgggctaaagttaaggacttgttggaaggagattctaataccaaatattttcaattggttgccaatggtaaatatagaaaaacaagaatttttcagttgcaggatggtgaccatataataagtggtgatgcaaatttaagataccatattacaacatatcataagggttttgtttgggccatctgaggaataacatttcaccttagatgagcatagaagggatgatatcttgtatatgtctcaaatggaaaatgaagcattaacaacaaattttactaaaaaggatgttagagaggcaatttttcaaatggaacttaataaagctccgggtcctgatggattttcagctgaattttctcaagtcttctggaatgttataaaggcggactttttagatttattcgtagaattccataacagtccattccctaaatttcgctaaatttcaatacaattattttggtacctaaatccaaagaggccataaagatataaaaatatagaccgatttgtttattatatgtcagttttaagatatttacaaaggttcctactaatagaattattggtgtgtcccaaaatgtaataagcccaatgtagatagctagcttttatacctggcaagaatattatggagatggtagttatttacatgaaacgattcacgagttgcataggaaaaaacaaaaatggggttattttttagatcaattttgagaaagtatatgacaaagtaaattgatcttttgtacaacaaacccttacgatgaaaggcttctctactaaatggtgtcatttcttttattcaaagggggcgcattggtatcaacgttaatgatcaagtaggaccaaattttcaaacatggaagggtctaggacaaggtgatcctttatctccaattctttttaatagagttgttgatatcttagctttgctgatcaagggcaagggcaaatggtcaaatagctagagtagtccatcatttgatagatgatggtttgtctattttgcaatatgcaaatgatacactcatttttatggactacaacttagataatactaagaacaagaagttactaatgtatgtggttgaaatgctctccggtcttctaataattttcatatgagtgaattattctgctttggtgaagcaaaagaatgtcaagaacaatactctaatatttttggtgtcatattggaacttttcttagatatcttggcattccgatgtatttcaaaggttaaactatatgggttgaaaagtaatagaggaaagaattgaaaagaagttgagcattggaaagggaaatatatttttgtgggaggaagattggtcctcattatatttttcacacataatagcatatatattttatattttattattattaaatatattaaaatggcaacatagttttaaattaggaaaaagtatgaactacccagcccccagaactatcgcagtcgtccgaattaccccccccccccccgaacaacaaaaccggaaattcttcacccccaactatgaataccggacgaattaccccctcgacccaatccacggtggttttggtctacatgacgtacacgtggcagtccagtcagcattctatttatgaaaaaattgtgggacccacatgtcatacactacactgtcttctctctcacacactctctctcacttctctctttcactcttcctctctctctctcaccggctcacggggtcagtggtggcgggggacatggagcggcggcgaccgcggcgcgtgacgcggagacggcggcggcggcgcgtgacgcagaggccgcagcggcaggggatgaggagctcagcgcagcttccaccctccctctcgtcggcagcggcgacgggggacacggagcagcggcgcgtgacgcggagacagcggcggtgggggatgaggagttcggcgcggcttcccctctccctctcggtgtcgtacgcgcggggaggacgagggtgcgagacaagaaggcggcggcggcgaaggcagat

SEQ ID NO: 68347 - DNA, 24413 bp, Oryza sativa
  unsure (1)..(24413): unsure at all n locations
gtgaaatgagtggtgaagaggtgaggataggataaggatgggggaggagaggataagcaggtaggtacgatttttgtaagcggaccacctaacatgcgcctgcgaaaattgattttcacaagcgtcgcttaagtggtccgcctgcgaaaataattttcgcaagcgtcgcttaagtggtctgcctgcgaaaatcaggcggacagctagtttcaccccgatttatatttttataggaggtcgtttggcttcaaatgttatgtccgactgcgaaaataagacccctacgttgggaaaaatgctttttctagtagtgacgtacgcatgaaatctagcaataccctatgggagcagcaaaccccatgggctacatgatagaattttaaaaggagaaagtcaacgacaatgtatgtatagtattgtttgttttgttctaaattagtatcagtgaaagcttaataatgtggcaccgtttagttcgcgaaatgaaaatttttaggtgtcacatcggacgtttgaccgaatgtcggaagaggttttttggacacgaatgaaaaaactaattttataactcgcctggaaaccgcgagacgaatcttttgagcctaattaatccgtcattagcatatgttggttactgtagcacttatggctaatcatagactaattaggctcaaaagattcggctcacaatttcctcctaactgtgcaattagtttttgtttttatctatatttaattcttcatgcatgtgtctaaagattcgattcgatgtgatgtttttgggaaaaaaaatttgaaagcagggcctgtattaatgattggtatgacgtacgtacgcccagctgggaacgtgcgagctagattcgccaccggaatgactgtgcgtacgactgcatctgtccgaccttcatacgactgcacatgataaattttaacttattttgattgggcccacgtgaatgcttatgaactcctatgattggttggtttggcgcagtcgtatgagagttgtatggttcagtcggatgtacagcactactcattctctacatactactccatccgtcccaaaataagtgtagttttgtactatttatgttcaacgtttgaccgtttgtcttaattttttttatgattagtatttttattgctattagatgataaaacatgaatagtactttatgtgtgactaaatatttttaaatttttcacaattttttaaaataagacggacagtcaaacgtggggcacggatatctacggctacacttattttgggacggagataatatctccttagaccacggtaaagactgatgatggaggtaatatctccttagaccacggtaaagactgatgatggagacattttactgcttggtcgctacgaaacttaacaaacgagacgtggccccctatcatatggattgctttgccagcatgtgtagttagaccaaggtccggagatcttgactcgcagtctacttatatataatctctgtgctaaaaaaaactcaatagattcattcctaagattttttttttcagagggagtacagtcagctccgtctcgaattataagacggctttgttcttatatgaaaatcaatcttaataatgggttattaataattataatgtgtttaatgccatgtgtgtacatcattaaattcatatttttaaacactttcatgttatgtaaattttaaaggtggtgatataacatatttttgaaagaaaaaataatggtctaagatatatatggtattggagatttcgagaccatgtagaaaattttatggcttgcatgaaagctttgatttaattaactgctgttttagtagtactaactaaattaggtgccctgttcattaaacgacggatataattaactggattcggaaacatttgacagtgagacgggataatatatgtactgagagatacattgggaatgtatcctatagacgcaagttttcataccgtatacatcaactaacaaatatcactaaaaattttagaaaactttgtacatgtactttcaatagtattatatctacatataaagtcacacctttaaatttattttacataaagagcaataaaaaagataaaattaagatagacttgtagtcttagtactatcatattttttttgttttttttacgcctaaaatgtattaaatttgatgttaagattttacacgtagatataatactatatattgaaagtgtatacccattttttctagatttttcgatgatatttgttaattggtgtatacggagtgtatacactttgtcagggttatagataccacatatctaattgtagttgactaagctcggcagggctcaccatataccatgtcttatacgaaaaaaaactcgtatatagaaggaattccggataaggaaggataaatagagttttgtacggaaacgacaaggactactcggatcatatccatatttatctccctagttctacttggacaatggggcatctatgcgtataaatacgagccccctaggaggagagaggtaggaggagagaggacaagccacaagacacaacagatcaatataatatagatcgatacaagccaacacacgccaagacaagctgctggatatcgatatcagagataagcctagacatacccatccgatgcctacgaaggctggcaagagggatctagtgccatctctgatctcgcggagtgtggattcgaggaggaagactaccccaccgtcgactacgagttggttatctagccgccaagtcgataacagctatattggttatcccaaatattgtacttgtgtgattcaaataaataaaggagcaacaccggcttcggccaacaggagtagggctattacctgtcagataaggggcctgaacctgtataaaatcccggtctccatcttttttacctcaatctcgcatattgatgacgctctctctcgtggcccgatcttctggtgaggggataactctcgctttgatcaagtgcgacgtttgcgacgtggctaccaaccagaacaagtccaggacgccgtgcaatcgctacaccacaaatgatgtcgtaccaaccgtgacgcgcagttgatgatccttgcaatgcaaacgagagaacactacaagaataagataagatacaatctaaatattgtgaataggtgattaagcacaaaggaatagttgcgattgaaatggtagatataatcgacccggcaaatcaacacaccaactattgggggctctgaatcaatagtcaccgactaatcgagcgataactagagacaaagtgaagggcactttgcaaaattcaactaaacaaaacccaaatgtttttgaggatgtacaaagctatttatagaggaaaataaagctagagttaagtgctaattagtggaggtggagggagacacttccgagatgggcctagtctattacagggaccaaggcccaagttctgtttcaggaatagcactgtcttgttttggcgattcccattgactcgagataaatttggacatgagaccagttgcatttgaaaggtagcgagataagcttttcacaaagtctaagatcacccaaatcggagttcgcatgaaggcgctaggttcatttgaagtcagtgctgtctccggaggtcgaactggattccaaaacccattggactttaatatcttgtagatcctctgttcactctatgtattctttgtccatgttttatatttctcatgtttgggtgtatgcatatatttgatggtcacatcacatataccttggttccaacggtccccataccatacaaataccgtagtcgcgatctcaaaagtcgatacacttgtgtgcacataatatattcccaaatacatttcatatatatatatatatatatatatatttatttaaactgaaattgtaaagaatttacaagatggatatagtatctcgtgactaaaactataatacgaattacaactaaattaaatttgatttttaaaacatggtatcgcaagaaccgcctacccgccaccgctgggcgcggcattaccagccgccgtagcgcgcagcccccgccgccgccggccgcttgcctgccaccaccgggaggagaggggaggaagaaggggaggaggggtaagatctgtgtaggagaggggaagaggaaggggaggagaggaggagaggggaggatcgatcgatctgtgggagaaagtggttgcgcgattgtggaggagaggataagtgctagggattagaattttagttccggttggtaatatcaaagggactaaagtggtgatctttagtcccggtcggtggcaccaaccgggactaaagatcctcggtcccctgacatgcctctgacagggaatgaaccaggattacagatcatctttggtaacaccaaccgggactaaagatcgtagaatggctatggggttttcaaccggggctaaagatcatttttagtcccggtttttttggaaccgggactattgtgattttgggttgacccagcgaaaattagttttccagtagtgtcagtcaggcactgacgaaagtacgtaagagatcaaaaagtacagtatagtagctaagtatggtccaagatgtgtagctagtacgtgcaacatactacatccgaccatagccaccgtacatagatacgtttatatattatatccgggggaaaatatgtgatggaaatcatatatttggtggaaacttgaaaactaacgttggatcgagaaatagacgtccgagatacgtccacgttatcacaaacgtccatttttcgacccaacgatagtttccaccacatatatggtttccaccgtatattttccgctacatccgaccaaggagtacggttttatttatcacagattcacacaggtatatatatgctacttggtcgccaagctaccgaacgtataaaatagagctttattaatctctgttcttatacgcatacgtgtaagaagagggacatcaattgcaatgcaatgcatatggtctcaatcaagacatgtaaatgtatttctaattagttgattggtgttcattgccctgggcatactgacttacagttttttttctcttggaggaatatatacattacgcgtttaatttggcactattttagactttcaggcgagtaagccgcgttggataaatacacacactttttttcttgacacggcaagcacttcgcagaaactacagggaaattttcatttcttctggctaatgatcagttgacttataaaataacacgcaggcagtacgtacgcttggtaattaagttcagtgaaatcatctttataaatacctattagagcttgctagatttaagaatctacttgtttcttcctcttaaaatctcaacttttccttgctatatatttcgaatatattcttgatcgcatacaatctgtgctttgaatttgttagagatcagggcggcttgattaagcaagattaattcattcaagattcaaccatgaggctgttcgaggagccaccggcgaagctcacccactgggctcacccggagcacgagctgacgctggccgccaccgccggggcgccgttccggtgcgacgggtgccaggagcccggcggcgacgggccgaggtacaggtgcgcgccgtgcaacttcgacctccacaccgactgcgccctcccgccggccaccctgcagcacccgctcctcttcaagggcggcggctgcaccttcgtcttcctacgagagccccccgggcccgccgccggcagccggtagtgggacacgtgcggcgacgacgtgcgcgggttcgtcttccactgcgccgaccgcgacctcgacctccacccgtgctgcgcgagcttgaaggaccgcatcgtcacggcgggggcggcgacggcgacggccgcgtcttcgagctcaccaagcggcgtcgtcgtcgtcgtcgcggcgccgctgcggcgtctgcggggacaagtcgcgcaggacgttctggttctaccgcggccgcttcgacggcgaggacgtgttcatccacgtggcgtgcgtgaaggagctccccgtgcgaaggtggaaggcgagctaccgccgccgcagcggcgccggccagatcgcgctcgccggcgcgccgctcatggagggcgccctgcagagcctgccaaggagaacgcggcggagcggcgggttcgagcggttcagcaagatcgtgggtgtcatcgtgagcgccataatcgccgtcatcttcgggaatccgatggggttgatcgccgcggtggccggccctgacggtcttctccgcgggtagaagacgagtggaaaacagtgtgctgctaattagcaacagtcaacgagtgcgtcacgtgtagagtgttcttctctatgatttttttttcttcgtataaacccgaatgttttatttttaatcttgtggtgggtttggaatattttgaacaaagattggttcgttcatttatgcatgtttcgaataatttcatttcatgttatcattgatgtactcttctatcctatttacagtttatggtaaagtttttttttcctaaggggcacattaccattcttcgccattcatatgctggacaaaatgttattttaggcgaatattcaggatgagataatatttcaaatctatattttttgagttgtacatagtaaaaataattttggataaggtgaagaaaatggtggttttttggtgttatgagctgaccatccaagaggagagagcgaggaaacgagaggacacagtattttctctgtaaaaaagaagaaatgatacggcatcaaagcaaatggaaatgagataaatcccaacatgcatttggaaagatacccaatcctttacatatgctcttgaaatttactcaatatcttccataccctaatttttttattggatcccttacacgcccctaccgtttaggtattcttcagatatgccagtgcatgcatgtgttagcttgttagtattttaaaaaattatgaaaatgctcataacaaccctaggtaacacatgttctcatctccgatctccaaatcatactctagcacatgcatagagacttcacatcacaatccgtgctttcttagttgtcgagttccgcttcctggcagcgacatcaactatacatcccgtcgcggcgaaggtccatatcccgttgtagccttggctcagcttcttgttgcgttggcggaggtttgcatccagttggtggcggtggtgattgagcatattgattgtgcaagaagacactgcctttggagaaaaacaatagatccccaaaccaaatctcactctcttgcggcttgggatattgtttgcagactaacgaatagaggatgtatgggtattatcaatttggaacatcagaacattgcacttcttatgaagcatcttgacaaatttttcaataagagaaatctcccctaggtcagatttctttggagcaaatattatcataacaaacccctccctccacaacctatgtatgaaaacggctcattttggtggaaagatatcttccagctaattcctctattcagggtaatctccactcttcaaatccatcaaggaaacatagctttattctagaaagaccattggggtaatgatatcctaaaatctagttcccatcactattttcatttgcaatcagtgaggacatatctgtctctgccttccatcaacaagatctctgataattttcaactacctctcaacactcaagcattgcaagagtttcaacttctggctataacgctagagagcgtcagctggtctgagcaagaggattcttggtcttacttttgggaaccaaagtttcaatcaaaaagagtctatgatatcttctattcaaacatcattccctccccagcaatcaccacaatctggaaaagtaagtgcactataaaaatcaaagtttttctatggctcctcctaatggaaagattaaatactagacttatgcttcaaaagaagaatcttaatattcctgatggacctgaatgcgttatgtcctctcataatcatcttgaagataccattcatctcttcttcacctgccaatttgcacatcaatgctggaattatctcaatatacattggaattccaatcttcaattcttcaacatgatactcatttccacgcaaagtttctttgtggaagtaattggtcactcttgttggaacatctggacttgcataaatgatttttttttttcttttataatatcccgatctctttccagtgtgggaagaatctctttaagagagattttgctctgcttgtgcatagagcaaatttgttagaccaaccagtttggaaatcatggcttgacactctattgtaattctctccctgtacatatgtatttgtaactttattattttaatatatcgcagtaggagtctctcgtgttgttttaactgtcaaaaaatagttggtggcggtggctccccttcccatcgtggttgtagctccgcatctgatcgacaacgacggcttctgtcgcagcggtggcttgccatcctgtcggtgctcgaggtccctttcccggcccccgaacgctcgagctctcgacgcccccactctccttcacatcgttgaggatcatccatccttggcaaggagcaggttgatttcttctcgtccttttcttcattacattgaaatcttcttcttccttaggtagtagtagtggataagcgagtcctcttgtattttggatattttcatgttcaatttgtgtaggtaagtgcaaacacttggatagaagagagagcgaattagaggcgaccatcccctttctttgcaagagaagttcactcagtgcactttaccgtcaagttggtgcaccacacatccgcatcgaatggaagattcaaggtctagaactattccttcatatcattctttggggtaattggcttaattagctatcatgaataagttttctatggtttatgagtatctaggattcaatttggttgatagatagattaattgataggcaactattatgctcatccacaggatggaatccttaactacatatctgttgaaaatcaaactaggtgagggatcagaaataagctagtgtggaatatgattggtttatgtcagtaaggtggtagactcaaatgcaatgttctgcaaagactttgttggtcatattatgaagttatatccatggagggctaaatgaaactgttatagttggctatgtgcatatggttcattgaagttctcatcatgtcacaactaactaactaggatatgatggaaatgattgaaaagtttgttgataccaaggtgattccattgattatccgtttgcatggtattaatgaaaatgttgatgagttcgatcaaccacactcttgttaaagtaagcgtagaagtgcttgatactcctcttttgagaacctcatctcaagtgaatttcagccaacctagcagcagcactaaccttctcatgcccttgtgccatccaacacatacttagaaaacccttatcctatggctaaacatgttggtgttgatgagcaaggcatgtacttagatgatggtgatgaggttgcagcatgttgtcatgctgagaaaactagacttcaaggggttgtcagtgaagaatccaagtatgaatcttaggatggacgtacatgaggataaatctcaggatggacttgaggatgaatctcaggatgattgtgtggatgaatcgatggtatcagatggaataccataacatcttcctacagcaacttatgataaaaacgatctaccaatgatagtagaaaacatatatcctaagatgaatgaatttagattgaaaatagtacaacacgcaatgaaaaggacaataggacaaggagcaatagctcaggttcaagtaaatcggataggcacttatactgcaccatccaatttatttacaactctctttgttcaagtctagatcacttaccgactccaaccaaccaacatgagccttctaacatgattgtagcactaccatgccttggaggataaacgctcctatttgcacctaaaatggctctaagagcaagacaaaggaaaggccaccacttgatattgttgctcctaacagcctagctatgagcacaaggagtaaaagtaagagccctacaatgagcactagaagtaaagaaaacttatggactaagtaaacaaaactatgggtataactagttgatttagttttcttttttactgtcaattaatttaacttgtgaactcttcaatatgctaatgcatttcctgaagagtgctaaagtgttagcaacttactcatattttgctactgtgaagattgtttgctattgtggtaatgtggtggtgtacttttatgagtcttgtgacattatgctcatcatttacaaagtaatggattttttgtgtgtgtatggtataatttgatttttctagctaatttggtttgtcaattgctcagctattgaaatggatttgtggtgggtgatggtatgaattgaattgttaatcttgtattgttgatggtgaataaatgtcttttcattttcttcctgttaatgggtgctatcgatgctcctaatatttttgtatggatgctccagatgaattgcattggtacttctcagatcaccaaaaagatccattgaatgctataaaaaagataataaatgcattaaaattctttttccacatttatattaaaaattttatgcattaattatttagtctcataaaacacataccgtgcagtcatgaatattttaatttttatcaagccaactgccaaacacacgctaaatttccaactctaaccccaacggtattatggtaactttcaaccaaattgaatagtgaacggaactaaatctaacggttgaggatcaaataaaaaattcagggtataaaaggcatcgagtaaattcagaggcatccaagagattgggtaacttatttaggggtacatagggaattttctcaatgcaaataagatatgttagatgatgagaccaaacatactgtgagaacgataagaaacacaaacaatgagcattgggcaaccaggcttgacctaaggctagaggatataagtcttggattacaaaacctacaccataaagatatatcttaattttcaacaaaagaaaattaagatcagcctgccagactaggtgaagctcctggcctagcccaaattaacgaaactaccaaaaagtttggtccaagttttttaattcaagattaacaaattttcttacctatattttctttagcgaaatatttcatccgtcccaaaataaatttacttttttacactatatttagattcaagtaagaaaaataatttattctaagacggatgtagcatatactagttatgtataggattcacaattacgacgaaatcaggccaattccacgaaacatcgagattctgatatggcttggaagttgttgccatctggaaattcgataggtttcatccaaattcaaatttgagttgataaataacgttaaaaatcaaatgaatccctataaatagtatgatattggttgaatatattgggatataattttttcaaaagaatggtgaattacattctttttgtgaactgtacagagaaaaaaaaaagataatgatttgggaaaaggaaaaaaaaaaggcctttcctaggagaaattccatgtaataggcccatttcgcacttagctagcccagttaacataatggagggatgatgtgacctgaagaatccctgatcgatcgatccctccataccccagtagctgaccgaagagaaggatgaggttaatgttgctttctacatgtggattgatgtttagaaatatttcccagttttctaacatttccctctatttttcacatttttgaataaataaataaatttggtattaattgtcggtttctcgacaaaaccaaccggttttcacttcggtcatgctttttaagttgtcatttagaatttcgttagtttctttgctactttcggtagcaccgatgatcggttttcaacgcaagatcagttgacctagaaaattcgaatacaaaactttgatttatcaattttgttcaaaatctgttggttttcgtcgggatttcaggaagaccgatgtcccaccagcacccgaaatggaaaggaagtcttggaaacagtccatccgagctgtagtagctagcgtgttctagtgaaatctccccgtgtaagacctcgattggaaacagtccatccgagctgtagtagcgagcgtgttttcgttatgtatgtcatccggactggatctatagaccgtgcattatattagtgcagttaatttattcctgacgcaacatatatataacttctccgtatatacttcctccgtattttaatgtatgacgccgttgagtttttaaccaatgtttaaccattcgttttattcaattttttgtgcaaatataaaaatatttatgttatgtttaaagaacattcgatgataaatgaagtcacaataaaataaataataattatatattttttttaataagacgaatggtcaaataatatattaaaaatcaacggcgtcttaccagctgtcgaccggtcggctttgctaacgaacaacgactactggactaccacagtacggccacacgcaagcaagcatacgcacgccagctgatccatcgctgatgcgcttgcactagcgtcatcaccgtatagcattattgtctactcagttttcatattataagacgttgtgatgtttcaagtttgatcaaatttataaaattctaacaacattttcgacaccgaacgaaatactatcaaaatatattagtttaatactatatttaattaaacttattagatgttacaaaagttacttatatttctctataaactttaattaaacttatagtagttcgattttaattaaagagtcaacacgcgtctttatactacataagaaagagagagaggaagttaatgtaacttatacgtaacgtacgttcatgttagttgctagtattgtcgtgttcatcctacattcctactatatatactcggtcaactctagatatgtggtgtgaactgtcatgttatatgctgcatgtggtggtcggatacgctaattgacctgactgtcatgtattatctgatcttgggtgccctacaaacaaaatggaacaaatccaggcatccagcaccgttgtaaaatgcccgttaatagagttaaaagggttatgtctatctttggtacgtgatgaacactcggcactaattcagtacttttttttccgtgggccaaggaaaaatggggctcagcgtgaaggaggagaataccgtaagagaagtacatatataggtcaactctttttaaatataaagcatggattccgaaaatgtaacatacttgggtcctcatatcaatccaaatgcattaaattaagagggactgtgtagggttagtgtatgagatgagactatgcatgaggcagcagatgttaattaacattttctttggaaagaaggaagcaataaaatggagaggaaaaaagtacggcaactggtggagaaaccatttatactcctggttagtaacccctttagtcccggtttttcaaccggaactatgaacctgggactaaatatgcccatctttagtcccggttgaaataaccgggactaaagataccttatcacaccaaccgggaataaagagagggtagcgttagtcccattaggtctcttttttttcattattttttagctagagtttaatccctatattttctcccaaatcaagtgggatacatatccccaaatcaaatctcaaatcaaagtaacatctcaaaatatttacgtcacaaatcttaagttacttatgcacacaaatcaaatacatcacaaatcttaaaaaaattacacacaaaccaaatacatcacagattatacatctcatatcatacaacaaatcacaaaattatacatcttagtgaatcacaaattgtaaaaaacaaaaaagatgccggcagcggctgccacctgtcgccgctcgccactgggcccgtgcgcggcctagccgaccgcctgttgcgtgggaagggaggaggggaggagagggccggggatgggagggaaaggggaggaggcggagggggaggaggagggagatcgatctgagagggaggaggggaggaggagagggagatcgatctgagcggatgggaagggaggatggggaggagaggcccggggatgggaggaggaaggggaggaggcggagggggagcaggagaggaggagagggagatcgatctgagaggataagtgcaaggcggttgtggaggagaggatagggaagaaggattatatattaagcgttgaattttagtcccggttggtattacaaacggggattaaaaatattctagatctttagtccgggttgataaccccaccgggaggtaaagttaggatttatagtcccaggagtaaagatcccaggggcctcacaaggcctgacaggtttagaactgggactaaacatggtctttagtcttggttggtgtcaccagccgggactaaagatcaaatatgtccactgtagccaccaaccgggactaaagatccggtttttagcggaactggaactattgtggattttggccgaccgaccaaagatggtttctccaccagctgccacggtgaaataaaatcaaataaaccaagcaaaaattacccatttcccccgtacaaaccaaacaattaattagccacaaaatcaaacaaaaaggcaaattattgtatatatacttcctccgtttcacaatgttagatttttttttctttcgttcatgttaatgaatctaggcatatacacatgtctagattcattaacttctatatgattacggacaatgctagaaaatcttaaaatctgaaacgaagggtgtacctaatatataaaaaacaatttgattgtaaaatcctgtcccatgaaatccatcacatcaactttacatgatcacaaaggcaaacacacccacgaatactctctctccgttctaaaaagaatccaaactaatatgagatgggatataatctatgtagaacgaaccttgatatgagcatatctagattcattgttttttttatggaggtaatacccgccaagaagtaattaacgtatcttgttccatcagttaccggccaacacaacactagaccagcactcagcttttctagccgtagacgacgttggagatgaaggctccgacgagaggcaccgccaatcccgttgggtccccgaacagcacgctgacgatgacggagatggcgaagttgaggaagcatttcaccgccttgccagtcctggaccgcttccgcttcttcatcgtcttctccaggatggagacgctgatgatgctcctgccgccaccatcgccgccgccgccgccgtggccagcagccaagatctcctgcaccatctccttcacgcacgccacgtgcaggtacatggcctcgccgtcgtagcacgagcggtaggtccagactttgcggcgcagcgtccgtgagcagctgcagccaccgtcgtgtcaaccggtataaaactctctgtcaaccttctcttttatcggaatatcacgtatgtcctgatatcagcattacttaaaattttttacatttatataaataatgttctagtacctttaaattaaatatttatactccattaaaagcctatagtggtggtagtgaattggatacccctattgctttggtaggtttacaaattgcccttgatattttctgatattgtggaatagctcaacatttagttcaaacaagtgaatataaatataatcaaataagcaaatatgtaacactaacctgttcttttctgcaacaaaagttggattaaattttagatactcgtggcacgcttttcaaactgctaaatggtatgtttcgtgtaaaaattttctatataaaagttgttctaaaatatcatattaatctatttttcaagtttaaaataattaaaactcaattaatcacacgttattacaacctcattttacgtgaaacacttaatcttcatcttcatcttcaggacattcaaacaccaagatatttgataaaaaaatattttgccatgatatattatgataattttattcttctagcttaaagcattggtattttacgaggttgtaaagttattggtaatcaaggctataaaattttaatcttaatcctattcaaaacatcaaaagttatgaaaccggaaggagtaggtccattgttttttccaccgaaaatcgcttccgtatttttgcacctgaaacggatccttcgtttacgcattagcgacgtgcgtgatacgcgaaagcagataacgaagctcgcagcaaactcgaaagaacacaatgcctcctcctgcccgacctcacgatgacgattcgcaagctcgtgctcgacctgaggccacacacaacgtacgtgcgccttctcctgcgcgagacgaccgtgcgtcgcagccttttcgctcattcgcgtgctcgcctccaataaaagagaagaaatataatgacaatatacggcaacatgtgtattcttccattgagtacccggtgttagacttgaacttgtcgactataacacattaacacctcaacccggacacgagcacggagccacagatgggcgaaagcgaaacagaggaaagcagagcagggcaactaggggcggaggcagcattttagcaagaataggactatagctataaattttttgtgtaaattctacctaaatttcagtgtttctccattaaaaatttttgccacgtgtggagcccaagcccaaactgccccacacgtggctccgcccctgagggcaacacacaatgcactaatactgaacacggagcttggcgtctcatccgcgaaacaaaattggcatattaatatgtatttttttttcttgatgaacatgacacaattttctgaattcaggaaaatagctactccctccgtttcataatttaagtcattctagcattttccacattcatattgatgttaatgaatctagacatatatatttatcaagattcattaacatcaatataaatacagaaaatgctagaatgacttacattgtaaaacggaggaagtatataggactgtaattggcaactgacatcaagtcaactacatactttgcgaccctacactcttttagctagcgaagacaacacagccaagcaatgcagtaatgcactagttaagtagttatccctaaagtgaatttattagcaaataaaattaatcttacggcattagactactaatagtatccggtttagtaagttttggataattgttaggtcaaactttaaaattttgaactataaataatttttaaaatatttgtctttcaaatagagacatatatttagattagtctcacaagcaattcaacaaaatcatatatctgttaaaaatattatatatattataatagaaaaaatagtgttcaaatttattttttttagagaccgtgctcttgtttaacagggcaatcagtattatcaaaccgaagagagtagcttgctagccgaagaaggggaagacgtggtagcggtcgtagagctcttcgaagacgtaggagacctggttgcgttcgtagagatcgcggagattgtcgtccttagggttgttgaggttccagagctccaccctgcgattgtcgccgctctcgaggtagtcgtagcgccatagcttgtagccgctgtcgtccagcacgacgaagtcgccgcacgcgccggcgaagtccaccggcctctcgcgctcgaacagcatgtggaagtagtagaagccgacgtcgtccaccgtcgcctcgtgcacgcgccgccacgccggagcggcgacgccgtcgtccgtcgtcatcacccacacgccgtgcacgcccacgccgccgtcgtgcggatacgggctgccgctctcgtcgctgtcgtcgcggacgtcgaacgcgcacatccggaggcgcccgccggtcgagcccagcgaccgctccgcccgcccgatggacccctccgccctcgcgggctcgcggaccacggtgactcggccgccggcgacgtcgtagcggaggatgcggccgcggttgcggcggtgggtcagccagtagaagcacccgccgacgtggatgcccggggacgcggggcccgccgccgacgctgcgtgccaagccctgggtcccctgttcgggcagctccttcgtctcccacctgccggtcggcgacgtgaaggtctcgacgaccacgcgccggtgcctgcagccgatgagcaccaccgtgaagtctagcctccccgtccccgacgacgcatcgtcgtcgaggtcgtcgtagtgaaggccggagttgatgccgtgttccggcgggagagtggatggcggaagctcgacccagcggttggccgccgggtcgcagacgtagtagcagctccggccgcgggccagcagaagacggccgtgcgccgcgacgatggagatgtccagcgccgggacggtgcgctcgaagaaggcgacgtggtcgtcgtcgtcgtcggcgtccacgacttccaaccccggtgccagatgatcggcaaatcgatcgggctcctgctccggcagcggttcgtcggcagctgaggcattcgggatgaagctgcggcggtggctctcgtgatacaagcgagtgggccgcttgtacttgttccggatggggacgtggacggcgagctcgtcggcggggtcgacggcgacgaggctgaggtgggtgaacccgagcttccgcggctggacgatgagggcgcgggggcgttcgccggcgagtggccgcggggagaggtggcggcagaggaacgtcggctgcgacaggatcgctcgccaccgcgggcacgcggcggcgaggcggtgcgctgctctggacgacaggctgcgcgagatgtctgatatgacggcgtcgtcgggtaggtgccgcccggcggcggcggcgacggcggcgacggcgcgagcaaatcgttggtaatctctcatggtgctatgctacaccaagctaggtctaagattagtttattcggaatgatatttagttaggttcggcccatttatccactggcccgatccataaattcgttggtaggccgtgttggacctgaacttggcgccctacacggctacgcctggacgcgagcacaaatgggtaaaagaaaaaaaaagaaaagttcacgttaggtcccttcatatgtcaccaagtgtgaaattcaaccctaaactgcaataacatatatgccgtgtctctcaactcctaaattcagtacaaataagattacaagatgtttggatagtggttttgattgatgtggcacttatagtcccaagaaaccataaaactcatatatccgcgactatccactatggaatccacgtcatcactcttgtttttttttccctcttctctcccttctttcttggggacctctgccctcctgctcgccaccaccggtcgacgccgcctctctccttcctcgatactccatagagaatgattcctcgttcccgatgggcgtcgcagatgtccccttgttggcttgttgccgacaacgacggtggcgtcgctgaggcaccagtcgcacatgccggcgctggccctccgccgggtccccatcactgtagtagttggtgaacagtgggtaagtttgttgattgcagcacgtacgagtgctggaagtggcggcggcgggcgcaacgagagagcttgttcagataaccgacatcgccgcaagaaggagacaattttgatacggttagagtgactgtgacagcggtgcagaccgtgtgagagaagtgacgacgaggagcaaagggagagagaggagcaaacggagacaagagggaaacagggtgatagagaggagcaaacgtagccaggagggaaacagggtgatgacgtgggtctcactataatttttttatttttaattaaatagttactgatacgtgggtctcacggtattttctaacttaaagtatcatgtcaatgccacataagcgtcacgtcagccgaaactactatctaaaccatcttaggattttatttgtactggttttagaagttgaggaacgcgtcacatattgcggtttagtgacaaattttatactcgatggtagattggggtacctgaagtgaacttattatgagagagagagagagagagagagagagagaagcagaggaaaacagagcagcgaacagatgggcctaaataaaacagaggaaaaacagagcagcgcacagatgggctaaggttaaacagaggaaaacagagcaaaccagagtgcagtgaaacggagcgagagatcccctgaaactggacaaattgacacacgattttgtgctgcaagaaccgcgcagcatttctgattttattcctctcacaaattataccaacaaaactgctatacaaaacaacaaatgatggtaaatccctagctaaaaacctatttgcgcgcgacgagctcaacgtcgacgacacgcatctaaactgacgctggcttctccaaacatggccatgcgcccaatcaatcaaatttaaacaaaaacgcatcctaaactcaaaaagtttaggggattattcaacaaatcaaacccctagtactcctattgccgaccatgatccctaaccggtggggaagactaaccccaccaccgccacggccatcgccgtcgggtcaccgaacaacacgccggcgatgacgcggaggacgaacacgacgatcttgaggagcttcttgagcttgctcctaggcctcccgttcttcttccgcagagccaccgccgcctgaaccggagccctgatcaccggcatgttccggccgccgccgccgccgtcggtgcggtggctgctgctgctgccggctctagagctctcgtaggccatcctcttcacgcacgccacgtgcaggtgcacggcctcgccgtcgaggtcgtcggagctgtacgtccagtagttgcggcggaggtgggggcggctcccctcctccgtgcagaggaggcaccgccggggagccgtgccgccggaggagagctcgaacgcggccccgccgagagcgacgcggcccggcaggtgcgcgcaacaagggtggaggtcgaggtcgcggtccaagcagtggtagacgaagccgcgcacgttgtcgccgcacgcgttgcagaccctgacgtcgccgtcgtcgggcgccgccgtcggcgggggctcgtgaaggagcacgaacgacgcggttccaccctttgacagcgcgcgcncccgcggcagnacgtccggcgccagcgcgcacggcgcgtgaaggtagaagtcgcacccggcctcctcgcactcgtaccgcgcgcagccggcgccgccgagctctttgcagccgtcgcacacgaacctccccgcccccgcgtcgtcggcggtgatcagtttcagcttgtgcgccgggtggaacgggtggccgcggatctccgccggcgccggcgcatccttgtcgctcttcaccttcatcggtgaggaagaaaggatggatcgtcaattcgaatccgtctgtctcactgcgctgctttctttggtggaatggtggcggcgcgagtcttcctgtttatttataggtttgcgcgcgccgccttaagccgcggagaacaagcggttgcgtaacactggcgcatgaccaacacgttctccttgcgcgccaagccacagcataagtaaagctcggggttgatctgctcacttaattcgagtacataatgcagtagcttaatccttaagcttgattagttactcatttaggagtactcacctattactggataggatataggaatattataatgatacaactataaagagaagcgggggttgatatctcgcgtgcgcgcaagatgcacacacgccagctggcgccctctcccccagcaacgcagtttttttttctattttagcgctacgtttcctctgcgcatttttctttttttaagtgttttttccgatttcttttaatcttcagcacacgtgtttttcaaatctctgagttaaaagttttcaaatttaagttgaaagtttctaaatttgagttgaaagttttttttaagtctaaattaaaagtttcaaatatagagttgaaagttttcaaatcttgacttggaagttttccggtctgaattgaaagtttcaattcaagagttgaaagttttcaaatctaagttgaaagttttcaaatcttgacttgaaagtttcaaatctagagttgaaagttttcatatctatgttgaaagtttttaaatttgagttgaaagttttccagtatgaattgaaagtttcaaatctagagttgaaagttttcaaatctacgttgaaagtttttaaatttgagttgaaagttttccagtctgaattaaaagtttcaaatctagagttgaaagttttcaaatttgagttaaaagtttccaatttgatttgaaaggttttttaaactttagatgaaaagttgaaagttttcaaatttaacttaaaaattcaaatttcgagttgaagttttgagtttagttatggcttttaattttttcatagaaagttttaaatttatttaaaggtttctttcatgtatagatttcattcaatctatcagtaaaaacaacttttgaaaaaacaaatcttaccttaattactgtcattagctaattagagtcattatctaagaatggttagttacgatagtatcgtcaagccgggaaaaaagataaggcgtagcggtgttggtctcgtgggtataaaacacgtgccgacaacacacgcgcgccaattagcttctctggacaaaagctatattatgggccagagggagtagttattgatttataaatattaaatttatatatatatttgtattacaaaacattttaaaaaaattaaccatatgctgaatgggttagttattcttccaatgggactattgtggcgacgacacagttaaagcaaaatttggtgagctataattgcaagaaaaaattatatggaggagtaaatttcgcataaaatacaaataattttatcagtctattataacactaaagatttaagaaatgtaatcataaaatagatattaatttaacatcaatcttattacaaaactactactttataacttaaaggaatatcaataatactcgacctaaactctaaaatacatagttctataataatattattactaaagctgtaattttgcgtgtttcaaaaaaaaagccgtaattttgtgatacaatatcttaaaatatagttttatgataaatttagtctaaatatgtagttttgtgatatatttatattttaatctaccttttttcttaagacacagattttatctttgttttcggttctcattatcacgcttttttaaactgctaaacgttatatttcgtgtgaaaattttctataaagaagttactctatctattctttaagtttaaaataattaaagtacaaactgatggtttgatagcggctcagctcatacaatctaaagagaaagatctttccgcactagcttacattgttaaggaggttaaacaccgagaaagggaaatagttataaagaagataccttggtcctagaaccaaacaagccatgttttagctaataaagcttgccctggacttttatctgaattttggttaggagaaacttgtaattttatttcacagttagttagttcacgaagactctttggtcgagtaatatatttctactcttccaaaaaaaagtttaaaataattaaaatttaatcaataatatgttaatagttttcttattgtacttaatttattttatctcctgtaaacttaaggggcttatattagggctgtgtttagttccacattaaaattgaaagtttgaagaaattagaacgatatgacggaaaagttgaaaaattatatgtatagaaaagttcgatgcgacggaaaagttgaatgtttaaagaaaaaagttagagtctaaacaggatcggcatgcacatacgttagttcggtcggtcgacgaacgtataaaccacgcagaggcagaagagcgcacgcggccgccgatccaccggaacaaaaaagcatattcgaccgacggattgatccatcgggcggccaagatggagaaagaagctagcgatgacgatgtccacgcaagatccgatttataatattattactgtccgcccacgcagcttaagcttagcttagctttgcgttgcttaatttgcgttgcccgccggcttgttc

SEQ ID NO: 68348 - DNA, 23061 bp, Oryza sativa
agtgtcgcccaaggtcggtttccgaacagacattgctgccctataaacccgagcccctccccaaaccaatcttccccattttcgccctcgccattgccgcgccctgccctgttcgccgtcgccgttcgtcgtcgcgcgtgtcggaggagccggcacgagcgaggacgcgtgacgtggactccgggcgcaccctctccttcctcttccccggcccgaggccagagcgatcacgccccgcgccgtcggccatcgtcactgcgccccttcaccccgcacggtagtgcctcctccccgttccccctcctcgttcctcctcttccccttagctttcggtagaagcttgtaaagcctccccgtagctagctggcgccgccctgactgctgccgccgctcgctgtgtgctcgccgccgtcgccgcccgtgcttcgtagcgcccgcacgtcgccggcctctctcgtagtgtctccgtctaatccgacggtagaaacggacaccggtggccgcgtagatgctctagtccggaggaattgaaccctagtcgcgtcgttgccgttccttcttttctcgcagccggttgccgccgccgcaatccgccgccgtcgaactccctccggcgaatccgagccgttggctcgtctcccctcatctcgtgcaaccacccggtgtgctcgatttcgcctgtatcgccgtggttcgccccgccgttcgcagccgccgtccgccgtccgttccggccggcgccttcttcaaccttccgccggcccgtgtggcagccacgtaggtgccacgtcggcgccagctcggccaagaccgggtcaagccgaccccggtccgccgctcccctctgccccgctcgcgcgcgcggtccaccgcgagccgtgaggctgcgcgtgggcccgccgcatccgcatccaccgcaagccgcgcgcgtgcaccgcgccccgctccaaaccctagcgccgcatcacgtgctcctcgctcacggtgagtcgagccgccaacaagcgggtcccactcgggaccacgcgagatggacccggcccaccggctacctctttcctcccctcccgcacgtgccttgggccgccttctcgggccggccggcccattatgctcggccgagccgcccctttctctcaggccgtgccctagccgcccgagggaagtctgtttcccctccctctttcttttctttttcgaaagggtttaattaaatcctttttcctttagaccaaaaatccaataatcttataaattcaatatcttctcaaccgtatgtccgtttgactccgttcaacttccaaaatttctcaaatcttgatatctatttaatggcacgtttagaggtcaataatagggctttattttcgccatttgttgagttgtcccgtttcgcgtgtagtttcggagcccgaagacccgcagtgcgaggatttcaaggatcaagctctcgagcaaggcaagtcacctttgatcatcttgcacctataatttaaatctaagtacttcttttccgcaaatattgcatgaataagtttaacacaagtatttcggccgcggcttgcgagatagcctaccggccccaatcctaattgttgcaattaccctccttgaattattgaacacttgaaccacctttgtcaactgttgtgcttcgatgcacgggcctacaggcacgcgcatcggaacacctcccctcaaatttaaaacatccaacgatgggtaaaacttggggttttacaaaagacttggaaaacccgacacctgggtcggtgcttgcgaactaaaattaaatttccaaaatcgcggaccgggggacgtaccgggagtacggtttcccgctcttgcacttaaggaccgtttccttggaatttcatccgaacataaggcaagtgcgaccacatgggtggaatgggacacccctggctgagtaactagctaatcgggggaaccatgatggcaagagacatgtcgattcaacggggtggtgccggggggaacccccgggcttcctggcacagtatggtgtgggacctaacctgatatcggtctgggacccctctcgttggcatatggtgaacctgtgtcggctttcgaaatgccttgtcatgaaagcctcaaggtctccagacgtggccgttctgcacgggcggggtgatccgggttagtaatgtcatgtgggtaaagtgtaccccctctgcagaggttattaaactgttcgaacagccgtgcccacggtcatgggcggatgtgaggtgattcctagcgtagtttgactactgcttgtgaaattacttttatggaatgggttcaatgtttggaaaatctgcggctgatgggatcagccaggcccgggtggccgtttgaaagccgttggccgggtgccaaccttgaatcagttcaaagattgatacattgcacatactccgaccagacgagacgcactgtctcatccgtgtcgtttgagaagcactcacttagttgtttcaacaaggagtttaaataaaaccaattgcaaaaacaacagcatttcctttgaagcctgcattaaacacttaattcccatggcttgctgagtactcctgtactcacccttgctctatataaataatccccccccccagttgctgaagaaaatgatgtggatcctgctgatgaggagttcttccaggagcaagtcggctacgatgagttttagggttttggcctagttcccaagtcacgcctgtgatgaatggtccaagtcttggcttccgctttcccttttgtaatgcagttgtgagctcagcatctatccgcagcccaacatgattgtactcctactctgtaataaagagacctctgctgctgtgatattctgtcttcctgtgataccagcactgtttcctgggactggtatcgattaacatgttaatttggagcgtcacgggctagttccgttcagggctagttcggggcgtgacaaaagatggtatcagagcacaggcttggccctagggcgaaacccgacgtttaggatgaccctaaggatactaagttcaaaaactacttgctcaaaggcttctttttgctttctttattttcagtagtttattgctaaaatggttactgatcttttctccctctttcaaaattgtagatggtagtgaacgccagcttcagttcccatagttttggtgagggtcaccacgtcgctcagcttcgtgacctcgcccgcttccttggcttctcgtgtcccgagtacacggggtactctgtggaccgtgttccccctcgttgtgagctttcggtgtacctttaccctcgtggaggtatacacggggctggcctttgcccacaccacttcaatgtggccaggcccactctccagatcgtgtaccaggacctctcctggacagcacttcgtcgcttggtccacgactacagccaccgcctcgggggctctgccttccggcagctcccacgccttccttctggccgcactgacactaggtacccttgtccgtaccgcgagcctcagcctgtgctgactcgcatggttgagctttctgaggctcaagccacccagcacgacctactccttgaggcttaccgctctggaggcccgtctggccgaggagggtgtcacctcagttgacactgcgtcttgggactcaggccgcctctgccacgccagccacctgtcttcccacagctcccgcggctcctttcgcactcccagtggcccacgctcccccagctcgcgtgcgccgtactctccagtgtactctccctaccctcacccagttagcccttcctacactcctggtcacaccccagtcgcttcctcccgccgtggcccacgctttatctgcactgcgcggaagcgtgttgttggttcttccactatgttccgctttgactacccagctcccccaccgccagcagctcgtgctgctgccggccctcgacaggttccgccggtctcttcgcgtcagccgatcgacgtctcttcgactgaggagccgactacaggaggcagccaggcaggcgaggagtagaggaggccgtcttcagcagttgtccgtgtgttaggccccttttgtgccaccgccacctctcttggagtcgtggcgaggtaatgcgtgcgtgtgtttgatgtgggtgttgtttggtagtctggttctcctaggtggtgtgcgtacagtcaagctcggcgtagctctgtgacttgtccacacccgttgtatcagatgtctttatgatttgagaaaaccagtttatgcctagtgtgtgctatctgagttgttatttattttgcttcttgtcttccttaagtgcttatctggttcttatctcgccccttttctgggagtttagatggctagccgcccccgtcgcgctgctcgtgcaccagcccgcttcggctttgaggaaggtagagttgagccagaagcagatcatgagtcagctaatgagcagtctcaccacagcaaccgttcgcaccgtaccgctccccgcaatgcagaagtcgagcaatcccaccgcagcaatcgctcgcatcacacagtttcccgtaattgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaatgagaaacagcggaagactagggcgacgaccacaggcgcttgacggcaggcacgagctagacaccaaagccttcatcttccaggggctcctcttctgggtttgggaaaaattgagcaagactgagtacaaccactgaggaggtgcggggagggtttaaatagagttagaagggggagagggcggccggaggggaaggaaaccggcgcggcgctctcgggctccatcaatggcgccgtcgagatttgcgggggcaaatccgcccgtttgaacgcgagagagggaggggaaaatggggggaaagggagagggaatcacggggaataattcccccctattgattgcacgcggggaggacgggggcggcgggattcgcggcggcggcggcgctagggcgtgggcgaggcagcgggagcggcgggaggaaggggatgacgggtgggccccacccgtcagcgagggtggcgggcgggcccgcccgtcagtggcgcgcgcgcggggagaggccggatgggccgcggggagaggagagggagggggagggagatgggccgagccggcccgagagggagagggagggaaaggggtctttttagagtttttctttttataaaaccttttcaactttgtttatttcttaataattattatttgtgctctgaaaattccactaaaatttatttacgcattttaggcttttaggaaatatacaaaaaccctctaagccttgtttgacttttaactttgcacattttaattgttggaggctttcacacggattttaattattctaggcacaatttagaggatatattttagggtcgttttgggacgtgacagtaatgcagaagtggaacagtctcaccgctctcactgcactgccagtcacaattctggtgaagaacgcattccttcgccaccccatattcaaaataacatgcagcacttgatggcagttcagactcaaatcttgcaaggtttagccacagccatagccggtattcagcacaacgcgcatggaaatggccacccccacatgggcaacaacagatccaagcagacagactttctgaggtctcgtccgccagagttctctcagaccgtcgagcccgttgaggctgacgattggctgaaggatgtagagagaaaactcaacttagtgcagtgtactcctgttgagaagacgttctacgcctctcaccagctaagaggacctgctgcagattggtgggagaattattgcaatgcacatgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcaggcctggcaatcaaaaataaacagcagcggactagcgggcctacggctccatcttcacaggcgctcaaccggggtataagccaggactccacctaagacatcttctccaaagcctctcttactgaagaggggaaatattgagcaagagtgagtacaaccacagtactcagcaagtcacaccggcagatgcatgattaatgcaagggggtacaaggggataataataggggttaagttttgcagtaaacagcatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgcacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaatcacctaatgttgcctaattaatcagcgaagcatctacctaaatttatactagtggaaccatgaatagagtacccactagttggggttttgtttattctagggtaaacaaggtaataataacaatagcaataataataaggccataacaaaggtaaataggcaaggctaaataaaacagtgataacgcgggaatttaaataaagcgataatgcattaatttaaatcaaaataattttataaactgggattcaatatgctcaaggatgatgtgacttgccttgctcgctttcccaaacgtcggcttcaacttccacgaagagcggatcttccgaagctgcagcgtctacacgaccaacggaaaagaaacggcttttactctaataaactccatataacaagcagaaacaaagcacaaaaatgggttcttgacttcttaaggaaaaattagagacttgaacggtccaattccgagttcaaatggccaagttatggccatttgaagtttatatgctatttaaatggatatttgcgaatttcttcatttaaattttaatttaaaatagatttattgcgtcagccgggagagaggagcgcgcggaccgggtccacgggagtggggcccacgcggcagcctctcggtccacggtggaccgggtgcacccggctcacaccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatggtcgccgccggtgaccactggcgcggcggagcggcgcccgagagaggggagggaagggggaagcgaaacggcggtccacggctcaccccgggtcgacggcggcgacgggaacggcgaccggagcggaggaaggcggcggcgcggctcgggtcgacgaggacggcggcgttccggcggtcggcgggcaaaacggaggggtggacgaggtcggcgaggttgcggcgaacccgaagaaggcgacgccgaaacgggaggaggtccggggcgacgacggcggcggaccggagctcggcggcgacggcggagagagagagcgacggcgcgagctcgattccggcggagagagagagcggcgagaggcggaaccggacgaagggggtgcggggagggtttaaatagagccggggcgagagagggtggccggggaagggaggaaaccggcgcgggaggtcggccgccatcaatggcgccggcgggattaggggagcggtttccaaccgaatccgagggagagagggagggaaaaatggggggaaagagagggaatcacggggagtgatttccccctctttattgcgcgcggggacggcgggaggcggcgggattcgcagcggcggcggcgctagggcacgggcgaggcggcgggagcggcgggaggatagggatgacaggtgggccccacccgtcagcgagggtggcgggcgggcccgcccgtcagcggcgcgcgcgcggggagaggccgagtgggccgcggggaggaggagagagagggagggagatgggccgagccggcccaagtggggaagggggaaaaaaggactttttagggtttttcttttcataaaacctttttaactttgtttatttcttaataattattatttgtgctctgaaaattcaagtaaaatttgagggctccttttagaccaaggagaatttaacaaaaattctccgggccgcatttgaatttttcttgtacgtattttagtgtttgccaatttcttttcgaattttaattaattctattattccttttagcgaatgatttttaattcgggatgaatttatcaggacgtgacagcacacctcgaacccactaacattccatggaatgagttcgctacagctttccgtgtagctcatgtgcctgaaagtactattgacatgaagaaagaagaatttaacaggcttaagcaaggcaatagtcgtgtcaatgagtacctaagtcagttcaacaagttggctcggtactctcctgaggaagtggacacagacaagaagaagatcaggaagttcttgaaaggagtcacagttggaatgaggctccagttgcttgctcatgacttccccacttttcagcacatgatcaacaaggcacttatacttgaggatgccagaaaagaggcaaccgaagaatataagaaacgcaagtctaaccatcgggggaattcttcctgaggcgcacctcgccctcgctttggacaacccatgcaatatcaccagtcggtcactcaggctaaccgccagccaggctatgcccctcgtcctcagatgaaccatccggcacctcagccgcagcagcgtgccccaaatggcaatactgcagcaaatagtgttacctctttcaagtcaccgccaggactgtcagcagttcagtgtttccggtgcaacctgatgggtcactatgccagacagtgccctcagaatcctaccaacttgaactcagggcatgctaatggcagcactgccagaactcctactccagcagcagctcagtccagtcctagctcgcaggcaagtggacaaggttcccgtgcttccaacaactttggtcgaggccgggtgaaccacattcaagctgagaccgcttaggatgctccagacgttgtgatgggtatgttctctgtcaactccgtacccgcaatagttctgtttgattctggagcttcacattttttcatatcgcaagcttttgtgaaaagaaacggttgtgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgagtgaaggaatacagagagccggagagccagagagagttcaggctctagaacccattcgctagagtcccaacccctttctcttttttctcctccccctttctctcctaggcctgggcctcctttttatctggtcaggggtcaccacaagggcctccaactacctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggatggggcgaggcgtgtgacaggccgcctgttgccacctaacccgcgatctgaccgatctgtgaccggtcacacaccgcgaccggtcacggaccggataagcgtgcgctgcgccgcattaaatgcggcgtggcgcgctcgtccaacttgctataaatgcggttaggtgagcccgctgtgctcacctaacccacacacgtggcgccaaaaccacagggggtcggggcgccccagccctcggggccgaaacgggagcggcccgacccctcggggagacagagggaggggtggccacgtcaccctcgggctcgacccccccgagggggttaggccacgtgggtgaccgcggctacccaagcctctagtcacgatacccccggccccatgtcaccgacagtagcccccggcgtcacgccagggcaatcgcccccctcgagggaagcgctcgggcgtgacgccactccttaggcccggtgacaggtggggccggtccctacaggcgggcagaaacccagcggtcgcaaatcgcgcgcatcggcaaaggaaaaccgaccgacaataatgagcggcctctttaagaccgctacattactcgagcagcgcgcgaatcgggacgagccggttcgtttcgcctggagacatgatgatggcgcttttcacggttggcgggcgtagttaatgcgcgcacaatctgccccatctcaaccgctacggccgcacatctgccgcgtgcgccgcaaacgggcgagtggggttagtggaggcgtgggcgcgagaaacgagggggcgaggtagcgggcgcgggaagcgaggagccgggcatagcattggcaagggtgtaaagacgccgagcaagggattcgtttctttcctctcgccactcttccccttgccttcgccacttgtgctctaactcttcgtttcctgtgccctacccttgccgcactcgctcgctctcaagcttctcctccgccggtgtcatggcacggggctccgcaccgctcgatggtagcgtgctgccgccttcccgcatcgtgagcgagaggcaggccgggctgccgcgccgattcatgccggaatctgccaccggccgggaggtggtcgcgctgggtgagggacgcccggtgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgtgagatgtttatcggggtgcgtccatctctccggctattccggtggttcttcaccgtacagccggtgtcgccgccgacggtagtcggtggctgctacttccagccgcgggggcaggtgctaaaccgctacattccctgcatcctccgcaaaaagtgggacgactggaagagcgattggttctacacccccctcgccgatgaagcgcgcttccgacttccgagccagcccccggcgcaggcctccagctggcgggcggcggtagatctgggagacggctacgacgccgttcttgaccgcctggcgggtctgcgatcccagggactcacgggggccatggtgttcggcgactaccttcgtcgccggatcgcgccgttccagcggcgcgcccagggcgcctgggagtacaccgggcccgaggactacattaggacccaccaggggcgcaaatgggactgggaccctgaggacttcaggatggtggtccaacgggtgctgaatctcagctccgtggaggcatccctcatcccccaaggggtcctccccctctgctgtgatccagagcgcgccaagatcctggccatcatgcaggtggtcggggcgtcgggggagcgggccccccgaggccacgatggcgcgggcgggagccgcaggggggaataatctaccccgggagggggtcgtgcttctgggccctgcgacgggggcccggggggcagccgccctgccgacgcccgggggaagaggaagcaggagggtacccctcccccatctcctccccgagggggcggggcggtgcgtgccagcagcaggcgcccggagggtgccgtgccgacgccgcagcccgagggggagcgaaagaagaaacggctccgcaagatgggggggatcgtgccatgccgggggaacctcatctcgcccccgaggtggtcgtttagccgacctccccgcaggttcgtccccgcgcccaccgcggccgtattcattctcccatctcccaaggcgagttttcactcacccgtttctttttgtcttctggtttttcttctgcctcagcgagatcccgtcgcgcccccccgccattccaagtccggccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggccagactccaccgggccgaggagtccgtccgggaggcagaggcggcgcgcgcacgccagacggcctgccaaacccccgacccgactccgcccgaggcgacgacgacttccgaggccacccacgacgaggccgcgggcgcgccgctcgggcccgacccctcgggcgacgcttgggacgagccagcttcgggggacgcccccgagtccggcacgtcgatcggcgggccgagccgcgcggcacccacaccgaggcggctctcccctctgtcttccgctgccccactgagcgcgaagcccttcctgcaggccttggccgccgcgaacagcacggtgctggactggttaagtgcccagatggaggccctacaggcggagcgggcggagctcgacgcggcgtgggcgcgcgtcgacaaggggcggcgctcggtggaggccatggtggaggcgggccgcaaggcgcaccgctggcacacctcacagctcgaggcccgtcgtagggacctggcggagatcgccagggaggtggaggaggagcgggagactgccctcatcgccaccgccgtgctcgacgaggcgcgggacgacctccgcctctaatacgggagccgggcggcggagctagaggagaagctcgacgccgcccggggagtccttgacgccgccgctgcccgggaacggtgggcggcggagaacgaggcggcgtcccgtcagcgtgaagagggccttgaggctcgcgccacggcgctagaggagcgcgcccgcgccctggacgcgaaggagagagacctggccgaccgcgaggccgccgtcgccaaccgggaggcaacactggtggcgcacgaggccgcctgcgccgaagaggagtccgcactccgcctccgcgaggacgcgctcaccgagcgggggcgagctctcgaggaggccgaggccgcggcgcagcggctggcggacagcctgttcctccgcgaggcagcgcgggaggagcaggcgcgccgcaatctggaaggcgcctgcgccgagaaggccgcactggatcagcgggccgctgagctcgaggcgcgggcgaaggagctggacgcgagagcgcacagcgacggggcggccgcgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacgccgtctcccgtctagaccgcgtcgggcggcaggcgggcctctggggcgggcggtacgcgaagtacgccgccaaccaggggggcctcgcccagcgtctctcagagatggccggggccctcgagcggctcccagaggagctcgaggagacgatcaagtcatcctcgagggacctcgcccggggggcggtggagctcgtactggcaagctaccaggccagggaccctgacttctccccgtgggcagcgctggaagagttccctcccggaaccaaggacggcgcgcgcgcgcaggtccgggacgccgccgaccacatcgtccacagcttcgagggtacggcccctcggctcgcgttcgcgctcgactccgacgaggagggcggtgacgacggtgcggacgacagtgacgacgaggccgacgacccgggcgcgttggagtgagcccccaggcccccgccaatcttaataacttctccttcttcttccgaggccttcgggcccccttcttgtatagactgatttaatctgcaatcaagtaaagaggaaatttctgcgtcggttctgtttgttgtgtgtatgagacgaggacggtctgtgccgcggtccttctgtgtcttggcttgaacaagggctcgtgcccaggccccagcctcaaacggcgcgtgtcggggctagtgcctggggagatcctcgtgtcgagactggccaggccgggagcgtggtgaccgagggttatggatgacccgattgtgggcctttgccgattcccccccagagttcaccacgccccggggcacggctcggttctgggccccgtttggcgattttagccggcccgggccaccgagggcagggtcgagcacgagcgtgctaattcaagccaagattcttcaaaaggaaacgatggcacagacacggtcgtcaggaaatcgaaaatgcttttattgaaatacagaagagaaaaaaggtaagtatgtgcatatggtagcccccggccaaccctgcacgcccggggggtgcggggttggcccgagcccgagacatgacacccgacccccactaggggtagaagcgacgaaggtgttcgatgttccacgggttaggcaactctgtgccgtcgcccgtggccagccgaacggagcccggccgagggacgccgatcactcgatacggaccctcccacattggtgagagcttgcttagtccagcacgcgtttggacgcggcgtaggacgaggtcgtcgacgcagagtgatcaggcccggacgtggcgctgatggtagcgccgcaggctctgctggtagcgcgcggctcggagggccgcgcgccgccttcgctcttccaagtagtcgaggtcgtctcggcgaagctgatcttgatcagcctcgcaatacatggtgacccgaggggacctcagggtgagctcagatgggaggaccacctccgcgccgtagacgaggaagaaaggcatttccccggttgctcggcttggcgtggttcggttcgcccagagcaccgctggaagctcctcgatccacgagtcgccatgcttcttgaggatgttgaaggtcttagttttgaggcccttgaggatttccgcgttggcgcgctccatttggccattgcttcttgggtgggcgggagaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtttgcagagcctgggccggctgatgggtttgcctggcgtgaaactggcacgccctgcaccgccggaccaggtcgaccgcatcgttgagagccgtcggccaatagaaaccctggcgaaaggccttgccaaccaaggtgcgtgaggcggagtgggctccacactcgccttcatggacatcggcgagaagctcgacgctttgttcccgaggaatgcacttcaggaggactccgttagccgcgcgccgatagagggtcccttccaccagcacgtagcgcttggagatgcgccggacgcgttcactcccttcgcggtcctcgagtagagtcttatctgcgaggtacgcctggatctcagtgatccaagcaatcaatctaggggagctgggagcgctcccctcgggtcccgaggcctgggctccgacgggcctcgggggccgttcaggcgcgtccgtctcccctacggggtcgggtcgcgccgacggctgggcaagcctttcttcaaaggcgcccggtggggtctgggctcgcgaggaagcgagccttgagagttcgttggcgaccgcgttatcccgtctgggcacgtgccgaagctctatcccgtcgaaatggcgctccatacgccgcacctggcgcacgtaagcgtccatctgcgggtcagagcactggtactcctgacagacctggttaacgaccaactgggagtcgcctaacaccaggaggcggcggatccccagtccagctgccactctgagtagcaacggctcatctggctccggggcgaccaagactgggggagaactgaggtacgccttcaactgagtgaaggcccgctcagcctcctccgtccaggtaaacggcccggagcatttgaggagcttaaataggggtagtgccttctctcccagcctcgatatgaaccgacttagggcggccatgcagccggtgacgcactgcacatccctaagcttactgggggggcgcatccgctctatagctcgtatcttctcggggttggcctcgatgcctcgggcagagaccaagaacccgagaagcttgcccgcaggcatgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagttcctatgggggtaatgaatgcagtttttcctcatcctccctagccatgcgaatctgatgataaccagagtatgcatctagaaaatacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcactttctgtcggaccggccttgcgcccggccgcacggcgagacggtgctcaatcacctccctggggaccccgggcatgtcagaggtcacatcgaagtccacccgctccgtgcggaagttggcggaaccaccgaaggtgaacgggaggtcgatatgacccaacggccaggtgtgccccggaaaacccaaaatttgcgagtaccaatgatagtacattccccttgtcggtgacatggggccgggggtatcgtgactagaggcttgggtagccgcggtcacccacgtggcctgaccccctcggggcggtcgggcccgagggtgacgtggccacccctccctctgtctccccgaggggtcgggccgctcccgtttcggccccgagggctggggcgccccgaccccctgtggttttggcgccatgtgtatgggttaggtgagcacagcgggctcacctaaccgcatttatagcaggttggacaagcgcgccacgccgcatttaatgcggcgcagcacacgcttatccggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcctttcttaggtagctggaggcccttgtggtgacccctgaccagataaaaaggaggcccaggcctagagagaaaaggagaggagaaaaaagagaaaggggttgggactctggcgaatgggttctagagcctgaactctctctggctctccggctctctgtattccttcactcacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcctggtgaggagccccacgctccgtcacccctagaagggatataagggcaactaaaatatgcccagaagttaaccttagaattgaggaagttgacttcctagccaaaccgatagtcctagactcgcaaagcttggacatcatcctagggatggattggttggctaagcacaaaggacagatagattgtgccgaaaggtctatcaccttgcaaggacctggaggaaagcaagtctgctttacccctaacacccttatcgcaagtcggtctatcctaaccagtttgcaagccactcctttggaatcggtgcccatagtctgtgaatatcacgacatatttccagaagagttatcgagtatgccaccagaccgagagatcaagttctccatagaattagcaccaggtaccgcaccgattgcgaaaagaccctaccgaatggcagctaacgagttagcagaagtcaaaaggcagatcgaagaactggagagtaaaggttatgtgcgacctagctcatccccttggggagccccagtgctcctggttaagaaaaaggatggctctgagagaatggtaattgactatagagccctgaatgaagtaactataaagaacaagtacccgttgccacggattgacgatctgttcgatcaacttgaaggagcaaaagttttctctaaaattgacctaagatcaggttaccaccagttgaaaatcagatctgaagatatcccgaggaccgctttctcaacgcgctatggtctgtatgagttcacagtgatgtctttcggactcaccaatgctctagcattcttcatgaacctgatgaacaaaatcttcatggaatacctggaccagtttgttgtggtattcatcgatgacatcctgatatactccaagaatgaggaagaacatgttgaacacctgaggctgataatggaaaagctcagggatcatcaactattcgctaagttctcgaaatgcgaattttggttggaccgagtagcatttcttggacacgtgatctcctccaacggtgtcgaagtagaccccagcaagtttgaagccgtacttgcttggaatccgcccaagaatgtgtcagagatccgcagtttccttggcctagctggatattatcgaagattcatcgaagggttctctaagctagccagacctatgaccgagttgttaaaaaaggaaaagaagttggaatggtcaacaacctgtgaagatagctttcaagaaatgaagaaaaggttgaccactgccccggttctcaccttgccagatatacgaaaggatttcgaaatcttctgtgatgcatcaaggcaaggcttgggatgtgtcctaatgcaagagcgaaaggttatggcctatgcatccaggcagcttaggcctcatgaagtcaactatcccacccatgatcttgagttggcagccgtggttcatgctcttaagatctggcgacactacctaatcgggaacagatgtgaagtatacaccgatcataagagtcttaagtatatcttcactcacaccgagttaaatatgaggcagagaagatggttggaactaatcaaggattacgatcttggaattcattaccatcccagtaaagctaatgtggtcgctgatacgctaagtcgcaagacctattgcaatgcagttcaagtatggccagaccaagattgtctatgcagagaactagagaagttaaggctgacagtggtacagtcaggcgtccctgctaacctgaccgtgcaacctacactggaatcgcaaatccaagaagctcagaaagatgatgaaggtataaaagagttaataaaaagaatacacgagaagaaagacaccagtttcaccatagatgaccaaggcatagtgtggtacggatcacgcatctgtgtaccagccaagaaagaattaaaagatatcattttaaaagaagcccatgagtccgcctactccattcatccaggaagtacaaaaatgtaccaggacattaagggatatttctggtgggctggaatgaagcgagatgtcacggaatatgtggctctgtgtgatatttgccaaagagttaaagcaaagcatcaaaggccagctaccgatccccgaatggaaatgggaagagatcggaatggatttcatcaccggtttgccaagaacccctagcgggtacgactccatctgggtaatcgtggatcgactcacgaaatcggctcatttcgtgccagtgaaaactacctttgatggaaataaactggcagaactctacatgacccatgtcgtatgtagatttggttgtcccaagaagattgtgtcagatcgaggcacttagttcacctcaaggttctggaagcagttgcatgaagctctcggaaccgatttaaattttagtatagcttaccatccgcagaccgatggtcagacagaaagagtaaatcagatcctagaagacatgcttcgtgcgtgtgccctggatttcgaaggcacttgggatcgttgtttgccgtatgccgagttctcctacaacaatagttatcaggccagcattcagatgtcgctgaatgaggcaatgttcggaagaaagtgctgcacccccttgtgctggaatgaggtcggggaagcactagtgtttggccccgacatactcaaggcagcagaagagcaagttaagctgatccgagaacatttgaagacagctcagaaccgccagaaaagttacaccgacaatcggagacgtgatctcgagtttgaaaaaggagatcatgtgtacctgcgggtatcacctctccgtggtatgaggaggtttgggatgtccagcaagttagcaccccgctacatcggcccctacctcataaccgccagacgtggcgaagtggcttatcagcttgagttacctgaaggtctcgcagatgtgcacaacgtgtttcacgtgtctcagttgaagaaatgtcttcgtgttccagaagaacaagttcccctgggcaatatcgagctggaaaagaatctgacctacaaagaaataccgatcagagttcttgaagaggcagaacgtcagactcgacgaaagaccatcaagttctacaaggttcagtggagcaaccattccaaagatgaagcaacctgggaacgataagatcatctccgcgccgagtttccggagctgctcccttaggtgctgaatctcggggtcgagattcttgttaggggggttggtctgtagcgcccgttccgtcgtggcgcctagcgggaaaatttaaattctaaaaaccctaattgcgaaatctgtttctttgcttgttgtcagtctccgtgccaatccctgatctcgaatccccgatctatcgtcaaattcaaatcccgaatccaaatccttcccaaatcaaattcctccgcaaaagtctattttgcttccctcaggttcggtgggccgatttcctctcggcccatctctctcgctctctctctctctccctcagctctcccctcgctttgcccgtgcgccgcgtgcacgtgcgcatgcgcgtgagccgacaccgagccgagctctccctctctctctcgttctcccgctctctctgcccgctccatccccggcaagctccccgcgcgccgttaccttgcgcgcgcggtcgccgccgtcgtcagccgcctgctgcccgtgcctgcgctgtccggcccgcgccctaccgcgctgcgctgcctgcgccgcgccctgcccagcgagccagcgcgcgtccccgagccgcgccgcccgcatccgtccaaaaaccagaggcagcgcctcccgctcccatccctcttcctccccaaaccggcata

SEQ ID NO: 68349 - DNA, 1431 bp, Oryza sativa
ccaaagtttataaatcaaaagtttatatacccgattcaaatttgaatttgaaatatatccgattcaaatttgagtttgaattcaaatattttctatatatagtatttatttatatatgtaaagtttatacacctaaagtttataaacccaaagtttataagtcaaaagtttacatacccgattcaaatttgaatttgaattcaaatattagtttatagattcaaagtttataggtcaaaagtttacatacccgttccaattctaaatttaaatttaaatatttatggcgtagtacgaagagaaaaaagagaggagggagcgacggaggtaggggaggcggatctgatcgcttgggtgatcgcccattatgccccactataagggtcaccggcaacaaggaggcacgacgatacacagcaaggacaccaggaggagagggcaacgagctcgctagcagggtcaccatggtatggcgacgtcgttgaatacggccagcgcggggggagggactgagggagggggttgtcgggtcgatgatggcaatgggcgatggcatgtcaatggtctttgggtaagggcgtgcttggttcttggtgttgtaatgtcggaggtgacaacatagtcgggctgtgtacatccattaatagatgtagagaccggattttaatccattttctaaaaaaaaaacatagtcgggcggcggtacgacgaagcgagggtagcggagtgacgagacacgaggtttccaatggccttggggcttaggaaagaggatgttgaggcgctgaggttaggggccagaggggaggatggtggaggggtcagccaggctaggcaagcctcgggccgccgaggaatggcggctgaagtgcggcatcgacggcggtgcttaagcaaaacgcgacataacagtgaggatgagcggcgttggagcaccagtgctgcggtgcaaaggggaggaagagaagaagtgggccgtcatttatagatcaaggaggatgtatgaaaaaaaaacaagaaaagcaagcaagctagcagcccagcagcagcggcaggccttgggccttggttggcccatgcgagcaagtagcagcagcgctagctaagcaatccaaggcaggccatggttagcttagattagatggacaacggtttatgaggtgacacggccgttactagcaacaccgagtgcaaattcttttttgcctcaagcgagatgatgaaaacgcaatgtgttgcagtgtaggtgtgattcaactaaatgggttttagtccaatactgtttttgtgccttgggtgttatagaccttgcctttcacatcaaggcggtgaagataaaaattatggggaaaatgaagaggatataatagagaataaattgataatggacatagggaaacgaagatgagagaatggagaataaaaccccca

SEQ ID NO: 68350 - DNA, 13909 bp, Oryza sativa
  unsure (1)..(13909): unsure at all n locations
ccgtccgtcccgcaatgctgccgcctccttgtcccgccgccccgcgtcacccgctgctgccgtctccacgtcccgcgccaccgccgcctcctcgtccggttgtcccgcggcgctgcccaccgtcgtttacagtgagagagagaggagagagaggaagagtgagagagagaagtgagagagagagagtgtgagagaaagaagagatagtagggtatgacatgtgggtcccaaattttttttataaatagaatgctgactggactgccacgtgtatgctacgtagaccaaaaccaccacggattaggttgagggggtaattcatccggtattcatagttgggggtgaagaatgttcggttttgtggttcggggggggtaattcggacgaccacaatagttcggaggggggtaattcgtactttttcctttaaattatgtactaacttgaccaaatgaaccaatgtgtaatattcatattgtattgcatacacgttctagttattaactatttttaaattctagattttagttatttgtaaattatattctcctcgtccaatattctttatttctttctgttatttataaactttattcctatatgtagtctaaactcttctttcaatattttttaattttatattctgaatttcagttatttctaaattgtactactatgtgactctagatttctatcacaatattcattattttaattctgaatttctattattttaaattgtatttctgtatgtactctagactcatctttcaatattccttattttttttaatttcgaatttagttattgctaattgtattcctcctatatgggctctatatgggctctagactctttttccaatactccttattttttaatttcgaatttaattatttctaaattgtatttctatatggtctcaattctacttttaattttattattttttattccgaatttcaattagctctaaattcctatatgctctccggacttttcattcaaaatttcttattttgatattttttttatttctaaattgtatttctatatgctctttaaacttttcttacaatatttattattcttttaattccaaatttcagcaataaattatatttctatatgaattctaacctctatttctattttttttaattcctaattttagttattcctaaaatgtatatcagtatggactctagtttcctattcatatattccttattttttaaatttttcgatttttagctcattttaattgcaattttttaagaactcttttttttcttttttttctcattaatatgagaatttgttggtcgtgagggggcacatgaaggctctttttattattactttaataagttaattaagtcaatagattatgtaataagtggatgtagtttcgtaagtaaatgtcggatttaattccattatgttaaagagaaatactgaatacagcgaaggtatatattaagtagtcccttcgtcccagaattttaagaagttttagggttgaatacgattattaaaaaagtaggtaggagtgagtggtggagggttgtgattggatgagtagtgaaggcaggtgaaaaaagtgaatgatagagggttgtgattggttagtaagagaatgttggtggtgaagttgttatattttggaataaatcctaatagctaagagagccaacaattaatcaagtagtacactcacatgggtccttgcctcctgggcacatatttatcatatccccatcacaaaccaaataactcaaaaaggccccataaattagccccaaaatcccaacaaactatccgccgtacataaacaaagcaaaatctccatcacgcaataattcacttcaccaaatcaccagcgaagccgctgtatatatatagcacctgcaacgagccaggatcgatcaaccacacacacactgacactgtgacacaacacaacacggcggcgcaacaaagctagcttcaacgcccggtcccggcgatggggtccttctcggcggcggaggagacgacggcgacggcggcggcgcggccgcacgccgtgatggtcccgtacccggcgcagggccacgtcacgccgatgctgaagctggccgtgctgctccacgcgcgcgggttccacgtcaccttcgtcaacaacgagttcaaccaccgccgcctcctccgcgcccgcggcgccggcgcgctcgacggcgcccccgggttcaggttcgccgccatcgacgacgggctcccgccgtccgacgccgacgccacccaggacgtcccggcgttatgccactccgtccggaccacctgcctgcccaggttcaaggcgctcctcgccaaacttgacgaggaggccgacgccgatgccggcgccggcgccggcgacgcgcggcgcgtcacctgcgtcgtcgccgacagcaccatggccttcgccatcctcgccgcgcgcgagctcggcctccgctgcgccacgctctggaccgccagcgcgtgcggtttcatgggctactaccactacaaacacctcgaccgcggcctcttccccctcaaaagtacacatcatcctaattctctccctaaatagcaaaattatattattctctaactaaaataggataaaattattcatacataaatattatttctagctcatacaggtttttatttgtgtgtaataaatttatattaaaaataatataagcgattgaccaaggttcaaatcatatcgcccatgaatattacgcacacgaagatgggtttttaacaaaatctaagtaaaatcagatactatatattgttgatttccgtctctttaaagatatattaggggacacatttcatagagtgtgaatgtgatattacgtgtgtagggttcaaattctgaaacagaattttcagaattttgaaaattttggtcatttcgaacctctcagtatgatattattttggctgaaatttttttattttttttaatttggcagtattttgtttaaatttgactaaaatttgttcaaaattttggaaacttcggaccgaatatcggcaccatccgatagaaatgtacagaccgaaagattaaaccctggtggggtgtgtgcgtctcctgtgtaataaaaaaaaatagcaaattagtacatgtttttacaggcgaggctgacctcagcaatgggcacttggacacgaagatggattggatcccgggcatgccagccgacctgcgcctgcgcgacctcccgagcttcgtgcggagcactgaccgtgacgacatcatgttcaacttcttcatcgacgtgacggcgaccatgccactggcgtcggcggtgatcctcaacaccttcgacgagctcgacgcgccgctgatggtcgccatgtccgcgctgctcccgccgatctacaccgtcggcccgctccacctgacggcgcggaacaacctgccggcggacagccccgtcgccggcgtcgggtccaacctgtggaaggagcagggcgaggcgctccggtggctggacggccggccgccgcgctccgtcgtgtacgtcaacttcgggagcatcacggtgatgtcggccgagcacctgctggagttcgcgtgggggctcgccggcagcggctacgcgttcctgtggaacgtgcgccccgacctcgtgaagggggacgccgccgcgctgccgccggagttcgcggcggcgacggggaagaggagcatgctgacgacgtggtgcccgcaggcggaggtgctggagcacgagcggtgggggtgttcctcacccactccgggtggaactcgacgctggagagcatcgtcggcggcgtgccgatggtgtgctggccgttcttcgccgagcagcagaccaactgccggtacaagcgcacggagtgggggatcggggcggagatccccgacgacgtgcggcgcggcgaggtggaggcgctgatacgggaggccatggatggggagaaggggagggagatgcggcggcgcgtggccgagctcagggagagcgccgtcgcgtcggggcagcagggcgaccggtctatgcagaacctcgacaggctgatcgacgaggtgctcctggcttgagagtcatagaatacaaaggactgctacggtgctctgagctagactctaccataaatgctacttttttttttcaggttataagacgtttggtgaaagtcaaactgcttttaagtttagctaaattagataaatatagtaatatttacattattaaattagttttattaaattaataattaaatatatttttataataaatttattttgcgtcaaaatattaatatttttttctgtaaacttggtcaaacttaaagtagtttgactttgacgaaagtcaaaaatattttatatcctgaaacggatggagtacaacttgttttaaaactatgttttagtctgaaatcatctttgtatgatgcacgtgcacaatgacaaacatcattatataccatgttttgttattattgtgctgctggtacacttgcctccatgagttcaataagctcttgatgtgtagcgtattattgtgttaaaacgattatcgtgtaactacggttgtatctctataagaaaatattgcatatttgccgaaagtcttctggctaaaagatgcatataggtttgtacggcaacctctcatatttttgtatgtccagatcgacagaaaaaatattttttttctccagtgtaattggaccaaaaataatctgaaagattattttttgtggatatgcgtgcgaacaagaaagcttcaatcgctgtcgagtgtcgactcgatgcttttacaagtcgatctgtacgtatagtgttagtagtattaatggttaatattgtgaaaacaaaattggttagtcatatcgcaataatgcatccgacttgtctgtcacgttaaattatactccctctaatttttaattagatgactccgttaatttttaaacacatgtttaatcattcgtcttatttaaaaaattgaccgtcattagtcttatttaaaaatttgcaaatctataagatattaatcatgcttaaattactttgagtgaaaaaataactcacaacaaaataaattataattacttaaattttttgaataagatgaatggtcacacgtgtgacaaaaagtcaacgacatcgtctattaaaaaatgaatgtagtacgagacactcgtagttctcttaattaattaggctcattttgggtgtattttctttatatatctatttaactaagttccttccaattaaaacatcgttattctgatttatagaatccatattcgctccatcaagagatgaaatactcacgagggcccttatataggttgtaggtaaatcgtaaccggccgcgctataaaaatcaagctctattttcgctatggctctcgcctgcaaaaatctaatttagcacgcgaacatcttatggagccacatgtaaaaataagatcattttcttatgcgggtctcttaaacggttgcatgagattacaggcaggcctcttaaaagcccgcctaaaaatctcacttacctcctattttcccactcaatacttcaattttcttaactcatcttccttttccgctcttcttaggggtgaaaacggagcggattcggacggataatggtcataccatatcctatacctttttttgtaaagcggatgcggagcggttgtggatgacatgcagatacggatacggagtggattatttcggacgtcggattcggtgtggagttggcgcggagtcggttcggaaacggaataatattatcggatgttaagtttgtattcaatccatacaacaaaagggtagcaatacaatgagcagtaatatgatggcaaaacaacatctaaacatggtgtcaactctctaggaaaatacatccaaaacacatccataatataaacaaccaaaaacataatataagtcctcacttcactgcattgcttaaaaataacgggcaaatgccataacatcaccatcagggacccagcaaattaacatgttcaatagtccaagatcaagatgacagtacgctaaatctcatctctaaattaatcaaattagacattgctactgacttaaattacctaaagcaaagctcatctctaaatttctaaatcccaaatctcatctctaaatttctaaatcccaaaattgaaatttcaaattagagaaagaagtcaaagaacacaatacttaatatggagccggtgggaggcgacggtggctagcaacggggagtccgggaggtagaggcgctggccgctggagagtggcgacggtggatgggacaagcaagcgggaggatggggacgacagggactggatctggaggagaggcgacgtcgtaggaggcactggccgctggcgagtggcaatggtcgttggatgcgctagcgctggtcgctggagagacggcgtcgcaggcgcgctggccgccggaggagaggcggcgtcgtaggatggcacatggcaggcaggaggcactgcgacgggcagttgacggggtagtcgcggcgctgcggcggtggcgtcgcgcatgtgcagcgccgggacagggactggcctgtgcggcgcacgtgtgtgtcgggactgtggcgcaatggtggcgccgacgcgtatgagagtgggaggagagccagcgtctgacagtgggggattaggattatgtcaacactcaacataaataggctagatgtgctggcctatttaaatgggctcaattgtgtagctttttggcctgaaacatgcggattatccgccaactcgtcattcggataatccgattcaaaaatcggataatacgcatccaccggatatcgatgataccatatccgcatccgcatctgcatgataaaatccgcatctgacgggtatctgaaaactcttaccatatcctcactccagtcagattcggagcggatcggatcggataatatccgctccgttttcacccctagctctcctccttctgtctctcacctccccttctcctcatattaattatcacctcctctcctctctctaactagccagcaggcagcggttggctcgagtggcagcgacgggcgactaggcaacaacgggtggcagcaagcggcggctggctcaagtgggagaggcgggcggcaggcgcgccgtccccgccatagatgcgcaagggacggccctcccccacccagtgaaggtggcgaggggtgacggcggtagcggcagggccatcccccacacagattttgcggtggtagtggcagaccgcacctagctagtattttgatttttgggaattttacttttttttcaaatttaatttttacatgtggacgacataagcacccacacacgaaaattggattcgaaaatcggattttcgcagacactttcgagcaaatagacggcttaaccgcacgtaaaaatagtttttggccatttggaataatgctttgagttctcaaactaaaagcaaataaatggcgcagaacaaaggaattccaaaagtctcccatacacactggcatgaataattctatagctcaggtacatgtgcaacattattagaaagaaaaaaaggtacgtgtgcaaacaaaaactagcacaagccacaaagctattttctccttttttttttctcttgtttcttctcctcatgatgttttgctatgataaccctccatccttgcattaatgacccatattaacacacagatggaggaaatttacgaaattttgtgttttggggtatttttgggaccgacgtttttagaatttttaacttttaacatattttgactgagatttgaataagcttttaccaaattcaacagggaggcccatcatcctcacgcgctccattctgaagcgtgcgaagcccatccggagacctgtccacaacagacacacacgcaccccggtttgccttagtcgccgctgccgtcctaccctctctggacctatgcccccccctctccgccctccttcaaaattttcgccatgaatgatagagtaggagcctaatgcatgccggtgggtacccttacccattccccaaacccatacccacctaaaacgggtagggtatggacaaaagatcctttacccattagaaatagggtggatacgggtatgcccgtaaattaaaagggtatagggagggtgctacccactttccccgtgttacccgtccccaatcgacctcatctaagcgatgacggcggcggcagcttcgacggcggcttcggtgagcatccggcaacagtgactgcagcctcggtaatggagaagaaccctttacaaggtactgcttcgattgactcatctgctgcttcaatttgtgaaatctttcttctgctcaaagcctcaaaccctagaagtaatcttggttgcatatgtgtaaatcttgnnnnnnnnnnnnnnnnnnnngttcttggctttgttgcatccaacatcttgctgattctaatgggagatcccagccatgatcgtgatgcggccggaagttccagtaagtggagaggacctgctgtacctgtagatgttgctattttatactgacaaccattcatgtggtatgtctttaggcagtagaatgaattttatttcaaatgagctccattggtgatattcaaagcttcgatcgaaatctagaattgcaaaatttttcacatgaatcatctgacgagcggcatgatgatgggtaatgtttctacttcacacttctagttaatcgtctttatttatttttcgtgctaatagaactccaatcttttatagtgtgtttaatgtggattttgctttagaatttactaatacagtactttcgtcgattcaattccatagagttgagggaataattgagctaggtaaatatgttagttcagacaacagaaagttcagatcgaaagtttggaaggattttaaagtgtcagtagtggatggttatactaaggcaatatgtttacaatgttctgcccatctagtcactggcaacaagaatggaacaagtcatttgtgttatcacatacgtgtttgcctagagcttcaaaagtcaaagaaaaagaaaactacttcaaaggcagaacttcctgtttttgatcagcaaagaagtcgtgatgacttttgctcgaatggttgtttgccataattatccattttgtatgtctgagtattattacacaaggtgattcatttataatctgcaacctcaatttaagttaatgcatagaactgctgtgaaagatgatatcattaagttatataaggagggaaaaaggaagatatatgaaatattggataaaaatcagagcctgaatgagtgaaatgacaggctatatgagcatgacagtacattactgatgctcattggaaattgcacaaaaaaaattttgggcttgtgcatgtcaaaaccccacacactggtgttgtcatttctaaggcaatcatagctagatcgtatgaatggaatttggatagaaaactctttagctttgttcttgataattgctcaatcaatgatgtagtgattcgggaaatacttggtatcctcttacccaagcaagcattacatttaaaaggtgaattctttcaaatccgatgtgcaatgcatatattgaacttaatagtttaggatggattgaaagtaattgcccctattctggtaaatattcgagagacaattagttatatcaacaaatccacatcaagattggaaaagtttgaattgattacccaataagcgaatgctcccaagttatctttagaaactgatactccaaccagatggaattcaacttttcacatgcttgagagaaccattaaattccgtgaagcttttctgtgatcgaaagaatgtgacaagtttttcccatcagatgaggactgggtacatgttactaaactaacagattgtttgtgtgtcttttatgaagcaactctgagggcttctggctcaaaattttccacagcaagtctttacttcaatgatttttgtggaatatatatttttctgcaagaattgaagttgagtgatgataactttattgcttcaatggctgtgccaatggcagaaaaaattgagaaatattgggagacatgcaacaagttattatctattgcaaccattcttgatcctcgctacaaattgaagtctattgagtacttctatggattgctttatccttctgaaaaagatgtgaaatttgaacatatgaggagatgctttagtgaattatttgatgagtattcaaagcaagcaacaatgcaatcctcatcagttgttgacacttcaagaaatttccaggagtgcagttcacaatcacatgagtcctcgttgagcttattttctaccatagtaggattagaaaagtatatccaagatagcaactcaagccagcaaacaacatcagagctcaatgtctatcttgatgatcctccacatcctggaatcagtgatacttcttttgacatcttggcttggtggaagttgtatggttccaaatatccaattatttctcgaatggctcgtgatatcttaagtgttcctatgtcgacagtagcatctgaatcatgcttcagtttagctaatcaagcacttgatgagaagaggtgcagtctactgcctgaaacacttgaaggtgtgatttgtacacaggattagctgagggattatataccaggtacagatctccaataaaagagtaaaatattgtattgcaattttgatgaatttgctaatcactttttttttctggagcagatgagtttttggaacagatgatagcagaagatgtgtcatttactcaagaacaagcagttgtagatcaacttgaatgaagatgtgctgtgatgattgaggcacttggatcagttgccaattactagtgacctacctagcacattgtatcaactagtcgaatatttcaaactcagtacttttcacggtctagtttcatttttaactcacttaatcagctagtagcagaaagcatatgtactcctgttattaacagcttcgttgtaccttaaattgtggggtttcatatctaattttccttttaaatgatatggctattacccaactctctttatccacacatatcagttttatccattccccaatgggtatgggtaatttagatgacaatgaatatggggagggtaagaacgagtaaggtttgaagtgggtgagggtatgggtaagcatggggatccccaaaccctccccaacggcaggtgtttaaggtctttggatgactggaggttgaagaaagcgtgaaattatgtcaacgaacgcagttgggccaggctcacttagagcagatacaatagcagactattagccagctataaatatattttaataagataaaagatgatatagaaaagtagcgggctacaaatctgtagccagctgcagcatgaactccaagacgtaatgtgtgtatgacagatgagaccatacattaatattatagtaagcaactattgtatgagttggctattagattggctatagatgaattagagctagtagtgggctatactattaaacttgctcttagaaaaggaattcccttaaaaattaggctacaggcccaaatgccacactagcccccagcggcccagcccaagtggccaaatacctaattccccaatcccccagccccaaatcccctagcagaaggcagtgagctccccgtgcggcggcgccggcgaggcagcaggcagcaggcgaagcgcgcggcgccgcgagcgcgagcagctgcaggccagtggcggcggagtctgcaggccggcgccggcgacgccacggcagcacgtgaaggaccaggcgagcagcaggcagccccttagcccgacggctgcaaaatacaaggtatgcaatgttttgtctcatactctcatgtacagattttgcctcgtgaaggataatccgcgtcgcacgtgagaaaataatcaattgtcttgtgaatgaagttgtgatgtactgatatttctcattatctctctgtttccatatgaaacttcttttagggtgtgtttgaggagaaggggattgaggagattcaaaagatacgcaaaacgaggtgagccattagcacatgattaattgagtattaattattttaaactttaaaaatggattaatatgatttttaaagcaacttttctatagaaattttttacaaaaaacacaccgtttagtcaagcgtacgcgcggaaaacgaaataatctttctccctttctcctgcgctcgaacgcagccttagagtacaacgtaatattatgctattgtaatattgtttgagacgttatgtgtttatgccggtgttcccaggatgttgagcccaccccccccccccattttttattcctggatccgccactgttggatccagtatgttgagccgccactgttggatccgaggagactcccgtccgctgctgctggtgagctccccgatttggggacttcgcgaacccttgtttgttcgtttgtttggccatggcgatgttggatggctttaggttgactatgaatttctggagtttgcggttgccaagaggggaaaaaatggtttgtttcatcatttgggctgttttgtagatgagggaattggcagttctctgcctatttttcgctattgtacagtttttatagcctgtttgagtttctgaatctctggtcttgccatcgtcaagggggcaggtggcttgttgagtcagtgtatgtagtccatgcgggcaccaactgttcgatgaattgccccttaggcaggaaatggcagtgactgtagaatgcatgcgcttggtgaactgccagccttgcattgcttccctgagaaggctattcattcgttccccctgtatcctgaggatgtgctagcctttctggccaatggccacaagaagcaggtttagttcagcctttcaatccagaaacctcagggggcaacttttataatcttcacaacccaatatgttgatgtatagtctttacctttacatgcatatttgattttttttctagaaattttgtctcaatcaaacttgaaatttcttgctcctcagttttctaattttgcttgctccaatcaagtaagttttttccaacaagttttctgtgtttaaagttataatatgtacccgttatgaactatatagtagtgatagtaaatatagctatagtaaacattatttatggtttgagtatcttcagcaatccatgaattgcgtgagatatttaaacatctttctatggaactggtgcattcttgttcatagttctcgttgaaatagcaaactctgattatggatatatttgaccttttcatagttctccaaacaatgagatgaggtcatgtttaatttcctaattttgctcaggtctacaactctaaatatgactatacttgtaaaatcgccttgacgatctccacaatttatggagtttttgtggcattgtacattggtattttcttatggtcacattcatatttacttgtctccaatagttttatttataagagatgttgaggagcaaacactgcatatctttacacttcacatacgaatatactttgtgctttactgcctggattactgcatctacttttttggtaaattcaatttcttgcataaaatggggataaagtaactgagagcttcagtagactagtacatcacaacctaggtaaatgggagaattagctactatgattctttggtgaaacttcagtttagtaaaatagagtaaccagatatatggtctatcaaatggaaacctggagagggacctccatagtccgatcatggtaattcaccctcagataatatactgtggatatataaaagttgctttcgatgattt

SEQ ID NO: 68351 - DNA, 4720 bp, Oryza sativa
taaatgtactaaactgttggtattgttgtaaacatgtgacggaataagtattgtggtattacatctatgtcgtagacagctttttgggtttgcagcaataaagtacataaatatctgtttggtgctgtggtacaacaatgtaaatagtttattgcagtgacaatgttgcactgttgcatgcatttttgttaggatcatggttgtctgttgccttgttatgccattaacaaatctagaataagtgaagcagcttaaagttatgttctcgtgctcttaagagcaaacatttaagaggtataatagcattctgtgttcaaactatattttagaacctttgcccttgcttaaatagtttctgtacattaatataaacttgtgaaataattcactaactaattatggattgatttgtttcatgcagttcactgggttaatgtgagcttcttgataaaatatggcggataatggtaatgcaaagccaggtggtgggggatctggagcttatacaatcaacctagataacttcagtaagcggctgaaggtgttctatgaccattggaaagagcataattctgatctatggggttcttctaacgctattgcaattgctactccacctccgtctgaagatcttcgttatttgaagtcgtcagctctggacgtctggctacttggatatgaatttccagaaaccataattgtcttcatgcacaagcaaatacatttcttatgcagtcaaaagaaagcaaatctcattggcaccctcaagaaggcttcaaatgatgctgttggtgctgatattgtcttgcacgtgaaagctaagaatgacagtggtgttggcttaatggaggacatagtgcgtgctgtctgtgctcagtcaaaatcagatgacccaattgttggtcacatcgcaaaagaggcacctgagggtaagctccttgaagcttgggcagacaaattgtctagctcatctgtgcaacttacagatataacgaatggcttctctgagctttttgctatgaaggatacctcagagatcacatgtgaagaaggcctcctacctaacctcatctgtaatgaaaaattttgtggttccgaagctagagaaggtgattgatgaagagaggaaagtgacacactcttcattgatggatgagacagaaaaggctattcttgatcctcttaaggtcaaagtgaagttgaaggctgaaaatgttgacatatgctatcctcctgtatttcaaagtggagggaagtttgacctcaagccaggtgcctcaagcaatgatgattatctttactatgactctgcaagtgttatcatatgtgcaattggggccagatatggaaattattgctccaatatggccagaacatttctgatagatgctactcctgcacagagcaaggcgtatgaaactcttatgaaagctcatgaagctgctctagaagcattgaagccagggaatcggatgagtgcggtttatcaggctgcagttgacgttattgagaagaatgcccctgaactactccctaatctaacgaagtctgctggtacaggaattggtcttgaattccgagagtctggcttaaacttgaatcccaagaatgaccgtatcataaaagcaggaatggttttcaatgtctcccttggtttgcttaatcttcaagcagaaacaaagagtgagaagacaaaacaatactctcttttgttggctgatacatgtttagtgccattggagaacttaacagcatcatgctccaagcttcttaaggatgttgcttattcgtttaatgacgaggatgaagttcttcctgtcaaaaaggtggaggttaatgcaaaggaggcattgccaccaacaaaggccacacttaggtcagacaaccaggagatgtcaaaggaagagctccggagacaacaccaggctgaacttgctcgccaaaagaatgaagagactgctagaaggcttgctggggttggctctggttctggtgatgggcgtggtccctcaaggtcatcaaatgagcttgttgcatataagaatgttaatgatgttccatatgcaagagagttggtcatacaagtagatcagaagaatgaagctgtcctcttacctattcatggcagcatggttcctttccatgtttctactgttaagagtgtcacaagtcaccaagacaaccgcacttgcactatccgcatcttcttcaatgtgcctggcatgccattctcaaacgatagcaatctgaagtcgcaaggggctatctacttgaaggagatcacgttccgctcgaaagatccacgacatagcagtgaagttgttccgcaaatcaaaacgttgaggcggcaagttgcttcaagggagtcagagagagctgaaagagccacccttgttactcaggagaaactccagttggcaagcaacagaaacaagccagtgagactttctgatgtgtggataaggcctgcatttggtggacgtgggcggaagcttacaggaactcttgagtcccatgtcaatggttttagatattctacttcaagggctgatgagcgtgtggatatcatgtatgggaatgtaaagcatgccttcttccagccagcagaaaaagaaattattacactccttcatttccatttgcacaatcatattatggttggaaacaagaagacaaaggatgttcaattttatgttgaggtgatggatgttgttcagactcttggtgggaataggagatcagctcttgatcctgatgaaattgaagaagagcagcgtgagagggaccgaaagaatagaataaacatggatttccagaactttgtgaacaaggttaatgatcactggtcgcagccacaattcaaggggctggatcttgagtttgatgtccctcttagagagcttggattccatggtgttccatataaagcttcagctttcatcattccaacttcgacttgtttggttgaactaatagagacaccctctcccccccccccctctgcgaggatcctccgtcgagcatctctcggcgcacgagctgaagctggtgaccaccggcggcgcgccgttctgctgcgacggctgcatgcagcccggcgacgacggcgccggctaccggtgcggcggtgcgacgtctgccacttcgacctgcgcacgtgctgcgcgctcccgccggccaccctggagaacgacatgttcgaggtcagcgcgttcgcgtttctcgccgagccgcccgcggcgcccgccgccgcgggcggcaggatctgcgacgcctgcggcgacggcgtgcgcggcttcgtctaccactccgacgacccccgacctcgacctccacccatgctgcgcgttcctgcgcaggcgcgtcgtggtgcaggacggccgccacttcgagctccgcaagcgcgcgcagccgcgccggcctgtgcggcgagaggagcggccgccgccgcaacttctgggcgtaccggacctacgacgacgacggcgaacccgtgtacctgcacatcgcgtgcgtcaaggacgaacacccggcggtgcgcgccgccggtgtgccggcgagatcgtgctggtgagctcgtcgccggcgatggacggcgtgctgcagagcgtgccccggaggagcacgccgcggagcggcgggttcgagaggttttgcaagattgttaacgtcgtcgtgagcgtcatcatcgcggtcatattcgggagtcccatggcgatgataagcgcggttgcagggcccgatggtctcctccgtgggtagggagatagtgcgaaaataatcaaaatgatatccgttgtgaattagtgcaaaacacattcatattcaactcaaattgggacgatccgacgatgagaaatttgaaaaataaatagcaatggatatgtgacgcgatattctgcctaactactatgtgtgcacacatgtattagcgctgggttgcaaacgggactatagtgggtttcttcagcagtggctagcagtgtgtctatatttcaggtgcccgaaattttcaaaaaaaatcagtcattttttcatccatcctttggatgggaatccaacatggttctcatcactcattcttcattaatggaaggttgaacaatatattattctaaactacaaaagttgaagctgatattaaagaaacttatgattcataaaagtatacaaaatcacatgcaaaaatattactccctccttccctaaatgtttgacgccgttgacttttttaaacatgtttaaccgttcgtcttattcaaaaaaaacttttataaaatgtataaaactatatgtatacataaaaatatatttaacaataaatcaaatgatgggaaaagaattaataattaattaatttttttaataagacgaatggtcaaacatttttagaaaagtcaacggcggcaaacattttgggatggagggagtaaaagttagataaaattaaagtaaaaccgaatataagaacaaaattgcaatttaaaataaataaaatttcacattgcatactatgacatacgaatgtgtgtaattttgcgtgactgaaaattttaaaattttgatacgcactgctagaaaaaggattttcgcaggcggcccaaaaccaatttcgcaggcggggaggaggaccgtcgctacacatcgactgtgaaaatagaccattttcgcacgcgggcctgtggcccccctgcgaaaatcatctaaaaaataaaaaaaa

SEQ ID NO: 68352 - DNA, 5424 bp, Oryza sativa
  unsure (1)..(5424): unsure at all n locations
ccctcccgcgtctttcaaaggaagccgcgcccgaaattcccctccattccggggggttccagattcccagcgaggaaaaaagcaaccaaaaaaaaaaaaaaaaaaacggaggcgagcgccagcgctgcgcatcccagatggacggcggatcgggtgccagcgccacccgcctcgccgaatccgggccgtccattcctccgctcggtcgggcgccccgttaagcctgagccccacccaccccccaccccggaaccctcgccctcctcaccccgcgcaccccctccaccttgccgccgccgccgactcgccggggctcgccgccaccggtggtgggggggagctcgacctcctcgccccacgcgcgcatccggacgccgtcgttctgggcgcgggagagatccgtccgtcgccccccgctgggcttgcgccatcctctcgccgggtaagccctaggtttttttttttttttggtccgatcgattccgccgcgctcctagccgcgggtgaggcaggaatcggggtggttgcggggggctcgtcgtgcggtcgagggatttggttgttcctagtaggaggggttgtacttgttcatcccgtcgatccagtggaggcgcgtgggagatctcggttgggggtttccgtgggctccgtgggttgccgctcgcggtgcagcggcgggatgtggatggggatggggatggcgtggtgggccgtaggtgcgagcaaccctagacggattttttttttgtggccattttagggtttacgggaatggattttttttttaccgaacaagagatgtactctgaaaattgctgtcttttcgtagcgaggggcctataggatcattgaagccttagggacttagggtttgggctgcttgcagctgtatttctcatttgtaaacattagacttccgtgtctgctgtgggaggatgaaagaattgacttgggagctgagttctattaggttcactggttttgtggagtaatgtttggaaataatctgagggagtataaggctgctccatcgcagtgccacgtgtagcattcggttcgaatttttcatttgtgtaatgtttcttagcagttactttttattttggaagttggttctcccaaaaaacttgtgtcctatctggtttatttgaaggtatcttaggacaacaagacgattagatgcaaaagttgaaagtaggggcattaacataaaccttgttgggtgcagaatatggtaattttatacgtattaattgcgtacgtaccgtttccacaaaattgttcatgtagtaataaataactgccaaagaaagctgatgtgactccatgaatgaatgtatactacgctatatctgctgtattgattgctgtagcaatccattcgttttcagtattgtgctggtgcattgtttgcaaaagcaaatcatatttattaatttttcattattgagttgcagcttgcaaatgtgtatgtatgtacatattgtgagagaaagtaggcatgtctgaactctcaacatgattattgtcataagaaaaatgttatcgttgtttttctctctttttgggtaactgtttgtgtttatggttataagttctatattataaatttgttcaggctggaattaggctgaccaaatccttgttttgaaattcgaattatattgatatatatcttgtacggtcattgcattttttattgttttgctttataactatatataggctggcttcattacgtactccctccgtcccaaaaaaacttaacctaggcaaggatgtgacatctcctagcacaataaatctggacagtcctttgtccagattcgttgtactagaaaatgtcacatcccttcctaggtttagtttttttgggacggagggagtaaacttgtctatgttaaagtttggaatatccaaaggtcctcaacctagtatgtactattttcttgaccttaacatggaactatacatgacctttttttttcctattttactgaataagatgattgtttgtttgcggtttcctaaatgtacttaactgttggtattgttgtgaagatgtgacggaattagtattgtggtattacatctatgtcgtagacagctttttgggtttgcaggaatgaagtacataaatatctgtttggtgctgtggtacaacaatgtaaatagtttattgcagtgacaatgttgcactgttgcatgcatttttgttaggatcatggttgtctgttgccttgttatgccattaacaaatctagaataagtgaagcagcttaaagttatgttctcgtgctcttaagagcaaacatttaagaggtataatagcattctgtgttcaaactatattttagaacctttgcccttgcttaaatagttttatttataagagatgttgaggagcaaacactgcatatctttacacttcacatacgaatatactttgtgctttgctgcctggattactgcatctacttttttgttaaattcaatttcttgcataaaatggggataagttaactgagagcttcagtagactagtacatcacaacctaggtaattggaagaattagctactatgattctttgttgaaacttaggtttagtaaaatagagtaaccagataataggttctatcaaatggaaactggagaaggtacttccatagtcgtatcattgttaatttcaccctcagtataatattagtgttgaatatatgaaagtttgctttcgatgatttcaggtgatttgagacaatcaagatggctttttcatcagttttcaggagaggaaatgtcaaagaattgatctcaaatgtttcggtctacactagcgcagcaggtaatggctttggctttaggcagtctgagactcttgactgacttgagtctgtatttgtgctattttgaataaggtgcttggctgtttgaatgacaaaatatacctcattgcagagtcatctggaggattgagcttgatttttaagcgttgggccaccaaaaagacagctggatcaacaaaaaatggccgtgactctaaccctaagtatttgggtgttaaaaagtttggcggagaggtacaatcttgtgatctgtcatatgactttcatgtttttttattgtttatgacagcacaaagtactttctttaatcacgtaaaagtaatcagacttcggagatttgtgtgtcccttctgatcccgtacctgaactcctgaagcaacttgtcatttttgttattagaacaaaaaggtgaaaaagatctaaactgttcctgaacatcagcatttgcatcatttttcagaaagtggagccaggaaacatcatcatccgccaaagaggaacccgcttccatcctgggaactacgttggcatggggaaggaccatactctcttctgtctgaaagaaggacatgtgcgattcgagcgcaacaagctgactggcaggaaatgggttcatgttgatcctgttgctgggcatgtgctccaccctgtctacgccagtgattcgacccctgcagctgaaatggagccattgtaatggctttacatggaatgaagtaacatatgttgctgacagctttcgtccttgccttgagagtgacttctctaaagaaacttattgcgattaagaggcttctgggttgaatttgcttgcaataaggaacctaaccatcatgtttagaacccttttgtttttggttcttgctgtggcttaaagttgtttgttttaagtatcctttgtgatttgtggcatgaaggttgacaaacctacatgatttatgaacacacagaaattctaaaaatgttgcttgggccgggaaagtcaagatgcttatttttcttcgaaatacctatggaataacctatgtcacgggaatttgagagaactactttgtaggagggttaatcctttggcttcaagagtttcacatgattgtttttcatatatgatttaaaatattctgcaatacgtaggattttcattcgaattgattcagtttctgcaaaagtcatctagaattcgtttggttcaaatgaagtatttctttgttgcaatacatactcttcccgcccaatcacccaatgatccaaaggaatatatgtgtgagcacttcctttattgaagtatagtatcggttgttttaattccaactcttcacattttggaatctaccctggaaatggctattttgaaagttttactactattttattgtcatgttataacattacatagagttaatttatcggtcactccatcatctttttaataagtttttttgaaagctaatacttaattacctgtgcattactctatcgcttcattctgtatgtagtggaagtgttctctacccaaaatgatataagtacgtcttaaaacgccatagaaaaactggttatctttattacaacccaatctttttgcttttgcttatacttataagccaaaatttaaattttcaaccttaaatttggagttgattttggggtttttcatcaaagtttattttttattttttgcttttagatcactaaggccctgttcgtttcttatgtaaggagagggttaaattgtgaatactcgtggcacgcttttaaaactgctaaacgatgcgtttcgtgcgaaaactttctatatgaaagttgctctaaaatattagattaatctatttcttaagtttatataataattaaaactcaattaatcacatattattaccacatcgttttgcgtgaaacacttaatctttatcttcatcttcatcttcaggagattcaaacaccacctagaaacacatatataaaagttttgttcacaaattatttttcgtttgcaaatatgcaattttgcttaggctgtgtttagttcatcgcaaagtttagattttggttgaaattagagatgatgtgactgaaaagttatgtgtgtatgacaagttgatatgatggaaaatgactgaagtttggatccaaactttggatctaaacacagccttaatccccaaataagccaaacgatgggggccttagtttgttcaacgtgttaaaattaaaaaatatatttacacaactataaacataagcaaacacacacacaccacgttaaaattccgagagagagagaaccgatgcgaaaagagcgatcccctcccgcgtctttcaaacggagcccgcgccccggattcccctccattcccgggggtttccagattcccagcgagggaaaaagcaagcaaaaaaaaaaaaaaaaaaaaaacggaggcgagcgcgagcgctgcgcatcccaaatggacgggggatcgggtgccagcgccacccgcctcgccgaatccgggccgtccattcctccgctcggtcgggcgccccgttaagcctgagccccacccacccccacccccnaaccctcgccctccttaccc

SEQ ID NO: 68353 - DNA, 21612 bp, Oryza sativa
tactcattactgtggtcaacgcttacgtctgaagatagacaaccacccgagtattatacactctcattaaagcttttaatttgggcttttgtccacattgcgggctaaaagaaatcagcaactctacttttcaactttgtgcttgtaaaaataacaaactttgtgcttgcgttgtttttggttagctcaattctttttatatcaacttcatgtaacacctgaaattccatttacaaataacttatatatatagaaagttagagcaaccatgtgttcagtttgttactagctagtagctaatagcctatgcgttgcaacgaactttctaatagaagaaagggttgtcaatactagtaagtcgattacacatgtaacaccaaaacaatcaacacttctaggatttctatgatttttctattatacaaacattcattagtcacatgtccttgatataatgcaacgagttataattgtatatacaatttatataaaaagacatgactaattaaatgggcttactactaggtgggtggtggtggtagaaccatgaccaccactaccttcttttaatgtagtatagaatttggctcggatttaagttagtcatagatttttagtcctcatgtgaaaaaaaatgcttacaaaccatagactggaattttttgaaacaaaatatgttatttgtgtaaatatcggatagatatattagtggtttttctaacatgtgaaataaaatatatacaatacaatatataatcaacgacacacaaacaattataagttttatctaggatatttccactacatagcaccagccacacccacaacgctagcccttcgctctttttccttgaaggttaaccaaaagaaaaaaaaaacccacatcactccacgcggcaaaaaaaactcacacaaccgcaacacacaagcagcagaggatgcagtgcagtccgttcactgacacgtgggccccacagacccccgggtccacgtgccagtgagcagcactgaagcactggagatgatctccacggcaagcagcagcagcagcgcccgttacctcctccccactgcggccgttttcttacaaatccccccctataaataccccaattcaccaacgcccccttcttcttctccaactccctccccctccaagaagcgaacaagccaagaactcctccaactccgccctccaatggagctcctgagcggggcggcgctggcgtggcagcagtaccgcgccctcctccgcaagaacgccacgctcacctggcgccaccgccgctccgcctccctccagctcctctcctcgctcgtcttcatcttcctcatcttctgcatcgaccgcgccatccgctcccgcttctcctacaccaccgcctaccgcaacgtccccgacccggccgccctcgtcgccccgcccatcccgccctgcgaggacaagtacttcgtcagggagccctgctacgacttcctctggagcggcggcggcggcgccgggagcgcacgcgtcgccgggatcgtcgaggccatccggaggaacaaccccggcaggccgatccccgccgagaaggtgatttgtggatttagattcatcttttttttctgtacttgtctctttgtatctatgtggatttcggttgggaatagaagattcggttttctctctgttcttgtagattgggcgcgattggttgtgtgatttgggcatgcaggttctggttgattagtttgggttgcgagtaatttcgctcaagcacgtttggtgtgaggattttgggtttttggtggagaaagatttgctctttttttttgggcgtattttgtggtggcaaaacgctatgatacatactgaatttgggtatttttattgttagtggttagcctcttgaaagaggggaattcgaagcattttgagggtgtatattgtatcttaggcacgtctgcttcttcggtttctgcatttctgaattatatattcccctattcctgcaaatattcttttagtccttcgaactggttgagtttgaaaccttagcatgcgtgtttcacagccagggagagatgtacttgtgaattctgagcaaaaatttgatattgagaatttgaaaaggagagattgattctaattcaaactcttttttttttaaaaaaaataaaataaagcgaagttctaataatctttaattctttttggagcagacatgccgatttgacgtttaactgagatagtctgaatttgcaattttagtttgtcatttgttccgtgtggggatgtcagcggtaagtactcacctagatggtggaccttgcgaacttttcaaagaagtatgaaaacgatgtttattttgttgtcaacgtggattaggaagcatcggagttcactaggaacatctaacttcatttaagcttgtcgtaagcacacttgatgtcattttcgtggtatggtactagtgcgtggcttcttgatacattgcgtataaagccttgtcttgctggaaataaagatggtcgcattgtgcgttggaaatttttaccgggaatatactaattcttttttttttttgggagaactaccggttgattgatacaagtacacatttaagtagtgttggtcttttgtataagaacatgcatacttttcttatttcctaatgaatattcaaattatgatgatctgagagtaaacgctgaaattctgctgtctaaaacttacacaaaatttatagaacttcctgtttgcgtgaggatttgattacataatttatttgcgcgccttcatatatccattcattaccaatcgacataagcttggctttagtggtactggtaaactgcaaacgcagtatgcactagtagtttcttctatactgcttaaataagattcatgaccccagaattattgttacactgaacatgtcgtctgactgtttctgctaaatttctcaggtcttgggttttaatactccagatgaagttgatgcttggcttttccaaaatccaatgcgctgccctggcgccttacattttcaagttataaacgacactcagataaagtatggtattcagacgaactccactccggtagctcggagaggaacatatgaggatcctaccttcaagttccagataccacttcaaattgcagctgagagggaaatggcgaggctgctgattggaggtattgctacttccatgccttttttgttacttctgtgctttgtacttggtaccacttatgtcataccctttgacatcaattccggttgttcagtaattcatgaagccttttgactagattaatttgaactatttatggtatgctgcaaaaatagttgttagctgtatgtatgcttctgtttgatagttgtcttggcaaataacagtatatatttatactgatgaatgtgacagacccaaattttagctggactgtggggttcaaggagttcgctcacccagctacagaaaccttctctactattgcccaagctgggccaactttcttccttgctattgctatgttcggattcgtttttcaaatcagtgcgttggtgacagagaaagagcttaagcttcgtcaggttcgagctcccccatactctgcctgtgttgtaagatttacatgacaccactcaaagtttggttaataattgcaggctatgtctatcatggggctctacgagtcagcgtattggttgtcttggttaacctgggaggctttcgtcacattactttcagcacttcttactgtgctctttgggatgatgttccagtttgacttctttctgcacaataactttgggatcctattcctcctcttctttctcttccaactgaacatggtaattttgacatactaaccatcagtctcctatctccatttaaaatgttaaatttagataataaaaacatgcttgcatggttggtttttacacatttcctgattcctgttacaacttgcaaaagaaagaagtttttaacatattgtcctcattcatgatgcttgctgcagcttagttttgccttcatgatatccacatttgtaacaaaagcagcatcagctactactgttggatttgcaatattcattattggcttcttgacacaagtaagttttctgaattgtaatactatggatccagtacttcaatttctcagaacaagtgtgtgaattctttaattttcttgttgtgcagcttgttacaacctttgggttcccatattcaacttcctaccagaagtactaccggacaatatggtccttgtttccacctgatgtttttgcccaagccctcaatattctgggcaaggcaacggccactcctgaagacaaaggaatcagctggaatcagcggggacaatgccaatcttttgagacagattgcgtcattactattgtacgtacgaatcattgcttattggatattatgttcttaaaccttatgcaaatatcaatctgaatgttcacaacgatctcataggatgatatctacaaatggctcatctccacatttttcttgtggtttgtcctggcgatctactttgacaacataattccaaatgtcaatggtgttcgaaagtcagtgttctactttctgatgccttcatactggacaggaaaaggaggaggaaagttgcaaggtcaggactgtttgaagttcttggtagttctggacaatgttctagctatagtttcttgcattacttgctaatctgtatgctccattacagagggaggactctttagcttttttggttcgaaccgcccagctgatgatgcttctcctactgatgaggatgttattgctgaggaaaatctagtaaaacaacaagctgcaaacaatgaagtagatcctggtgttgcagttcaaatatgtggtttgcggaaaacatatccagggagttttagtatgggttgctgcagatgcaggacaactaaaccgtttcattctgtcaaagtaagtccatatgtcacttcttgttgtgtaaaacatggaagatttgcttattctgattactgattacaaaaaattctccagggtttatgggtgaaccttgagaaggaccagttattttgccttcttgggcccaatggagctggtaaaacaacaacaatcagttgcttgactggaatcacaccaattacaggcggcgatggttggtatctttcttaaaagcaaaagcttgtatagttgtattgttttgtaatatctaataagccattttgaacattggcagcgatgatttatgggcattctgttcgaagcactgctgggatgtcgaatattcggaggatgataggagtctgtccgcaggtaggtgctttaaacattgttatattactgatgcatgtgaattgatcaaaggaagataaacattcgtgatttatttctttgcagtttgacatcttgtgggatgcgctaacagctaaagagcacatggagctgtttgctagcattaagggactgcctccatcaacaatcaagtcggtatgtttctttagaactgattacacgtactcctccctaaagcacttaatttaattgtcttgcattgatcttcctctgattgttcaaccaatgcaggtagcagaacaatccttaatccaagtgaagctcagccaggcagctaatgttagagcaggtagctacagtgggggaatgaaacgccggctaagtgttgcaatagctctaattggtgatccaaaattggtctttcttgatgaaccggtaaagaccgccaaatttgctacaaacttccttccaaacatcccttatcatgtgctgatctaacaatgtatatcctacacagactactggcatggatccaataacaaggaggcatgtctgggacatcatagaggaagcaaagaaaggaagagctattgtcttgaccacccattccatggaggaagctgacattctgagtgacaggatcgcaatcatggctaaagggaaattgcggtgcattgggacttcaattaggctgaagtcgaaatttggaacaggatatattgctaatgtgaatttctctggaaatggtcacacacaaagccctaacatcaacggcaacactgaagtcccggttaaccctaacatagaatctgtcaaatggttcttcaaggaagtatgtggctcatcactaaattctatatccttcaaaattatcttttcatatagtagagctggaaatcatgtgaaatttattgacagcggcttgatgtggacccaaaagaggagagcaggacattcttaacgttcgtcatcccccatgagaaagaaccacttctgacggtactgcttcctcacccaaaactctggctgtcataacatcatgctttaatttcatgataggctaatatattttccattaagcagaggttctttggggaactccaagacagggaacgggaattcggtatctcagacattcaactcggcctcacgacgctcgaagaagtattcctgaacatcgcaaagcaggcagaactggagagctctactgctgaaggcaccctggttactctgaacctatcatcaggttcatctattcaggtttgttccttagtacccctaagaacaatgctgcaatattggacatgaaaaggataatctcactgctatgtagagaacttctgtacagcagcaacagtacagaaaactctgaaacttgctgctatgctgtaatttgattgtgtgatttcttcagaaaactctgaatatctctttgatatcacttccattttctatggcaatgcagataccaaagggggctcgttttgtcggaattcccggaaccgagtcggaggatcacccaagaggcgtgatggttgaagtttactgggatcaagatgacaatggatcactctgcatttctggtcactctgatgaaatccctgtcccagccaatgttcagctgggtcggcccccttcgctgtctcgtagggcctcagtgggccgtggaaaccctgttgggtacatcattgatccgaatgaggtcacagcagcaagatgagtgccaaagaaagaagaatattctgagagtggatgaatttagatttgtcttcatgtaaattatctctaggtgtaatgcaactatagatatgtttgtactagaacagtgtattttttctgttttgtggtaaaggaagtgcttgatgatagatacaacatgcttacatcttccatttggtggctgacaaagagcttgacgattacagatgcaagaatgacaggaatttttacagtgatttaatttgttgcattcaggacggtaggatgtctggggtccttgttttgtcgctcataatttattttttttgttcatgggtgaagtatataattatcaatcttattgttttagaaatataaataatgtgctcattagatgcattagtgcattgttcctgttgtttatacatatcataccatagggatcgtacggtttctggttcccacggccacgatatatatagcttctgccaaattgagtacacaaataacacttactaaaagtattctgaatttctatattgcttttactttgtttgtgagatataaaaataacaattttatattttttggaattatatatttttatttcttacaaacaaaatcaaatttgaacaggatttttttacttggttacaaaatatcatcatatctacatttgtgattttttttaaaaaaatttagacaactttttgattggtgtttgcacgagttttcacttaaattgagttttcatcacatatttaccccaaagaaattatatacgattaacatttgcgacacttaaccgaagaaacagctatataagctagcttaaagttttgcaatctgaaattactgatcagtgttcactgtttagtaccataaaaaactgatacgtcagctattatataatctgaaagtacatacatggatgatatatatgtgcacgttatatctgaggtaactgggcaatagctagttacaaattacaagttaacttgggtgagggattaaattgagatcccagattgcgtgagggcaattccacttctttacttcaagtttgttgattgcagttcatggaatcaaactggaaaatggtaattgctcattcaggaatcagggctcatgagtcatgacctgggctatctgaatgcatatccaccgacgaatcatttgatgctgcaggatccgagtcaccgtttccagggcaaaaaatgccatctgcaaagcatcctgtgtcaccgcattgctgtacatggtacagttgcaggttttgccggacagggctggatagcgctttcgaaaatatcatagagtccttggaagggtttgatggtgtgattgaacaagatggcggctgctgcgtgcttgtgttggggatgtgcattggagcttggagattctggaatgcgtgttgcgatctcggtgaagttaatgcattgtcacctccatactcaatctcgtgctacattcaagaaaaacccataaacatggctacatgggtaaggagtaaggacaggagctattaatgaaatgtgatgaaatatcatcgttcataatactacagcctagctgagaggttcagtgaacagatcatagatgtgaaagtgaactatatgtagtacaataagagtgtgattagtctacaaatagaaatctggacctggatgtgggatgctatgtcagatactgtgagcctcaagccaatttcatgctgtcgcaccatccactggtagagtttttcctgaataaaacaaaatggctgcacattattaccaagcataatctatcaatctaaacaagagcacgaaaaatgctaagcaccagtatatgcaattgggtttgtgcatcatagcaccaattattgtcctgttgtatggacacaatccctgaggattgatttaaacaactaaaatacttgtctatctataccatattaacacaaatgggggaccagatgactaaatcaattatgtatttggtactgtgccaccatcacttaagctttttgtaaggaacaacgcattcaagtatgccaaattcattacacaatatcactgtgtcctcccatgaattactgcagcctgttggtgaaccaaaaagtccatcagattttaaatctcaattggtgtttcagtaggcaatggtagtttcggtggtattgcctcttctaagtcattcaaaacttataggagaagattgaaccacaaccaaaatgaactaatgcacaataacagaacatgtagtacaggtggactagtttagcacaagttgatgaaggcaaacttgtaaaacttaaagagcactcccagcaagctgtcttacagcaccaaaacaattatagctaaaatctatcacaggggggataattttggctaatcttccaacctagaatttgcttattgcaatgctttaagatgagaaaaaaaaacatgccttttaagattagaaaagcatacctacacctaacagtactactttttaattgtgaacaccaaacaagcaaaaggaaacttgtcaaagatcctttagaaatagtgtagaaggaaacctgtcccatacgtttctctattatgttctgtacgccaatccctttttttatctctttattactattagcacaatctaacttctttcttttttttgaacgacaagagcacaatctaacttgtgtcttggaatacagaattgaaacatttccacctaagtttgactaactgatggtaaacaaattcacaacaaaccacgatttctgcaattaaacgagaataccaatgatgaaaacaaagatgcatttaggtttcagtcatcatgaagtagcgataaactgcaatttcagatggtgtgatgacgcccacacaaattaaaagtgtgaattaactgagcaaaatttgcatcaagaaacaattgttgtcataactcataagtggcaactaaaaccaaacatgaatagcagtgaacaccaaaataaaaaatctccgcacaatttcaccacagctgaagacagaatatagcaaatattgcagctttatatgcacagaacctagcaaaaaggtgaaaatcgagagttcaattctccacaaaatgtaagtagcgaaaacaaaaattctgaagaaagaagccccacgactcaaaatgttcagcgtcccacccgcaccgcaacaccaaaaatcttaagatccaagaactgaaagaaatcgaggaaaaggggccaaaaaaacaaataatctaatctctcgattgcaaaactgaccagaagttcacccgactggaaagggtgggacttggggagggggcgattttagctcggggcgtaccaaggcgtggcgctcaccggcgtggaaggagaggcgctggtgggcaccggcgagcgcgtagagctgcgagagcgagttggcggcgccgcggaaggcgccgtagagcgcccggtcggcctcctcctccgccgcccgcgccgcctccgccttccgcttcctccccgccatcccggaccgacgacgaccacccgagccctcgggattcgggattgacggcggcggcggggagagggaggaggatggaatcctctccgcggcgcgaggaggaggaggaggaagacgacgacggcgagggctacgagcctatcatgcgtgcgtcgctgccgcgtggggcccactctctcagaggagtagctgtagctgccattggggctatttggagtggagaggttgggtgtgctagcacgtgggagcggagagagacggtagttgcactgagcgctgggtcccttcgatgtgggcccacatggcagtggcgctaaggagttccccgctggcggtgatgtacggaaacggatagcttagagcatcccagcagtccacataaaattgatcctccctgttcctatttgggttttttttttctcgcacgaatttcgctcggttttttttttctcgcacgaatttcgctcttttgttttgcacgacttttttaacaaacagtgcaaaaaaaaaccgggcgctatttccaattgggggcgacgtaggaaagtttctgggcaaaaacaccttgattttttataatgggtgaaggtaaagatatagatattcctatttagattaccttcggaaaagattttctcttcgtatctcttcttacttcaacaaattatctatattatatccatcatatcgcaccctcctatattttaacaatatctttcaactaaacaaatatactctattctcacatctctcttcctctctcatctagctccttttaccaatttctcctcctctcttctacttgtactccgagaggatagggagaatgaggggaagggagaggccggcgcggctcaatgcaggtggcataggggcaacatgggcttggcggcgtagggccgatgcgggtagatgcggctcggccaagggcggtgatggggtcggctctagggcatgcgcttagggccaatgtgggtacatgtggcttggtcgtgggcggtgctcaggtcgacacgcgtgcggcgcacggttggaggtgccgcgaatggagcttgtctgtccgcgacgaccacatcccttttcctagaaaatccctcacgtctacatttggtacatcatttcctagtcccggccgccattgccaccctagtcgtcgtcaaaacaagtagaggagaggaggaaggcatcgatccggatgagggtgggagttctgtttagacgtcaacagttgtggggtagcgtgaggagagatgaatgctaaatttgatgtttctctctctaggatggaggatacgctaaatttggagggtgggatggtgtatctgctggatcacgtttttcttctcctaaccgctattttgccaatcgatgtctggatggcatatctgctaggacgatactcttaggacctgtgtaaagaaaggaacgatgtaaatttttagtgatattaattaaagtgtatatagatctttcagtggtataaagctagacttgtaaattttggatatcatggaaccaatttcccgaagagaaaataaatcaatttctggtatgcagaagaaatgttatcatagacaggcagcgtataggtcccgcctagcgttctccacaagcctatctccttatggaccccctatggagatccagaggggcattggagaaaatcgcttttgtgctagtggttgcacatttgtggacggttggctgggggtagacccttggttgagctacatacactgaatctataaatggaaaaagtatgaattacccccctaactatcacgttagtatgaataaccctcctcaacccaatccagagcggttttgtcctatttggcgaacgtgtggcaatttagtcagtatttttctttttaaaaaatggtgggggtccacctttcatatatactctctcacctctctcttgagagtgccattgggatcggcgacccagtggccaatgatgggcagtcggtggaggcgggtggagcagcgtagaggctagcaccttggggtggcagtgaagtccaggcggcggcctaggatggtgatacatggagcagcgtgacagcggtagagagtggtccatggcagcgctgtggagacgatccggtggcaggcagaccccaccatatttttaaaagagggggaaaaagagatgcgagagagtatgacaggcaggccccaccatatttttaaaagaaaaatatcaccaatagttgagatttagttcagccacgtcattaaaagttgtaagcagctagattagatcatgatcatataattagccgttcgatcatcctgtttgcatgtccttcccttacgtatgatccagtaagtatagaagcaataatttcacaaagaacattaccctggcaaaagagaaaaaagaaggctagggtgtgttcatatttagaagaaatatggatggggaaagactgcaggtctagaataatacaaggcaaactatgatgccattgaaatccaagagaattgtaaagacaagttgtcatggtgcttgataaaagatggaaaaaaattatgtgaaatccttttatgaggctttcaaattccaatgacaaatttctatcacaaaaaactttggacattcaagattccgttgaaattgaggttttcctttggttcatacataagatagtataataaccaaagacaatctaaaggcctgatagttttcccagtcaaaaaaaaaaaaaccaaagacaatctaattatagaggagaatgggcaaaaatggataaaaggaatgcctgtttggagaagcttccacttctgcagcttcttccataatcagaaacttcctcaaatagtatagcttttggttcagattataagaagctgtagttatagaatctagaaagtgaactaagctgggaaactcagcttttctagattctcataaactagctataacatctagctgtttctcagaatcttaactcccccaaacaggcctagaaaatgtctgtttcttgacaaggaggaaataatacaacatcttttcattcaatgctcaatgacaaagattaatcagcaatgtagtgatctgctcttttaatcgttaactaattccgaacatgtaatacttcttcgggccgtactttctgaatgactttaattatgaaatgaaacaaatatagtgatgatagtgggaccgtgggagtggctatagttattttgcctatctggaaattcagggaaaatttatcctaaaagtcccactgaattaatattgtttgcttgcactagattaaaacttgggctatgttgtagacatcggaggaaaaggccaagaagactactatatgggagcccagtttctaagctgagttcttttgttgtccccaactcatctctacacgtgcacacttttcatactataattgtacgttttcttttgcaaaaatagatatatgaaagttgcttttaaaaaaccctatgaatccatttttcaaaaaaaagctaatacttaattaatcatgtactaataagttgcgccgttttatgttcacaaggaatgagttctcaacaccaagcaacaaactgttgtgttctttagccaaagttctcgactcacttttctcgtttctcatgcgcatgttttccaaattgctaaacgatgtgtttttaaaaaggtttttatgggaaagttactataaaaaattatattaatttatttttaagctattacgtctttaatcatgtattgatccatcactccgttttacatgtggagtggaggggttcctaacccctccaaaagaaaacagggttgagttataagtgaaatctccaacccgaggttaggatggaagaatggcacaagaagactagagtgaaaggaggatgatgaacaaattaagagctggaagttctctaggaaagtccgtgtgcaaacctttttttttatgtgctgttcaatgcttttgtccctgtttttttagtactggacctactggtgatggtggtatgacatgctaaacctcttgccaagtccctgatatgcttcatatgtggtcaagttgagtgtaaggtcgttctgtatacgaagaactatcttatctcattcccgacaatggaaatgggggctctcaagtcgttgataagaaaaaagagtagtagtgattgttgatttgtggcgtagatctccaattaatcgtcttcttccttaccattacagaagattatgttatacatatataatttgataatgacaaattctttccctgcatacttaatgtttgatgagatgcaatcagttctctttcttctctcttccactgaccatctataaaaatcaatttgatagtatcatgtgaatgcatacagagtacggttctgatgtccatccgaacccttctatctaccaattcattgggtcgcaaatgcaattgatacatctgccagccaaaaccttcatggttgctgggtgaaatcacttctatatatgtggccctctaagctctgcactggtcttcacatttctgatatcaaagatcaaactgatctggctctagttccttgatcatctcatacttggatatagccacaaaagaatgccactctgttgtgccaaatgtatttgtccattactattgttctttagtttcttatgttcttcctaggtcaaacttctctcatgtatgggttgcatttagtacttcattccttgggaatgggaagaaccaggaaagccagattttgatgtaaaaaacttgaaagtggtactaccgaagtgccacagtcaagccaggttgtcaaaggtactcctgaggtgtacgctgcagttgcaaatagaatgcctgttagctggtaatttgctatgatcaggattttatctttttattgagtgatcatacagaagatgatggactgccgtcttctctctctactagactcccaggtcatgattattgcgacttgtttccccatgactgtgaaatatatattaatcgcccatgcacccaactaagagtttatgaattttaaatcacaaagtacatgggatgggttagcatgaaagtctttctgtattgtttgctcgtagcctggggaacttgaaaaattcccaccatgagctgctgagtcatactcttgccctgttaaatacaatagtttttctgcaccatgcctgatcacatattcacatgcacattaatgttcgttgatgtgctcattcaccacaaaattgtaattggcaaccagcacatgaaccactgggttttgatttgtgtactgtcagaagctcaaaattgtactacatgaacccctgagtataggccatgccacacttctatggtgcggtggagctaataaatttattttaatatatatcactactaaaaaatgatttttcacagcgtcacccaatcattttcgctggcggctatttgtgaaaacctccagcaaaaatataacgatagtggggggcttcgaaccgccagcgaaaactaatcttcgctggcggccaagttaagcgggccgccagcgaagatgttgcggttttcgtttgcggcgcacctaacagaccgccagcgaagatgaagccattatcactggcggattggtgacgtgggccgtcagtgaagatgaagccattttcgctatcggacctcctaaaaccctaccagaaaaatatattttttgtggcggacctcctaagaccctgccagcgaaaatctatttttgctggtggtaggaatagtgttttcccgtattaaaagcctacctacccacataaatccatgcccgcagaaacccccacccatagaaatccgcgccgctccacctttctcactctctccctccgtgccgtcctccacctctgttcctccctccctccacgctgctccggcactctctccatctgcgccgccgtttgcctctcctccctctccgagccgcgccgcgcacaccaccgtcgcgtactgccacgacccttcctctccctctccttcagttctcggtgagtcggcgatggtgatggcgacgggaggtgggcggcagcggatctgacggcggggtcacagggttgcgtggatccagcggccccaggccccacgatggcgacgtggtcacgggtgggagactgggagagcttcagcgcggggcatagggcgtggatcgacgacagcgtgcccctccctcctggatctggtgtcggcgggtctgggcggtggatccgatggggccctcagcaacaaagcaacggggtcgcaggccaccgctagaagatctccggaggtcattgggtccggccgtgggagcgccgtggtgactctgccctcactcccctcctctcagatccggcgacgacgacccagccttcccctgccctccctctctcagatctgatgccgacgaaactgcatttccgttccctctcggcgacgagttgttgctcatgttgttgttcatcatgctatattgtgacatgttgttcttggattgtgacattgtatttgtcctcatgttgttcttggatttgtattgtgacaagttgttcaacaacgacagattggaacacattaggattgtaattttgacatgtttttggatttgcattgcaatgtggatttggaatgcaggactgctgcatctaggtattttcaaattttcattcaaaaatttctttactggcggttggagagcaggtgcggtgcatattttcaatttttttaaaaccaaaaaacaagcttcgcagacggctggcttaacacaaacgttagagaaaatagatttttcctggcggctcgtgtaaatcaaccgccagtgataattgattatcgctggcggctcgcgtaacataaccgctagcgaaaatcgattattgctagcatttgaagtcccgccaacgaagacctttgattttctctggcctttgattttaggcagctaacctatccgccagagaaatgattttagccgccaggaaaaaccattatttagtagagtattatatagttgacttatttaatatgtttgaaatattcatcttttcatgaaatctttatgtaaatagaaaaatatactgggcatgcttaaagtacttttgatgatatatagatctaatggtgttctttttactttacttattttgaataaatattgttagaccaagtttgagaaaaataataattgtgcatcatatgttaataacagaatagtagaaatacttcagagtccacacagaacccactaagacaggccaccaacgttgtttgataccggcggtacatcatgtctaccctcttaattaattaattgccatccacatgtgagctcaggcagctgagcagggtggccatgtattgggtctacctatggttctctgttgcttatatatgtcagtccttacctttgcctctcttacctttgccttttaattactttctatggcctgtttctccattattcacataccttctttgctacacacgtagcaaatatgagcttgctttaactgatgtacctagctagtgctggccatggaagcattgtgctatttgcttcagatcggaatgggtgtcatcagggagaagacaagcacattgttcttcatcatgatcatttccatatgttggctgtatactggatagggaataccttgatcccaaatacaatgtttcagaatatgtgtagtcggacttttctcattttttgaacatgtcattggtatggatgtcctagctagagagccaataaaaaattaatggaagtagcattttatttgaactcatagctatacataaagctattatttatttcttagaaaatctagtttaagttaatacccactgaatagcaatgtctactaccataaaccaataacttattgcaatgggggtacttgtcactttgctggcccttctctgatatttatatagcacaatttattcgtctttgtctttgtcatcatgcatatatagagatagtttacacctgcagggcaaaggaccagaattaagcaccagaaatagaggtctcacacactttcctcctctcgctaataagaatatatacatagctactctgtttacacggccctgtatctacgaattcctttacaagagaatgggtagggtgtcgtggaaagaacatacaacacttgcaccttttgtgttttgcaaggtttcactcaaggagagagccgcgtaagcgatgctcgaagggcatggaaatcgtgctagccatgtttgcgggatagaacctgtaaattttcattgtggcatgggactgtgacgctatgcacaaagatccccaaactaacccaagcttcctatccattttcatcgtcattctgctgctcaatcaacgcgcttatgatggattatgacgatgacaaacccatccatcttaacgtctagcgaacaaaattgagacatcaaatagacgaagggatggagtattttctctccggaattaatgagatgaaggatttgatggacttctataggaatgtatatcacatgtccatgataagcaccagacatcttattaatgtcctattttgtcccttcgtctcatggtaaaaacaacagcaagtaatcaaaaccaagtaatcagatgatgcatataggtaagaatatgtcatgacattagcaacaaccatatcagctaagaaaattcagcatgatggcaacaaatatagccgtcaacattgaaaaaaatatcataactaaactactactctgtcccaaaaaaacgaattgtgtctaggttactaggtaggattggtcttttcttttttggacggatggggtacaatagtacatagtaacaatgtaacacacaaacttggatctaacaacacaaaatcaaatagcaaaccgacaacaaatacttaacaaatataatcagtgctaatgagagaccctatccagataccttaactatagtactagtccatcaagcaagtagaaaatatattcctatcacctaaaataaaattttgttttaaactactcatccaatctacgatctgattacaccgttatgttcgtaagaattaaatctttataacaagatctcacacgattatattttgataaaaaaatacatattacttttataatatatctaagttatttttagatttcactaaattacttcttagacatataaaagtaaattaaataaagcctaaaagtaatttacatatattaacttaaaaaacgaaagtaacttttaaaagtaaatccgttatggatgtaaaaacacgagtctatctaaaaattaaatttaatcagcataaattatggaattgactaaaaatgataataaaataaataactcacaacattatgaatgtacgagaagtaatttaatctaattaaaaagtaatctatatatagagtcaatatcacaaaacaccggattttcaggcgcatctatcttaaaaccacaggtttagcaatttttatcataaaaccacacctcttggggcatatgtatcagagaacccaaatgccacctgtttcatcccctttcacgtttccgtttctcctgttcactgtttttgttgactagtcccgcaggaacagcttatctgaaatgctaatatgatcaacaatacaattactctcctatatgagtacagatttatgttaggaaccgttcactcagttaacatttggttcatcatgctgtcaagcataacccaatgcaagttctcgcaaaacttacatactcatgtcattctcaacacttttgtgctattaattcagctatcttcatcaaatcaaaacatttacagcatatgaaccaactcctgaacttctatgcatctactccttcccaagcagttctcctttgaggactttgtcctatcaacacataccattcttccaagcagttcatcctcaaggtcctctcttctcatgtgttcttgctgttgtgggtacggaagaggtggtgctatgatgggaaatggcgaacgggagggatgaaaacaacgaagggaaggaaaggaacgggatatgggtgatgtgataccatatgccctaaagggtgtggttttgtgataaaagttgctaaacatgtggtttttgagatagatgtgccctaaagcctagtgttttgtgatatttactcttatatatatatatatatgataaaagtaacttatatatataataaaagtaatttacaatatagatatttcttttatcagaatatagtcatgtaatatcttgctgtaaagattatagatcggataagtaatttaaaagatgtcattgtgccatgtataaatggatggtgaccatgtacatacccatccagctaacaaattgatggtttattttttctctggaacgatcaatctttgacagccgtacgtgcatgtagagtacggtaaaaacaatggcaagtaatcaaaacttgtaaccacagatcgatgatgcatataggtaagagtatatatgtcaggacatcagcaactatcctgcagtgactgtgagctaagaaaattcagcagctacgcaaatagtaaattcaaatgtttagtttcggtataaaatctctgcctagcagcacgcaagcaaatatgattctcaacattgaaagaaaaaaaaatatcagggctaaacaactcagaagcacaccaattaaaactagacttagcgactctaattaaattagagcaaaatgtaggacaccgtagttttgtgacatttgccgtagaactctctaaaaatatgtcgtaaagctttgccatacaacactctggttttgtgacaatttgctaaaaaaaattatagccattattattttcacattttggttacatgaaaaattagaaaggacacttctgctcctgtgccaaattgttaggcagggttctgtacttcgactaaaatttccaaaatttcaactcttttgggcctctggtgtgatataattcgtcctcgatttttttctggtttcaaataatgtttcaactcaatcaatgtctattgccattttagtttttttccaaatgttctaaaattttccgttaggaaaagtttagatatttgcaaatttgtttatatccagagaaaatttattcaagtttcaaattttccagttcacaatttaaaaaaatttcattctattggtccattggaaca

SEQ ID NO: 68354 - DNA, 953 bp, Oryza sativa
aagtgatttgtcatgtcctcactcccaagtcctttaatcttgttgacaagaatcatcatcctatcatacatctattgtgttgtctccttgtcatccatcacaaatcttccaagccttccttccaataattcaatcttggcctcacgaacggcgggtgatccctcatgagccaattgcaaagtatcccatatctccttggcctcctctagttcatcaaccttgttgaactcctccggactcaaggcggagagaattgcattggaagcttgagtattgcgatggatgagttgttcttgctccgaagtgagcttcatgtcatcatggggtatatcaataccggtacaaacaactttccaaatacttggatgcaaagagattagatgcaacttcatcttgtgcttccaagcggcataatatgtcccatcaaattgaggagcacgcccggaaggcacggagacaaagttgtgagagggaatagtaagtttgatgtaatcaaaaggtatagtagctcccttgggtggtggagttcccttgctgcttgcttcatcttcttttccattttcctcgttctttccccctaagtccgacatcgtggatcactcaaagcggtgaagcttgaatcaagagcacctcgctcttataccaattgaacgtgcagagatgtagcctagaggggggggatgaataggctttcctgaaattttctcaacaaaagcaacggttaaattgacagggcccggaacctcctggtgatgaacaccggaacttcctagcagtgatgagcagcccggaacttccggagttcttcagacaggaacttccgggcaacagagaaaaacgaaatatgagaagtataacaggtcctagctagtgaaaatcaggcacagggttgcacaagatgaaaatcacaagataccagtagattcaaacacagatcaggcacacgagagaca

SEQ ID NO: 68355 - DNA, 555 bp, Oryza sativa
taagttaagtgcacgttaacgatagcgggcatgggacccactttcgagacaggccccgacgcccccgcctcatgaaggaagcccgagagctcaagttgacttgggacagggggctcccatcttaagattacaagtaggaagggaccaggagcccaacttggcctaggatcctgagtccccatctatccttagggcttatgttcttcgcagagaagagtgtacaagcctataaggtttatatcttaaaaggtgtaggttatgaagggcccggcccctcattacccttgtaagtaacatattcctccttgagaagtgttgacgtaaaacacgaggcctgggatatctgcttaactccagtgcaggtccaaaactcaccttcgggtatgcaagcgtgccagttgatttgatcctataatcaacaagaaacaaagacaaagaaaccgcggttaaacctagaaacgatagccgatcagctgagtgccgatgacatatcatttatctttgagccgatgtcatatatgtatcaatcggcggtcatgaataaataagaaggaa

SEQ ID NO: 68356 - DNA, 799 bp, Oryza sativa
gaaatttctggttcgttacgcccggcgttttttgacttagtttaaattcgctcgtgaccgttgggctccaaatggcgtgctcgactacggcctgtctcgcgggtcctcgcactaggaccgacaacagtctcgacacccgaagtcgcgaatggttacacgagttcattttaagcagaagtcgggggctactgtcagggctacgggttaggcataccctttaccctttaatatacgttacatatcggtatggtatatccacgcgcatacggatacttcttgcgtactctaaggaaatccttcacagaatctatggatgggaagaatcctactcggacaagattgggtcgttaatgtatcgtacagggtctgatatctccgagttctacttggagacctccaggtctgcaatataaaagggaccccccggggaggacctaaggcatcgaatctcagagccaacacaacccacacagcctatgaagccagagcctgcaaggagccaagccatcgagatctagttgaaccaactcgactacgatctcgccggatccgacaagttccattgttccctttgtaacctgtgttttccaccatataatcccacatcaactggattaggactattacctatcaaggggcctgaaccagtataattctcgtcttttgtttgcttgatgtcgtactacgtagatccttgtaccaacgtaccccaataccctctatatccggtctacgggtatcacccgtcgacaacactagtaattcttttaccaatatgggtaccgagctcgaattcgcc

SEQ ID NO: 68357 - DNA, 537 bp, Oryza sativa
atgattaatttggaaaggatgaagtagcaaaaactacacgcatttaattcttccaaagacaccccacaaaaaaaattcccctaaaaaaaattcttcttgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtctcatgccccctagagggcttcctgcccaccttatataggatggggggcaggattacaagatagaaaccttaaccaacacggtatcggattcctaaatctactttacaatattatcaaaccaggactttaggccgttccataatatacaaggaaacgtaatacccaagtcatgatctgttacatattccatacatatatgttatcccctattactagtcggataaccatgccgtgtggatatggggtacccataatcttcaca

SEQ ID NO: 68358 - DNA, 598 bp, Oryza sativa
aatagtagcactccgtaatattgaattacgacagtgtcgtcccttttggcaacgaccccaaccaactaagatgacgcttaattgatttcggcaaatacgcctttccttccccttcatcgctttccactcagaagaaatacttatcggatttgcacctctacaatttgtaggacgatattagcttaccttaataattcaaacttgccaacaactaaatgtaacatttttaaatgaaagacgatgtaattcaacccattctaattttttattaaattgaataaaatttataaataagcacgaacaataaaaatttattatttacctaaaaaatatcttccgttactatatgaatatatctagaatcatttttattctagaattagaattattactgtatatatttggagaaaagaatgtcagacatcttaaaaacactttcaatattcgtagcttacgagtcattgcaagagaagcaacattagaacaaatggaaacactacttgaaaaagtatcaaaagtgatagaagaaaaaagggaagccattaaaccccacggagttgaacaagctaaattataaatacaaagaattattagaaaa

SEQ ID NO: 68359 - DNA, 748 bp, Oryza sativa
atagtatagcaattaatttcagataaggccaacctttgcctgtgctatgtttgcattctatttcctgctggcttagaatacattgttctcattggggtgctgaaaataagctgagaaatacccatagaacctgatctgattcgtatcagcgtagggatttgaggccatttctactacaactaggaattttaccgctcaaatccttctagtttatgttttgttagaaggactttttatatgaaatttaccaaacttatagcattttctgcggtgatcttcagtggcagtctatttgctcaaaaaccacttttaacggtttatacctatgattcttttgtttccgattggggggccgcgcccaaattagaggaaaaatttgaaaaagtatgcgattgcgatgtgaaatttataccgtttgaagatggtattactatgttgaaccgcattcgtttagaaggcaaaaaaacaaaagcggatataatgttaggcattgataatttcacaatgcctgaggcggttaaatcaggcttatttgctgcgcataatttgccaatagatcaaattaaatggcaagacaatacattttttccatatgattacagtgaatatgcttttatttataataaagaaaagataactaatccgcctaaatcgcttaaagagctagtcgaacgtcaagatttaaaagtgatttatcaagatccacggacaagtactgtcggcagaggcttgttattttggttaaata

SEQ ID NO: 68360 - DNA, 1020 bp, Oryza sativa
ttctgaatctgcaaggtatttaccattagctttttcagcattagttaatgcataatcgtaagattttcgtccgctgttattttctgcggtaagggagagtacggcttgctctagtgcatcatttaacctggccttatcttgaattatgcctgctacctctaatgaaacaaacaataaggctacaataggtagcgtcaataacgcaccaaaaataatataaacgccagattgattttggataaaccgtttggtttgagtaataacatattttctcataatcattattcctttttagttttgctaataacagattatttatcgagcgacgcctaatgaagaagcacgtaaccaattattagaataatcttttctatttaatgttaagcctttaaataaattatccatttttttacaaactgttacctgataaagggtcgcataacgattggtaccacgtaaattctccggtaatggagaggcttttttaatatcatcaattttaattgattgacaattttgtgcgttagttggatatattttttcttttgaggtatccagtgttatgtctggcctaggttggtaatttttattttcatcaagctttgatgaattaatatctttgaagccatatttatagatagtaacagcaatctgatcttttttttctcccattaagttagcggctaattttgttatttgtttcagttcttcttcttttatatcttcatctccagcacgctctatatgtctttccttgataacattggttaatgaataaaaagtgcgctgtaatttaccgacggtagcctgtagaatagcaacgtcaatcaagaaaataagaatgacgaaatacataaagaaaaataaatcaaaattctattaagacagcaccttgggtattttttagaaattttttgatctttttcatattcttgggagtaccacgattttacgttcaaataatcgctgaacagcttgttcaggtggtataaaaaacattggtttatatggatatttaaa

SEQ ID NO: 68361 - DNA, 573 bp, Oryza sativa
cttcaaaaagtacttgacctttttttactaaatctccttcacgtactttcattgaaggacgcatacccacatattcctcaccaagcatcgcaacttcattaacggtattgccgttatggattacttgtgctggcgaagctgcaataggtaaatccaagccttttttaattgtaatcatattatttgcactacttttttgggttaaaaaataagattgcgaaaatcgcaatcgcttctattgagtcgtaacggtcatttaataacaaatgaattcccccacctgtttctaaaaagttacataaagctctcaaatcttagttgttatcttgcaattattttacaagcaaaaataaaggcgctattttaccttaaaatgcggttaagtttttacaaaaaccggctatttttgccgattagcccttgaaaatttgaaataaatcaaatatttattacgggcatagattaaccataactcaaaagtagtaaataacgttgatttaaatacgcactattccttttaatatttcgcatagtcttatgccatagcctttaacctgtcgatttgcaaaattt

SEQ ID NO: 68362 - DNA, 801 bp, Oryza sativa
aaaaagcaaatattgcttttaccggtaatattgataaaaaagttgagaatggcttagctattcttggccaagcaaaaggtgctgctattcaaattacaggtcttgatggtaagccagtaaaattagatggttcaaaaactaatgtaaacatccaagatggtgataattccttacaattctctgcttatcttaaaggttacccaacagcagcggttggtaaagatgatggacctggtccaactccaacaggtaaagctattgtagctggggagtttacttctttagttaactttactatgagttatgaataaaaattaaatagtgtgctagttatagaggaataggatagatgttaaagcaagcattattacaaagatggtttattttgcttgttatgagttttgattctcctttactacatgctatagggtatggtgcaggtttcgtatcaatgaatggtagagttgttgatgctgcctgtaccatcgctatggattcaccttatcaagatattgaaatattgcttttagaaaagcaaactttagaaaaggaatttgaaattcaattagtcaattgtaatttagctcagtatcacaaacctaaacctaatttgcatatgttgcatatgctctttcgtaattctgaaagtgacttaactaaaaatgataaggatctgatatatataagaagtgtgcagtctcctttttctagtaaattattttttgagcaaaatttcatccctcctagtatgctattaaagtaccgagtacatttaattgcgaactcaaaattatttcaggc

SEQ ID NO: 68363 - DNA, 519 bp, Oryza sativa
actatagccaaacaaatgatttcgattaaattccgttctcacaattaacggcgaagttaaatctttcgcaacataaccggttatactttcgataaattcaggaaaagtctcggttttgataactaacaatgaaccaaatgcgcctgtttaaacaaatcaatcgcttgcttggcattagtttgaaaatcaaaaaaatcgaccttagcattagtgggtttaaaagtatgctgtaaagttagcaattgatgtgcaatgggagttagaatcacgaattagcctcattatagaaatttggtttattatacccaaattccggctatacttgcctaaagttaaaagtaatggggctgaaaatgagatatcagaaattagaaattcaggaagcccattgggcaatggaaatattaactggaaaaaacatcgtgaaggggaaaatataactaaacatactgagcaaagtcttattgagctaaaagtccaatttctaactacactccagcattcacctgcggaaattga

SEQ ID NO: 68364 - DNA, 1875 bp, Oryza sativa
atagtaaataagcctattgatgactcattatttcgtgatttttatggcattgggatcactaaatatcactttgatataaaaggaaataataaaatatatggtgtttatattcatctgttgataatcaaagaaaagaacgtaatttggtttataaaaaatcagctatagaggctttagccgctaagtattcaaactggaatgttttgccatcttcaaggaaatttttacacagtgaataaaatatatcgtgcagaaactatggtttcactattagtgggaatagcaatttttgctattttatttagcgcttttagccattggcaagaaactcaagtgagtcaaacaaattatttatatcaacaacaggcattacatattttagaaaatcaaatagccttaaaacaagcaacacaagaatgtgaaaaacaacttcaacaaaacgacgtgttatttacgattgactgtggtgcttcatatattcaagtgaatttcccattaggcaacgtcagagtgaataagcaaatggcagcgcaactatcgctagaatagcgtgtttcaccacttataaaagtgattgaatatcagcgctaattagtagaaaatcaaattctactttaggagccattatgtttacggtctatttttctcagaagctatcatcactcgctaaattatttattcaattacagcaaagcaatcctaatcctaatccatttgaagcagaaattgttttagtgcaaagtgtaggaatggcacaatggttacaaatgcaaattgccaatcaaatagggatcgcaggtaactatgaattcccttttcctacgagttttttatggcaacaatatcgtgtcctctttcctgaacttcctactgaaaatatttttgaacgtgaaacggttacttggcgtttaatacgtttaattccagattatttatctttacctgaatttcaatctttacagcactatttaactaaagattcgcgtcaataccaattaaagctttatcaattagctaaaaaagtagcggatttatttgatcagtatttagtttatcgtccacattggttggttcattgggaaaatgatcggcttgagattgttcaagatgaaattctgacccatgcaaatttaaaagtgaaaaataccaaagatatttggcaaaatttaagttggcaggctattttatggcgcgcattaattaatgatattaaattagattgtgatgaatcggtgtttgtgacttcacatcgtgcttatttgcaagaacagtattttaataaattagataatttaacagaaatagaaaaatcaaaattacctaagcgggtctttatttttggtatttcctctttgcccgcgacgcaattagctgttttaaaaaagctcagtgaacattgtcaaattcatctcttctttttgaatccaagtgcagaatattggggagataatgttgaagatcgggtattagagaaattagcacttaagcagaaaatgaccgctaaagaattagaagcgttatttgtacagaaaaataatcagttattatcaatgtggggtaagcaagggcgtgattttttagcacaaattcttgagcaagaacccgaccaaattcttgatgtttttgatgcttgtgaaggcgattcaaatctgattaagttaaagaacgccattctttcttttgataatcctcaacaattattgcttgcttcgcaagatgattcagtacagtttcactcttgccatagcattatgcgagaagtggaagtattgcataaccgtttattgcaaatgtttgctcaagatccaacattggctgcaaaagatattattgtcatgtcagccgatattaaccaatatgcgccttatattgaag

SEQ ID NO: 68365 - DNA, 783 bp, Oryza sativa
ggatttaatagcattaaagaacacgaataaacactaaactatttcagtccctttaagtacaacgtaattatagaattttctttcacctgcaacaaactaaaaattttaatttttataatcaaaaaaaataatgaaatagttaatcgccatctcaatataagggctcgaacaattttatgaataagaaacttcctccgcttaacgcattaaaagcctttgagtcagccgctcgtcatttaaactttactaaagcggcagatgatttattcgtcactcaagctgcggtaagtcatcaaattaaattattagaagactttttaggcgtaccattgttttatcgtcgtaatcgtcttttagaattgaccgaaataggacggcaatattttgaagaaatccaaccgctttttcaacaaattgcgctatcgactgagaaaataaaattaaaaaatagcaggcaaattttatcaattagtaccacaccttcttttggtatgcattggctagtgcctcgtttaaatgaatttcatcataaatatcctgatattgaagttcgtttagttacagccgctcaagacgaaggattgttaggtaaagatatcgatgttgctatttattatggtagcggtaattggcagaatttagaagcggtcaaattagtacaagcgcgtattatgattttagcctcgtctgaatatttgcaacgaaatccaatgaccaagcctgaagatttaaccggtaaaaatttgatccatgtttgttcacatactaaatggaaacagatgg

SEQ ID NO: 68366 - DNA, 705 bp, Oryza sativa
taccgttgaaaacctatctgtacattttgattcgttttgtgaatgcggttaagggtgtctctgccctagaaatctctcgtgatgcgaaaatcaactatcgcaccgcctttgtgctttgtcataaattgcgtaaagccttgctagagagtcgagatatgcaaccacttcaggcgaagtggatatgggcggcacttacattcatcctgcacctcgtaaagcaaataagaaagccgaccgcattgattaccgcttaaaagaaaatcaaaatccaaataagcgttgcgtggtagtcgctcgtgagcatttttctgcggatgaaaaagcggaaaattcactttatcgtggggcaaagcgttcgcacgtgttcgtgacgtattctgaaacccagtcggtagtgaaaaatttcgctcacgcttacattgagaaaaacagccgtatcaatacggacgaaaacaccgcttacgaaagtttgttactcgactatgatttacgcaccgtaaatcataaagacgaataccgtagtgattttggcgtaaccaacaatcaagctgaatcctttttctctcgttttaaacggatgtactacggacacgtgcataaaatgagcaacacctatttactcaactatgccaacgaaattgcgacacgtgaagataatcgccgtaaaccgaatggctggcagttccacgatattttaggcaaatg

SEQ ID NO: 68367 - DNA, 1327 bp, Oryza sativa
tttttatttttcacgatgccgtgtattgccgatccattttatggagatgtcgcaaaaaataggaatgaagtaataatagaaaataatgttttaacggaaaatattatgccctgtgcattacctaatacgttatcaaacattagtttgcctgtaaaatttgaacaattaaaattgattggtatattaaagaaagggcagcaggctaaagcattttaattaatgataaaaaacagattttcgatttaaaagttaatgattttttattagatgagcatatacaaataactcgcattgatttgaaatcactacattatattgattggcataaaaagaaagattgtcaacatccaaaagaaaatgtggatgaaattataaggaattacgatgagaatacttttttctttattcttttttatttcattatcattattagcacaaccgttatcgctgtctttaaaaaatgcacctactgcagaaatattaagttatttagctgaaaaaaaaatgaaaaatatcggattgagtgagcaaatagacaaaaatacgacctcttagaattgaaaataggcattttgatgaaaatggtgaaaggattgtgcgcgctaatcaattatcaaaaagaaaagaaaaacaggtttatttatcgggcatttaaaagaagataaggcaatagagaaaaaaaaaaatggggagaaggccaagttaaacactcaaaccattaaagggggaaatgctaaaagttcaaaagaaattggaatccttactaaaggtaaaggtaatggtaatgtattgtcagaaaaaggggtatttatattttgatgagcgaagtaaaagcttaattataaaagatagtcctgattcaatgaagcatattttggcattaataaaaaatttagataagccaacagaaaaattgcaattgaggctagaattgtgacgattagtagtcaagatttacaagagcttggtgtccgttggggaatgttttcgccttctgacgattatcataaggtggccagtagtttagaaaccaagggtttaacaacagcaaatcatttaaatgttaacttcccagtaaataatgcaacttcacttgctttgcaagttgcaagaattaatagtcgcgtattagatttagaattaacggcattagagcaagagaataatgtagaaattattgctagtcctcgtttactgaccactaataaaaagcctgcaagtattaaacaaggcgctgaaattccttatgtattgtataaccgtaaagatgaagtaaaaaatattgaatttaaagaagctgtattaggattacaagttactccgcata

SEQ ID NO: 68368 - DNA, 779 bp, Oryza sativa
  unsure (1)..(779): unsure at all n locations
ggtggttgnnnnnnnnnnnnnnnnnnnnnnnnnnnnnnnnnnnnnnncatctgatcctttcttctgtgttgccattcgatttaacagttcatgctgtgcaggtgaaattgcattgtgcgcttcgtatcgctgaaaataaagataagattgagcattcgttcatttttcacctgagattattactgagcgttgcatgtagaggatcgaaggatcccattaaagagtgggttttaacaatatgaggatcactgcaacaaatcaggtacattttccaagtgagatgagagaggtcattgagactagaaggtggtctgatttagtatcaaaacatgagaactcatcttcaccaacaaattcccaacagttgatactgatcatccaggaacacgttattcaaaagtaaaaaacgggggaggggcaaaataatcagttctgactcctaatagcagccatggtagaaacgacatatacattcaaaacattgtcgcgttgtattccagatagaggttaggcatgaataaacatcaccttagagaggcaatttacagaatgaaatctgcgatgcatgttgaatgcctttgcatagaggcctacgaacccaggtcctacttcatgagtactagagtactggtactacataactagagtaaacatgaagagtgctacagtgtattgcatcaatgatttttgcggcatttggtggaactggaatcgataatgagatgatcccagtgaaatatcacctaatggctctttgtggcgcttcagcaaaatcttgt

SEQ ID NO: 68369 - DNA, 30834 bp, Oryza sativa
  unsure (1)..(30834): unsure at all n locations
tagttggattggtagatcaagccgtcgacgtcatcccggagtgaagcgctgtcgccaagccattttcgtgtctgctgccatcgtccggacctcatcaactccggccaacaccatggtatatacccatgaacctcaaatactcacatgcatgcacccccttaaccaattcatgactgtagatgcacatgcaccatcacctgaaaacaccttccgctcacactcgccatcggcgctactccgatgtcccctaaccaagaaaactagaggaatggaatcgcgagagctttctcttcattttatcttttgacctcaacctcaaacgagccaccgtttgccgccggcgagctcgagctagctctactctgtctagagcagagggatgtctcccgtgaattagattatatcggtatttgaaattgggttaaggtgttacgacctatttgctgcattccctaccttgaataattgatcctcttgctgtttgaacccctagaaatggttagagcacactctttgtgctcaaatgggtttatatatgctctatgtgcaactacttgcttagccatatttagaaatatgcaaatgctcattccatctatatttaaaatgtgattttcatatgtgaacctttgctggaataaaatgaatatgatgggtatttacgaactaaaatgtgtaaaatgtgattttagacttgggcggcaagtggtgtgcatatggtgttagttacatgccgatagggggagtgtttgcccaagtccgtaaggaccgtaaggaccgaacttgtgtcaccaacttaaagttattcgtacatccacatgtactagtatgggatggcctaagctgattaatctatttagaactagcattgcattctggtaggccggtgtgtatgagttagtcgataattctgaggaattagtcgatgattcagaggaacttcctatttgccccgacgtggtagtttaggtgactaagtctgtccaatacaacggtattgtgccacgtgggtgggtttaaggcgtgggcccaccacttaacggttctagacatatttctaagtatgcataggatggaggaaaacgtatcgtgatggtgcaaggctaggctctaagtagtgtaaaggcttcgttgtgacctctagtccgcactcataatgtagagtgtggggtgcttgggccggcaccgaaccatctagagtgtagcctccgggcttctatcacatcatgtgggtaaaggtgtacaaattctgcagagttctttaaactaatcgattagccgtgctcacggtcaagagcgctttggtgaagtgtcatgagtatagactatgtttgaaaatgtgaacatgtgaccttggtttgaaattgataaatgtgttgagttgtgtgtgtggtgatatattattacttgttgtcaaaagatgacaacaagatattgattatgatggaattatgatggatttaatgttgaaacttaaaatttgttttgttaattgaagcatcaacttctttacaaaagaattgcgaaataaaacttgctttatgctgaaattgaactacatattgccttcattttaatatatgtcttacaagtagtatattaggattgtattgtgcttgctagtacattaacttgtttaatgtactgactcttgctgttgatataaccctttgtttgcaggtttagacttagtctttgagtgatgcgggttccgattgcttcttctaggatgagaacttaatggggtaaacccctagtcggtgtgcttgtgtttgggtagtcaagcttccggcgttctctaataagtttatttggccggtcggcctatgtatctattaagctgttgtaagtcttaagtttctttcatcttagttgtgtttactatgtataatcatgcttaagatgaaagtgtgaatctagtgcacatcctgggaactagattcacatgagtatgagttaagaatatttgagatgttgtagatctttagccatttttgtcaagtctcctgaatgtataacacatctggtcgctaccttcgagtggtttgaggggcacatctcaggctgaagttgactggcaggctaaaggactagcaatgtctccaatattcctctctcgaggcgtcggatgtttcattatgcttgtttgatgacttgaattattcatttcatctctcaagtataatggaaggtccggagagcctacgacaattcccgttgctgcgcactatggtaccatgaaaattttggattgggcgacattgggagatagctagttgctcggtcgtcgtggacatcaaacaaaaacacaaaggatatcaggtcattcttctccacttgcaacacttgggtttctagagaactcactgttatcagcttatgaatattggaacacaactctgatatgaactgtaattattctcttcgtgttcacatcatcggttacactttagccatgtgggataattgaccgacatacacagtatcgagtattgtcacatagtgagtttaaattactcatgcgccactgaaaattaactctgtttttgcgtcaggaaaataagtatgctgaaattggtatccttttgactgctgttaatatcatgaacgattggtttagttttttttgaatgcttatacttagtgttatcgatcttgttagatgttatctttttcttttaaaaataaaagtataatttccatcctctagacaaactaagaatacatggtaacaccatatctgtagacacaatgatttcatttttacaagaagagaccaggattaaccatggttaggagtatctgttaggctatttcttatggatacatcttaagaccatgcataaatatatggtgtagctgtaaggtgtaacaatgcacgaccaaaacaaccgatccctttcattcacttgtatcgtctcttatggtcttctctcctgcctcgccaaagctttcctctttagccttccatctgctagcttctactgtctatcttcgaaccctatcttaactatcagtaagaaaagacagtgataacacattgataaaacaattacaactttactttgcactcttgctctgtcctaattctcgcttaggtcatctctgatgctgctacatactaaaaacagctgatcaataagacacccaattttgaagagacaaacaattttggcttggaaagcatgaggaaagtgtgggcgatgttctgcagagagggatgaagtgtctcgtactttctgagatcacaataatgtttactccttgatcatcaacatcacctcatattacctaaaacctacgttatcagctatacacaaatatttggtgcagatgtgtataacaattcattggttcacatattaatctatctatctatctatcaatccaaagccggccgttctgccagcatttcattggtccacacggcaactctggactagttttttacttcctccgtctcaaaatgtagtcatttttaagattggcacgggtattaaaaaagtaggtgagaatgattagagaaagtgggtgatttgttaaaaagaggaagtaggtgagaagaatggttgtgattggttgacaggacaaggtaggtgtaaaaatagcttcattttatgataaaacattatgctagaaatagctatatctcggaacggaggtagtagctatttgggaatgtgttatggctttgccgtttcaccgtgaaagaaaaaaaggctattgcctattggcgtgtgcaccggctcacaccatgctggcctgcacagcccagtcagctctaggcctggttgtccggaggccaacatttgcattgttgtcttgtcaggttaattgtgcagttaggaccaagcagaaatagtataaaacaaggtaaaaatagaaaaaaagtataaataattttgtcaaaaccatctgaataaataaaatttattatggtgaaaactcgaaactgagtcgcgtacctaaccatacatattgatattatatatttctacaaataaataataatcagaaataaaaactaaataacagaaataagttgaaagattggatgaaaactttccaatactatattacaattgatactatatgcataatattttggttaatgaaatcgcaacaattttgaggaaacataactttaattttttagttagcaaatctaatcacaagtaaagttattggcaatcactaattacaatcgtactttggtttttctcattcttacaggataaacacaaaattaaatttctttcttctgggacaaacacaaaattaaattccattaatttgtcttttgaatgatattttatggtgtgaaacttactcatgtaaaaatatattactccgtccgtatcaaattacatatcgttctgacatttcaacttttagattgtgatcctctatctgcacctttcattaatgccacatataactggtaatcaaagttaacattgcttttaatactattaaaatatagttaatgagcataacaaggtaatttgcagtaagttcttgtgtgatgtgaaatttgctagagtaacaaataattaaaaaaaggtaggtaaattttctatattgtagatgagtcctaaaataagatatacatgctatgaatttatcggcgtgccactaggcgcgcagattttttctagtatatttactctttctgggttgataatacttgtggtttgaacaactattttttattataatatataaaaatatcaaaacatatatgattttattaaagtattttttaacactactctacgcatatggttttcatatttttaagataaatattttggaaattatttatagtcaaagatttcaaagtttgactttacccttgttcaaagcgactaatattgtcagcccgaagggagtattactccggatttgagctattacttaatcatcaccttgtacgataaaatttgaattcatggctagaaattatgttgttcccaattgcattatgttgatgagctataatgctatcattctctgttgttctcaacatatctcttccaagactttcatcaaaagttggttattaaatttgtagaatcaaacagaaagaactaaacctatggtgggaatatgtttagtaggatatatcggggcttttaggtcctagaagagagcaaatgctaattgccaagacaattcaattcaattatatgataaaaaggctaaagtgttgaaagaggaaagagggaggaattgatacgaaaagcgtaggatttaaccactatctagtcaaatatacgtaaacatagctaagttctatgatgtttacgggttcacatcctctaccataatgtcactaccattataggtactgacattcctaaaaaaaatatagacaatgatatgtggggcaataggagggtgagatctacataccagtaactgtaatgataatgatattatgttagaggatcctcacccgacgtttacacatatcttggctggccctttattgactttaatgatgctctcacattctccaagtatagttttacaaatctcaaagcacttgtaatttttagagataattaagtagcagtcagccaccactaagtcaagctatattaatcaaaaacactgttaaatgaaaggttcatttaagtaactctacaagtagtataaaaaatgagcactttagaaggtaacaagtgatgatattgatattgattttcctttgcacaaaaaataaagccggactaaacttttcagctatataaatcattgtcccaagagtcgagcaagagtggtacaatggtgaagaatgagtactacggtttccaaaactaagatcaataaacatgtgctctagatgcatgccacaaaaaattaagatctaggactgggcggacctaggaaatacaaggcgatggggccaaaatggtcatgcatcggcagcgacggacagagaaggctttgagaatattgtggcatagggtcgtacaatgtacttgtgttcatgatattgtgttgtgcatttactatatatttcgattattttagttagcatgattattagcaatgtcattacatcatttatatatttcatctaattcaatatcacattcacacccaaagaaccatagaaaaacatcgtattttcgtagtccgatatctaaagctcgtaggctggttgcatttgataaattagaaacatttcctcggaaacctcaaagtacaactcctttacagagaaatttgttggaatgtgtgctaccatatacatattgataggactccggcgtttcgcttatcgacgaaataagcgaaacggcatatttacaaacggataatgatttataaataaaacttttatatacgtgttcttagcgatctaaaagcaaaggctgacaaataaactacgataaaaaagccctaaaatcaactctaaatttaaggttaaaaatttaaattttggcttataagcgtaagcataagcataagccaaaagatgaggctgataatgtttgctagaattcatgcccacacgactcatgaaactagcaaaagtatgtcactaatcgatctacacctcagtcacttgggccaaaaccacaccactaatacaggggctttaaatgaattgggctggtacaatgaccccttccttaagagtccactactagagaactcagatgtgtgtagtatgtgcgatggtaacgctcttaagggctgagatgagagatcgtgagttggaatcccacattccacatatttttgacttgtatatatcttagtatcagttccttcaaccggtactaaaaattaacaactttagtctccatttccttgtttgtctcggttttcttctctcaattgctacaatcagaattaacaggggttgacaaccagtattaaaaatcatatatctcctagtggtcgatgcaccgacagctcacaacttacatggcggaggcccacaacttcaccttggtgtagactacgcacgagttatacagcaagggtacatatcagaacatcagctagctaggaaggggaggcacagtgaaccagggatccatgatgccatgtcctcggagatgtttgaccttgccataatgggacagtctaatgctatacgttcgagttgatcgtcctctgtatgggtgagaacaaaggaaaatagaagcacaaaccaaatgataacttctctctcgccgtgtatatatatatatatatatatatatgtaatgcatcggcccaactgcaaaacaagagttgcgtacaccttctgaaaatatttactgaagcagtagaatcatggtaaagaagatcgcatcaagtctgttgaaggagtagtatagctgtatcaaaatttggatggaatgactctgcgtatattctgcactttgtccggcatcaagaaagatggttggcagtaattgtgccacatttttactgtcctctgaagatgctataactcattgtctcatgcacttcacaagaaccagataaacacatcatatatttgtaaaagtttccaataatgacaaatcagataatatagtttttattggattatttttttagtctgcaaattaagtggaaaagacttcgataaatctgataaaaatgttgcaatgtgttgcacattgcttgtttgttaagaacgattactttacacgaaagtaccctaaccgaaaattttgactgcactataattattattgtaccgcaacattttggaccaattacttgctcctgaatacacttaatccatatcaacctgtgctatatatgctcatatatatcatttttcctgttcacttgtgtagttacctacacagtagacatggtccatccttccaacccaactagatgtaattaactttcaagctacagaatacaacccaagtattctttgttctgaagaaaatgctgaagctatatcttcctagctccccaacaatttttcttcctagtcccctatctcttttctcctccatccttctcttccttttttttccccctctcattcttaaacatctagaatctctctaacataaacatgctagacaaatattgaaatcacacatttattactgtcgaggcatatagccatatacctatttctagctagctagttgcataccagtcaactttttagtttcttgttcttaagaaccacacatctattaatctcttacatacaaaatggtaacccgaacatgaacttagtttgtttacataatacatacatatctgcaatgttggcatgggaggcattgggaaagatgtggatatcgagtaaaaagaaacatgacctctaaaccatcgaagggtctcaagaaggtactagaaatctttgaaccgattcaatccaactcaatcttgaactactcaggaacaatgtgaacgttgacgatcgataatctctcgatgttcatcatgaacaaagctttgatgtggaagttgatgagatcaatgactcgatctaactgaaagtctaggttgaatagcttggggcgagcagcaatgactgatatcaaagactagtcaagtaagacatttcacttagaattgattaatttcatgttatttgactagattagcattaaccggaacatagatctgcacattgctctatttatcttcataagtttattttcctcggatgcttaattcaatgctgaatgaaccatcatcacagtaaaaagaaaaaacactgtttctaaagcgtttggtgtttgataaatctattaatgtaatttttgttgtattgctaaagtttgatagtctgaaagtggaagacttcgaaagttgcatcctaaaaattgttggaatatgtcgcgcattgctagctagttcagaacgagtactttacatgacaacagtgcaggatgaagagcctgcccgaaaatcctcttgagtggtctataattaccttaggtggacatatggatggaccagaccaactacttcgtttccttctcgatgaattttatctatatcaagcagcatcctccatgtccatttgtccagtagccatgcatgaacattacagtttagatataccaaaactgcatgtagctagctaggcctgggaggcagagggaactactgagccataacatcatgtgtacatgagcagagttgcaccttgtcatgcagagaaacaacactaacatggttgagtagattatcggattgcagaatgacaagccaactatgagatcaaggcctgggttgaacgacctgattagtccgtgcgtcttcttaacacaagcgtttgatcaaaggacctggcctgataaaggatcagcagagcacctcatattaagataaaatagatcatttgagtagaattaatagaaaggggaaacatgaggcgctctgctgatcctttatatgtcattttttttgttctgcacatgtgtagttacctattgtacttagtactcaagaaccttataattctctgttctgaattcctagctaggcttctcaagctgactagatgcagttaataaccggtatcataacagagatggtatacgatcgaaattgagtacattaaaatgcaaaaaaaaaataaaataatgaacgacatatatgtttatttcccttctcctttgctcaaacatgatgccaatgacaagttatttcccttctcctttgctcaaatatgatgccaatgacaagttctcaccgtgtatatatataatgcatcgtcccaacggccaaacaagtaagtaaaatcaattcaactatggcagcaacattaattatctctcattcgtacattctacctagctagcagatacgtatatatagatcaatttcgctagtatgcacgcctacatgtctcatcaaactatagcaggagtatcgatcgttgatcgatctaggactgggaggtgctaggaaatacaagctaacagcatcaaaagtatcacaaatgggtgacgactgatttagaagacatccaagaaacagtaacaccttgtagtgtcttgaatcatggtagagatcgaaggcgttgctgacagacttgttggagtaatatcgaaatgaaatggctcctatactgtatgatgctaccagtgattttacaacatttctgtggtcctttcactactggagaagtgatctttgccgggtaggggaaaaaccacaattgtcccggttcaccaaaaaaccgagactaaaaacaatttttagtcccggtttataggttcaacgggaagatttcatcctggttcgccagttgtcagggtgtgttaggcccccggtgatctttagtcctggtttgtgttactaaccgggactaaagatcatggcgatttttaagcccggttggtaacacaaaccgggactaaaagtccatccatataaagtcttcttcttcctccagctagcccgagaaggcttcaaaaatttgttgagtttgagggaaggtgctgccaaaatttttggtgattttgttttggtgaaaatataaaatttgaaggagttaaaggttagcaacttcatcctcctctactttgtgataagcatttgtacttagagatatgttttgtatactattttgcctctagaaatttgggaatgggagatgatgaaagagaaagtttgtgtagggatgaaataatatagaaattttgtttatgtagaatttgggaaaaaaaaacttgtgataaaagagatgagaaagagaaagatagaaaattatatgaaaaagattagaaaacttagttaatttaaattaaattaagtaaaacaaattaaatatttgtttacaactttaaaatgatggggaatgaaaacatgaataatttgtggtattattttataatcaaattttattatttagaatttggaaaaaaacttgtgataaaagaaatgaaaaagaaaaagatagaaaattatatgaaaaacatagttaatttaaattaaattaagtaaaacaaattaaatatttgtttacaactttaaaatgatggggaatgaaaacatgaataatttgaggtattattttataatcaaattttattatttagaatttggaaaaaaacttgtgataaaagaaatgaaaaagaaaaagatagaaaattatatgaaaaacttagttaatttaaattaaattaagtaaaacaaattaaatatttgtttacaactttaaaatgatggggaatgaaaacatgaataatttgtggtattattttataatcaaatatgattatttagaatttggaaaaaaaaacttgtgataaaagagatgagaaagaaaaagatagaaaattatatgaaaaagaatggaaaacttagttaatttaaattaaattaagtaaaacaaatttaatatttgtttacaactttaaaatgatggggaatgaaaacatgaataatttgttgtattattttataataattatatattgctatttttaatattgtttaattggtttgaatttcgtggattaatttttcatgatttttgtgcttttcatgtagatggatcggcaatggatgcgcgcggactgacggtcaaaagagttttttgatggcttgcataattttctgaaagtggcagaagctaacaagcagaataatggttttatccgttgtccaagcactaagtgcaaaaaccagagagagtattctacagttagaactattcatattcacttgtttgagacgggcttcatgccgagctataatgtttggacctcgcacggggagcaaggggttcgaatggaagaagatgaagtagaagacgagaacattccggactgggcccagtacgttggatttgaaggaaatacaacgtgcgaggtggaaggggctgacgttgaagatgatcttggtcagatgttacaggacatcaaggaggattgtgaaagtgaaaaggaggctcagaaattagagcgtatgttagcggatcacaagacgccattgtaccccggctatgaacaggggcacaaaaaattgggtacaactctggaattgttgcaatggaaggccaaaaatggtgtcagtgacaaggcatttggcgagctattgaaactagtgaagaacattctttcggaggaaaacaagttgcccaaaacaacatacgaagcaaagaatatagtctgccctctaggacttgaggataccaaacgattgtatcctctatcgcggtgaggagtacgagaacctagaagcatgcccggtctgtaatgcactatgatacaacattagaagagacgatccaggtgatgttgacggacagccttcgaggaagagaattcctgctaaggtgatgtggtatttccctataataccacggctcagacgtttgttcaggaacaaagagcatgcaagattgatgcgatggcacgcagaagaacgtcaacaagacgggatgctaagacaccccgccgatgggttgcagtggtgaaacatcgatagaaagtttaaagactttggaaaggatccacgaaacgtaaggttcagtttaagtacggatggcatggatccatttggagagatgagcagcggccatagcacttggcttgttacgatgtgtatctacgacccccctggctatgcatgaagaggaagtacatcatgatgttgattgttattcaaggcccaaagcaacctggtaacgatattgatgtgtatctaagaccactggttgaagatctcaaactgctgtggaagaaataaggcgtccctgtgtgggatgaggacaaacaggtggaatttaacctacgagcgctgctgctcgtaaccatcaacgattggcctgcccttagcaacctatccggacagtcaaacaaggggtacaaggcttgcatccactgtttggatgaaactgaaagtacgtatctgaaacattgtaaaaaagttgtgtacatggggcatcgtcgatttcttgttacgaaccacactgtccggaagaaaggcaagcaccgtaagaagcctatatttcgaaacggtaaaaccttgttcgaaatggtgaaagatctgaaagtagtgtttggaaagggacctggaagccaacccatagccagcgaagatggtcacgcagcaatgtggaagaaaaagtctattttttgggagttaccctattgggaagtcttggacgtccggcatgcaatagacgtgatgcacctcactaagaacctctgcgtcaacttgctgggcttcctaggtgtatacgggaagtcgaaagatacacttgaagcacgcaatgatctaaaagatacgaaccaacgtgaggacctccacccggaaccaaaggagaaaggaagccaatgcttgagcccatccagctacactcttagcaaggtaaagaaggaaagtatgtttgaatgcttggagagcatcaaggtaccgtctgggtactcctttaatataaagagaataataaggacgaaggataagaagttcacaaacctaaagtctcatgactgtcacgtgttgatgacacagctgcttcctgttataattagtggtattctccctgacaatgttcgagcaacaataacaaagctatgtgctttcatgaacgcaatttcacagaagatcatcgatccagaaagattagaagcccttcaaaatgatgtggtgcaatgccttgtcagctttgagttgatctttccaccttccttcttcaacataataacgcatcttctaagtcaccttgtgaaagatatcagtattctcgggcctgtgtacctgcacaatatgtttcctttcgagaggtacatgggcgttctaaagaagtacgttcgtaaccgtgctcgtccagaagtaagcatagccaaggggtatggaacagaggaggtcatagaattttgcttagaatttattgaagaccttcgtccaatcggggtggccgaatcacggcatgaagggatgctacggggaaaggggactcttggaaggaaagcaattatgactgtagacatcgatttataccgtaaagcacatttcacggttttgcaacaatcttttttggttgctccttacatcgaggagcacatggcgattgtaaggagcgaaaacatcggtaagtccgatggctggataacacgatgtcacattgatactttccccgcttggctatgacaacatctcatgggtaacgcgacgattaaccaacagctagcctttttcgcgaggggaccatctgggtccatcacgacatggcaaggatatgagatcaatggaaaggggaaatatgaggcgctctgctgatcctttatatgtcatttttttgttctgcacgtgtgtagttacctattgtacttagtactcaagaaccttataattctctattctgaattcctagctaagcttctcaagctgactagatgcagttaataaccggtatcataacagagatggtatacgatcgaaattgagtacattaaaatgcaaaaacaaaataatgaatgacatatatgttgatttcccttctcttttgctcaaatatgatgccaatgacaagttctcacggtgtatatatatatatatatatatataatgcatcgtcccaacagccaaacaattaagtaaaatcaattcaactatggcagcaacattaattatctctcattcgtacattctacctagctagcagatacatatatatagatcaatttcgctagtatgcatgcctacatgtctcatcaaactatagcaggagtatcgttgatcgatttaggactgggaggtgctagaaaacacaagctgacagcatcaaaagtgtcccaaatgggtgacgactgttttagaagacatccaaggaatagtagcaccttgtatgtggtgcattttgaatcatggtagagaaggcgttgctaacacacttgttggagtaatatcgaaatgaaatggctcctatatttgtatgatgctacaagctattttacaacatttctatagtcctttagaggtactaactgttgagaaaattgatctctcggttcaaaaaacagggaggagaacgggctagacagttttttccacctgttgtaactcgaaatcacagcaattcaatttgttttaatccctgattaactgtgtgcagtgatcggtggcgcccaatttattttcttttgagtcaccaccgattccctacaatgctaaatgtaaaaggggagcccgacccaagagcggatgacgatctctctcgatctcaatctccccgataaccagaccctaaacccaatcaacataggcgctggaggggaaacgtgtggcggttccgggacagtgtaggtggcaaccggaaagctatcactaccctcacgagtgatcgccggcgacccctttgggatcaagccagcgttctcactgctaccactatttcccctacaccaacaatacgcgaggtggttcgagtttctgcatcctctacattcactctggttcgagctagaacaattacaatgtcttagaacaatttcgaagacagcagcacagttgtcctgatcaaattgaacgaataatccatgtggtcatgctgctgcgcaggttcgtgaggatgaatcaataaaggcgggaggtcttcatcaccaggatggatgtcggcaaaatcagtgttaagaacaaaaacaccaaaagtccaggactgacctaagccacctcgcaaggggagttctttgagcacgattactcttggcactgcatcaatgtcatcaaagacagctctgagcaaaactctacctggaatgggatccctctcctgctaatccaccaggcgaccaaataggggaacagcagggggagaataacccacaaaatagaggcaattcgggaatcagtgctggtccaaaccagaatctggcaatgtctgttctagaaaatgaaacttctcctgtgttctttgtgccggattctgttcagggcaaaatccaggaagtgcttctcaagaatcagttgttaagacagttagcagaaagagttcaggggcctccagcagtccctttggcgcttgctcccttcactgctttgctgctcccaagaaggaatgcaatttatgattctttgccgccagtcttccactcttcacagctgcccgtggtagtggttcaacatgaggatcatgaggatgatatggaccatgacatgggccctctgggccaagatgagatccttgatgttcagcttttggcaatttcagagccactggaccaggctcagcccaagagcccgccaagaacaggaccagtgcctctcctgttagaaccaccaagagctccaatcaagaagaaagatggcaagactgtcttgtttgatcctaacagaaggcagagtgctcggatgcgttcttctagtcaggagctcacccagcctgaccccagaatgggcataggaaagccgagaggaaaatctgccaaaaaattgaaatagttggcaggtatttcaaaccttctagctggcaatatttctttatcagcttctgattttcattctgatttagatgaagattgtctctctacatctgattcctctccttctgactgttcaatatctttgctgcaaaagttgggagtggaaatatgcggtctatctcctgaggaggtggaagaggcgactttgggtggtgctaggaagaagaagcttccaaggccatctgaagaagacaactaggcagcctccctggactcttttgtttatctcagttttaaatggatagcagctatatctcttatcttttggttgtatgtttgtggaaccttgatcacctggttgtgatgtgtggctgtcagactatttatgttactacttcaagcactgagtatgatatgcttgacatgtattcagggtattttgttcaatcaaggttgtttgttataaccttgtgtttctcctgctatatttatgtcctcgatgaatagtcaagctagaagtatgaacattctctgttggaatattcgggggatgaactccccaggaaaatccttagccttatatcagcagattgatatcagtgcctgccacatcttatgtttgcaagagacaaaaaagcagaattttgttttagccgacatcaaaaattttgctccaaaacgctttgattcttttgccttctccccttcacgcggtgcttcaggtggaattcttgtggcttgggtctctcgtttgcttcaagggagtacggtccagattaatgattatgctgtgacagtcaaattcagctcgaatctcaacaatgctacgtggtttttatgttgtgtttatggcccttgtgctaggccgcaatgtgatctttttgttcaatggttgcgagaccttcatatcagtccagtggaaaattggctcatccttggtgatttcaatttttatagatcagttgataaccgaaacaagcctggggcaaatatgaatgatatccttattttcaatgatattattagtcacttgggacttttggagttgccattaaaagggacgagtttcacctggagtaatatgcaggataacccactgctgcagcaattggactggttctttacttccccaagctggactctagctttctcaaacactgatgttcaagccctgacaagaagtacttctgatcatgtaccatgtgtggtaaaaatcagcactaagattcctaaaagctccatctttagatttgagaattattgggtgcaactggaaggtttctttgaggttgttcagtcagtctgggcccttgaccctgggtttgaggatcctgcaaagtgcatctcctttaaattaaagcacttgaggaaaaaactactcaattggagcagaaattactcccaactatctaaattactagtcaactcaaacagggttctagatttcttggatttgatagaggagcttaggccactatccatcttagaatggaattttgaatatgaaaagatgtaccaataggtggatgctcctaggtgaggaaaataccaaatttttccaggccatggcaacagaaagatttaggataaactctattccccaagtgataaatgatgagggtacctctatttctgctcatgaggaaaaagctgatttgttttaccagaattttatgcaaagaatggggatcacaacttctccttcaatggcttttgacttgccttccctgtttgccccccagaatctggatagcttgattgaccctttttacacacaggagattgatagtctaatttctttactcccggttcataaggcacctggaccagatggtttcaatggtcagtttgtcaaaaaatgctagccaataattgcacaagatttctatagacttgcagcgcatttccatgctgaatgcactgatctacagtgcatcaatacatcttatattactctgatccccaaaaagcatctgcctgaaaaagtaaatgattatagacccatatccttgatgagcatcagtctgaagttcctaatcaagttgttggccgataggttacaaggggtcattctcaagattatccatgtaaatcagtatgggttcatcaagggcagaacaattcaagattgtttggcttggtcttttgaacatatatcatcagtgtcaacaattaaagagggaaataattctgcttaaacatgactttgaaaaggcctttgacactatagaacactcagcaataattcagataatgaaacatatgggctttcctctgaaatggctaaattgggtctccttgattttttccacagctagctcatctgttcttctaaatggtgtgccaggtgcctacttcaaatgcaaaagaggagtgaggcaaggtgatcctctttcacccctgttgtttgtccttggagcagacctcctacatgctgtagtaaacagagctttctctttaggactgttgtccaagcctatcaatgagcaagacaataagggtttcccaattgtgcaatatgcagatgataccctcattctgcttaagtctgaccaaagagaactcttctgctttaaagcaattctgaatacttttgctcaatccacaggacttaaggtgaattatcataagtcacagctttaccccctgaatgttcccccagaaaaagtacacttgttagctggtctgttgggttgctctgtgggacaaatgcctttcacctatcttggtttaccaatggggacaacaagacctagactgattgactttgcccctctggttgacagaattgagagaagactaacctccagctctatgttcctgccctatggagggaggctaacccttgtgaactctgtgttgtctgccatccctacatattacatgtgctcccttcagcttccagtcactgtaattgaagcaattgacaaggctaggaaaaactgcttatggagagggaatgatactagctcgaaaagaaagtccttagcggcctagcataaagtttgtagaccaaaggaaaaaggaggcatgggtgtcattaatctgaccttgcataacattgctctttttctcaagcacttggcaaaattctatcaaggggctgacctcccttgggtaaagttaatctggaattcatattatcagaccaaggttcctcacggagtttttaacaagggttctttttggtggagggacattatcaatctttcagattacttcaggggaattgcaaagtgtgaggctatctcaggtaacacagttttgttttgggacgacatgtggaatgaccaaattaggagcatcacttacccacatctctgtggccatgccattgccagaaatattcgttggctgtcacctgtgctaaaccctttgaggattgttttaagtttccactgacccaggaagcttacacagaatttctgcagctaaagggagagttggatgctctgtccttagcaagtcagcagggggataattggagttttatatggggcaggaacaattacacctcaaaagctttttacaagttgaattttgcagccatgcaacatcccagacctttccgatggatctggaagaccaagtgtgtgatgaagataaaagtttttatatggcttcttttctctgataggctgaacacgagagacatgttggacaggagaaaatgcgcccccctaaatgctgatcttacttgtgtcttatgccctttgcatcacagagaaactttgtctcacctgttctttcaatgcccttttagtagaaagtgttggcagaagctgggaatatcttggaacacttctctagaagtctttcagatgctggtgctagcaagattgagatttcagaaaaaaggattcttagagatttgtttcattgcgtgttggcacatttggaagcaaaggaatggaaagattttccagaatatagatccttcatttgaccgctggtggaattcttttaagcataaaattcttctacatatgtgtaggatgaatgatgatcttagacaattagtttctggggttgtagccttttgtagtttttcttttttcctgtaaatactttgttggcttctataaaatacactactgggccattgcctggtagtattcctttcaaaaaaaaaattgaacaaataaagttaaactacatggtctaagatttctgttgcaaagcaccatgcacgactagctgatctgttcaacgagcatgctggtttttacatcaaagaaaagaaaacgagaatgctgctggatcatgtgtctgcatatacatttctccggaattgaattgagtgctctgatcattccttgtgattattcttctgatttcatcaaattgtgtcctagtcccggcatacagaccatcctattaacaaccccgaatgatgtttctccctattgataatgcatgttgttttgttttggataaggatacagtctccaaaaaataactatgaacattaatatatatgaaagtatcaactaatatatgattttattgaagtattttttaaactaatctatacatatgatctccataatttcaagacaaatatttcagaaactattcatagtcaaacattttaaaatttaactttactcttgtccaaaatgacaagtattatcaatctagaggggtagcaagtgtgcaagttttaaaaaggaaatgttgtttattggtctagaaaatttgaaatgcagcaagcagatatgcaaattaaaacagacttaaggcgttttaattccagacgacatggaatttgtttacctctgtaaaaaaatttggcatcaatttagtatagggtgtgatgccttgagagactagttaatcaaagtaaggaatgctaatacttactgactgcgcccatcaaatttatctaaaaagatactcttctagagcacttcatgtctcaaaatatataacttcaatattatctaaaaaaatatactcttctagagtactttatgtcccatacttccattaatatccttcctttcaaatttcttaattttcatctttaaccccagccatcctcccactcctgagtaagatttgtcaagcactaacaatttttacaggtagtaattccctttaacaatcacccatatatgcctttattgcagttgatatctgaacactgccaaattctatatattcgtcactctcttctaattaacctccatatatcctcacccatatatttcaactgcagtctgcagccatctctcatccgcatgtcttcatttttttctcctctgaaatttaatttctctcgcgttcttaaacttccagaatttctgtagcgtaaatatgacagacaaaaaactgtttatattcctagactcctagttgcatatcattgtgccatatatgttgacctgaagcacatgaacttgaccattatttttctacaaaataccacatgcatatatatacaacaatgttggcttgggaggcatcgggaaagaagtggacatatagcagaaagatacatggccaatgaaccatgggtacatctccaaaagagtgcgcgagtgtgaaatcattcgaatggattcattccgtctctgtaatgaagtgtgcagggccaatgtgcagtttggcgatcgatgatctccttggtttgatcacgaatgaagctttgatgtgaaagtttgggggtgttgtggacaaagagatgaaagagatttgggggtgcaaagttcctattgctcttgaagagcaattttacggtccttgaggaggtaccatgaggtaccattttttctattgtaaatttggtatctcttggtacctaggtactatgaggtaccatgaggtaccaaattttacactaaaaatttagtacctcatggtatctcctcaaggatcgtagaattgctctcctttgaaagtcaagcatttcctgtttttggctgggagagggagaataccttgtgctgaactcttagttcagagaaattggaaggggggactaaattctgtaaattatgcttgggaactgaatctactaaccatgttctttttacttgtcctattgcttgctttgtttggtgctctgtaatggaggtaattggagggggttcaattccaaccaatttttgggatggtataaaagctgttaaggataaactcagggtgaatttaggtctttttctttgtgctagtctttgctggggtttgtggttggtaagaaatgaccttgtttttgagaataaattggtgaaatcacctttgcaggtagtgtacaaggcaatttctttgatgcataggtggaaggtgctgctgccaaaagaaagagatcgcgaagctttgaacatgctgcttgagaagctgaaggctaagatcgactctcttcatccaatgaacgtgctaccatacaatattagtgtttcagtgttgttgctcttggggttgaggtctcttagtcgtttggatgtctttcttggcagggcttgtaagtcttttggggtttagctatctagcgcttgatgggtactggcagccccagttttttccttgtttttcctttaagtttctgtatttcagaccttgttatgtttggctttctcccaaaagccgggtaaataaattacctgttatcaaaaaaaaaagccaagggagaccagtgataaatgatgtccaagagttgttgataaaaatattaatgttcagctgagtgatgaagcactcgagatatcccctgcttagcttactcggagtgattaatttcgtgttactcagttagacaacctttgctcgtcgtgttaataatgaatccatgaattgctccatttagcttcatggaaattctttttcataggctaatcactgcagaaatcaaccaacgtcgttgactcatagtacaaaactcatgaattgtttactctatctatttatttctgatatatttcaacgtgataagtaactgcttatgttcatattattattcacgccatttagatttcaagttgatcctatgggtacgatgttattcttgttttaatattctggattctggttctgcttaaataattcaagttccctgcttgccatggatgtgtgatgtgtttcaatttggttatttgattccagtttcaattattctagtaccatgcgtagtcatgggagtgcaatttggttctttattcaagttcctgtggataagcgctgatcacgcttactcggctttgccggcaaatgctaggatgtattcactattgtccgggatggaaactactatttcaattcatgcctgcccgggatgggaactactatcttctttgacttggtgtttgaaaatatgtttcctatcaacgaaagaaagccttatgttcaagctttattgccaatgttgtgtacgtgtgttttctagttccatattgtacttgctgagtattttttatactcactcttgtgttttatttggttttaggtacgcattgagaccgacatgcatgggcgggaagtagcacccttatatacacgtctatttgcactctatcaaactatattgcttaggtccataatgatacttaaactatatcatggttcgatcttgtaataatcttttagaaatctattagtttctttccatggaattataaggatggatcgtattatgggaatgatattgttattagtttaacttataattgcatgtcgtggatatccatatttacaagggagactctgccgaaaattctaataattttggaagttagtggtttgagtgtttttcggtgtggcactctaggtacgtggttacttggggtgttacagttggtatcagagcgggcggtaggtccatgggaaataaatatgacaacttaaaatattgatcatgttttccttaggatgggaaaaataaaagtaaaatttgagttagatttaaactaataaaatttgacacactggtgcacaataggatgggattgggtcattctttgcatcacacttctgatttattttattgattaccgatctctatctcattgtatttgtgattactagagttatattgttactagatatatgctcttctacaaataagacctgattatatattaagtaaagctaggaggtataaaaaaattattcagttttgattcgttggtgcggtgtatagtgtggagattaacatttgcacataactatattcggaaagctattagggagaacaacatggggttgcaataatgagttatacttgaggtgtgtgagtgtacatgataaagttttagtttccctagaccttagttaaactagcttgatcatggctctaacttgtgttaatctcttctatagaagtaattaacgttgtatcctataagacttaatgatcctttaagaataggtaacttttcttccatataggcaatgcaaagtggttagaggaggggacttttactctttactttttttttcccaatgccaagtgaggttgtccgagtgtgagtgttaggtcgtgatacatctatcactgtaccgagttaatagtttgggtatgggatggattggcccccatgccatctactcattctatttttttcttacagtggtgtgatgtgtccatgtgttatgcctgatgcaccaaggtagtgatgtcttcacccgaaaagcaaagaaaaaaagtaagaaaaaaagggatgttccattttttagacttgagattcaagggcgatatggcttattagtttcttttttgagttctattatgtgactatggttgaggtaatgaaaaaaaaactttctcatttgtggtacacgttctgaaataattccaaaaggaaaacatttgactttgcattcatcagttggtgacaaatattctcctaatttctaattttcttttttactttcagaaaggaattaacactaaatatttattttggtttcacttttgtggctttcattcgcttggttgttcaaacataagtgttgtgcgattgctttgtagtgataaattataaattattgatatgcacaatactatttgaaaatactaatttaaatcttgttatggagaacttgtattaaatctgaatttctttaccaagtgatttattttcattacatagctcagaagtgtgtgcagtattgatattcttggattgaagttcacagctatttgattattaatctttatttgattttttttatagaatagcttctagattcgcagtttgaggtgacaaacaaactccaaaactttgatttttggttcatgagattatggtaaatatatatgtatatatttcctttttgtctttttttttaaaaaaaattcaattcgaagaggattcttccttctacgcattttcttcaaaaagtggttttatattcggttcatgttctaaatatttccattgtctttacatgtgattcttgaatttattacagatagtcattatcctgatattagatttcttaagaaaaccgtgtttgagactaaatattcatttttttatgttgtttgttttgtttcttgaccttccatattcgattatttcttttcaattacacgcacccaacaaatttttttttattgagtggatttaattcatttactttggaatgtttgagtttcttagaaaattcaagatctatcgatgttcagagcagtttttgaggataatgctttcgttctagttactcagaaagttcattataagtggaacaagtgtggcctatgatccttgagattgacttcgtggatattgtttattacctctaaataattggcaatcaaagatagactttcagtagttgttgaaggggagcaacatactaataagatgtgatgggtgtgtgtttatttctttaaattttaagttaaaagcttgtgttgtattcccgattcccttgaccataaaggttgttttcacaatgtgttttattgctttgtagtatgattcttcatgatgtgttctaatgatttttgaatatgtcccaattgggtgttttagtatgtgcattgcgcttctttggcaagccaatattctcgtctagtaggtctgagttggtttattagctgcttttgaattgttagctaccatactttcttatgctagttaattattatctaccatacctagacgcaagcagtgttgcgaatataggagatgtcctcgacattgcttgagagttctaactactttatatgtatgttttgtgtattcctttccttctttcggtttctcaagctctatagtgggcgaattcgagggcgcattcaatgtgcactttgaccatcgataatgtaataccccgtatatcaaaagatatttaggttttttttagttttggttgacttgttaaaataaagatattaacagaaataaataaaagaaaaatatctttagaagtgggccaatatgagaaggcccataaacccagcccattagttctcccctaaaacctagagagaggggaaccgaatcccacccccccacatagtgccgccacccctctccctagccgttgcctccttcctcccctcctcttgtgttcgcatctcacccatctccagcaaattgctctccctagatctccaccttcatagcttggatcaagaagcgaagtagaaaaacggaacgaggaggaggagaggagtagaaggaggggttagaccggagtctcccctattgtcttctcacaagttctctaaagaaaccctaggtgaggcttatccccttgttgtatcagttgttctagcatggctttagtgcattaatttgtggttagggaaggttagagaaggagtttgggtaattgcggttcggtttgttgcagttctgcatgtgggcagatttgcagtgcttcagtgtttcgatatttcggggctctaaatgttattttctgaaaaagtgtataactaggaagttgtagataatgtttggatatatcttctggccaaagggcacgattttatctcaagtggattaggtggtggtccatcagatcgtgcatgataccaatccttcgttggaggcaagtgcatgacgaactaatcgtgtaattcatggattgtttactctatctatttatttctgatatatttcaacgtgataagtaactgcttatgttcatactattgctcacgtcatttagatttcaagttgatcctatgggtacgatgttattcttgttttaatattctagaatctggttctgcttaaataatttaagttccctgcttgccatagatgtgtgatgtgtttcaatttggttctttgattccggtttctattattctagtaccatgcgtagtcatgggagtgcaatttggttatttattcaagttcctatgggtaagcgctgatcacgcttactcggctttgccggcaaatgctaggatgtattcactattgtccaggatgtaaactactatttcaattcatacctacccaggatgggaactactatcttgtttgacttggtgtttgaaaatgtgtttcctatcaacgaaagaaagccttatattcaagctttattgccaatgttgtgtatatgtgttttctagttccatattgtacttgctgagtattttttatactcactcttgtgttttatttagttttaggtacgaattaagaccgacatgcatgggcgggaaatagcacccttatatacacgtctatttgcactctatcaaactatattgcttaggtccataatgatacttaaactatatcatggttcggtcttataataatcttttagatatctattagtttctttccatgcaattataaggatggatcgtattatgggaatgatattgttattagtttaacttataattgcatgttatggatgtccgtatttacaggggagactgccgaaatttctaataattttggaagtaatggtttgagtgttttttggtctggcactttatgtacgtggttacctagggtgttacagataatctccttgacttgatcaagaacaacgctctgacgtggaagttgatgagatcaatgactggggctcggaaaaaactgataggtaaatagatcaagaagactaggaatgataagacttagctgaatgatgtagaaaaatggagatatcgcttgtttaatttactcgaggtgaataattttaaacatgttcactatcttgaaaatgaatctacgaactgctccagttagcttaatatgaattatttttcttataatcactgcataattaaccatggtcgctgtctcacagtacaaaatacaccagtgcaatgattgagagagaagcatgaaattgtacaaaatctaatattgtttcagggtacgtagtgaaacttcactgaagtactttggtagaatttaaaaggcgttgatgcacaggtagccagattcggtcttagttatgcttaaattcgagctttagagctatacccacttgagttccttgtctaaataaacatccaattgacgttaagggtccgtttcaaatgggatatagatatatatcgactagaaaatagacgcgcctgttagcacgtcggattatttaacaatttataccgcaagcacgtttaaaacatacgagtctttcattttttttattgatctagtgatatcaatatgcagcttaacactgatgcagtgataatcgaataatggaagttatttatatttatcattatgaaaattacatgaatcattaattaatacgatatcccattgaattttgcaaattaaccttacatatttaatatcagtactaagttaatttggttcggctatatcactctttcgattagcaatggagctgagagcatcaagccagatccattacagctgatacctatggctcgatgtggccaaagtaaacacctcgagagcaacgttatagacatccagctctagcgctcggcgtctcctcatcctcacactattttgacggtgtggcgcatggtcaacgctgatcacatacactgcttctctctcctttgatctgcttggttattcaatcggtacggtaaaagaggatgtcttgcccttacttctcactaccctccaagacgaaccaacgtcctgcatggttccatgtgtcagccaatgttatttagcacacgttcattcatagcgtacacttttatctgaaaactttcatctcaaatacattcatccgaaaagctttcattcaagaactttcatccagaaagtttttatgaaaattttcacaagaaaaaatgtatgttgggaacgaatgtgcaccaaatagcaatcctgacttgtgcctcgtgcttagtcaggatttgtgccactgttacttctctcacttcttctgtttgttgtctcaagatttgtacacatatttggtctgaagtgcctcattagcagcgagcgaagcacatatggcgcaggagatcatgagacattatgtgaggatggccgttgtctagccgttgaattggttgcagccaggttgtggtcgatgtgatgctagaactggtggggacacatgaaaacgtccgctctcagttggcagtgaccgcgagctccatgactatactagctaagacaataaaaaggttttctagaaatcttcttcatggtatctggcacatttgaaaatagagaaatggacttatttttccagaatgtttagcccactttccaatcttggagggcttaatttatgaaagaaattattctgtatatatgtagaataagagatccgctgaagcaaacaatttttgattggttacaaactttgtaaaattttgagtcctgtatgtcatttaaacttcttgtaaatattttattctttaaaaaaaatacattgttgggcaaaaccctagcagtcattcccgtaaaaaaaaatggtgtgatactgtgctggcggaaaacatgaaggtgacactagaacggatacccttatctcaatcgggcggtaagccccatctcaatcaggcatggcgtccgtcacaggctagaagtcactgatgtgaagagctatctcaatcgggctttagtcaacttacaaatataaacatttcatatgaaaaatggaaaaatagtcatctgtgacgggctttagttaatgcccgatagagattaagtatatagcccgtcactgatgagtcatctgtggcgggcctatctcaaaagggcctcaagttggtgcacgtcacagatgatggtgatttgtgacgggccccaacttggggcccttttgagataggcccgccacagatgactcatcagtgacgggctntntacattaacaaaatcggcctttacctaagcccgactcaggaagccaacnaaacagcaaccgatgatggtctactatgggtggcggcattggatggcagggtgtgcctatgggaccggcgcatctgggttaatagtcgacatccggtaaaattagaaaattaagttccttgtagccagatggttaacgagtccaaatggggcattgggcccgggaggactacatcccgccc

SEQ ID NO: 68370 - DNA, 30461 bp, Oryza sativa
  unsure (1)..(30461): unsure at all n locations
gagtgtacttcataagttgttttcgtgaaaaaccatggtgtctctttacccagtatggaatcagccataccctatggaaagaggaacccttctcttcaagccaaaaggtaagcccatctcaactcattaaatggcctagtcagtagaacaacagcgtccagtgatgagtcgagttccactgcttgtatttcgccgcactagaactgatccttctatctgtgacaggctcaaaatgcatagaaatagtgggccgtcacaaggctgtcatctatatcggcctgtaaagtgcccgatagagatatggtcgtacagacatgttagaagggcataaagctggggcccgtcacggatgacgccaatctgtgccgggccacaacttccggcccgtttgagatacgaaccgatatctcaaatgggcctaaagctatggcccgtcacagatgatggtcatctgtgacgggccataactttaggcccatttgagatatagaatgttatctcaatcgggcctaaagttgtggcccgtcactgataggtgtcatccgtgacgggcttaagttttatgcccatctaacatgtctgtacgaccatatctcaatcgggcacttttcggtccgattaagatgacttccttgtgacggcccactatttctaagcatattagagcccgtcacagatagaaggatctgtactagtgtgagggctgaggatggtggtggcgatggacgggaaggagatcttttttttttcctttctattacttttcatcaaccatgtttgattgttgattttttttcatcctcttttttttcttttccttgttctctacatgggcccagctcagggcatggcccttgggccagtgtgacagtggcagtgatatgcatatgctctagtggcgcgcgatgcaggtatagcatacatgagtaaagatttatctcaaacttaggcatcaccacgtgcaatgatatatatatgctggtagaacagccaacatttgaagtattgattgattgattgattttcctttggacaaatataaagccgaactaaaattttcagatttgcttatatatgattcttcttttcattggaacaatcagatttgcttcatgaagaaggatttggtagagttggacagccatggatggatctctggaatagagggaagttgttctaaggaatcattccatcccagttatgaaacactcaggactatggactatctgaaaagcaagaaatgttgcttgcttcaagaacaccttgacaaattttcaaatagacataatattctaaagttttatgattggatcaatgtgggctgttttacataactcattgttaagggaataaaagtgggtttggggactcaggcttctaaagcttctaaatcttgtaactagaggatagatgggtaacttttgtttatatgatctgagattgcgtgctcgatgatcaacctgtgttattttggccttaaatgtttcttcatgtctgcaaattttgtggaaaccagtgtcatggcgttaatggagattggggaaggcctctccaatctttctaaaaaagaactctgaactaatgtacactttgatgatcgatgatctccctgactttgatcatcaacaaagctttgtttatcccaaactatttttgccatgtttgcgcatatgtttcatccggcgagttgggacgacttcattgagggtgacctcttcatgggaagttcttcgtgttcccaaatgtttgatctgataaactggccgggatgagtttatcgagtgccaaatcatctatatgtcattacaagagttgggacgacttcattgagcgtgatctctttatattccatttgttcgattcaatattcatttgacagagcacaatgacgtatttagatggaattttcatcaaaatggtcaattttcagtccgttctacgtatttagccttaattaataatggctacattgagaggaataagtttttacggaaacttaaaatgcctcttaagattcagatttttatatggtacatgcttaaaggggtcgtgctaacataggataatttagcaaggagaaattggcatggtagtttgaaatgttgtttttgcatgaaaaagacgtttatttgtggaatgtcactatgcaagatttctttggagagatctacaattttcttctggtttaaatactccgcttagtatatctcatatgtttgagaattggctggtgggggttgataaaaaaactagcaaacttattcttgttggagcatccgctatttgttgggctatatggttgtgtagaaatgatatggtttttaacaagtcaccttctatatcttatatgcaggttcttttcagggcaacatactggctccggtcttgggcttaactactaaagtgtgatgaagatataaagttagtgaagactgcatgtcgcattcttaagtcaacggttatgcagtttttcgctaactttggatggagattcacaaatagaattcaataattttgtgaacttctcatgttgtatgcgtctttagtagttggtgtgctcctatttttttatgactatgtttctttattttgttgaattgctataataattgattgtagctccctgaaagaccgggattctattccattataaaagaaataaattagatcgagtttatcgagtgcaaaattagacaaccccttagtcaaagaaaaaacgccctctgccagggcggcaagggtgtcgcctgcgatcgcatgtccgtgccatttgccacatcatataatacatcatgtgggagggtgtaaaagaaaacctcctagaaagcattcgggatatagatatataaaactaaaaaaagaaaaggaaaaattacatcaaaggtccctcaactcgatagccagatacaaaatcgtcctccaaccgcaataccaagtaccggacgtcccttaactgtcaaaaccgggtatttttcatcccaaggcaggattggagccggatttgtccgacgtggcacgttgaccacggactccggcgctgagtcagcacgggtgggtagttaggatataaagacacatcgatttggcgcggttgatttcttctccatccagcgaaaccctagagcaggaacaagcaagcggcgcggcggcgggcacaatctgggatgcggcgtgcagcagcgggcaagatctggcaagtggcgactcagcgccggagaccgtggtcaacgtgccacgtcggacaaatccggctccaatcctgcctttggatgaaaaatacccggttttgacagttaagggacgtccggtacctggtattgcggttggaggacgattttgtatctagctgtcgagttgagggacctttgatgtactttttccaaacagaaaatatactgaatatttaaaaaagtaaatataaaataaaaaaaattccttgacccaagtgttgcaggcagcagttgtctgcagcagagcccagtaggacatcacggcagcacaggaccactaggcacgagggcataacaacaaagacaaaggcccaaaccaaccagcatcctgggcaactacgtggttagaaatcggatcgatattgtcggctaatgtgggcggaggccaagtgtacaaaatcctgtagatatatataactatatgattataatcagctgatccactggtagagaagtgaacttttgtaccgcttagtaatcctttttttaccggttctaacaaccaagataaagaaaccgagactaaagttttaatctttagtaccggttgaaataaccagtactaagagatgcatacaaagtcaaaaaaaatataaatattgtgggattcaaacccaagatctctcacctcaacccttactcatgtaaccatcccaccaactccacacatctaacttagatagatatactttcttttttatctaaccctagagacatcttaattggtgttaagcgggactaaagatccttcagcatgaatcttagttggtgttaccaattagtattaaagatgtatttttagtaccggttggtaaaatcaatcggaattagagatgtttctaggatttggactttttgaactggtaataaaaatatatttagtacggcttctaaatataatcgagatatttatgttttggtactacgcttgcatactgtatagatcccacaaattaacactacaagcgtggtaaacttctgttacatggtgatagtgaagctaagttgcatagacatcaacttgaatgttgaataagtaaaacgtccgaataaaatgtcgtgctcattaaattcctacgaaatttcaaaacacacaaaagtttcaaaatttttcgtttgaatggcacagtagataggaaaaacgcatgaattcaagacacggaaaaaacaacatgaggcaagactcatgttcattttcctatcccataggaattttaaggaatttgtaaaaaggctccataggattattttcctaatgcttttaaagtaattttctcggtccaaatatgcatgcctacatgttttgcgccgtgcagatattattaggcttcaataatatcgtcaaaagggggctaaacataattcaaagcctgactaagatgtcaagtcgtgacatttttttcaggtaataattccatgtaatattttttcctaacttgtactacctctttttatttttacatcgaatatttacggatggacgtagtactgaagtcgatatctataagcatagctaggggtgttaatgaccgatgagtcttttcaagaccctacctaaccctcatatattttttagataaaaataaatagaaatttagtccaccccattatatagtccttaaattatataagctaaaatgttaaaccctttccaactcctaagtatctaggggtgaaaccgaaacctgtattttacggaatgattgaatttcttttggacaaatataaagccaaacaaaaattttcagctatataaaatcagcctatgattcttcttttcattggaacaatcagatttgcttcatgaagaaggatttggtagagttggacggccttgtggtgcaagttttttcattggcttgcagtcatcgccttgccaagcaagggctgcaacatgatcaggccgaagaatcgatccaacacatcgttgtcacgtgtgttctctaccggcaggtttggtcattaatcgttcgcagtcaagacatgaaccatttctctagctggtggtccaagggagtgaaaggcattgaaaaggattgaaattaaaaaggaggttcaacttgcttgttttacttgtgcctgggaaatttggaaacatacgaatgactgtgtattgaatggcataagtcctagtatatacgatatatggttgtaatccaatcggtgggcaaatgcaagtgtattaaaaagcaggtttgatgcttggctagagcttcaaacctccatgaggttctttgtgggtctctaatccttacagagtaattgtaggactttgtatgtgtttaggtgtaggggtttctaccctctctatgtttttctctcttgcttaatgaaatgacatgtaactctcatgtttgttcatgaaaagaaaaacagtttgctgcatacaggtattatgtatatgaatttaggggttagaaaaacacgatgtgcttctccctgccaatcatgatgtagtacgcacatgccctcgcctctttgtctatgagtttgaggaaggtgctaaatagtcccatattacttgtaaagtatttctttcactggtttttagggagagaacttatggtatcttttcgggggtgagaaaggatatttgcactagttattgtactagtgtgcaacaaccactatttcgaagctaaatatttttaactatttcttgcatccattaagataggaccgatctaataatgtaggaccaatataacatggtctacatttacaaaaggtatcttatttaaatgtagctctctagtgttgagcttccactcttgcttctattttcacacatgtacagtctcagcattctctcctcccattctccactgaggctttactaggcagtgataaatttgaactagatagaacttttgttttggccaatagattaaactaactaaatctattattcatccataatacgtagacctatcgttggatcgatttatagatcttggactgggaggtgctaggaatcccaaaggtgctgatgaattcggtagtgtatgtaccgttggctttggaagaaaatgaaattgattttgctggcacatatatatatagtatttgtattatcctagttatatgtgtatcgtgtatgtagcgagtaattcagtagctggagtagttaagcaaaccaagtcatgcccggcatgtgttcttctttagaaaatggagtcatgctcggtgttagatacaatgaactaaaacgtgatttgggaatattaattagttgctattctgttatgaataaattccggtgaaattgaggttagttactgggtattgtttggacttgtgcggtcaacctatatatagcctattgtttatacttttgattgttttcttgaccgggaattatacttttgattgttcgttcgttcttcaatacggtcaggtaaggagagcgctccatatgtccacatccgatgcctggaagggtgtttcctctcccaccgcattaagcctttatgcattgtgcataaactctacggaagggtatcttcgttattttgacagtcatgccctcggtttacgatgatgtcctgatggtttatgcaaacaactccaaccagcaccagcaccaggatatcctaccggacaatatggtcaccgccgttgccggagaagatagacgttgcgtatgttttacgttaatatagtcatggtttacgctaatagagaaggaccatacgcaacgtaaactatgcggtgggagaggatatggtcattgccgtcgccagagaagatagatgttgcgcatggtttacattaacatagttatggtttacggtaatagagaaggaccatgcgcaacagccatgtggtgggagagcatatggtcaccgccgtcaccggagaagatagatgttgcgcacggtatacgttaatatagttatggtttaccctaatggagaaggatctgccatgaccgctgctttatttagcgtttgtagaagtacaacacaaggtaagttatatatgtagtttagatgaactttcgtagaagatccatataagtgaatggttattcgtttacataaattcctacatggttaatgcaaaaacttattgcaagtacatagccacagcagatctggagtaaatgagcggattacgttctattaaataataatgttatgttgtggccttgtgggccaaccccacaatcatggttcataaacatcgtatctttttttaaaaaataaaagacttaaaagacactgcaatttatagcggatggcccaacaaaagtacatgaaaatagcccatttgcgctttactattttactactaaaacccttacgttttcataattatgctcaagttctcacatctgtattccatttagcaccttaatatttttagaatttattaactactgttagatattttatttgataccccatagattgataagtaattacgtttgaatctctcaaaagtaattacgtaaatcatcatgtggttactcacttactctcataggatcttccacaactactattcatcctcggaacatttaaaaattggattacgccaagcaggacgacaagctgggaatcagcccatacacccaaaaagatagattatatgtcgaggacgacaagggttacgccaagcatggactcagcccatacactaccagctgctgcctacgccaagaagatgagagtttacgctgcaaaaggttagcttccaaggcttgtacgcgtacgcgagcattgcgaggttccctatgcgtaaacacatccatgctatgcttgaaaggctaatttacacacacgaaggataagtttacgtccacgatccacgggcaagcgtgaaccatatgtaggcaagcaagggctgcaacatgatcaggccgaagaatcgatccattacatcgttgtcacgtgtgttatctaccgacaggtttggttattaatcgttcgaaggatgggtataacctacataatcttgccaagtacgtcaagatatgaaccatttctctagctggtggtccaagggagtgaaagacattgaaaaggatatattgaaaaaggaggttcaacttgcttattttacttatttttgggaaatttggaaacatacaaatgttgcgtatataatggcataagtcttagtgtgatggttgcagtccaaccagtgggtaaatgaaagtgtcctttgatgcttggctagagcttcaaacctccatgagttgctttgtaggtctctaatccttacaaagtaattacaggactttgtatgtgtttaggtgtgggggtttctaccctccctatgttttttctatcttgcttaatgaaatgacacataactctcatatgtttttgttcatgaataaaaaacagcttgctacatacatgtatatgaatcagggggttaaaaatacacgatgtgcttgtgcctgccaagcatgatgtagtgcacatgcccagatgccctcacctctagtccgtgagtttgaggaaggtgctaaatatatagcgccatattagttgtaaaatatttcttccactggtttttagggtgagaacttctggtgagttttcgagggtgtgaaaggttatttacaatcctgcaataggttatatgtgggctattgctattgtactagtgtgctacaatcgctatttaatagcaaaacatgttaaactatttcttgcatgggatccattaaagatagaccgatctaatataataatgtagtatcgatctaacatggtctacatatttacagaaggtatcttatatttaaatgtagctctctagcgttgagctacacactcttccttctatttttgcacatatacaatctcagcattctctcctcccaatttccactaaggagtgaggcctcactaaacagtgatatactcgaactagatagaacattccgttctggccaatagatattgaactaactaaatctttattattattcatacataatacgtagacctgtcgttgaatcgattttatcgatcttggattgggaggtgctaggattcccaaaggtgctcaagtgttgggaggtgtacactacatcggatcaggtcacctctgacggccccaaaccctcacatatgagtggtctgggcctggtcagagaacaatggtcactgttgaggtaagtcacctttgacgggcggcgaccgacctttggaggtgacagtcccttctgacggacaagtactctatgccccaccagaggtgagtgtccccagtaacctagagcttgttacaacctgtcggaggtgactcacttgtgacgaatctgaaagtaacggcccgtcacagatgactcacctgtgacggcttttgcattataacccgtcagtgatgagctacacctagaaagaaatttaattgattttgcattatgttaagtaccgttggctttggaagaatgtgaaatcgattttgctggcacatgtatatagtatctgtattatcctagttatatgtgtgtcatatgtatgtagcgagtaattcaatataccgggcagagttagccaaaccaagtcatgccatgtgttcatttttagaaaatgaagtcatgctctgtgttagatactatgaactaaaacgtgatttgggattttttttagttagttgctattctgttgtgaatgaattcgggttgaaattgaggttagttactgggtattgcaagtgcaactaagtaaacattctctcatcatctatctatatatatctatctatctatacctatactaattaattagacactttctacgagctctcgtattatccagaaacgattttgctatatctttgtcgggtgactttttattgatatttgacctttttctgttcgttggatattgcactacgattcgtgctggacagtgcgggatgaggatgagggcccgtgtttggacctgcctcgtggtagtcgagaaattacagtcaacgtgattggacatgttcgtgtttgaacatgatttttttagacaatgtgactcgatctccgtgcgaaaatttcgattttctgcaacgtgtcagtagagtgattttttttctattaaatttgatgttttcttagccgtaggatcctgcgccaagattagttaagaaaattacagtcctatataactaaaattacattcataaatttagttgatacgatatgtaagtgcactataattttaataaaaatattatgtaagtaaatatgtatttgttatttactttaaaatataaaattacaatcgtatataactaaaattacatttgtaggtttagttaatatgatatgtaagtgtactgtaactataactatagtgtaattacagtgtaattatagtgtaattacaatttttagtaggtgggttggtgatttttttttacaatataactatagtgtaattactgtaatatagtgatcaaatgagcctaatctaactatctaaaatctgtgtgatttagacaaaaatatgtcacgtgatggataggtagtcccatgctggagcaagcagatcgttttattctacctccaatacatatctccagcacgtaacggtagaaacggatagtttcctgcggtgacggaagcggcgacaaatgacggaagatggtctatatctggactctaaccggagtattgctccagattggtttctcattccaaacaataaaaatatgtttcatatgtttcataaaattgcatgtgatgcagaaaaaatcaatttttatatgttgtatccagtagctatattagtactaaaatacctattattggttgtatactaattctcaagggcaaatgcatctttttacaatgaacttaatggtcaactgacggtggagtgacggcaatggcataaaagggaggagaaacttgaaccggtggcataaaaggggagaagccaatttgaagtggcatataagggagccggttaatttagagtggcactctgccgcgcctccagtggtgccgccgttgtaagggtcataatctgcccacaccacgcactcagttctcacggatgtgtgccatcctctcttttgcaggtgagagtgcagagtgcagagtgcttcagctgaaagtgagtcttctgattcccctcttcagcccaatagtcctctatgtggattatttgaatctgaatgtacatcattttctttcactatgtgtggagattatgaatatcccatatctacacggcatgtatagtccgactaggtacagggtaccatatatagatagaaaatctttaagaggactcgagttaggtctaaagttgtatgtcaaggaaatatccgagatcctagtcggttacgattgtatcttatctgtaattacatatgccattagggatatggattgtatttggtaatacggacctcttcccctatataaggaggggtccgggtcaatctagggatacattttttctcttagatcatacgatcaataatacactcggcggatcaatccccggacaggagtagggtattacttcttgattaagaaggcctgaacctgtataaaattccttgtttctaaacccatccacttttccaacttgatagccacccccttttagtattgccgaaatcttgtttcgacagttggcgcgcaaggtaggggtagcgtcaagttcttcgccgactaagtgcgatgggttccgtctccggcatcgacgacttcgtcttccctcccgggcaggcgttccggtttggcagcctagacttcatcaccaacaacttcggcaagatttctctcctcgactcggattcgaaccagtcgggaagaggctggatctccgccccgttcggtatcccgaactcggccgaggtctaccccaaggtcatctccaccgagttggtttcaaaccactcggacgagatccaatctacttcaacaccaccagatcaagacaatggggcctatccgccaatcctgatgaaactccccgatgatctggctgtcgtctttactaaaagggcgtcttcttcccgtaggcctaggcgggatccggcttcagcaccgatccggtctagctccagggaagtcggcgtcatactccagccacacggcacggtttcgatggaccaactggaaggctacttcagctcccctggcgtcgactcacgagtcacgaccaacagagatcgtagagtacgatgaattcggctaccgctacgacaaccgcgaccttgacgacttcgacgaaagctttgaagataactacacccctctctattttggcgtcttcatggccgataacgagacggaagaacagcgccaagcccgagaagcagaaggacgacgtgtacaacaggaggccgaacgacgccgactggaagaggagcgccaggcacaagagcaagaacggctgcagcgtgagcaacaggaacgtgaacgggctgcaaaggaggcggaggaccgacgacaacgggccttggacgccgggcgacgagcgcgagaacttattgggcagcaagacgttgaggggacagcggtcttgcacacccctcaacaaaacgcggttgcggtgatcactctcctcgacaccctcctcaaggaagacgcgctcaaccaagttgatcacgtcgtcatcatcttgaaccagaccaagaccatgattgccgcctcggtcccggttaactccgcaagcgtccgcacgccgactggcagccgagttccccatcttcgatctcaagattatcaccagccaagcctcagcatcaccggcgcgggatccaatcgcaggagtaggggtcacgacgagcgatctgtccacccgcctcccgaacgacacagggagcgccgagttgaacggcctcgctccccacctcgtaggcgccccgtcgatcttcgtgatacaatcaaccagcgccgtgcaacacgaggctatgcccgccaccattcaccggatcgctatgacgacgacgtggatggagtcgctgcctttactaacgacctgcgtcgagtggattggccagccggcttcaagccgactggaatcgagaagtatgacggcaccactaatccggagtcttggctcaccgtctacggtctcgcaattcgcgcagcaggaggagacagcaaagccatggcaaactacttgccagtgcccctagcggattatgcccagtcctggcttcatgggttaccccgtggcacgatcgaggcggaacttcgcgaccacttcatcgccaacttccagggcacctttgaacgccctagcacacagtttgatctctacaacgtcattcagatgtctggagaatcccttcgagattatatccggcgcttttctgaacaacgcaacaagatctccgacattaccgatgatgtcatcattgctgctttcaccaaggggattcgtcgcgaagatctagtcggcaagttcgggagcaagcctcccaggacggtcaagtagatgttcgaaaatgccaacgagtatgccaaagccgaagatgccattatcgcgtccaagcaggtgggcaccacttggaagccgaagaaagatacgccgactacgggagggagtggaagtaccaatcacaaggaccgtaagcgtaagcccgaggaacttgttgcaactactacacattcctcccgacaacgttcgcgcgtcaatacttttgacaagatcatgaactcccaatgtccgcatcatcccaattccaatcatgcggccaaagattgcttcgtctacaaacagtttgcagaacaatacgccaagaatgcacggatggcctccgacggagatcaaagcaagtcaaaaaagaaggacgatgacgatggtgccccgacaggttttcaagaccatcgcaaggagctcaaccacatctttggcggacctctggcttatgaatctaaaagaaaacaaaagctgaccaaacgggagattaacgctgttcagcccaatacgcaccaatatcttcggtggtcggagacaacaatcaagtttgaccgctcggatcatccagaccaagtggtccacccggggcggtaccccctggtactagacccagtggttcgcaacgtcaagcttcgcagatccctcatcgatggcggcagtgcactcaacatcctcttcgccaaaaccctagacgacatgcagatctctcgcacagaactgaaaccgagtaatgcgccctttcacggagtcattctagtgctatccgctacgccactcggccagatcactctccaggtcaccttcggtactccggagaacttccgcacagaaaacgtctgcttcgaagttgctgatttcgagacagcgtatcatgccatactcgggcgcctggcgttagccaaatttatggctgtcccgcattatacctatatgatgatgaagatgcctggtcctcgaggagtcatatccctgcggagcgacatcaaacaagccatcacatgcgacaaggaaagctgcgagatggcccaaacccgcgagatcacgatggcccgagaagacatccgactagctgcaaccacggcaagcaaaggagaagtgcctgcaaccaagatcccaaaaagtggagaaagcgaaaccaagaccaagaaaattcctctagatccctctgatcctactaagactgctgtaataggcgctgagttagattgtaaataggaaaccgtgctcatcacctttcttcaaaataataaagatatctttgtgtggaaaccatccgatatgcctgatattcctagagaggtgattgagcactctttacatgttaaggaagacgctaagccaatcaaacaacgactccgccgctttgcacaggataggaaggatgcgatcaaggaagaactgactaaactgttagcagcaggcttcatcaagtaagtccttcatcccgactggctggccaacccagtcctggttcggaagaagatgggacaatggcgcatgtgcgttgactacaccgacctcaacaagtcctgtcccaaagatccttttgggttgcctcgcattgaccaggtagttgactcaacaaccggctgcgagccactcagctttttggattgctatcaggttatcatcagatccgactaaaggaatccgactgcttaaagacttcattcatcacgcccttcggggcatactgctacatcaccatgcctttcggattaaagaatgcagtagcaacttatcaacgcatgatccagagatgttttccaactcagatcggtcgcaacgttgaagcttatgcggatgatgtagtcgtcaagaccaagcagaaagatgatttgatcacggacctagaagaaacctttgcaagcatccgcgctttcaggatgaaattaaaccctgaaaagtgcatcttcggagtaccgtcagggaagctgcttggatttatggtgtctcatagaggcatacaagccaacccggagaaaatcaatgccatcctcaacatgaaaccgccaagttctcataaagaacttcaaaagctgattggttgcatggcggcactcagccggttcgtttcgcgactcggcgagcgggggatgcccttcttcaagctattgaagaaaacagacaatttccagtggggacctgaagcccaaaatgcctttgaagacttcaaaaaactcctcactactccaccggtcctagcttcaccgcatccacaagagccgctgttgttatatgtattggcaacttctcaggtcgtaagcacagtcctggtcattgagcgtgaggaagaaggccatgttcaaaaagtccaacaaccaatctacttcgttagcgaggttttggccgactccaagacaagatatcctcaggttcaaaagctattgtatggcatcttaattaccgtcaggaagctatctcactacttccaaggtcactcggttacggtggtcacatcgttcccactcggcaatatacttcataatcgcgaagcaaatgggcggatcgcaaaatgggccttagaattgatgcccttggatatatcgttcaagccacgaacttcgatcaagtcccaagccttagctgactttgtcaccgagtggaccgagtgccaagaagatatgcccgaggagaagatggagtattggaccatgcactttgatgggtcgaagagactttcgggcactggggctagggttgttttaatttccccgactggagaaagactgagctacgtgttgtggatacatttttctgcatctcacaacgtggcggaatatgaggcgcttcttcacggactaaggattgcaatctctttcggaattaggcgtctgatagtttgtggagattctcagttgttcgttaatcaagttatgaaagagtggtcttgccttgatgataacatgaccgcttatcgacaagaggtacacaagttggaggataagttcgatggactcgaactcacccatgttcttcgacacaataacgaagcagctgacaaactagctaattttggttcaaaacacgaagcagctccttccaacgtgtttgttgaacatctttacgaaccagccgtaccaaggaaaaaaataatcgaggccacggacgctcaagacatagctatgattgaagccgactggagagagccccttataagatttctgaccaaacaagaactcccccaagataaagatgaagccgagcagatctccaggtacagcaggctctatattattcatgagaccgagttgtacaaaaaaaaagtccatcaggaatcctgcagcgctgtgtgtctttggaggaggggagacagttgttaaaggatatacattctcgcatctgcggcaatcatgctgccgcacggaccatcgttggcaaggcttaccgacaaggttttttctggcccacagctgcgtccgatgctgacaagattgtgtggacatgtgaaggttgtcaatttttcgccagacaaactcatctaccagctcaagagttacagactatcccgttgtcttggccatttgaggtttgggggcctgacatggtcgggccgtttaaaaaggcagtcggcgattatactcacctctttgtggctgttgacaaattctccaagtggattgaagctaaaccggtcatcacaatcacggcagacaaagctagagatattttcatcaacattgtgcaccggtttggggtacccaatcggatcatcactgataatggcactcaattcactggcggagtatttaaagacttttgtgaagacttcggcattaaaatctgttatgcctccgtagcgcaccctatgagcaatggacaagtcgaacgaaccaatggtatggtgctccaaggaataaaggcacgagttttcgaccgactaaatccatatgccggcaagtgggtagaatagctgttgtctgtactttgtccttgcgcaccactcccagtcgggccacaggccagtcgccgttcttcctagtttatggagcagaagcaatgttgcctagtgaggtggaatttgaatctttacgttttcgcaactttcgcgaggagcgctacggagaagaccgagtagatgatctgaaccgactggaagaggcccgcgaagcagccttaattcagtcggctcgatatttgcaagggttgcgccgttatcataatcgcaacgttcgatcacgagccttcttagtcggcgacctggttctgagaaaaattcaaactacacgagatcggcacaagttatcccccttatgggaagggccattcataatctccgaagtcactcggccaagttcctactgactcaagcgtgaagacggtactcctatcgacaactcctggaatatcgaacatcttcgtcgtttttatgcttaagcattacttttgtatttccctattttgactgctaacatcaagctttcccttgagttatcagttgggggctactataataataatggagtgtgatttttatcaattcaatttgcttacttgatttatcattgccttgcttgattttttggcttagtcaatgaggactgaaagttttttaatagcttttgcgggttttaggctcaataaggtttgacaaaagcttttaagaaattagaagctaagtttgaaatattaaacacagcataaattcatcagtattgtacaaattgtgcctccatcatcatcatcatcatcattatcatcagaatcattgttatgatataacatcaatcggtatcagttttttcatcatcagagttatcagatccagtcggccgaaggtcgttgtcctggaatctctcaactacataacctgctatcttatcggcggctttctgctcatcgttgatgaggtcaagagcagcttcttcactcgtcctatctgcaaagccatcaatggcgtcaatatcgatcttcgggtacaaagacttggtcattgccaacgccaggcttgccccaatacttccagcctctttgatattcttaaaatatgtatccggagcaactctcagcttgtcgaagatttcggaagcatcgaatgtactcggaccattgttattgaagaacatggcttggacgagtggggtagcagcgttggcgactttatccctggccccgtcaagcctcttgattttgttgactaagacatcgaattgagcctgcgacttgattttgcggtctgcatcaacagattcacatcaacgagtaagcataaagaagataatggcttttgaagtattgattgctagtacctacaacgtctttcaaagccgagtccctctgtcttgccaattcagccttgtcattttccagagtctgaatctgctttcccagttgagatatcttggcggcttgcactatattacctctggttaattgatattacaaagatggcagcataagtaagttggacagagattgtgtgtaccttttgaggagccactcagttcgaagttggagtcttgcagctcggcgatccgatctctcagatcatgttcagttttcctagcaagctccctagcttcgtgcagctggtttctggtagcttcaagggttccaaggtggggaactaacctctcaagagttgcagttttcgcttcgttcctgagatggattctctgcaatacaattttatcggcatttaagctaagtggcaaacaggatggttgaggccgtgcatgagggaacttacgtttacgatacgagtagcctggctgagtgcctttttcagcaggcatacttcatcatcttctttttacttgtttatcacgattccctgaggttgcatatcgtcatcccaccacttgaccagaatgggagggcgagaatcttcagctgctcgtatccggaggacctcttcttcatcaccaatcattgacccttgtatattcataaaggtgaaacaatcgaataaagtctgttagaccaaaatgatttcagagaatgtatttacctgtgatgattttcggttggggacgagtagactcttgtgttttaataggagagctggaccctgggtcattactggtatcctttctaagagggctgtccgcttgggtttcaacttcagggacatctcggtttggttctgtgcccgactagtttccagtcgggggctcctgattaaccccgatttcagcttcggccgactggtttccagtcgggggctcgtcgctgggtattacattgtcggttgtcggctgattgtcacttgggtgatcttctgtggttggctcggtctcttttgaaggacccgtctctatgtcaattggtttagaatcttttccagaaggatctatgtcagatggcttcctacaagtttgagttacgccattattattatttcaatagtgggtgagcagcgctacgagggagacagtcaaacgattcgtacctagaagatttcctgatcttcggcattggacgattggatgttttcttcttagggttggattgctttggcagttttcttgtcgcctctttattgctggattttccagcatcatcgccttcgtcatcactcaggaccaatttcctcttgcacgagtccgattggatggttgatcttgagatgtttgattgagtttcagacctgatttttggtcctccgcttgcctgaccagtctgtcggcgaggtgatcggcgttgggtaattggagggtctgatttcatcaaggcgaattcctgggtatgatgattcaagctttttatcaaccttgcaaatgataaaagaatgcttagaaacgagctgggattttaaatacataccggtggagggggattgaagccattgtatggcaccacaggcagcaagtgcgaatagctgactacaattgcatttgagaagattttatacatcctctccttcatgaccttgaattcaagagattcaggatcttcacagttagggtcatgtttgccgtcgaattcaaaggctgtgcgagatctttctttgatcggggctaaccggctcttgatgaagtgccgagtgatttgttctccctgtagaccttgctcctttagcttcagcatgcgatccatcagggcgagcacttgggcggcttcttctcccattggaagtgaattccaggtgccttgataaactggagggagacaggagtactcggggaatgcaggctcggggttttgtacataaaaccaatttgcatgccagcctttgtttgaagttttaaacggcatggagaagtacttttggctcagagttcccctcagttggaatccagctcccccaactacgcatggcttgcttttgttcggttggggtttgaggaagaagatgtgacggaatagggaaaaatgtggcctaatgcccaaaaagcttcacaggcgtgtatgaagttggcaatatgaactatggagtttgggtttaggtgatgtaaactgatcccatagaagtccagaattccccggaagaaccttgatgttggaagagaaaatccgccataaaagaaatgagaaaataccacggcttcatgagtgtcgggggtcgggaatgcctcgccgaatgccggacgccatccaatgatctccttcgctggaagaacaccgtgcgccaccatctccttcaggttttccttcgttacatcggagggcgcccattggctctcgaagctttctctctcctccgccatggatgcgaattgggtgatgcgatttgctttggaaatggctgaagaatggatggggaatggatgtggtgggtgcgtggatgattttttgtggaattttggaaggtgaatttgagcaaattggagaaccctagttccgcgggagtggttttgtactgtagcgtgaaatggggaaaatggcgagagtctcagcgaggaagacgaagcgacgctttgacttcggcgtttatttcgctagggtatcgggagtgctaatgggcctgggcctatacagtacttcagcccaattctattatcagcgtgactagttgtgatccttagggacttaggcatttttgctttggcaatttttgctcacaacagtatggcccgatgctgttaaaatcctttttaatgcagttagatgattctttggaatcactacgatgcgaacaaaaaggtacccaacagaaaagtgttatactaattttgtaagtcttcttaggctgcaaaagctgttcaggtttgttgagataactggtttttgatcagttatttactcggcatgcttattcttctggtgtgagtcatagcctaggctatttagacttatcactaattatgttatcacatttgtatcacatttgatggatatttttgagaatttttactcggattcttgtcaaatgtgtgaatttatggaccttaggagtgtttatcactcgggcctttccatattttcatttttggtatattaaaactaaaagcagtcggctagatgttttattgaacgccgcatatgccttgctatatgatattcagttgtaaaaccacttggttcttgactatatgtttagttttttaactaaccacatagtcgggggctacacctaattcggtgcatctagtcgatgcactcggtattttctattttagaccttcacagtctttgattttggtactcggagatctatacagaagaaattgaagcactcggattattactttatgtttcaagagaaggccatttcatcgactgtaaaggtcttgggggctactgtggagattatggataccccatatctacacggcatgtatagtccgactaggtacagggtaccatatatagatagaatatctttaagaggactcgggataggtctaaacttgtatgtcaaggaaatatccgagatcctagtcggttacgattgtatcttatctgtaattacatattccgttaggtatatggactgtatttagtaatacggacctcttcccctatataaggaggggtccgggtccctctagggatacgttttttctcccagatcatacgatcaataatacactcggcggatcaatccccggacaggagtagggtattacttcttgattaagaaggcctgaacctgtataaaattccttgtttctaaacccatccacttttccaacttgatagccacccccttttagtattgccgaaatcttgtttcgacactatggcttgatttacactatttgatctagctatcagttcaagtggatacaatcctattgtcatcctttcaccacaatcagtagttttgagaagttaatttctttgcatacactgatgaactctgtagtagattctctgcaggttctttcttgctcaattaattattgctcactctatagcagatcaactctggatttagacttctttggccaagcactatggctaaaattgcatgccaagcttcgaacagaaaggtcaagcaatttttccaaccacggtgcagcatgtggcaatggcactaacactaatttctatcatatgtaggcagatccaagttgatgctggcataggctttggtgaatcactgatgggtgagagacctgcagatttccttgtccaacagagcaatggctgagttctttcagttgtgggatgaaattcagatggtgcagcttcaaccaggaatagccacgactccattcggtggtagctaacaggtgatggccagtttactttctcatcggcttacaacctcttcttcatggcaaagaccaaatgtttatatggtgaactgcataatttcgattctttctgttcatgctgatctgttggttaatctggaaagacgaaacgcttgggtatttgagcagaggtctagacctacagagcaattatttggagacatcaaggagatcacgatttggaagtcggctagcattttttatcctacagtgattatttattagtgttagttgtttattgtggtctgaggctttgcctcatacctttgttcgacagcatagtactttgtactttgtttctccctaatcctttggccaacctggccaatcatttcagtagtaaaaaaatgtgttttcctggtcagattgatatatatatgatttctactaggctgaaactcttggcttggagaaactttgttgcatactatagcaggagctgcagcggattgaaaattgatggcatcaaaggttcttactaatacaagcaataagttgtcaaagaatcattgtttgaatttgttgtaccaaaattccaatcacacttagtggctaatctttttattttgactaaactaatgccacatgttagcagcagtagcagaatttttttattttggtttcaggttttagaactgatgttatttgttgctccaaataatccactgatattgtcaagtgggagctatttgacttgtgtggctagaagtattcgagtcaatcatctgcttgcctcggcctacttcaatagacaacggaggatgctctacatcataatcgtatgcaaagacaggtaatacacaccatatttcccttcatttgcaaagtcgtaataaactgaataagaacaggtaccacattcatatttgtctgatagatctcaaatccatatattgctaatggtctacttctcaacttggtttttacacctcaatgcttgttctgtattccgtttgtcacacattttatcaatgaattacagttctttgaaattggatcatgacttccaacttgcagcaactaattgcattgtatcacacgttcattacaagatactcaaagcaaaaatggcaatatgttggttagcagcttgtacttgcaatgagtaagagcatagaggttctggacttacaatctgaggtcaggatcatgttccatatatttttacatagaacactattgcatgaattgtactatttgtagatgttctatagttaatcaactatgttaccttaaatatacatggtgtgttttagattctgaaatgtttagcaaacttagtcaacatgtagattaactatcacaatttatgtcactttttcatatctagcgaacttatctaacttttttttcaggttacaaaaaatgcaggaaaaacgtttaggctgtcgaagcaaatccatcaggaggacaccctggcatctgatgttgtctactatgcatcaaagagattactggttgtttctactccttctttttgaatgagataatttacgttaatataatgttttcatagaagtgagccaatcttgatttgtttggttaacacaagttatgtgttaaacgtgtgatccaatagtatggctttgtcatgttctcttattagctaattgtaagtccttagcagctggaatgctggatcatgactaacaagtgaaaaggatcagtgatagttttatgctggtgcagacatgcaatgccaaataaaacatggataattccttcttgtttgtgcataattaattgtttgtgcaggcttcttagcactcaataatttatcttttcgaagtttctatagttgttgctcatatacaagggataattttgttgctcagtctcataaggacagctcactacctatccatctaaaatctgattacacatttgcccattaaattctactatgcacaacaagaagccacgattgtgctcttaattcaaatctgaatttgttagaacatattattggcgtatgttgtcgaaacgacaactgcatacgtcgaaagacgtggttacccaacagtggttggaaaagaagtaaagtgtattaaattgggaatttttcttgggatccccctattacatggccctaggagactatttatagcctcattacaggttcttactactagggtttaggttacacaggggaatttacatggttgcccttacgaaagggacatttatatgggcatatagtgtaattgaggtatgtgggctcctaatgggccgccaggcgatcgctagcccaatggccactgggcttgagaagctaggatggtctcatctgccttagcaaggccaaacttgctatggcgaagtcgtctcccttcggtatacacgcttcgccttatatccttcgcccaagaggcctttggcttcgcgaggtacccgcgcgattctccgtccttcgccttcctttctccatagtcttcgccatgggtgcttcgccccgactaatcttgacgtctcaggcttgaatccccgctggtctcatggtttcggtaggtttggtcgaagggcctcatgtcatactgccaacaacgtgtaaccacataaataaatccaaagtatatataatatttttgtttccccatttcaaggtctatatgattttacttatttggttttggtccgcatactggtagtacgcctgagagtggttatgttgatgactgttaagagaatgacaagtcaatatcttgctttgatacctttttttttgcatttttgatttagctaaaaataactatgtactggtaatggttatttttattgttacaaattccaattacatgaggatatgttttataaattttgggtaaataggttgtgcttcagaaggtgtagtttctaaaatttttagtgtaattatgtactcgggtgacatattttgccaaaaacgtgtattgcacatgcacgattattagtaaaggctaagacaaggagatgtgcacgcagtgatgattaatgcccgatcattaatcgactgggcacagaaaaagctagctttctttccgatcaagcttactataggctgacatagtgatatcaccctctattttaccttggtcgctgagggccttatgtggaaaaggatattaactattccctcagtttttttaatagttgactctattaacttttgatacgacattccaccattctttctataaaaatatatatatctcatttatttaaaagtatataatgttatttattttgctgagacatgttttataactaaatttcgtagaaaacctataagctgatgtccattactgtacttcagagttccgaatatttacactactttttttaataaaatgattagtcaaatattattctaaaggttaacaacgtcatccattaaaagtagaggtagccatagttgagtccgatgcacgaacagagactcatctatatggttgatcacctcatctataatttacacaggtaccgctgaatttgcatcttctattcaacacattctcagatatgtcaaacatgcatgttctttgtgtctaattcaagacatccatgaatttgttttattttgattgaaataatagattattttactatatacctattgaatatctgttttgtcataactcataagtgcattgtcaaagcaatcaggtcgattaacatcctaaatcttatgctcactataaaaatttggttatttgatcttagtcttaaaacaaagaatatttttttctaaataaaaactaacaattaataactaattttcagatgtgttgaccatattatccatatgcatactgtatacagtccatagcatgcatattgttgatattaatgtcgttggatttttataagatttattgcgacggtatattgtattaagaattcatgttaaacagaacatgccatagccagaagataccgaggactattcaggatttgttttttttctaaaactcagaattaatagatatagagttgtatccgtttggactttatcaatttaatttctaaataccaaactgataattgtaaattgcaactgacatgtatggaatcttttttcatccaaaaccctataatttgtaaataattttgaattcatatatatggagtaccaatcttggattctcaatttagatccctattaatttaagagtaaatttcacgtgacatcaggtattatggtctaagttgcacaaaacctcaggagttctagcacgtggcacataacctcaggtattatgaccaaaaagtttcacaaaaccacgttattgctcatttcgacattgatttacaatatttttagttctaccatcacatctcaaatttataagttatttatccatcatataaatgttagattcatgcaagtaaatctttttaaaattttgttataggagtaagtcaatttggttaacggtgtgattttgtgaaactttaggaccataatatgtgaggttatgtgcaacacgccaacatctatgtggttttgtgcaacttggaccataataggttgtaaatgacatggaatctttttttattctaagccactataaataaccaataaccaacatatgtaacataaaaaaattatatgtaataatagcagtaataacaacaacggctagtttttttaattgctgatggctaaataccttaatgactttttgataattattagagggtagaataaattaaatataataaattccaaaacatcggcaccgcgacccatgtgtttgtgggcagcagcccgtctgcaacagagcccactaggccactaccacggcaccacagcgccaccactgcacaacaacaaagacaaaggccgataccaactagggtcctgcgggcctaggtttgacggagatttttctgatcatattagaggagtcccaattcaaaaaaaaatttattcataattatatgactataatcagttttttttaaaacatatttcaaatccagacatttataacgcgcgcctactcaaccttataaatacgtgcatgaataacctactcatatgagcatctatgaaagattacaccaccgtattcctatgagcacggaataggttaaaattgatgaagtcaccatagacatctcgctatcagcggaaaaaaataatttgacgtaaatacaagcgcgcatatcaagtctagaacataaatccggggtgagttagttccaccataagaaatataaccaattaaggtacgctcactatgtataatcaattttttagggatgattataatcagttgatcctcaagaacacatgatttcttgtgggacatccctctgattgcccattccttactagcaagcgtgttttttttttatcttgaagtactttttctcacacaaaatatgatacatgttttgcaccatggaggtatatatattaagcttcaataatgtcgtcaaaagggggccaaacgatatccaatgcctgagtaagatgcgaagtcctaaaattatttacaggtcctccatatatatatcctcacccatacatgacagctacctctctcatccatacgccttcctttctttccctctcgtttttgttttctcattcttaaacaatcaagaattttttttataacataaacatgccagacagcaaactattagtattcctagactgctaggtgcatatcagtgtttcatgaacattgttttcttaacataatacatacatatcagaaatatatgttggcttgggagacatcggaaaagaaatgggtacttagtagaaacagacatgggctctggagcatggacggatctgtgaaatagagcgaagccgttctaagggattcattccatcccagttatgaaatactcagcagtatggactatctggaaagcaagaaatgctgattgcttcaagaacaccttgtctgattataccatagacataattctcaaggtttgtaattggatcacaatgtgggctgctttacatagctaattgttaagggatgtctgcggggagtcatgcttctaattaaaacagatggtaagtgggatggtaactagaggagagaagggtagcttttgtttagatgatctgagcctgcgtgttgccgtgttccatgtgttttttggtcttaaatgtttcttcctgtctgcaaactttgtggaaacctgtatggctataatggaaatgggggaggcctcgtccaatctttctcatcaaaaaagaagaattctgaaccaatgcacactttgatgatcgatgatgtccctgacttgatcatgaacaaagcttttttttaccatgtacctcctagctatgtttgcgcatatgtttcatttgacaagtttggacaacttcattgagcatgacatttttcatgttcccatgtgttcgatctaataaactaggataagtttatcgaataccaaatcatccatgtcatgataagagctgggacgacttcattgagcttgatctcttgattttcctatgcattggatttgataaattatgatgagtttatcgagcgcaaaataaggcaatcccttagcctgagaaaaaacgccctcaagcaaggtagcaagaatgtcgcctgtaaaattatcgcatgtccgtttgtgtgggctgatggctgtttgccacgtcatagaatacgtcatgtgtaggagggtgtaaaataaacctcaaaacttgaaaacgaaaatgtactgaatatttaaaaaagtaaatataaaataaaagaatttccttgacccatgtgttacaggcagcagttgtctgcagcagagcccagtagaacatcacggcagcgacaggaccaccagcgcataacaacaaagacaaaggcccaaaccaaccagcatcctgggccactacgtggttagagatcggatcgatggtctgctagtgtgggaagaggcccaattaacaaaattctgtagataattatatatagattttgctatatctcactcgaaagattttttttcttttctcccattatatattactataatcagctgacctctgattattgcgctgtcttgcatactgtatagatcccacaaattaactctagcaagcgtggtaaactatctgttacatcgtgatagtgaagctaagttgcatagatatcaactcgttgaatgtngaataagtaaaacaaccgaatagaatgttgtgctcatttaaatnctatgaa

SEQ ID NO: 68371 - DNA, 24099 bp, Oryza sativa
  unsure (1)..(24099): unsure at all n locations
gtggtttttggagcacntaactattggtacagnagctcatcaaaaacaacggaatagaatgttgtgctcattaaattcctatgagatttcaaaacacagaaaaagtttcaaaattttcgcttgattggcacagcagatgggaaaaatgcatgaattcaagacacagaaaaaaaaaaaggaggcaagacctcatgttcattttcctccacaatttctcgagaagagcctacctattgacgaaaaatcttcctaaagataaaaggaaattcctaaatcttatctaattaatagatagaattaagtcatctgtcatgttttttatgaaattctttcctaaagtcagtctcttttggacaagttctcattggctgattgtgttctttccttaaccaaatccaaataatcataccatattttagcattcataccatcccataggaattttaaggaatgtgtaaaaaggctccataggattattttccaaaggggtcataatacttttaaagtaattttcttgctccaaatatgcctacatgtttcgcgccgtgcagatattattaggcttcaataatatcgtcaaaatggggctaaacataatccaaagcctgacaaagatgtcaagtcgtgacaatttttacagctaataagttgatttaatattttttacctaacttgtattccctcttttttctatatcgaatatttagggatgaacgtagtactgaagtcgaatcaacgagcatcctcaatatatcttttctttaccaagtgggtagtaaaatgtgacccataaaactagatagtagttattttagttctcacaatgtgtaggtattaggtggtaaattggatccaatgtttaaaagaaatggatacgtgaataagagaaagtgaatgagaaagaagagaggagagagtgttttatatttgcttaatgtttgttgcgtggtaatggtgctactacccaatgatactattacccactttactatctgggcttataaatgatgaaccagatagtaggactacttaccacccacttcttaacatattatgggtgccctaagcatagctaggatggtaatgtgtcaagacttatgagtcttttcaagatcttacctaactcttatatatttttagttaaaaataaataaaaattctgtcgtccccattatatacctactccttaaattatgtaagctaaaatgttggaccctttcccactcctaagtaggggtgagactggaacatgtattttccgaccatacgcccaacccgatgtccatgggaagaatataggagggaaaatataatgcctggtatcgtttgatttggaacgtgaacccgatacgagaagagttgtgtccacccgtatgtcccatattattaaacataaatgaaaatgtattacaaatccatctataaacataataaaagattggttaatccctattttacgagctctaatataatattgtataatttttccttgatgtatctcttttaacaccttaattgcttccctatatttaacctctatgaattagagatataaataattattctttgccgaatcccattcgaataaaatagtatgggataggatacttatcagtgatatgtcatacggtattacctgtatctagttcagaactttaaaggaaaatataggttataatatatgggaatgccatgatccaatcgtacctgcctgattttagccctacccctaagcatagcccatcccctgtttcccaaacatgccaaagttctatatattggttcctaatttctcaactctggctgctttcgtttctccaaccagagttggatgaaattttagatgctcgtagcacgcttttcaaactgctaaacagtgtgttttgtgcgaaaactttctatatgaaagttgctctaaaatatcagattaatccattttttaagtttgtaataattaaaactcaattaatcacacgttattaccatctcgttttgcgtgaaacacttaatctttatctttagcctcaggagattcaagcaccacctctcttctaccgccctccatatatccttacccatattgccagctgcagccctttctcatccatacgtattcctttctttcccttccattttttgttttctcattcttaaacatccagaatttttgtaacataaacataccagataggaaacaagtcatattcctagactcctagttctatatcagtgttccgtataggttgaactgaagcacatcagcaagaacattgcttttttttttttacatagtattacatgcataccagcaatattggcttgggaggcctcgggaaagaagagggtactgagtagaagatgggatgggctccggaccaatgatattggatctttgaaagaacaccagttcgttctaacgggttcatgccatctcggttaagaagaagtactcaggaccaatgtgcactttgacaatcgacgatttccttgactcactactacgaaaaccatctttcgtggcggccattttgggtttttgctggcggaaatcatagccgccacaaagcaaaggccagtgaaaatgtagatcttcgctagcggttatcgaccgccagcgataattcattttcgctggcggtcgtcttaagctagccgccagcaaaaatccattttcgctggcggttgccttaagacggcctccagtgaaaatgaattatcgctagcgggttacaggaaccagccgccagtgttaatgctggccaagtttaaaaataaaacgacggacggagcaacaccactccgtccgcctccgtcaacgctccaccattcgaaaatttcacagaaatttacccaagcattcaaaattccacagaaatttacattaaagaattttcattcactcaagcattcaagcatcacaaaaatcaatgcaatagcatcacaaaaatcaacacaataacaaaaaatttgaagtcccttcgccaccgccattgcatctcctccttggctacatcggcgagtgggttgcctagccggagctggtcgtgctacttcctaggctcgcaccgccgcatcttctcgttctacctcgcccacagcgccttcgtcacctctgctcatccaccaccaccaccacacacggatttcagattaccgcgtcaacaaaaatggcgaatcgaagcgcaagaacggatgggtgctgaccttgggaggtgatgaggcggtagacctggacgaggagtagctccaccggcggcagccttgtcccctgcggcggcggcggccttgtccccgcggcggatccggcctcctagcgacgcggcggcggcggatctggcctccccgcggcccggcggcaccagatccggcatccctgcccgcacccgagcaccgccaaccgccgcacccgagctccgccgcccgcgaccgagctcgccaccgcccgcgccagccctctcctccgcccgtgccgaagcatgccgccggccgcgcccgagctcgccgctcacgcctgtggatggagggagagatagttcaagggagagagggagtggaaggaggagataaggtaggtagagtgaagggaggaggatataaggatgggtaggtggagcgacttttaatgccgcgattttttaaagggccagagcggcgcggtcccccaccaggattttcgctggcggtaggataagaggtccgtcagcaaaaattgggatatttttgcaagcggacttcttaacctaccaccagtgaaaacggattttcactagcggttctaaacccactatccctcattagaatcttgcaagcggatttcttatataaccgacagcgaaaaaataggataatgccatgaaaaatgtttttctagtagtgacttgatcatgaacaaattagctttgatgtgtggaagttgattagatcaatgacttagactgactaagatctctcggtgaatagctatgggtgaccagtgataaaagatatcaaagagttgttgatgaagatttttcatgtttttttgggacgaaaaagaagattttaatgttgataggctgagtaaagcactcgagatatcacttgcttatcttattactaggagtgattaatttcatgttattcggctacaccatctgtgttcgttatcttgaaatggatttacggattgctccatttaatttagcttcatatatataagaatgctttataataggctaatcactgcagaaattaacctggatcgctgtctgacagtacaaaatacagcagtgaaatgatggagatagtatcacggaaatgtacaaaatcaaatatgtttcaccgtggtgaaacttcactgcagtatgttggtaaaactttaacgcgtatatatggaaattcgatcttacttatgctcaaatttgagcttatataactacatccacttgagttctttgtctgaaaattccagtttatgcattatgggtcctttttatttgagggcaagatcatataggatatgtccattgatgattttagggatgggacgatctatattcgggatcgctaactagtgatcgatcgcctcgaggctatcttttttttcaccactttttgtttggcaccatatagtttttcttttcggggtaaatttatatacctaaaatttatgcatctaaactttacacacctaaaatttataggtcaaaagtttatatacactatttaaatttgaatttagatttaaatattttttatatagaatatttctatatgtaaagtttatacatatgaagtttactgcgtgtatgtgtgtgtatatatatatatagtaaagtctatgcacatgaatatatttttatgagtattagattttttttattttttaacttgtttttctttaaaaaaattatggtgtagtaggaagaggagaagggggaggagcgtgcacgttaggagagggacgggggtgcccgatccttgtggacgatcacccacccattagttctccctatccatactgggtgtttggctcagtgctcacggatgagctatttttgtttgtggttgaatgaatgtaacgagaataataagatcattaaggctatgtatagttccttcaaaatggcaaaagttttattgttttagagcactttttgttaaatgtatctaaacactggtagcaaaaaagtaggtaagttggcatttgtcatttgggagtccatagcagcaaatttggccaaaaaagcatcgggccccgtgtatgagagaggcaacaacaattaatggcaaaactttaccatgcatctaaacaacaacctgtaaaattgcatgccaaatttttttgccaccaaaacttttgcaaaataatttgccgccgcaaattgatctaaacaggccctatgcaataataaaacacattaattatcgttaatctaattgtaactaattatcaacaaagtagataaattatcccttgtcaactctaatcttgatatggtaattagtaaataaaaattaaaaacaattatcactgatctgttactaatgatgaagacggatccaggaaaaaaatttgggggggctcagttacacagtttcttcaatctccaaccatttagggacctttagtttattattaatggtgaaaaaatcgaagggaatgcttcgggggtatccatgggtcttgtgggtgtaagggggacttgagtcccccctgcacccatgttggatccacccctcgatgaagctaggttagcaaagatgaacggtctcctcccaacaaatttgtggacccatccacatctttatgtgtgatattcctttgcccgtctatcgcattcactttcattcacaaaccaaacacattcaaaacttcgattgccatctcccatccacgcgatatccatccaaacaaactaatattaagtttgctagatggagctcgtgttatttttcattttgcacacaactgggcttccgttaatatatctgctcagctttcggcctgcaaagtgagaaaaggaagaaatcaaagcaaagacaaatgcagttggatagcaaaagttttcttctatatacgtaggcagaaacaatccagcccttatctctgaccgtaaaatctatccgagcaacttttatgagctgtttgcatcatttcagaccgggaatctactttcttcaactttgttattatctctctttacttccaggaatctacttcatttgctttttcatgaattctccaatgtgacaagatcagtttgttctgtaattttaattgttccctggatcaaaagttttcttgtgcatagatatgtgtataacaaacatcaacaagctttatataggtaatcaattaatcagaggaccatagtgtgcaagtaaagtaacaaaccgtttgatagttttgcctttttatgtcctttttgtatatgtagattagcccccaaaactgtagtatgcttattaatttaggacaaattggcatggaagatcaataacaaatgtttgtggcatgcagtgaatatagatagaatttatggatttttagttgagcttcttgacgttacaaacttaattatttacctgtacttttttataaactgcacgagaaaagttaatttgggagtatgtctgcagtggaatgggatccttggctactgcatattgagctacagttagttgcacttgaagccttcttccacgtccgattggaatttggaatgggacatccggcataataagctacactgctacagtaatctgtacggtatttccaaaaaaaactgtaccgatagttgatctatacgtactgcattcttttaagggttatggaactcttcccccgtatggtatgtaaaacaaaacgatagattggtacataattaattaagtatttattatttcatcgtgtcatagtataaataattttaaggtagacacgggtattaaaaatataggtgaaaatgattagataaatattgtgattagtttaaaagaaaaggtaggtaaagaaattaaatagagttggttgaaaggagggatagatggagaaataaatttattttgggataattactatgcaagaaataattacattttcacggaggtagtaaaaaacttgaaaatgaattaatatgatttttaagtaacttttctattgtttttttataaaatgcatggtttaaaaattcaggaagcgtgtgtgctggaaatgaaggagtagaagttagtaaagtggagaaaagaacacactgctagggtgtgttcgaaactatgggttcatctttaatagactactgagtagtttgtacaggacatgaggagaagggtcacattgcttggagtgttttttcttcaagaatgggttgttcccagtttgagtttatgcctttctagctacaggaacttttgcatgctcatgaatctctcagttgtttggatcagccttttggtatttctgaattggataaaattgtaaagaatttacccatagatagagctcctgggcctgatggttttaatgggctgtttgtgaagaagtgttggccaatcatttgtcaagattactacaaacttgcagctgaattttactctggcactttggacttggatcccctaaatcactcttttatcattttggttccaaagaaacctgtccgtgaaggaataaatgactataggccaatatcactcctaagaatttctcttaaaatcctgacaaaaattctggctgacagactgcaaaaggtgatattagaattaattagttagaatcaatatggcttcataaaagggagaactatacaagattgcctagcttggaattttgaatttcttcatcagtgccatcattccaaaagagaaatagttttgttaaaattggacattgagaaggcttttgatactattgaacatgaagccattttgctaggaatggaagctatgagtttcagtgttacatggcttggatggataaggaagatcttttcttctgcctcctcctcagttctgataaatcgggttcctggaaacaattttcattgcaagaggggggtgaggcaaggtgacccactttcacctttactctttgtattaggagctaagcttattcaagctattgttaacagagcttatagtatggggctcctttcaaagcttcttccttcagatattgatccaaatttccccattgtccaatatgctgatgacactctcctctatttgaaagctagtgatagagaactttttattctgaaggctttattacaaacttttcagctggggactggtctgaagttcaatttcaataaatcttgtctcattccaataaatgttgatgaggggaaagctcagaacttagctgcagtttttggatgtaaattggggtatttgccttttacttatttgggtttacctcttggtaccactaagccagaggtaattgattttgcacctttggtggatagaattgacagacggcttactgcaaatgcttctttcttgtcttatggtgataggcttacactggttaattcagttttttcttcactgcccatctactacatgtgtactataatgttgccaaagacagtgattgacagtattgacagagcaaggaggcattgtctttggagaggctatcattggcagcctgggataaggtttgtaagcctaagtgcaaagggggccttggagttctaaacctttctatccaaaaccaagctttgctcatcaagtttttggataagttttacaataagaagaatttgccctgggtcaatcttgtttggacttcctattatggtaatactatccctcatttatcaaatttgaaaggctctttctggtggagagatatttgcaaattgatggatgtcttcagaggtcttgcaaggtgtcatctgaaaagtggaaataccggttcgttttggtatgatgtatggaatgatcaatctcctcttttttactctatgccgaggctatgctcttttgctcaggaccataatgtatcagtctccgatttcctatccatcgaggcagaaggcaatttcacattgccactatctatctaggccttccaggagtttcaagaacttacttctttccttgtggatgttgagctggtcaataaaaatgatgtttggtcttacatttgggggaatatgaagtattcctcatagaaattttatgctctaaacttcagagctgttaagccaacagttcattacctatggctttcgaagtgtaagcagtttctaaaatgaaggtgtttggatggctactcttgatgaatagattgaacaccaaatttatgcttgatcataagaattgtgctcctccaaattatggcctttcttgtgttctttgtcaatcgacagctgtagaagacttaatacatctgttctttctatgcccctttgctcagaattgttggaaccttttaggcattgcctgggatacaaccctttctttcgaaggaatgtttataagggctaagttggattatcaggggagctgttcatggagaagtttctttatgctccttggaatatctggaagtaaaggaatggtttcattttttgatcaaaaaattcctttttgtcttcttggaggcgattcttaaagggtgacctctttcttttgttgtttaggattaatgtgagatatcacgatgtaatcataagctggatcaatctgttgtaatttgttctcttctttattaataaaattatcttaacaacttaaagtagttttgcacgtaaatcgggcgctgacgtcatcgcctgatttccctcgctcccgtcggacgaccgatgcgtagtcgcgtcccaattataatgtgttttttcattgttttcttttccagatttaacatttaaactgctaagtgtataaatataataacttgactctaaaattatttttcattgtctcgtttattttccttcatactattagccgaagccaaccaatttgacatttctattttaggacactttgaaattttttcgagaagaagactttgattttaggactgattttacgtggtttgctggtcactctagttccctagctctatttttatgatatttagaaacataaaaaaacatatatatgtagttattttttaaaaaccaaggtcaaaatttcagaacctttaaaaaaatatttgacaagcatgacattaacggaagctaataaaatataatcaaaatctaaaaccgtgaattggaaatagcccatccggatttcaattctacgctttataatggaactatcccatctgggtttaaattctacgctttagtgataggtactacctcccatataaattataattctaagttgtttaacatatattaaggtttgagaaggaagactatgatgccccttattaaatattgtataggtaggagtagaagggtagttgagagtaaaatagagagaaatttgaacgattagtggttaatgaggccattattactctattgtgataattattttgaggcgaattcaaatcctagaaatacaattgttatgaaacagaaacgtatttgtcactatgtatacattaataagggtgaatgaaacggtctttagaagaaaatgaaaatcgaactggcgaagattctcgggagataaatgccagatgctgaaaatataaacgcagggcgacaatccaacattccttccagagtttttccacccaccagcatttaccgcgcacgcattccgaggcggccccccctcatctcatcaagtctccatctccttgttttcttctgaccaaggagggcattttcgtcagaggatgaacatttccaacggcccaattcttccccctcacatccgtttctgaattctcatcagattcagatccctttccttctgctgtaacaacgtttcctaataattttttttgattccccatccagagaaagaagtaaataattaagcccaaatcttgcatggtgaccacgtgtcagtgacacattctgtcagagaatgggattagacgatttgttaaccacaaatctctgacagaactagagtgagaaacaatctctgccaaaatctagagagagaaacaacctctgcacagagagagagagagagagagagagagagagagagagagaggcctttgtatagtacagttgcccactcatctctcgcactcgcaatgcgccttttgatgtcactcatggctgctctcttttgatcttttcctctttttcttcttcttctttgaagcatcatcaactagggcggtagggcctctttcctttgttcgttttatctttatagcttctctctatctctctctctctctgtgccctcttcttcctagccgaattctgctggtctccattgcggctactgttcttggggttgccctctctctctccttcctttggttttgggcggttttcttttgctgaaaaaaactagttcttgattggttcttgtcatctttgggaggacattgctctgggtgtgtgtcaagattgtgctgggagcataaagctgggatctttggccaggttcttgactatctaaattgtttgttgttgctatgtactaattacccttgcatttgggagctcataagtcataacattacttttctcttttgcagattgtagagggcttctggttcttgtcactgggggtgctttagagcatttcttggtgtccattactgttctgggtcatagagtttccaatctttggcaattactcggaggaattcttgagctgtgtgctactgtttcctttccctgataaatcaaccaagggaagggaaggctgtatattttccctttcttgttcttgatctttgcaataattttgatcatcttgaagaaaagaagtgtaaagtgtttggctgtgaaatggctgaggtgaagcctgaggacatggtccatcatccacccatggaccagctccagggatttgagtactgcatagactccaatccatcctggggtatgtagtgttacactgcactgaagtgttctatgattggttgatttgtattgtagcatagtatatgttactaaccctgagtggttctggttgttgcaggtgaagcaattgctttgggctttcagcattacattctttccctgggcactgctgtgatgatcccaacaatgctggttcctcttatgggtggaaatgatgtgagaattgcttcatttattaacccgttttttatgtgcagtagaattccagcttctgtatcagttgtcaaatgctacagcacattaatattgcaggaccaacatatgactattcttactaaaattttttgtttcatttgcttccaataaaagcatgacaaggcaagagttgttcaaacactgctatttgttactgggataaaaacactgctccagacattattcggcactcgacttcctaccatcattgggggctcatatgcatttgttgttccaatcctctccattatccgtgacccatcgcttgcgcaaattgctgatggccatactgtaagtatgcaatgatcttcaagcttatttcaaataggctattgttaattatggccattttggtactggaaaattttcgttgtatttacctaaagtatctgttttggttcatttgcagagatttgtgcagacaatgagagcaatacaaggctccctgatagtctcctcgagcattcagataattcttggctatagccaattgtgggcaatttgctccaggtaccgcagctcccgcaatatgcttgagtaggacgtacgatgcctttatctgtttctcccctaaaaaatattcttctgccattatatgtccaaatctgtgcaaacatttatactgagggcatttatttgacaaactttgctggaccgatatgacattgatgtgtgtagatattgcagttcagatgataaatattttaatcttcatactagtatgactagccggccactttatgttgttctcagtttgagtagtgggcatcatgactttagagaaagtgaaaatatgctagtatactaatcaaagggagaccaagatactcaaaagtgatgggatatgtttgctaccttcatgtcgacgataagaataagatgacagtagtttgataccatgatgtgcatgttgcaggttctttagcccacttgggatggttccggtggtcgcgcttgtggggcttggcctattcgagagaggattccctgtggtaaaagctctaatagctacccttacttccactctgtatgacagtaccagtcaattcaatgttaggttcttgcaattctaaagtatgcccacataatccagaaaaaaagaatattatctcaacataacctttttgaagcatttgcttgcttattttgtactttctctatttcatattataagttgattgactttttccttagttaaagttctttaggtttgaccaagtttatagaaaaaattattaacatctaccacaccaaagtagtttcattaaatttaatattaaatatattttgttaatatgtttattttatattgaaaatattagtatatttatctctaacttggtcaaacttaaagaaatttgactaaaaaaagtcaaactatttataatataaaacggagggagtaccatataatttatctgataagttaaatattagcattattattattattatttagtttatttgaagcatagaagttaggatccactattattattggtttatttgcatcatactcctagaattcatgaaaattacccaacttagtcgtaaacattcggcatgaaaaaaggggttgattgttgcctatgctaagctgcttcgatcattaattaatcctatggaaacatgttcacttaaatatttacttccaacttggcaaatttgactcctggaacaaatcaattctttgcatgagtcatctctgttatcacctttttaaagctatttatattacaataattgttaacccgtacttaatttggttgttacacattatatcagattgggagatgtgtggagatcggccttccaatgctcatcctgtttgtcgcgctctcccaatatctgaagcatgtaaatgtccggcatgttccagttttggagaggttttcgctgcttatatgcgttgctcttgtgtgggtatatgcccacatcctcacagcaagtggcgcctacaagcacacagccctgctcacccagttcagctgccgaacagaccgtgccaacctcatctcttctgctctatggtttggagtctgccacattagctgattaatttttacatccacattttacaacaaactctcatgttcaatgttttcactgtctcgaaggataagcattccgttcccgttgcaatggggtgcaccaacattcagtgcaaatcatgcgtttggtatgatggctgccgtcgtggtgtcgttaattgaggtaccttgaaatacttagcaaatacatggtttatcagagcatttttcagtgttctgagaacatttcaatactgcagacaactggagctttcatggctgctgcccggttggcaagcgcaacaccaccacctgcatatgtgctgagtagaggcattggatggcaggttagtggtcttctcataggttgattcatgaatcttaacttggaatacccactaaattagttacatgttcataaacatttaagaaccaaattttgtttctggtaaagaaatgtaaatttttggatggataattctgctagtgataaactcccttttaacttttctgctcgaatatgtcaatttttcagggaatcggtaccttactagatggtctatttggcactggtactggatctactgtttctgtgtgagtgcatctgctgtactaatactgagttttcaccctatgtttgctctgtaaaagcacccctaatcttttgggtgttattcagtgagaatgttggtcttcttggatcaacaagggttggtagcaggagagtgatacagatttctgcaggattcatgatcttcttctccatgctaggtagcatttctccctagcattcaacacacatttttgctgtttttttgggagttctgaatctgtcatggttgtaggaaaattcggtgcactatttgcctccattccattcccaatatttgcggctatatactgcgtaatgtttggcattgtcggtaagcagcccaaacatacatgacaaaatgattttttttcgctttttaaatgtatttaatggacagtacactcattttattgtgtcttcagctgctgtgggactatcctttttgcaattcaccaacatgaactcaatgcgcaacctcttcattgttggtgtctccctctttcttggcttatcaataccagagtacttttctcggtataccacgagcgcacaacaaggaccagcgcacactaaggctggatgggttcgtacttatatactctctaacatttcaatttccatttggaatgaacagcatacgaaaatgaatctatatctagtacattgcggtaacacaatgctaattgactgcaaaaaaaaatgtgatattgcctaatgttattccttatttgttgcaataaaaataaaacttagacaagaagtcaagaacattatcatgattaatttcaagtccaaaatagaaaagtattgatattggtttcatgatttatatgctattcattttctgacattggttctccattgttcttagaatatttgacattttcctgcaagtctgttcattgtacatgtttacactggaaaccagaatttgaattgtgctgctcttgtgtgcagttcaatgactacatcaacagcgtcttctcgtctccaccgactgtcgccctcatcatggcggttctccttgacaacacactcgatgtcagagaggcggcaagggaccggggaatgccatggtgggcgcgattcaggacgttccgaggcgacagcaggaatgaagagttctacaccctgccattcaacctcaataggttcttcccaccatcttgagcagagcagagcagagctgccgaaattcagagaatgcaaagacaaagttccagatgcaccaagcagtgaaatgtagtctgcttttgatagggtagaacagaaagttgagctgacaaaatgagcaattttaccagcaggcaaggaggaactctcttctagctgtccacttgtacatagaaacgattcgtttttcttttcatcagcttcaacaccgaggatgtttgattttgctgtaagcaattaattaatatcttgtgaacaactggtcatattagtttgaataagaactgttagttataatttttttatccattacatccatctgcaactagccatatacaactctttatttttcttttgttgaaattcagatgtacatgagcacatccctatggttattggtgacgatgagtgatcttaagtcaggcgaccaatttgcaccaaagtttgacaaaaaattttcatgtcggtcatcacagaaatagcaactcactgaagcaaaaatgtgttctgagccacaaatcacaaatgtaatggaccaagatgtagcacggaaaaaagttaaaacattgttgtgctcatctacgcacagtaaaaactttgtttgtaacatggcaattgtcaaggtaaaaaatgtgtggaagtagatctgataaatcatgtagccaatctctcatatgcctctgatttttgctcactcccaggctcccagccctttcattggtagcccttggctgaaagctagtgttgaatatataagcacatgcatattgatttaatttattccataaataaattatgacattgcagatgtaaattagcataatcgcatcatacgatctacacatataaacaaatcgaatatgtgaaacatagtgaatgcgtaccgagggttttggaagttcggctgcatagtaggaaggactcgcgataccgagcgttgacgacggcgtgcatgtcacaccccgatctggcaccgtcgtacaacggcacctgataggagcgtgtcgtaggaaaaacggcgcgaaccgcttcctacgaaaccgcgatctcagtaccagtcccaggacatagcgctggtacccacggtgacaaatatgaatcattgcaatccttaaaataaatagaggacttatttaccttaacttaggtttgcagctcagaacagcccgagaatgcaaccgacgacgcggacgaggaaaacaccaacaacagcagcagcagcggaaccaacggactaacacccaacaccacaggcgatggctaggaaccaggacgaaatcctaatcttcacttcactccgtcttcacttcaaggcggaggaactatatatatatttatatagagcaagggtgagtactttcgtactcagcaagtcacgggaatttaggtgtttgatgcaagcttggaagagaggcaaggttgttttgcaaatctttgttttgaaattattttgaaatcacaaagtgatttatttctttctaagtttgggccgaaaagagacttgcgtctcgattcgactttaggagatgtttttcaacagctcatttggtaatgtaccgacctctcaggtcagatcattatctctcggctcccagagtcattccacttgattaatcggctcccagagccttttcattttctcggactcccagagtccagctgcccatcagcacaacaatccgcttccacttgggaagcctagtctatgatgtccgtagacatcccgaatcacacagactcgtttcttgaccactcaggtcatccatatgccacataggctgattctagtaacgattcccacaccacaacaacttttcacaaagcacaggcaaacaaatctacgctataggaaacacctcacatccgcccatgaccgtgggcacggctgttcgaatagttagttaacctctgcagagggggtacactttacccacacgacattactaacccggatcatccaacccgtggagaacagccacgtctggtgaccttaaggctttcatgacaaggcatttcaaaagccgacacagggtcgccatatgccaacgagaggagtcccagactgacaacaggttaggtcccagaccatactgtgccaggaagcccgagggttctacccgacaccaccccattgaatacacatgtctcttggcatcaaggcttccctggtttgctatttactcagccaggggtgtcccattgcacccgtgtggtcgcacttgttatatgctcggatgaatttcccacaagaatcggtccttatatgcgaatacgggacagtgccacacaggcacaacccccgcatcgcgagttttcacaatttattttattttcaaacacaccgacaccacatgtcgggttttaaaggcttctcaaacccatttcccaagttttcgacaaacaatggtgtatgtgggatatttggtatacgcgctcagagagcacgaataccgaggtaccacaaaggtggagcgacaaggagtcagggtagtatagcctacaggaattagtgcgactactgggtaggtccatcggtttgacacgcaaaccgaggctaagcaagttaaacatgagtgattctaataatgcaagttgcaaacaaaataataatgattttccaattataggagaaattggtcaaagggtgacttgccttgctcaaggtcttcacgaagcttcacgaatcttcgagaaaacctgcgatcaacgaaaatccggtaaccgcaactatacgcaaacaatcaaaaacctaaacaaaagaccaagaaaatatcctatttagactaaataatagtgccattagatagatctcaattttacggaattactggaaatggaacggagtcaatcggaggaacggatgaagagatatgaattttggaaggtcaatggatttttctggacaaggaaatgatttatcggaattttctggaatacgacaaatgatttatggagtttatagaaataatattctcaagaatattattgacagtcactgacgtgcaggaccaagggaaatgatttatggaattttgggaataaggaattgatttatggaacaaaggaaaaaggatttattaaatcccttggaaaagaaaaggaaagagggatgtcatttagacttcctttgggcggctagggcgcggcccgaaggctattgcggctcggccgaaccaaatgggctagcgcgggcgcgaggaggtggcccattaggggcgcgcgggagagagggagcggtccggtggaccgagtgcacctcgtggggtcccgggaggggcccgcttttcggtgacgcggctcacggagggattggtgcacgcaagggcggcgctagggtttcggggggggatggcgcacgggcggtgcgccggtgtggatgggagtgcggcgggcccacttgcagtcgctcggcttactgtggattgcacgcacaggagggaggacggagggaggggccgaccgggtcggttgactcggtcgtgccgaggtggcgccttcgtggcatgacatgcgggccggcgggaagaggaagaagggggaggccgagatggacggcggacggcggcgacattcgctggggcagcacacggagattcaagggagggggaggacaccggagtgatgggagggacaggaggattcaccggagggaggctggcggcgacgaatcatggcggcgcacgccagcagcgagaaaagggggaaacggcggagggacgacgaggattcaattcaaggaggtgggagcatctccggggttcaaagagtccatttccagcgtcggatggggcagagcgacgccgtggaggtccggcgatgagcggcggcctccgggagcgggcggcgacggcggcaagcctatggcgggtggtggcgaggctaggggcttcgtctacgcgcattcgggagcgctaccgagctaccgcgcgagctaaaggagggagagggcaagcgagaagggagaacggagggaggaactaccgagccgagacgggcactgtgacgagcagccgacggcgcggcagcgagctctccggcatcgggccagggaaggggaggaagacgggtgcctggagtcccgcgtcacgcgtcctcgcacgcaccggtctccccggtgctcggcggcggacggcgactgcgagagcagaggaagggcgacaatcgcgcggtggagtaggagtgtgaagcgggagggattgagatgggaaggggagctcggcttcggttttataggcacgggaagtcggttttgggggaggaaaccgacttaggtggtcaagggagctcggctggcgcggcgcttgcggtcaaggagcagcaggaggtggtcacgggcggccgggctgagaggaaaaaagcaaaaaggggaggggaaaggagctcggctccttgccgatttgggcgagcagagggaggagggagagcgcgtgagagaggggagccgaggctctgcctccacgtcttggacgcacgcgcgcacaggtggagcgagtggcagggcggcatgggcggctgcgcggcgcaggcggccagggcggacgtggcggcgaccggacggtcggccacgcgcgggtgagcgcgcgcgcggcgcgagggtgcggtgaaatttgaaaaggcggcggcgggaatcggcgccggtgggggagcttcgacgggagagagaaacggagagagagagggcgagcaagagaagagagagagcgagcgagcgagcgagagagagagagagagagccgctctctctctctcggctcggagagagagagagagagggcgagcaagaggaggggggcacggctgagaggagggatgggccgagggagtggaattcggcccacaaaaatagagggaggcaaaacggactttgacagagaagttgaattggagggaatttgaatttggaatttgacttggacttcggatgagagggaggagtcgacgaagggattcaaaatggggatttggtattctcggaaccgagaggaatattggcaagggattcaaggacagaattggatttcgcagacttgaatcggaagagaaattttcgaggtgaaggattttgatttcgatgagagggaacaacgggattgaattgagatccttggcacaacttagactcaacactcaaagaacggaaattttcgcaaataggattttgcccaaaatagtttttaacgactcacgaaaagcggagcgttacagtgcagcacccgagcgaaggggaatatgagttgttgtggacgaacaacaagcagtcgcacgacgtgcttcctaaaaatcttattgccggcttctcctagtataggacgtcaaaagcgaaggttccggggacttactctcccgatcaccgatgcaatacagagtaggaggaaaactttagattgatttcacgtgttgcgaggaggcgttggcttggtttatatggatatatcatgatgtttgatcaggacgcctgtatgatctccacaccgtgtaactgaatcggatataatttatccagactccatgccgctccacacaccggattattcagtgtgtatccaaaaccaaaccaaattttatagaaaaacaaaactgcaaaaaaaaataaaccgcattcgtgcaagggtgatgaacgaattttgacggactattcaattgcatgtcgcctatgcgcgccgcctagccatgccaagccaggcgagcgagtacatacatgtgttgctcttgttctccccatcacacatgttggttcaattatgagatagactgaggtatgtggaactcaatgaaagcgcaaaggacgacatcatttggaagtagacagaaaatggtcaatacacgtacggtaagaagtgattatttggcgcaattcaatggcactacttccactgcaattttttccatgatttggaaatcccaggctgaaccaaaacatcacttcattgtttggctctgcagtctttgcagggactcctttgaggatgcaacacatcttgcagaagaatgcgacttcacaaaatcggtctggaaccaaatctgcacttggcaaggttaccggcatatacacacggactcccaatcaatttcagactgggtggaagcactttctaccatcaggccaaaaagtgaaagaaagaaaatcataggaacctgttaaccacttggtggcatgtatggttggaacgaaaccgacggatcttccagcagaaatcgcaaccggcgatccaagtagccttctcgatttaggaaaatatagaccttttgtaatttatctgacttcctttttttaggaggtcctagctgttcagggctaattcccagctctgctttgttcttgtacttaactcaatcttccccttctaatatatctggcaatgctcttgtgccgtcaaagtttttcagaaaagcagagtatcctaaccatggaagaaactagtggcataaattagggctagaaacctactaacatgaagcatggatgaacttaaaattagcaaagtattgtaagagagaagtatcaagtatgcatgttacccgatcggcaagactccgacgatccctcccggcggagtgccgtcaccgaggaatcctccgggcgagaagccaacgtccctgactttctcccgaaatctccctccattcacagactgacctacacaactatttctgcagcatggtgcgttcttgttctgcttcccgaacttggtctattcccaaatggtaggcatgcttcctcaatggatcaatgtcgatcattcaatggatcaatgtcgagcttggttatcttccttggatgctcccacatgtgcagtcgaaggtcggttgccgttcgggccagggcaacaaggcccaatggggccggtcagcgtagctacttgttgtaggccggtcggtcctccaataaatcggggaaaaagtacatcgaaagtccctcaacttgtcatcgaattacaaaatcgtacttaaaccgtaaaaccggatacaacgcgtcccccaacttacaaaactagtgtagactaggtctcttggcggttttgactccggttttatccgacatggcagctgactcagcgtgggacccacatgggtcccacatgtcagcctcttcttcccctcctctcttcctctctcatccctttccacggcgacggttacggagagcagctgggcacggtgcggcggggtagcagctgggcgcagccgatggccagcgggggaggagctaggcgcggccggcggtcagcgggggaggagcggggcacggccggcgagggtggagatgggcgcggctggcaaccgccggggaaggagctgggcggcggcggcgggggagaagctggacgtggtggttgtcgtcgtcgtcggaggcggcggggactagaacgacaacgacaatggcggcggcgacggctgtgaggcggcgccgcggcgcgaggagaagcgcccgagaaggaggccatgcggcaggctgaccgcaacgtcggcgccatcgtcatcaatccgctcttgccaccggggccggtggacaggagaggagacggcggcggctgaggcgggggtgggggcaccggagccgcggcgtgacagtgcagggtgggagctgggttgcgcagggcggggaggagggcaaggtggttcggcggcgaggtggggagagcaaggagaggacgtcatcgacgctgtcgggcggcagcacagggaggagtggcgcgtggtggaggggtcgtgggaggtggtggtgcaagcccaaagattccttcagcctgatcttcaattggatctgtggtcggagctccctcatctggttcgggcaagtagatgattagatgggattcaggcaaggtttgacaacgcacctcatggccgaggagaagctaggctctcaagagactggcaagctccattccgtgcagccatgaagagctggggatccataaatacacggggagggggaggtcgtcttgggtcgccacgttcttgcttgacgccatgggcacaaccatcggagaagcaacggcttccccactcaaccagatccttgaacccctcacatccatcgcgccctgacgccatggaaggcctggctgctacaggcgcagcatttgcctcc

SEQ ID NO: 68372 - DNA, 18571 bp, Oryza sativa
cgtagttaacaaccccgagaaaagtggtctatttgaaaagcaagaaatgttgctgcttcaaggagcccttgatttatttcaaaatagacataatctggagttgttttatgagtggacaagtgtgggcggtttaaaaacctctttgttaaggaaataaagtgggttggggattcaggctagaaaagttaaaaatcttgcaacaagaaatagaagagtaacttttgtttatataactaaaatgcgaacagagtgacaagagtgtgtggaaatgcgggaaatgtttcttcatgccaaaatattttgtgaaacccaggtgtcgggcagttaatggattttggggaagccctctccaatgtttttaaaaaagaactctgaacaaatgcacggtttgatgatcaatgatctccccgactttgatcatcaccagagctttgttaatcgctaaccagttccaaaatgctgccctaggagaggtcctctttcgtagacgttggggtatatgacagtacgaaggtaccactggagtccggcctcccccacgggccagctgccctgcccactgccgaactgaggagcaaagggagagaaaaagaagagaagggaggaagagagggaaggggaagaaggggctgacatgtgggacccacgtgggtcccatgctgagtcagctgtcacgtcgaataaaaccggagtcaaaacccctaagggacctaatttgtactggttttgtaagttgaggaatgtgttgtatctgattttacggtttaaggatgattttgtaattcgatgacaagttgagggaccttcggaactttttccataaatcggttggtctcttttttgatccatgggtgagggaagccggcctgctggccgtactaggctagctgaccagatcaccagatgtggccggtctacaaggctagtggctctttccgtgcattttcgcatgagttccatctgtaactgcaagatattctgaaaaaaaaactcatggaattcattagaaataggcgaactgatcaggataacgtgcatgtatttaatattttgttaaaacgtaggtggtataatttgggtttaatatccacctgaaagggcctgtaaaatttgactttctcaggaagttctctataggaactgcccataatttggagctatacaatctcaagagaaaaaaatcataactcattcaattttttcattaagacgaatagtgaaatgtattttaaaaaatcaacggcatcgtatattaaaaaaaggagggagtaaaaaggagaaagtttatataacatctattgtattaggcttagtgtgcttaactgtctatgatataaaatcaagccggtttttgtatattctgaaaatggattaattagatatctcatggcaaataaaaattaaagtatagcgcgccgggacaacccgaataaactactccctccgtttcaaaatgtttgacaccgttgactttttagcacatgtttgaccgttcgttttattcaaaaacttttgtgaaatatgtaaaattatatgcctacataaaaatatatttaataatgaatcaaatgataggaaaagaattaataattacttaaatttttttgaataatacgaacgatcaaataagtttaaaaaattcaacggcgttaaacattttgaaacggaggggagtagcagtggttaaccccacacgcaaaaagtgctttggctgcaaaggaggaagagaaagagtgttgaccgggggagaagagaggagaagccgggaagagggccgggatggcgtcgagcaacggagagcaacctccagaatcgccgaaggaagcaaatgctgcgcctgtagcagccaagcttgccatggcgtcagggcgcgatggatgtgagaggctcaaggatctggtgagtagggaagacgatgctactacgatggttgtggccatggcgacaagcaagaacgtggacgacacaagacgacctccccctccccgtgtaattatggatccccagctcctcatggctgcacggaatggagcttgccagtctcttgagagcctagcttctcctcggccatgaggtgcgttgtcaaaccttgcctgaatcccatctaatcatctacttgcccgaaccagatgagggagctccgaccacagatccaattgaagatcaggctgaaggaatctctgcgactgatcagcaagcctctggtgctgtatattcgctctcgctcctggagggactgactcttgactcggaccagaactccgcgctgcatgtggtggcagcctccggtgacagccaggcgtatgtggagtgtgcgcggatggtgtacgaccaggcgaggcacctactcggcgcggccaacaacaacggcgacacgcccctgcactgcgccgctgcagctgggaaccactcctcgcgctggctgctgctgcgcctgcgcgtgacagcagcggtgcagcgagggtggatgaccaggagctcctagcaaggaggaagaacaaggtcggtgagacggctttgcacggggcggtccgtgctggccacagcaaagtggtggaggtcctcatgaaggaggatccgggactggccggcgttgatcggcacgacggcacgtcaccgctgtaccttgccgtttcgttgggacgcttcgagattgcgtgggatctgcttgatatgagctctaggaaattatcttactccggaccagatggtcagaatgtcttgcacgtcgcagtacaacacccccaaggtatgcgccacattaccgtactctctttgttgcccttccattacatcagtaataacaaaataattatgtttgttttaaaagatcaattaaatccaactcattatatattcaacaatgcacagcaccgttaaacaacctgtaaataaagctgtatcgaaaattatggttttgaggatatcatctaattaagattgtttgtataaaaaggaagagattcgtgatccccctatatatatactgaggcaaagacttttttttttagtacagattaattaatttgggtctcttactccttttatgataataactctatttttatcttggatttgtatatacttttggatataaagagcataggtaggaagtagacctaatcgactatctcgtcaacatgtttgggtatgggtttgttgcgatctctgtcatgctcatctgattagcttttcgggagtttggcttagttgctttagagcatgtttaaaggtacgtagaactcggtatgagctcttacacggtacatgtttatttagaccatgtccttacgatagttgaaaccattaacctaaaaattaatttatttttattttctttttttcacccacatccaagaaagtttctattatatatatatatatagaggctataagaattgttatttagccattgttaaccgtaacaataatatttatcttttctcttctcttcttatctcttccatgtcagcaaacattcctaatattttgcatgtccttacccctcctagcaggcgcaggacattctatttatacccataactccatccaatccttgtagggtttgtggagataaacttggtatgtttgattttgtacaagtagatgatcatcttattagacctgttttgaagattatatccctttcatatactccctccttccctaaatgtttgacgccattgacttttttaaacatgtttgaccgttcgtcttattcaaaaacttttgtaaaatatataaaactacatgtatacataaaaatatatttaacaataaattaaataataggaaaagcattaataattacttagatttttttaataagacgaacggtcaaacatttttaaaaaaatcaacggcgtcaaacatttaggaaaggagggagtagttcccacccacatgatttggtacctttcaattcaccttgggatcctgtccgaaagacaacgaaacagcatcgcacccctcaccccagctttatcatttgcagggaaggagggatgtgtcacggagagggagggagaagaggagcaggtagcaggtggcttgccgctcctaccagccaacaacggcatgcacccccgccccaagccttaattccagacttggtaccttcgtaccaaggtttatacgtgtaggtatcatctgtgttaccctaggtattaggcttgatgttgtgggtgccatccgtggatggcatggcgcacgacatacctatagacacaagccacattgagatcacgccaggaggaagccatacatctagtcacgtataacctgccagattgcttcatcgaaattagtctgttgggctagaatagctagcatgctccgcatttatgctcggtatgctacatctcaaagctatacatataaactggattagatttattatctttctcgggaacctaaatcaatacttgtcccgtttcctcttaatcccatcttgcatatatcttggtatatatcaaccataccctatgtccataaaatagcagtcagacataacccgccgataaaccgcatactctctcccttttaaagtacttatcattctagatttatcctaggtcatcgtacattttaatactttattatccatttctttaaactcatatagtatgctttcataatacataattcacattctcttatcatttcaaattagaaagaacgacaaatattttttaacgaagagagtacaaccggctattatgaaagcatatacttcctttgacatctcgccatatttttttaacgaagagagtacaaccgttgatttaattgaactgcaatgggtcaacggggaactgcatgaagtaattgttcaattccacgtgctcttccaactatctgcccatggaaagacatcgtacttcagtacttgcttacgccatacgcgtagtttgactgcctcaacgtcaatgagtaaggcctggtctactttccaaatttttttcccaaaatgtcacatcgaattttcggacacatacatggagtattaaaaatagataaaaataaaaactaattatacagtttgcatggcaattgcgagacgaatcttttgagtctaattagtccatgattaaccataagtactacagtaactcacatgcgctaatgacggcttaattaggctcaaaagatttgtctcgtggtttccaggcgagttatgaaattagtattttcattcgtatgcgaaaactcattccaacattcggtcaaacatccgatgcgataccaaaaaaatttcttttcgcgaggtaaacacactctaaacagtgcaactggatctaacccgacagcttgatcggtataaataaaatctaaggcaaaaatcaatggttgaaaaattcatgtgattacatgtacatagtgaattcaatttaggggtagtttggatatacatgactaaactttagtccctgtcacatccgatgtttgcactaatttagtgtattaaacataaactaattacaaaactaattacacagattaaggctaatttgcgagacaaatctattaagcccaagtaatctatgattagcacatatttactgtagcactatacattgttaaatcatgtgtgtaattagttttgtaattaatatatgtttaatactttaaattagtttctaaacattcgatacgatagtgcctttagtacgtgtatccaaactacaccttgccttttgggcttccgtgggctttggtgttttcctgctggcaatatcccatcgccagtcactgccatcagacactacgagcagcacagtccgccgccaaaagcttaaggaagggtgtgtttagatctagacgcgcaaaagttttcgcgtgtcaccttgggtattatataggatgtcgtatagggtgtatgagcactaatataaaaactaattacagcatccgttagtaaacagtgagacgaatttactaagcctaattaatctgtcattagcacacgtttactgtagcactatattgtcaaaccatgaagtaattgggctcaaaacattcgtctcacaaagtagtctcaatttgtgtaattagttattttttagcccatatttaatacttcatgcaggcgttcaaacgtttgatgtaacagtgtaaaattttgtggtgggatctaaacaagcccaaaatggtaggagggcaaagaatgaacagtcagcacaggaaaacaaccaaaattttgacaaattgaccctttaagaaaacttattttgagattgatccatgctaaaaaccaattgaaaaataagccatcggctgagtgacatcgagtttggcgctgatatataacatgtcagcgccgagaaagttgaccctaagatctaaaactctttgccgctgaccccacatactagcatttaacaatataatttttgcctcttggttggaagtttggtagtggtttaatggtttagttgcttgcatggtatatgcaggtcttgtgtttgattcccgtcggccgcatgtataagccatttttgtcacttttttctctcttctttttaatctctcagtagtttgcttttaaaacaaacagatgatttttatctctttttattctctcagttggctttttaaattccttcttttttattctctcagttgttggctttaaaaaaacaaatacttttttatctcttctttttttattctctcagttggattttaaacaaaataaatgcgacattgattattctcagttgtttgcttttagtaaaaaataaatgcgacgctagttcaagaaagcagaaagagaacatacactaatgaaacaataaaggaaaaaaatgcatagcagaggatagaacccaagatatcttgcatgtctctcaccactaggctacacttgcatcacagattactaagtgttgcttccatttttaaccggtacatgaggtcagcgccaaagactggcgttgatcctctgccgcgtggaatgcaccgctagctcatttcggatcttagcaccaacatttccaacactgagacgttatatatcagcgccaaactcgatggtgctgagccgacggctcatttttgcaattagtttttagcatggatcaatctcaaaataagttttcttaaagggtcaatttgtcaaaatttcgggaaaaacaataggtagaactcctgctccatccgcccctaaaaaacgaatatagagtcggatgtgacatatcctaatactatgaatctggacagatatatatccagattcgtaatattaggatgtatcacatccggtagtagattcgttttttatgggatggagtgagtatatgattaggaggtccaactcacttaagatagaaacaggaagattcgatgggaggatggggaatagaacagaaaactattaaatttctgttgtcaacttttaggctaaaacctaaaatgcccttgtttataccggcagtacattaccaccatgtaatttgtaccacaaaagtcctctttttgaaattgaaaaatctgaaacgggccaaattgaatgtgacgaaatatgagctgacggctaactatattaattgttgattggctgactgtttgcttcagtaaaatgtctatatataaaccccaaactgtttgtgttgcttagcccccaaagtaataaaccaagtattttttatctcgatgtattgaaaccccggtttacttaaccccagggtggttttgcacgctggtttcaccatgctgccagtcaagcaacctccaagtggttaatgtgccaatcagcaacatgagctgattaataatattccttcgtcgtccttggcaaactcaagttgagtggaagaaattggacggggcttcgaaggagaccgggagataaattaaggtagaggtctggggcactatgtacaaagtggttcaagtcctacgtgtcttgactgctagcgtggactgccagcatggtgaaattagcgtgcaaaactaccacaagagttatgtttccatatgtagatttaccattttcccccctattatagcgacacggtattatctccttaatgaaccaatggaaggaagagtagaaacacaattaaactaatggagtagaagcctaggaggaagtagaagacaagtgaaacaggcaacaacctgtggcactgctcatgctgacatgcatgctgcaggccacacagctgataggttgcttaatcatttttaaaagaagatgataggcttagtttgtttttgaaacatgtttcaaaaataaagtgtaaattaaaagcaagatgtttttctttctataattgattgtttaggggctttattttttataacaaatcttaaaaaccattattgtttaatagacgtctttatttgtacagccttcgccctctaattggttcgtgtatatttacatgtaagcatctaagcactcaaattaaaattatgtattggttatggtaatgggtattctagtttaagtgaaagctaagaacttattttctaagaattttctaagtttttctatagttagttcactttgctcccttttatattttctagtttctttatgcaatcttattttaagttcatattttgtgagatgacaaaatagtgacagcgtgttacaccttatatgtcaaccattttcgaaaaaaatgaatcaatttttgtataaacatctaagactaaaatatgttctcattatttattgattgatggattagaatgattcgagactatgttaaatacacatacttgtagaatccaattctattgcacagtgtaggagacaacccatataggaaaattttttgcaagtatgcgaagcttctcatagcctagcaggaacacgattggatgatcaaatataactatgaaagcatcaatttttttggaatatgatttttgatgattgtttccatgatttaattaatattacgaattatgtactcgaagccaacctctctacaaataatttgtttagctagactacactgggcaataattaagtacaatgagattatataatcatacatataatgcttataatgcctatccacttgccataattatcattgttttcatgctatattagttagaaaccatagtttatgataatcttttaaaataaatggctaattttatcaggttatgtcattcgattatttataactaatttgcagttaaagaaccatattaacacaactaaattaaattgtttgtatttttacatatgtagattcaaattagtgttgtatatttgctaagtaatatttgaaactataaaatatgatttgaatttttaaatgttgttatggaatttataattacatgtcaaatgtcatctgccacattgtagcttgcactaaaatatagccaacataattcatcaaagtaaaatcacaccaaaataagtgataattacataatttgttttagtcaaacgaatgatgaaaacatagatcaaaagtcaatagtgtaaaaactggaggtaatataaatattttgtggcaaaaagagcagggccggctctacatattttagggccctaggccaactccatgacatgggcccttaggcatacactctctctatatatacacatatgcactttgaatttttaaagtatacttttaaagcattcatccgctaatcacgctgaaaataaatattgataatatcctctatatatgttgctaaaaataccaaaagagcattaaaatggaattactacggttaccttgaaatcttgactaaggatcaagctccagggacttcattaataatacttgacaaaagataagatgacagacatccatttgcttctcataaaaaaatactccttcggacatttcttgatgcaaaatcattaatgatggtatcaagatcaatattgtccaagacatttttctcaatgcaacacatagccaagccatttaatctttcttgtaacatggttgatctcaaatagtttttcaataactttaattttgagaagcttctttcagctgaggctactatcacaggcacagttaaaaggataaatgctttttaggtaacattgcaaacctaaacgtatagatgaaactgatctttaattagtatttactagttactactgactgattaatactttgctagttcaattcaatggagtatggacaatatggttgcagcacagcagtacgcaagtacctgtaaattgaaacctgcagacactctggaagtaggcagattcacattgtgtcagcggtcgccggtcggacgatgtccagggcaaacagtcgacagacaaaggcacaaagctgtgaagggctgaatgctgaagggatcgccggcggcccagcgtggggtgaacttgcagaggcgccgtggagggcgcagggcgatggaggcggattggcggagactgccgccggtagaggagaggagacgagaagactggaactcggacggtcgcgtatgcccgacgattcgatcagaaacttgtatacatgtatatggtatacctaatacatacctaggtcttctgggcccctacttttcctgggccctaggccatcgcacttcttgccgtagcccagagccggccctgaaaaagaggagatacaagtgcacgtgagggagagaggagagggagggattacattctgtttataatctaatctaatctaatggtctaaaacaatgagcccaccaatttaaatgaaaaaaattgagggctagatgtttctaatctattagaatgccacttggtggtttagaagcgtttacagaaatgccacattggcatgagaacgcttgtagtatgtttaatggacttgttcaagataaagtggtataattcaaatatcataaaatttggtgttatatatgaaaaatgtcatgtttaagagtgccatatgttaattttggcagtgcagttggatgctgaaagccgacagagagaaaattaaatcaaagatgaccttttgttagggatcgatgtggaagaacatgactgtattactgtaatagaagtttattaaataatcttaacatcttagagatatttcattctagagatcttatgtctccagttggttgtaggtagattggacgtccagtatttctatgctaacatggccctccgctattgcaaggaaccctaggaagattgattaatttagttttctaaatttgattttggttccatttgccctttgggcttgcttaactgatggtatcacctgctgcagcactgtctgtactgttagagaagtgcaagaatgtcgaggtcaatgtacagcaagaagaccaacaaaggagtattcctcttctcttgtacctcactagtcaaagtgacaaaaatgggagcactcctcttcactttgctgcatcgttgaaaactagtattgaaggtttcacatcgagattatgtgaacattttcgcccgaaacaaagcccaacaacattgcttcttggactcaatgaatctgctatatatcagccagacaacagaggatcatatcctatacttgttgctgcctccaatgggatactcaaggttgtcataaccttgctcaaaaggtatccagattgtgccactttgcgtgacatccaaggaagaactttcttccatgttgccgtggagaagaagcggcgtaatatcgttgcatatgtgtgtgaaaggccaggattttctcctatcttgaatatgcaggacagccatggggatactgctctacaccttgctgtcaaagccggtgttttttcaattttcagctcgttgttccggaataggtaggtttgcctgaatttatcaaatgaggatggtttgacacctcgtgatctttcgtggattatgatacctgcgaggttgtactctaaaaaggtaatcgttctctgccttttctgaccataattatcccatataatacactacagaggccgagtttagttccaaacttattctttaaacttccagcttttccatcacatcgaaactttcctacatacacaaactttcaacttttccgtcacatcgttccaatttcaatcaaacttccaattttagcgtgaactaaacacacctagagttgatgatactatacctatttaactaggctaccacatgttaatctttcagaacccacgatatatgataagtcaactattagcactttctggaggtactgttggttacagtcgccaggaccacttcttcgaaaaatacagcaagaaaagagacgaagtaatcgattcaaacgatatgacaagtgcggcacaggttctcggcatttcttcagcgcttatagcaaccgtgacatttgcagctgcattcacgttgcctggaggttacagagcagatgaccacactgatggtggtacaccaacacttgctgggagctacccttttgacgcgttcattatctcgaacagcctagcattcatttgctctttgctagctaccgtgagtctgctctactctgggatacaatcgagggacatctccatccggcgcaggtactacgcgttctctatgctcttgatgcagagttcaactacgagcttcactgttgccttcgccatgggaatgtacctggtgctagctcctgttactcttaatgcagcagtgtctgtctgcatcatagcatttgtttctctgctacctggaaatatggaaatcggggtatccctagctatcgcaaacacattgaggattagattgggaatttgggcagcgatgtcccaagcaaggccagttctcctgttcacgtggaaaagagtttggtcctgcataattatctttggattgcctggattgatgaagattcatagaaccaaaatggcttgattggcgtgtcacctttttttctgcattgatgtactttcttaatatatcctttattcggagtgttagaagtacatttacacaacatcgtgtatgacagctttgctgttacccctctgcattttaacgtagaatatacctacgatcttaggcagaagatgaaagaggggaattcagagtgtggcaaataagttacagtgtatttactactccatatatactgtaagttttcataaatgtgtgactgaaacttttttatgttccactgttttgaatgaaaaacaaatgtttataatattatctaatcaagatttttttttcattttattggccagccagctaattattatttatgtgcttgatatcacgttcctccaatcgtttgatgatagaaatttgctccaatttaacaaaaagtaccaaatcattttcgatcgttggatctaacaatgcccatcctgcccagctaaatccaacgatccagtatcgtgaggtactagtacctcgaggtactttttgcaagaccagagcaaatctcttattgctaatcatgagacctgtatgtccggactaatataattaagggttaattggatacatgccattataatttttgcgatatgcatgacaacacaatatatgatagttaagggcatgtacaacaataactataatgaattaatgatatgcatgacaatacaatatttattattactagcttggatgagagagggggaatagagaaggatggcttagtcacaacacatatatgagaaagtagagaagagtagtggtatggaatgacattttgtctcttgggcatatccttttgtaaataggaaattttaagtagtttggtgcgaataatattctagttagtgcattgtgttagagttgaacatgccctcaagtcttgtttcaaatggaatgatttctattgctgcacaatcaaagtgtgttgattgttattttgcgatgaacaattggtatatgagattattgattttgatattgggagattattggcaaagtggttttggagatgattgaatttttaggtgatgaacaggagattgctgacagtgtggactggtcagaccgggcagtggttgccggtcacatcggctgtacgtgtgcagtcagaccagccagcccgcggtctgaccaggccacattgtgttaatttcggttttaggttgtttctttggatatctagtggataaatcatgtttatgacttctagatggatactttgcgtatgtaatactgttgtgtgctaacaatgagttaagttggagagagcttgtgcttggatatggtttctttgttgatgcatgtgtaggtgagtcttgatgccttgggagagcgttgccggtgatggatgatgagtcaacttgggagaagatgacatccgaatgatcaggatatcatgcgggatgctaggctaaaaatcaataaatgtgcgtatgggatgcagagttgaatttggagggagaccgaattcggtacaattacagtttgtaagtttgtttcttgtacgggaaggtttccttcgggattaggagttattgtataaggttggttaattcgatgctttaggctacctacctagggtatgaatagtgagggaggcctcccggtatcgtttttgagagagttgagtttagagaaaagttagggtttagagtttcattgagatttttgtgaggagtgttgttgttgcattttgaaaacacagagagaagtaataaattttcaatctatttcgagagatcttcgatttgtatttgctcgggttctgcggtccaaccggcgggacacatgccatcagactggcaggaatacgatggtcagaccggtggcaacgacaggtgacagcggtgtgttaggcggtcagaccgaagctactacactgctcagaccgaaggtcatcgagcggtcggttcggcgcatctactctagtcgaaccgatcgccatcgaattgatacaacttttaattccgccaaaagttttgctttttagtactacaaccattcacctcctttggttggcttggtatttactgttcaatcctacaagtggtatcggaaccttgttttttccattagatttttatcgatctagagttttagccatggctaacatgcttacaactaagccacatgttttcgatggattggattttccttattggtgtgaaaagacgatggaatcttacattatggctcaagattacgatatttggaaaaatcttgctaatgctgatgagattcctgatcaaattaatattgttgctttaaagattgagtttgaatataattgtaaagcatgtaatatttttctcagtggaatttctcgttttgactttggttgtgtttctcatcctcaaactactcgtgagatttggattgttttacctaactttcatcaaggtacttcaaatatcaaggaacttcataaagatcttttcaaaaatgattacataaaatttgcgatgaaacctggtgagactttggatgattatcttgctagatttaacaaagttttgagtaatcttaaatctattgatacatcttatgatactaattactcacaatatgaggtttctcgttactttttaaatggccttgatatttctatttggtagatgaaagttatatctattcaggagtctattgatatgtctactttgattttagattcactttacactaaacttaaaacccatgagaggaatattcttttttgtaaagttgactttaaatctagtgttttggtttctccttcgacttccttggatattggtgcttcttcgtcaaattctaccgctcttgcttctataaatgtcatatccgatgatcaacacgagcaactcgaggaggacttggctttggctattgttggtatttattacgagcacaaaataatctacaggcgcacatataccgttgtagctttcacccaacagtattccagggtattgtatccacaggaaacgtgtgtgaacaatctaataacagaattcatccaatgacaacaattaaatagtaggccaaagatagagatgattcctatgggttaattatctaaattaagtttaggtaaaactctatcaatcgctttcggcacaggtttacccctagtctaccaaggagactctggcctacaactctatgttgtacttgaacatggaggattacaaaggatggacagggttatcaccacctgctgtctacctctacaacccgtgtagcacacagcaaataaaggtaacctctagcttagacatcatgtccacgctattaattactaccctaatctcggatccacatagaagattaaggtactctacctaagagtgatgaacccgtaatgatgagaatatatcttgcataaataataaaagtaaataccaaggagatcacaaatacttatcatctccagccctcctccggaacacccctggatgaatgtcgacatctccggtgctcctccgaaccaccccctcccccgagagaacttcgacatttgacacactcctttcagagcttccccacactcccttccaatattctaattctactagagagtagcctaaatgtataagtgagttgtactccacttgttgtgttgtgccttgagagtgaaatggagaactcattttataagacaactatgacggttactagggcgataaccatccacaaccatcattgggagagcatcgtagtcccccacgtggcagcagatggcgaggggagccgatgtcagttcagctgaactaggagttcgatcgacccttggatctaacatcttcagtcgcgtagacctgaatgcactcctagggtcggtgggaacctccctaccaaagttgggcctaagaggccacaatggtggttcgatcgaactcctagataggttgttttcagccgcactggtctaaatggcctcctggggtcggtgggaacctccctgccaaggttgagcccgaaaggccacaacagtggtttggctgaaccatttttggcccttctcggccaccccttttgtcaggtcactgtccagtgggcccccatgacagtgcacgagggttttgctacggtttgtgggccctccaaatccatgtactcgcgtctgattagccggaggtttgttttattgcatggcggatggttttcgtccataattcacctacatacaaatattcagcaagacttgtgaaaatggtcagtaataaccactatctctaagtttgatattccattttatattctttcatttgtttttatgcgtgcattgattattggatttgctacttaaggaccgtcaacaacacctcacacttatcctttactcatctttgagtaaagctcatggatataaaaaatagagcaaggacttcctgatctcctatttcctgtactctctcctctttttctacagtttgtatgtttgctgctgtgggagggagattcacttcacacgcagtaggatggatgcgtgcgtgcatgtgcaatgcatgtgaaagagcatgtagcctagtgattgcagtgacctgagtagcggtcgtgagttcaaatcttcataggctaagtttctaatttaaaaatgttgtatatatcggtcgtatttgaacataaagaccgataaaaaaaattactcttctctaaaaaaataaaaaaagtaatgcttaggcaagcggggtggggggtgagtgcctgtttggttgatgccctcgttagcatgccggagaaatttgcatgcgtgataggcatataagatgcggataaattgcctggccaggcagcctgacaccttgcttgtttggttgtgcacctctgcctgggaggaaaaaaaacatgattaggatctagattggatctgctaactcacatactagttgaatgacaaatcttggctttttaccgcccctccaaagaattcaacgtaatacccagtttttttttaacaacttgcatacatcaataagaaaaaaagaacagaaaaacacatgaaaaaattaatccccaaatccacgcatctatcataaccttcaacgattcctcccagctagttgccaattgattcaatgaaacaaaccgttgaagccttcagtgtcttgcatccggcgtgggcgtgtggctttagcgcatgcttctgtgaaatcattgtcatgattaatatttgtgatgaacaattggctattcaaatgatttaatcaaagaattggtttgagagtttgtgtgaatgttggtatgagtgcgtgtgactaatgtgggtcaggttgtgatatctgtgtccagaaacggttgttttgtctgattgtgtgcaggtgacttgaggtcagccctagtcaatggtgaggaccgggactatgctcagggaggagcagaggtctattgcggtcgggataccatgtgagaaggtgactagagtctggactcttggaggtcaactttggtcaacggtggggatcgggactagactcaaggaggagttgaggtccagacagtcaaggataccgggtgacgaagttggatacaagatggcatacggtggatagacatcgtgtggattggataatcccaggcgttaccataatgaatggccgcaaggcacatccccctttaaccagatggaataatagcaaaaagatatgctccgactagcccttaggaacatgtgccaagccctgagtgtcgactggagaggaacgcggattttacctttatcgcctaacagagttaaaacaaatcacccct

SEQ ID NO: 68373 - DNA, 10226 bp, Oryza sativa
gcggcgagcccgtcgacgccgacgacggaggtgaacccgttgcgggacgcgttgagcgacgccatccgcgcgctcgccccgagccgcagcgcgccgccgagccggttgcgcgacacgtcgacggcccggagcagcggcgcgcgccagagcgcgccgccgccgaagccgtcgtcgccctcgagggagttcccggagaggtcgacggtgagcagcccggacaggttccccagcgccgcccacccgacgacgccggcgaggttccgcgacgagtacgcgagcctccgcacgggccggcacgacggccgccgcggcagggggaagttggcgacgttcttgaacgcggcggtgacgatgccggcgtcagggagcggcacggtgcagttggaggtgctgtttcgcgcggccgcaggcgccgtcgccgcggacgccgaggtggcggcgacggcgacggcgaggaggaggatggcgtggagcatgggcggcatgggcgtaggcggaggagggggggggggggagggatgtgtgtgtggtggagcagtgggcggagacgagggagacgacggcttaatcaattttaatcatggggacctgaccgcaacatggattactgtagcacacgcggttagtacactactatacttgggctggctacttgcttgcttagctgtggaggttagcgattaatctggcttaatcatgacgggttactaggctaattactatatgacatgggcctcttcagattccagcccacaaagtttgctggtggaggctccttcgaagagcacggtttttgcgacgattttgggccgaattcagcccatctaggtcagctatttgctctaggtgggccgcgaattatctggaccgtcgactgaattaagatccgtgaggaggcatccagaccatgggcttcatttagcccggattagtcctcctacgatcgaaccgcaaaccattttacatggagaatatttcttccaatacccactaagaaaaaaattcattttattctcgcgaactatttcattagatggcttacccccccccccaccccaaaagtatttgtcggcttattttacaccccccccccaactatttaaaatggtttagtttgctccctaatgatatttctctctttttttctcttttttttctctatatataagcagggtttacttcttcggtttagccgatttgatcggaggtcaccgatacctcgaaatttcagtccgaaattttgaacaaaatttagttaaatttgagcaaatattaccaaattcacaaaaaattaaaaaaaattgaaaatttcggacgaaataatatcatatcggagcggtccaaaatttccaaacttgtatattagtcatattttgcaatgaaatttggtactattgatagatgcattataacttatctttgaatatttttacactttttagcaccatttatataggttcgaagcgatgagactgatttaaacattgaggttttcaagcaaagtcatggaaaaaactgaaaatattttgaaagttttggggagtaaaatgatttttttctagtaagtttgtaccggctcaatggtgtgccattcatactatctctttctataatgccactgaattttcaacaattttaatatgccattgagatggatagttttccataatacccaaaacatccttatagatctataagattgagaattaatttattctattagaagtttcaaaaacttatggttttcttaacctccttacacaacattgaagtttttatgtttcatgatgtcattcatgttttctacaagatatcttttgtggcatatgagaaaggaatcgcttacaacaaattaaagatatataatagcacaaaactattttgtgtagcatattaaagatgatttacattaaaaaggaacaacagcaaaagtattaacatataacaaacaaataatgttttataaaataaatagtaacgcaaaaattgtgaaacttatacaaacttctatgacgtgctaagaggctagacaaaagttttcaaaactttttgaatcatgtagtggggtcaatcaattgtcaactcttatatatactagtaatatgcatgtgccaacgctacgacttaatggcatattatagaaatgaatgataaacttgaagcatattatagaaagaaacaaagtcgatggtaaatcattaaactaatgaaactaaatggcatggagtagatctgttttataagacatttacaggaatcattctcaagaaaattcccacgttttgaaggaggtatgactcctgtggagtggtaggttaaatctataccatgtgttgcagttcacaaaaagacaaattttgtagtaacacaaaattgggagaaatttggtcttgttgtatggtgagctaggagcgagggcaggaagtttcaaattttgaatttaaataagagaattactaacattctactcaaatttgacatactcccccaaccatcctctcgcggtctcactcccaactataaatcatttagtaagggacattgctatctctttttctcaaatcttaatctatactaaacaatctaacaagaaaactattttgagacggagggaaaaatactttttctgcagaaaataaagagatgattcgccattgtatatatagagttgctcataagacacaaccagattctttttctccgtagattgaattcttatagtctcacatgttctttttaagtgaataaggggccatataatttatgttattaagtatttttcagatttttttttttaactatgtgggccacacacataaaacatattaggtccttaacctttccctgagtttagttacacatttttttcacttgctagctctgacagtactagctaggggtcagcaggctcaatccacgagcttggaatttttctacccatgtcgacaaaagactacaagaagacacacaaaatccatccccaagagagaactgagaaggcatccaaactagtactacacacaaaagtaaaagattagcaacaagctgcaaattaagctaccccatcactactacctaatcctgacatcctgtggatgattcccctgatcaaagttgaccttgtcccctccctaggcccatccgtatggttttaaaaatattccagattaatcatcttgttgctcacaggctagccagaatcatgcatcacattggatggccaattaattaattattttctctccttcctttctaatgcgtctatagggagattactaaagaagaaattaaaactttgtagtgtcccgggtagaaatgtttcgctctcgtcacatgacacgacatgccgtcccaaattctcattcagctatggtcatcagagattccggaaaagtaattatttggacgctgggaaagggatggcatggggaaaaaatgaaactttttggtgtgcgttttctataggtctagctagggttcttgtctggtcttataagctactactagctaggtcatggattttctagagcagctcatttctgtcgccaaactatacgttccatatgggtttgtttgtcacaactccacctctcctggagctaaagctttgccaaacagtttcagtttcagctccacctaaaataggagtggaggtaggtggagccgggtttaagctgctctataactctactccaaaccaaactcctggagctaaatttaggagttagagctttaccaaaggtgatggtaaattggttatactgtttcgtatcgccctgtctgcaaataaaacactacctcaataaaaccctctctgtttatttcattgggcttgttttaccatcttgcattagaggtaccgagttaaaaaaaatatcattaagtttttttttttcatatgagtgtccaaatctaacagcatagtagtcacaaatggagagtctggcacgcgaattattattagttaaacttccgtataagtagaaatggaatggtggttttttatatatgttgattagtcccagtggatattgctggtcaacaacttgattgacacggacaaacgtaaatacctgctacacttaaatcgatttgatttggaatgagtcggagctcagtgagatccttatcaaaggaatcattccaagttgtatatcgcgactaaacggtatatgaagtgttttaaagtaattggacaatttcacctaacatctgctgatgaatcgtcctcacggtgattcattttagcgattcgaggaccaaagacatgctcatggtttcattattccgatctgaattgaaggttgttcagagatcgagatccatgattaatttataaattcatgtgcatataaatatatatagtatcaactgttgggatggagttgttgagcttgaactaaaatctagagagaaggctgatctaactccatagacaattaattctacggaaattaaaataaaacctaaacatatatgtatatgtatatgtatatataaggaaatgttaattaattgcattcatgcaatgatatgtaatgtaaatatatatagtctgtgctatgtgtacatattatattttgaaggtatatatagaaacctggtactacagtgctggagcacttgcggggcatgcagggcattgtatgccaacaactccagaatatgccgcatgcatgtatgtacttaattaattaagaaaaataatttaatcgaaataatggttagctatattagcaaacagttgctagcttggcctcttaatttcatcgtttgttcgttgtattatcagtcacaaccaaaatttatttttttttattttaagttttttattatagtttattttccagtacagcagtactgccatttaatccactaagaacataaatgtaaaaaaaatattgtcttttcattgcttattttaattttttagtgacttggccgtagatatatcaaacatcagattgatctctacatgtgtatagtgtaaattcatcataagttgtcgttcaggggaaatgtttttctttccatcttctactggttaatttggcatttagctagtggattttcctacgcaattttgcacgatgcaagattttaagtagaattggatttccatataattcttagtttctatttccatatataagtacaattgcaataatttgtatacattttttttaaaaaaaagacttctatcacatagatacaattgtcgtcatttgtatactaatacatttgaaaaaagtttcatacgtactatagatacggttgcattttgtatacatctatatatatatcaatcaatctagctacatcatatataatctagatccaccacaaccacctggtgcaatttttttctccggttaaaacggtaatttataaacctccgtagtgaacgtggttgttcttttttttttttaccttgctctgaatataatatacagtagatacaataagcaaggctgttctttttttttctttagcatttctcgtttagtttattttttaactaaaaacatcactgctagctatctagacttcttttctcacccctttaatcaatttaagtccatgcgcaacgtaaatatgcctttattaatttgcttgttgcttgcccaagtactgaccaacagtttctccgcgtagagctagaaaagacagcagaaacgactaactaatcatcagaaggtgatgagctgagataacactttacactacacatgcggccatgcatatgtgtgtaatgatgcaacaattaaatcgatcgagctcgtttgttgtgttgtcacacaaatcagcagcaaattaaacttttttttttcaaatttccacctatgtaggagaaagcagatagggcatatgcaaatcgatcccatgaattccgtgacgacgcaaccacattctgccggcccattcgtgtgatcgttcgtccccttttaatttcgatcggaaagcacacactacgcatatgaggaggaagcaagaggcccccttttttgcatgcgtccccctgaaccataaacaaccaaccaatttgaccaaaaggggtctggctgctgtttaggtttaattttgatgtttactagttgattacccatggttggaatgtatgatggataagttggatctacagaataacagatggttggttgttgagtgtgatttatatatatacatgcagaattatatccaggcctacatatatatcttttgcccggtcccaaccgtggttcttttataaatttcgggtactctgagcatgatttacagtggagtgattttaaagtcaggaggtaccgagaggtactatattttatcgtgtaaaatttggtatctctcagtacctgttatactagaagctaggtaatttgtactagaaattggtacctcttggtacactgtaaaatttaatttctctttacagtaagaaacgaggaggacctatagtttgcccgaccgcatcgggatgcactcatgtgtaatccttatccatggtttccctgtgtgctatgcttgtttcgtatttaaatctatggtattaattgttgactttatttgttcaagcttttaaagctctgcccttcaaattaatagctctcaatatttagtttgaagacaaagaaaccatatgtacatattttccttttaaaaaaatataagcacttttacaatattacaattttgtttgatgttattgttatattctaaaagaaaaacagaggtcaaagttacacaccaaaacctaataaagtatatggaggtaataaatgttttttttaatattgcgcacacatctaaatattgtttaaaggagacatttatgcaaactatatattgtggtgtaaccagacatccacctgagctaggacagtgactagaagagaacatctgcagtctgagagtatatacgtacgtaggatatatatatgttcatatccggaatgaaataaatacacatggacctgtcaaacatttgttcctttttagctagctaatagctgtttaaacaagcctgtcaaagggagcatgcagatgcacaggcacaggcaggcagaggtcaaccaccaaacgctttgtttttgtgtcacggagtgcagctcagatccacacgacaagggggtcagtgtcccaagcgagaaaactattagggcaaagaaatgcttttggaatccagccagattggcagattgggtcacatgaactaaccagaggctagctcagctgctcagctcagctcacactcactcgtgcatggatgcatgcaaaacctaataggaaagcaaaaaaaaccaagaaaaggatctcactgctgctatgtaaagtatgcttccaccatttagtccatggtcaccttcaccaaaagctcttgtctttagctactaagttaattaatttgtagcctttttggctgttgtaatctgctttaacctgatgtgtagtttccctctctctagctagcttagcttctctctctgtttgtgtgtgtgtatatatatgtgtgtgtgtcctttgcataggtgtgcataccaaacacaaggacagggtcaggattatattgaggatagagatataatttctagcttggaacagtgtttcaaaaccagtcaatgtaggaggagaatgcttgtccaattccctcttattttattaacacatcattagccagtagctagcttgcttatgcttcttccccatctctccaccagtactactacatatcattgcttccctcatttcatccccttcttccttcccctttcctagctattccacctgcacgcgcgtacgattccgatccagccatggcagtgtagatcgaaagagatcaagtagaagatttggtaagatgcttgagaggtagatagctacctagagaaggctgatcagcatcagcctgagagagatgaaggagaaggaagtgctagttgagattgttgaggatgatgagctgaagagatcgattggtagaaatcagctggacctcaacgaggaagttatggatgtcgagagcgaggagggagaagtcggcgatgatgaagatgacgaagatgaggaggatgacgacgacgacgatgatggtggtagcaccaccgatgttgccggaagcaggagctccagcaacaacagcagcaccaataacgtttcagagagcaaattgaagggcgacaaggatagcggtggcggcaggttggaggggatcaacggcggagagcagagggtgccatcggtgcggcagtacaaccggtcgaagctgcctcggctccggtggacaccggacctccacatggcctttgtccatgccgttgagaggctcggtggccaagagagtaagtagcctaaaaacttcatcttctttttcttttgaaacgagcaacaccagatagtgcgatgtttcatattaacatagcagaaactgctagaacttttatcacatggtatatatgtatgtgtgtagctgcctgcatctcttgcaattatggattatttgcttttcttctgagtcctaaactccaatttcttgttgtgcttttattgttttctcaccgatgatttgcatgtgttgatgtaggagcaactcctaagttggtgcttcagatgatgaatgttagggggctcagcattgctcatgtaaaaagccacttgcaggtaaatgatgctctaaagtgctctagaatttctacaagttaaagagctagattcttaattcgtagtcgatatctacctcgtatattcgcaattccattaattctcatggattaattagcatgcatggattccaagtttccaactaatttttgatccattaattttgtttcagatgtatagaagcaagaagttggatcacgagggtcgccagatcagaggagccatcgcctcaggtttaataactttcaatcatcatgcatgcacacaccaattctctccacatctctgcacatcaatttatttcattactctcatctttttctcaagaggttgtacattttttttcatgattaattttttgcttctcatgtggttttgcagtgttctctccaatggatttccatctgatgagaggcgatcgacgcttccacgacatgctcctccagcgagccgccgcgctctcctcctccaggcaggagcacggcggtttcttctcctcgagaagcggcggcggcggcggcggcctaccgccggaggccagccggctgtacggactcctccaacaccggcagtctccggcgatagcgacgatgcaaacattagacttcaagaacagcagtttcaggtaatcaaagtgccttagctaagttcgtatcttctctgccgagacgtacgaaaccctaatttctgcgagtgtgtgtggtctctgaatctgaaggaaccaagagtggtcgttcagcttcaaccaccagcggaaggagacgatgaatccgtcgtcgtcgtcgtcgaccaccgcggcgatcaggcggtggccttcagccgccggcgcggtcgccgtcgtcgccggcgagcgacaaagactagcggagagattcggctactacaccgggaacggtggcgcgtcgtcgacgtctctgccgctcatcacgagggccgccatggcggcgccgccgccgatgtttgcggcggccgtggcgccgccgggacgtgatcaccatcgtcttccgtttggatggcacgccggcggcggcggcggcggcggcggtaataagaacaggtcgtcgtcggatcccgtggtgatcgatgaagccctagattcccgccgcctcgaggttcgtgcatgccccccattcgtatttatccatgcatatcatcttatcattctccacgtcgacgaacgctgtactccgtttattccaaaatatagcagtctaaaaataaattagacatttcataaatttcatatactcaatactcaatgttcaatttattattattttggaacagagaatgacaagcatcgagtcatttctgaatctctatctgacacgcgcgcccatttgacaacgtaaactaactaactttttttttatcacgacattgcatgtgtggttcagcatcagcagaagcatgtagaacaaccaaggatgactccgacgacgacgaccacaccggccggcaagcggccaccggagtggtcaccaccggacctgcagctcaccttgtctccgacgaccgcccccgcggccgcagacggcggcggggccaagaggagcaagacgtcaacgacg

SEQ ID NO: 68374 - DNA, 687 bp, Oryza sativa
ccgttctaccaagattataaacacatatttctacatcggttttatacgctgatgaagcggctaataactcagataacgcagcttttttggtataactattgtaagaaggaatcgcaaccgtggctaaaattgcgataatggcaatcacaatcattaattcaattaaagtaaacgctttttgtagtggcttaatcaaaaataaagatgacattgttctctcctatataatattcaatatcaataaaaaaatagcagagatagtgtgcaatttgtcagcaatttatgcgacttaaaaaggttatttattcgatctatatcgcaaaaataagcgggtaaaagcctgtgtatttagtcagtattttttgttatactttgaaggtctgatcggatttagaaggttaaaatggcaaaggcagcaaaaacggcttatgtatgtaatgattgtggggcggaatattctcgctggatggggcaatgtagagaatgcaaggcgtggaatacaattagtgaaatacgcctaatttcaagcaaagaaatgaataaaaatgaccgctttagtggctatgcaggcgaaacatctggaaaaatccaacgccttgctgatattagtctgcaagaagtgcctcgttttagtagtggttttaatgaattagatcgcgtcctcggcggtggtattggccaggctca

SEQ ID NO: 68375 - DNA, 19772 bp, Oryza sativa
cacacccacaccccaagtgccttccaaaaactgcacactgcaccatgcaaaatgacagcaataagattgttaattaattttaacctcttgtccatctctctacccagtagttttatctcagtacatagatatatatgtcatggtcatgcttgcttaatgcttggttattgtcttctagggagttagtctgcatgcatgcctctctctagatatgtatgcatgcatgatcaaatcacttagcttgttcttttgtgacagcatctttgggaaactaaaccatcacaagagatcataagtatcagtgtgcagaagttccagttaatctaatgtgccattaatttaatatgtattaaattgtttactttttcgatctgtttatctataagttgtgcgatttttcttagttgctagtcacctagactggcgcaatgtgtgtagcctaagcttacacaattagtagctcaaactttagtataaattcactacaccatttcttttacttttattttcctggataaattacatgcacttttgtgcctaatttagtactacttgtttttatcgttttgcagtcgtaagtatgcccaccaggcaccagtgtataattttcaggtttgacactttagaaattattccctccgtgttgaaacattttttagcgtttgtagacatacaatgttatgacatatatattcttttttataagtgtctgtagacatttctcacgataaaaagataagtggtagatgaatagctaatgatcaatcactcaattcaggaaaaatgatgtataaaggccatcaaaccttcaaaaattattccagttaacacttctgagaaagcctctacaaaatatttaaaccattgtcacttctgagaaaccattgtgcctccttcctctctagctgatacttttctgttttgagcagcttttgcttttccttcgaatttgggtagacatgtgggtgtgttagcgcttcttgctagagcaatggctttgtactatttaatgggctgattttaggtccaatattaatatattgaacatttatttcatattttaacatatatttcatattaatcaacaccatatcaaaaattcgtatgcaaaaattttacatgtcgaaatgtttgtatgtaaagtttatttatataaagtttttatacataaagtttatacgtgtaaagtttctgtaaaaaaaaattatgtgtataaagtttttaagtagattttttttaattatgtactagaaagtttctaagtggaattttttattcatctaggaatattaccgagtagattttataatttggtaaacagtgaacttttttatctattccgagaagaaattctgatgtaattacacaagatgctaatctataagtgctattcagatataactatgcggtaatggagcatcacatgcaagcgtaccaaaaataaaaagatccatagggggagcgcccgttggttggcctgctcaaagatgtgggtgtgctggacggttcaggacatggatgtcgatgatcttgcgggctgcgagaatgtgatcgatcgtgtactaggaggcctacaaatgtgttaaacatgagaaataagtctattttgcctctgttgctcctgatttaatcgcctcccttgatgaggacatcctagctacacacgtacatcaacatgacgtaaacaagggtgataatttacgtcgtacatcacatgatgaaaataaagatagcgtaaaccaagttgaaagattatttctcagcaagaatgatcatgcattccattgtccaattacgcgcattcgtactaggaaaatacaacaagagatgaactcactctttgctcaacttaacccaaatattagtgagaattttatactatctaaatgctctactttgtattgctaaggtttacaaccgaagacatgatcactacaccaagaaagatgagttacatcgaggacgacaagggttacgccgagtaggaatcaactcatatactaccagcagctatttacgccaacgagaagataatttacgctgcaacaagtcaacttccaaggcttgtgtagcctagccaatcaaagagatggggtgcatggcatacatggttggaaagaggaccaagtctagtttccaatgcaataaaccccaccttgatagcattttccaatgaggagttggactattttactgaaggctacgtgagagctgaagggttgtgcacgaacccgagaaaactctgagcattctcatttatgttagccttgaccaccagaacatgacttcttatgttcacgctaagctaggagggttgttcctagtgcaaatacccctccattatatccacaagagaacttttattcaattgaaaatctcatgtatgagagattgctaaagacttcataagtgccttacctcctttgtaattgtgagtttcttagaacttgtgagaaggctcctttggtgccccctaattcgtgcttttggctttcggatctcttgtgtagattaatcctagattatggttttgtgattgctcggtttgacgggtcatagtccaggaggctttagatcattctcaccatcaccacttggttgcatccaactttggcacgtgtaaaactagttatcattttgctgctcgcaacaagttatcctcgaggtcacggtttatgccggtgccacttgcttcaatcctactgtcgtgaagatcaagccacccctcacgagtgagttaatttgcatccactacaggagttctgggcttctgtgacgattacattatgatgataacagcctgtttcctgtcactgcctgcctgcagtgacgaaatggctgtcatcacaaaaggtgagtcactaaccagcttctgtgaccaccagaggacatcgtcattgatacaatgacgaaagttctcctgccattgatgaatgacgagacaaattcgtcataacaaattgaacccacgcgtatgatgacatgtgatgttgcagatgacaaggcaggtgatgtggcaaatgacgtgccaattcacattcggcccatatagcatgggcttttttattttcaattacaatcagcccaattggcccatatattttttgacccaactacaaatttgcttttacatttttttcattatagcccaatagtacaattctagcccatactatgggctagcccaattaaaaagcaatcacaaaatataaaccataaccatttgcataattatattataatcacattccagccataattaattttccagcccatacaaaagcaagttccagaatatagtttccaacatgttccatacaaaagcacagaacatgaatacaaaatgatccatccaccattgaactacacaagtcccagccgactaccaaagttactacaggtagtgccaagttccggcaccaaaaaattccacctagcagccactactaagtctcagcctgcatcttgccaatagccagcaaaaaaattccaccaagcccccactacacttttggactgcatcctgcagcagccaacaactagtgccaaaaaatcctatgttccagcaaccaacgaaaaaaaaaactccggccaccaaaagcgccaacttgcaagcaaccagcagctagcaccaagttctagcagcaacatacaccatacaatagcagccacatacaccaccaagttcaactacactaacaccagccatcaaattccaagctcatccacctcattcctgccatcaaaaggtgcatgttttcagttgctggtgaataaaaagtccattttgtttggacttggaggcaaacaaatgaataaacagtgtttaaagagtaataatccagcaagtaaattgagtaataagtatcttgatatgcctcttttccggcaagtccaaacaaatggatcttttctactcacaactaaatccaaacaaatggctcttttgcagctaataatccagaaaaaatagagtatctagatcaattaatcaaatgactcttttccagtcacactaaacaatatctaatttcacagtaacaacaactataaacaatccagcaagtaaattgaaataggcagagtaataggcaattttgatacacaccatgaacaaaaaattcagccaccaatgaaacagtacctgaggatacaagtgcacaagagacaagttaaagctttgtacctgagcatacaactagcttagggaggactgatctgaccctgtccaaatgctatcatttgtcgaaggaggctctgagtatctgctgccatcttcctcaggctctcaatctcctcagcttgtttttccactttcgcatcagattcttgtgcctgcgccttcaatctttcaagctcctcctgaaagtactgcagactctagcttctttgcatctagttcagcttgtatctctttcatcacattggttgtcttggcagcgggctgctgaattccgacgttgcgcaaaaatgtgtttgacttcggcaacactttggaaacagcttcaatagaagtcttagcttgctgcccatcttctactgatggtgaagtgagggcttcccaggtatgcatatcctcctagcaatcaaagtagtttcagttttgcattattatataaataaaggttcattgcataaggtatttaataaaagaaggaaagaagaggtaatagcttagtacttactatagctttcttcacaggttcactaaaacctttagttttgctacaatgcaactccttaaagagatcaattgcagtgggctcactgtctttgtatttttcttgcttctgcaatgttgagagatggcatgagtaatggttatgttaaagtacatagataacacaaaaacatgtcctccagaacaagcattccagttgacattgagtctttttgttaaacattgacagtggttgccatgtataaacttaattgatgtcaccccaaataagtataagcatgacaagagcaatcaaaccaaattgatacagatttatggataaaacatgagcatatttttacgtggtcaaagtgtgagataatatgctactctccctactaaagctttaaatcatatagcattatgcagagccactatcaatatgcagatatatatctccactggatctgaacacctccatcaggaaacacaaaaactacatccaactagatgacatcatcattttttttcttaccacgacataggcatgtgcaatgtaagaccgagatccggtacgctgttgaaactgaactttttcacgattcagttggttttggcacatttgtcctgcacatgacacaattacatagcattagtaatagaaccactatgcatctgtcatttccatgcaacatcattttcatttgttttcgcaagtcactattacattaaaaatgcaaatagagctgatccaaacagagctataaactggactatggaataattattttgccacctgactatcaaatttatgttgatgtatcttaggaagctatgtggtttaaaaaactcaggaagattacatgaattatcttatagtcaatctgaaaactactataataaatctagaattatcagatgtagctggcatgttccaattcctactgacagattcaaaagatctcaaatgtacctcatatccaatatgtgtatatccagccaaacatgactttgtgctcgaatccaagtaataagctcacacaaaatgaaatctgctaaacagtaccttgtgctctgggcttgaccacatatctaccaattttgtccattgctcatcggtcatacacttcaagggcgatgtagtcctcacttgattagcaggtaccccatcaaagtacttctttttgagcctatacctcatatggcgtgttccacaccttaggatgtcttccattgcagctattacaggatcgctgtggatatcaatggagaattttccctactcatcaaatagcataacattaagcttcaacaaaagtagaaagtagaaaggaactacaataattatatgtaatgttcgatatggctaatgtattatttcttaaaggtgcacctagttgcaccttgggcatctagttttatttaaatgtgcatctatttttacttatataatgctggcagcacatacagtagcattgattcaattagtggaacagagccttaccttcagtttgccctttaagttatcaagttgactactatcattcttgtagtctgtccaacttggatatattggtatatgctgcctgattatgatcccactctctgaggccagctttgcagtttgcataggagcctctggcctttttttcccttccttgacaatgattggtatcatggtccctaaacctttgcttatggaatcaatctctttgcccatgctcttcccccttgtctccacttgtatactgctagtgagggtgcctaacataaaacatttacaagtgtcaataaaaagatcctgcacttgatatgaatgaagcatagcacatataaggacaaaagaacaagaatccaagttacttgccttgttgagtagtgctcaatcccattggctctagttctgtacttaaagtgaggttgcctaacaaaatacattattaaacatatgttaataagaagatcccttcacttaatatgagtgcagcataccacacatattgacaataaaataacagtagggtagccacttgccttgtccagtattgttggtgtcaccctgattctggtttgcagacaaatcaggttcgagtccaacctctgtggcttcaatcaggctagtggtggacacttgtttcatagccctttgcctagtgcatctcattgtttcttctagattttcaagtgctagcactctcttagatgctcttcctgttccagttgtgacacaatcaccagtgatggccacatcttcccctagtaacaaagcctcacaaagcaaacaaagacatgtacaaataagttgcagaaacaaagtcatgaaaaacttccttaaatatccactgcgaataaatatgtcacagaatatcaatataaatgtaaaattcagaatgcaaactcaacatatctaagacctaatcttacgtctttgacaatagtttccaaaaaaattgcctaactatgccggagtccatataaggcaggggctaactaacaatatatttgtaccaactgtacacgtaagggatagagtactctcccgacagattaatcatatttttcatactctatgaccaaccattaagtttggattcagtgctatgaaccagctattggcacttaagcaatactgcaattgttcaacatgtttaaccaagtagatcaaagaattcatatgcaaaatataagtggcatctaaactacatcatacatgtattgaatctcactaaacacgcatagctcagtcaattagagatattgattagtagaagagtttagtactagagttggtacctttgactttttgccaacagctttcttctttgcaactgaactctggaatatttgtgctagtttacggatacccagctgattagcaaatcgattgttcctcatgatattccaagccctcgacgtgcttaagtccatgtcttcctcttctgcacatacattgcaattatatttagtgggtatgaaattagttagaaacctatagtccccctacaccaccagattgacaatttggaaaattttaaatcgagaaaccgaaaatcaccccacgcacagactcatctcccagcgcccacctcccaatccagggccgcccaatccaagcctcgaaaccctaaggaggatgagctgagaagtacctagcatctccatggcggccgcttcatctggaaggaccgaaggatggcgggaatgtgtgctgttgccaccaagcaccattgtcttgctcctaggagggaggcaaggggttgccgcaggatctggaaggacagaaggagggtggggaggcttgttcttgccgccgagcatcttcctcccaggcgccatcgtcttgctcctgggagggaagcaaaggggtggccggtttggaagccgagcaagatctgcaagaaggttgttcttgcccggcggctgtgcagatggagggagtgggaatgattctagggttagcttcagcttcacctatatatgtgtcacactcgagtgagtaaaagtcctaaattgacctcatttgggtatgccagttcaatagctggtatgggcataaatgacttttagcatcaaaaaaagtggcggggcaggcattttgatttcgcggtaacggaggcgcacacgggatgtgaaaatttggcctctttgattgcagcacataattttgttggataagattatagctaatcttataaaagtttataagatcttgtgttaacaaatctccaatataaaatcaactataattcttgagcttttttttacatatgttacatcctcaaaataaaaaaagttagggtttgagttttctttttttacattcgagtgccatttcttaaaacaggtgtaactttctcactgcagcattcattggcgtcggcggtagcagcgctaagaaattgtatttgcctactactccgaccttctatgttcatcggcgtcggtggcggcggcgctacgatcctgcaccaatcatgtggggatgttgtgcctcgagctagcacaagaaagacggctctggccctggtagccagacggggcacgatgcacgacggtcgatggggaaggtgatgtgtctggcggtggcagccctgcgcttcgaaggggatttggttggtggtgggcatcagacgtatcagcgacgtatcgggtttgttttgattatatggaaatcacgaaattaatacgtatgtatcgggtttgttttattcctccttctcgattcctctttctgtttcctcacgcacgtgcccaagcggacggagagccggtgggtcgaggcgacagtcggcgcggcgactgcggaaggtgacgggggcagaggaggtggggccagcggttggcgcggccacgacgggcggtgcggcaatggagaagggcagcgaggcagtggggcacgcgagaaagccccatccatagtgatcggccacctccgcgcatcccccacccgtccttgcatacgccgtctcctcgcatcccccactcgtcctctcatcttccgcctcctttcgcatccacatctggggtggcatggctccctcaaagaaatcgattcaagcgcgccgacagttgcgcgacgctactggcaagttcagcggtcgcgtctctctgggaggggtgcgtggtgcctcgacatcggcgaaggaaggggcgcgccaggagctcaaaaaatttaagtaattattaattcttttcctatcatttgatttattgttaaatatatttttatgtaggcatataattttacatatttcataaaagtttttgaataagacgaacggtcaaacatgtgctaaaaagtcaacggtgtcaaacatttcgaaacggagggagtatatgctaatttggaccttaatggtcagttatggtacctggtgttctggatgctgatgcattatatatctataatatatgtatgacttgtcagcaaatgtgtgatctcatgtacatttgttgaaaatcatattgctgctctcttttaatctgaatttcctctccacttaaaaattgctgtcagcagatatattcaaaggagtcccctcatacatatacttcagaaaagaacaaatgcacaaaaacacaaacatcaaatattcaaacaacatcatacacaacaatcaaatcctcagatcacaatttaaactgacagccatgttctaacagcaggttatggtgggacttagccatacacagatattttactcaaaatcactatattcaccatcatcatggattggcccttcattttcactgtcatattgtctcacagtttcgtcagcatcatcttcaaagccattttcttcaacttccaattccctttccctctggatctgatcaactagggaagcctgaacacaaataccatcttcataattgctaggctgctcgttgattgaagctctctcaagatctgcaacctgaaaactagtattttcttgctcatcatcttggtatgacaattcatgctctgcctgggccggcaggtcatcattttcttcttcgggcacattccacaagtgcctatgggaaaatttttgaacaactttccaaggctcaccatgcttgttatcttctaagtagaaaacctttgttgcttgtgtggcaaagatgaaaggatcatccttgtaccagcaactgccatggctgacacttttgaaatggccatcatctttaatcctagacttcttgctacaagtgtcaaaccaattacactgaaataaaactactgtcctttgactgttcgaatcagagttgtactgcaactgaattatttctttcaactgaccatacaagtctatatctcctccattatgtgagccctcaaccatgacaccactgttttgtgtttttctacttctctcacggtccaaggtgtgatagcgaacaccattaacaagacatcctgaaaataaatgaactctaagatgtggttcacttgccaatgcatataggtcttcattgacttcttctccatgcacaaattttctggttgcaagctgtaccaatatattcagagaaaaaaattcagagaataaggtcagaaccaaaactgattgcaaacagtcctgtatcctgcaaaatgaccaataaattcaactaggagctaaatgacttacgtgtttattaaaccatcctgcaaattccttagcaagagccctatcaacatcaacattgccagcactctccaactctgtcctgcatatcctgcaagtattgcgcactgtcatgtgaggtgtaaaaaattacagcatagggaaaaaattgattgctccaataaaagacatactctataaatggctcgacctccggagtattgttgaggatataccaaagcatcttgtcataatccttctcattgtacgtcatcctcgatgcaccaagaagagtgactccatgctggaaaatagataagccaccttctctcaaaactacacgctctctattcctgccctcacaattgtgtcgtgtgtcaacatcatcaaaatacctagagcaagcattcaagcactcgtttgcgacatatgcctctgcaatggacccctcgggtcttgccatgttcctcacaaaacgcttcaaagtaagcaacctacgctcaactgggtacatccatccatactgaaccggacccctaaggattgcgtcatcgattaaatgaatggaaaagtgtaccatgacatcaaaaaaaaggtggaaaaattttctcaagcttgcacaatattattgggatttcacttctcattttgttcaagacatctaccttcaatgtcttagcacatatttgctgaaaaaagttacctaattcagcaattgcttcataaatttccttatccaggattcctcggaggcttacaggcaatatcctctgcagaaggatatgataatcatgcgttttcaatgcctgtactttgcattcatcagcagaaatacaccttgataggctggaggcatatccatctgggaatttcacattctttataaaagcacaaaaagcaagcttctgggttttagtcatcgtatatgaagcgtgtgggagagtgtacgaattcccatcaggcttcaagtgtaaatttttcctcacacccatatcttccaaatcaagccttgcattaattgagtcctttgacttccctgtaatgtcgagaaatgtcccgagaagggcctcacatatatttttctcgatatgcattacatcaagattgtgacgtaacttcaaatttgaccaatatggcaaatcccacaaactcgcccttcgcttccagcattgaccttcttcttgtctctttctctttttgttatcaggatggttcccaggtttaacatgtgaaaccctcgccaattgctcattcagctcatccatagtaaattcctcaggctgctcacgttcttcggtctgtccatcgaaaaaaaattttgtcctccaaacatggtcccgtgggagaaaacgtcgatggccaatataacaaatcttgttccttaatcttctagagcaaggatttttgtcacaacgaacacaggcatagtaacctgtagtaactctgcctgaaagtgtgctcagtgctggatagtcatgaatgcaccatataactgtagcatgaagatcaaatgatttcttagtcagagcatcataggtagggacacctttccaaagatctaacaactcatcaatcaggggttgcaagaagagatccatatcctttcctgggcttgtcggaccaggaatgagtaggcccatcatgaagttggattgctccatacattcccatggaggaaaattataaggaataaggaatactggccacatgctgaacgaggcgctcatcttcccaaatggattaaacccatcagtagcgaggtcaagttggacattccttgcatcttttgcaaaccagtcatatttcctatcaaaatccttccatgcctcgccatcagctggatggctaagttcattgtgcactggttttctcttcaacttgtgccattgtgcctgctctgaaagctttttggatgcaaacatcctttgcaaccttggaaccacaggaaaatgcctcaaaaccttgtttggaatttgctttcttgtatcttcatccttccatcttgaagcaccacatactgggcaattatccattttagccaactcctttctaaccaaaacacagttattcggacaaacatgtattgaatcatatccaagtcccaatgcacgaataactttcttcgcttcagcataagatgcaggaatagaacattttgggaattgtacacttaacaacttcaaaaaagcatcgaacgcaacattgcttattctataaaattacttgatgtgtagcaacttcaccacaaaagaaaatctggtatagggaccattagggtgtagttgctgtttcatctcttctaatatggttgcaaacttggactttgttgctggttcatggtcttcggctgtgtacaactcatgtaccatctcatggattcgatcatcatctgggtcatctttaggctcattcatctcagtttcaacattgcagccaatatcaccagcttcaacactgcagccaattatatcatccaatgcttctccatgatgtatccaattagtgtacgtgctagtcatcccataaatatataagtgagtctcaacttctcctttatgttgatgtaaccgattcaaacacttacgacatggacataatatctcctgactatcatccaaattagcagaaacaaagttcatgaactcagtgacccttctagatgttccttgctaaatagcctagtattcacccaacttctgtccatctgcgacacactgaaataaggcaataatcaaggaatcaagaactaaccaatcatcataacaaactgctattccttctagctttctatcactgaccatgactcactacagaacatagcattgaattttgattacctctgaagtcgaagaaatcaaatcgaagtcagccttcggagagaactggagcagtcaggctcgccggcaggccggctctgtgctcctacagctcgggaggttgtcgcggttgctggccatcgcgccgagcacgcgacgcgctggatctggcctagtgggcagcggccgaaagcgtggccacggggtagcgccgaccgacgagtagtgagcggagggctagcagctggcggagaccacgggctagaagctagcggagggcggcgctccggcgcctcgaccagggagctggcctcggcgcgctctgctttgctgctgccggctatggtgtggtgtgcggccacgggcaagggcgacgccaatttgcaatctcttttttttctcttcatccacacacaatctacaaatataaaataacaatcctaggtcacaaaaaacaattgtctcgactggttatcgaagtggatgtaaaactcctctagaattaagtcatgggttcgaacccaaagcttgcttcttttttatgttttcccccctttttatcctatataattctggtgcagcacttgttcatgggttcaaaacagtcaaaggtaaggcccatgtaatgcaggttcaaaccaacttatagccattttagttttttttttaagttttttcattcaatcataaaattaaacgccatatttctgattttttaagatgacttcaatctaaaatcctaaaatgagagactagaattgatatagagaagaagagtccacctaggacaaacgatttgtggtctagtagcaatgtagtataacaagattttttttgtttttaaaaaaatataatagttctatattttatgacgatatactattgtcatcgtgctatcgtcacagagcccatacagtatattgtgacgatgattatgacatagacacggtttggtcataaatagttgtcatcctgtgaacaatcgtcataaacagcctctgtttataacatatatgtgttctgtcatcaggtaatcgtcacagaagcccagatttgttgtagtgatcatccctcaaccataaacagggtataatgcattcccatcttcgaaagttgctgcaattagacttctttggtggctgagaaagttgttttttgttggcatgaccagttaaatatggctgactttgctgagtcagcaggtgggacccatatatcagtgacttcctcctcatctcatattctttctcacctcttccctctctctttctctttcctctcttccttctttcacctctctcactgtccatccgtcctgtagccactggccaagaccacgtcgcgtcactaccgccgtcccctctcctctcaccacccgccccccccatatccgcctcttctttacctgagccgctatttgctttgtgctttcccctcagccccactccaacccaccccacagctccatccacttatctcctcatcactatggatccgatattttgctatggcgccgttggcatctcgccccctcttgctagttgtggtggttgttggatgtggctgtcagaggtgtctcggtaatggtaacagaggatgagagaggatgttcatcgtgcaggtggatatggatgcattcccaacccacgcactcttgtacgaggcgatagtgacggtgacgtcgggtgtgggggggttgggggtggaggaggggagtggcgtgagggcggcccactgatccacatgtatctactccaccgtttctcacggctttttcgcacgaatgttgctggttgcatgccaccaccatcagctggcggaggctcccgtggtggcgacagtggtgctagagtgagttcggcatctcgccaccacccgctcattgtggctccttaggctgttgtcctccccgtcgtcagcactcctcgtagactccaactttggtgccaatcttgtcatcattatcatcgacactagcatctccctcacctaccgtagctcccacgaccacaggcttgatttagtcacgcttactcgtccccaaaccacattggagagcctttgctcgctaacaaaacacactggagagccgtcgcctcctccgacccgaaggaagctgccttcacccaagccatggacctccatcgcaagcgcctgcgtgtgcctcctttctattgccagtttgccggccccgcaatgaccattcccccctgcccaccatcaccgtggcactcgtttagctacggagggctccgccttgttgcatttgtgtgaggaagaagaggagcgaagaacagaagaggagagaagaattccttcctccaatccctaacttagcaagttaaccacggtcaacttaccacgtcaacaaaaactgcttcctgaaccaaagatggacgtcacactcggttttatgtttgagggaggcaattcaatcaaagatcaagagatgaggaaggcagaatagacttatagcaacagatgaaagcacacacattcaggcccatttaggcattgtcttcctcctcacaacgaactcacacgcggcggcggcccacggtctcaaatccctccccccgacgtgcgggccccacctgtcaccctctcccatccgtgcccaccgattcgcccgttccaatccgtttgccctggtcgctctctcgcatctcgcgcgcctcgtgagcgaaacgaaatccctaattaaaaccgcttaatccaatttaatcccctcgtctcccctctcctcctcctccctcctcactctctcccctcctctcccctcctcctccccccacctgcactaattaatcacgccacgagacgagatcccccttctccttcctcctcccaccgcccgcctcctcctcctcctcctcctcctccgccgccgccgccgcgcgcaggttgctatcggaggggagacgcgggaggcccccccctctcgtctccgcgccacccaggtcagccgccgcctcgccctctcgttctcttcatctctctcttcgcgtcctgtcgaatgctggtctctgcttgcgctcgcagcgtgggggccccgatccgggggggcaccgccgcggttggggcgtggggaaggaggaggaatggtggcgatggcgcgtccgcggggggcgttggtcaacgtgggggggcgagggttcgacgtcgcgtcgcgtcgacggagggtttgcttggattagggcagggcgagggcgcggatggggtggccatgctttgcgagggcgtcaacgctagttggtcaacccctcgatcgggttaggggttttaggttgcggcgggcggcagtcgagtggctgacttctaggttaatttttttttcctccgagaacacccagctttgctggatttaatattataaggaggagactggctctagtttattgatggatttcattggtcatggcccgtctgttacatcattgcttagcgtatgtcaccagcctaattggtctatttgagacgaaactagttagttttgagttttgacctgttcataaaggctatggtggcattttaacatttgctatatggcctcttccaccgaatgttggggtgataggtactatgattaatatgattaatggctggaacttggatttagagttttggcgccaaggggcttgataccaattttcaaacattggattagtgtacatgttcgtcaaacattgaagtgtgatcagatcttcaccttttatgtctctttcttatccttttgtttgaaatggaagttagtgtggagtttgacagtgactggagtctggtgtttgatagtgattgccttgaaaatcttagattgaagggagactggaaactttgaaattcaggctagtggatcccgctgtggttattgttgacatggaactgctgtagatatgtcatatcatgttcttgtttaagtgataatttgaatcgttgaaatggtgttaatagtgtgcttagtatacttatcggcttgtttccacagctcaccctatcatcatatcatgctgcatatactatattgctttttggtgaaagactgttctcaatgatgtttgtcactctgtgtaagtatgtttgaagtttgagctcagaacaacttttttattgttccactcctttgtaacaaactatttaaacttatacagtgtaagtatcgtgccgttgttactttttagtaccaaagtgtaggaatccaagtttttattacaaaaataagaaacaaatctgttgttcatattgtacaagtcaaatacaagaaccagtaatccatacagtggtggacccaagaaaattatgttgtgtgtgcatgcaagtctcacgcagaacacaacttaaataaagtgcatcactgtcatcaaactatgcatggcaagttatcattatgcaattagtacgcaaaaatgcaaataaggatttcaaatattgttcttaaacaaaagattcagcatttccatatattttatgaagaaaaacaggaagttgcaaccactgaatgcgagctgatcctaggaaaatttcatttgttttccctacccggcacccccttggtctgcccctgtccatagcaagaagccaaaaccaagaagatgttttacattaacttgttttggcacaaatttcaataagggtgtttctaccatgcgaaaaagcatggatagcaattgcttatgtgtgaacaaggatatatgatgtatctgtacaatatagctgttgatgtgatatttctaggaaaggtaatggaaatggttataacctataagcacctaagcgtgcgtgcgctattcaaccatgataatgtggagattatatctttcagctgggctagtggttggattcttctctggtcaagaaatatatgtatacagtattacagtctgtgttgttagtgtagctgcatggttgatgagtcgattttggttgtcataactgtgcacttagccacttactatgcccagcgaaatactcaacataataattgaatcacttttttgtgaatgagtgtagggctatattcttttactggactcatgatccttttttttattaatggcacttcaatgcagctggcgtttagaacgtaacatgtcattggcttttgactaaattctacttgctgttgaatatatactatctactgcagtttggcatcaatatgcagaagtcttctctattccattattgtgttctagttctagaataggtgctattgtataaattatatttacattagatcttttgagcttctgcattcctaaattataagtgatctcatgcttgattcaattggttgttttgctccattatgcaggttgaccttgtagaatgaatccataaaatgattctttatttcaacatatattggagatggatgatctgccggatgatcaaggacaatccgacgcacacccttcagatccaaattggtggtcctcacatgcggagcacaagctcggatcaatttctctgactaaacaggaaaggaattcgggttcgccaggatcttctcattgtggggaaggtgaccattcattatgggctgcccagacattatggtgtactgggtgtttatcaagtccaatacccaatggtttttattcaattattcctgtaagtgtgaatttcatacgaggcattgaattgttaaataaaaatataagtgactcatctgtacattttaattttaatcctcgttttaaaatttgtaggataagaaactgaaggagcgttttgacaccatcccgtctccagatgatctttattcccttggaatagagggattcaaagctgagataattcttgtggatttagagaaggataaaaaactatctgctataaagcagctatgtgcagcattggtaaaaggattgaaatcgaaccctgctgcaatgataaaaaagattgcagggttggtaagttcttcctaagattctctatgcaattgaagacaattgtgacatcttcactggtaaccttcagaataccacaagctgcaatcacttgacaattgctttgcaaatggtttacaaaatcttcttgcttgaaactattccattttattgtgctgcaaccttttgagtactacttgattcttttaagtatgtagtggattatatgttttcttgaaaatagaaattacaataactctattgatagcattgattatattcttttagttacttttattatacatttaaaaatttc

SEQ ID NO: 68376 - DNA, 2104 bp, Oryza sativa
taagtagcaacatttttagaatgaatatagtagtttcgcttgtggttgcactgatccgctgtaaattttcttgtggttgcatgatccgcagctcgattgtaatcccagggatgatcgatcattgccaaacattaagttttggaactttttaattgatttaaggtggctttcttttgtaggagagaggttttatttataaaagcatttcttttttatttttaaagttttgtacggtttatcggtaggcatatgtagctccgatcataaagccatacgtacgcacgtacatttctcaaccgtcgatagatgcaagtgttactagcttactaacactggtggagaaaccctttgtagtcccggtttgtaacccccctttagtcccggtttccaaaccgggagtaccaatccgggactaaagatcgctatctttagtcccgggtgaaataaccgggagtaaagatcgatctttagtcccggttggtaacaccacccgggactaaagatcgagctgaccttttttttttgcatgcccctgttgctgcatggtttatatatatatatatatatatataatccatgcatatatatgtttcaatacatatatatgcatacatatatatatgtatatatatatattatattatattatatgtatatacattcataatatatatgtatttatacatatatatatatgttatgcaaatgcatatgtatatagatatatatatgaacaaaatatatttacattatagaaaatgtgtacacatgcatatagaaacatatgtagtcatgtattaattataatccattatatgtcctagctagctacgatttcgacgtagtagtactcgctgctagctcagaagctaaggaccggtgaattgtgttttcgtcgtagtagaattcacccttgggatcaaggatttcttcgttgatgaatcccatgagttgttcttgaaccgccgcgataaattccttgtgtgtggtcaggttatccctcatgcgaataaactatatgagtgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaaggatttcttaattaacaaaggaacttatgaccgtacctgtctataagttcgaaaaccttgtcaaacgtagactctttttatccattgagtcatatacgttgacggtgcaggcctccatgtcgatgagtaaaagcacccagtggaatctgcaatgtacgtgggatgcattacatatgaaacacttagcaagttcgtacgggaatgaaatttggtatgtatgaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccatgatccccgctccgatcatctctctaccggtggcgttcatctccatgtacagctgatgga

SEQ ID NO: 68377 - DNA, 752 bp, Oryza sativa
ctgtggaaccttcacccaaactaccagctaatctaacagagctacagaaatccaaagtttttcatccatccatgcctcctgcaaatacagcctcagcagaaactttgtctccaaaacatgtaccaggacatcaccagattgaacaaaagaggatcagcttcctatcttccatttcatcactcattccttttcttctgtttcttagagcttccctcgccaggttcttctattccagtctgccagctcctatcctccagccatgctttgagttgtagatgtcatttgctacctgctttagcagatggagaccccattatagatttcttgtatttgccaccgacctctgcaaaattgcccacgaggagatccgagagctgatataatgaattagctcaattgggtgtgataatgattcattcttgaaacaggctttgttcctagtcttcaaaattgcccacaatacagctgcacttctgatcgctatccttctctgtaagtttctgtcatatttatttagccaagcacccagtaaatgatgtgttttacatccttcaggatgtagaggccaggttttatttaatccattatctaaaaaaaagtaaatgatgtgtgtcatggataacccccagatcagaagtgctagctgtatcatattccagggcaggtcaggagtaaattttttcttccccttccaccctcttttcagcaagttatatttggttaagggtaccgagctcgaattcgccctatag

SEQ ID NO: 68378 - DNA, 762 bp, Oryza sativa
atagtctactcacggtgatagtattacattactagtctacaccatagatgatatatttaaatggagatcaagatcactcacctcaccgaaatccgaattcccaaacaggggatgagtcatccattccaggggaagcaaacatcaattgctaatttgcaatcaatacagaaccggtaactaactaatgcacctttcagcttgtccaggacatctccaaggcttttgacttggtcagatgggactacctacttgcgctcctccaaaatagaggttgcccgtaaaaatgacgcgaatggataaccggattgctgtccacttccacctcaaagatcaccctgaacggaatccgggtcgaaacaatcagacacgggaagggtttgcgacagggtgaccccctatcccccctcctcttcatcttagctatagaccccctccagcgccttttagacaaggttaccgacatatgagttctaagtaagctgcggggcaaagttgtgcgcttctgcacatttatgaatgctgatgatgcggccgtcttcattaatccgatcaaagaggatgtgagcgccttcgccgatctgctaagtcgttttggaaaggtatcaagattatgcacgaacctacaaaaattgcaagtggcgccgatcatatgtgataacataacctgaccttgatgacattctacatggcaagcctacaactagggcaagcttccagatgaagtatctggggtggcctctgtccactggtcgtctgcgcaaa

SEQ ID NO: 68379 - DNA, 677 bp, Oryza sativa
ttttccctctcgaaatggtggcgtgtgctgccgtgccggtcagttgtcccgtgacacctggcgcctgacgtcccgccgcagcggttgggtggcgaggttgtaggatcgaatcatattaagtaagccaattagaaggggtgaatagttgatatactcaaaaacccaaacttttagcggaaataaaagttaccctcaaatttgatgtagatcggtctgaccgaggttgatccgccggtctgaccgagctcatgtcgccggtctgaccggtgttgatccgagctcatgtcgccggtctgaccgcctgaagattgcctgccgcgtgtgaagtcgccgccggtctgaccgcctctcctcagtcggtctgaccgccgcctgtcaccggtctgaccgccggtatgtcgctggttagaccgccgaaacccgatgaaacacaaatcgaagaactctcaaagtagatgacaactttattacttctctctgtgtttacaaagtgcatcaacagcactccttacaaaaatctcgactaaactcaaaaccctaactaaactagcaactcaattgctctcaaaaacgataccgggaagcctcacgctccccctctatttatacatgaggtaggcagcctaaagccacgaaccaagctcatactaagagtcctagacaccttaggaaaccct

SEQ ID NO: 68380 - DNA, 3363 bp, Oryza sativa
ggacatggcatcctattaccagccatcgcatgaaattaataggatgcaacgtcctcatcctagatggaacaactatgtcatctcacgggtgaatccattcatcgatagtgtggttttgtgaaactaaactaccaaaataaatgtacttaagtgctaagtgtcaaaatatgtgttgttttatgcaacttgaaccataaaacttgtagttttgtgaaatttactcttatgtttattactaaaactgaatcattatttgtgtgttcctctgttgactacagtttttacaacatttgtgtgctttaattttaggaaatcaaaatttttaattttttctgatgggccatattgccattttacgtgttttttttctttcagccaagagcaagatgacaacaataggtccttcaaagtaccatctctaagaaatatcatgcttaaatcgacaaactctatggagggtaaattgcgatggtgagtcataagatataacatatgctgctcggtaatgttattttatcttgttttcatgttttatttacttattgtgaagtacttatctatttattaatttcatgcttttatcagctcatcacacagtgaaccaaatgtggccaattccttctgtggtcgcagccggaggaaggttgtggaggaacatcaaagaactgctagctcaaggttcctattttcacccttctatctatttgcacgatatctgttgcatatttggccaaaaaagggggcccacttgtgtttctatcaatttttattcagatttcttgtttgccatggccattgctccatttctccaccctctggcccttaataaggataatagttatgcaaatttggaccattaatgaacatatctatatctggctacatgaaaattgggaagcatctggtggaaacatcaattaaataaaattgtggaaaccgctttacaaactatgtatagtcctaaaaaattcccaaaaccttaccataatatcacaccctgtaccaccacatattctcgaattatgaagtttcacccgtcaagtaacaggtgaacacccacaccctatatagagccttaaccacccttatcccttcaagtcttctgtcccatcacgcttcctcctccacacaactcgatctcgcccttcttcaagctctggcgagatctggatctccttccccctgtatctctcatgccgacttgagctccccagtcaccaccaactgagatctgtcgctgccgcccccctcccccccaccatccatccatcccatcttcaactccggcaccaccgacaaattataccctccggcaagatctgtctcttcgccgccaccaccagtccgttcttcaagctcagcaaaggtaacctctgcgcccctccttttccgtcctgcccctgcttcccaccactggtcgcaggtgctctccagcttgtccaccgtaagatgccgcccccctcgtgcccgatgctaaccctgctcaccaccctctcctagatcatagcgggtggcatcacaagtgcccctgccattcctgtaaacctgaatccccttctctctcctcatccccaacctgtcccagaatcctaaccctgtcctcaccgagccagctcaagaggggaggcggcatgcttgacttttccctttttggcacttccagttattagcaagtgatcgctaatttgctaattagggaagcttcattgcataaacccttatgtttcccatcttctatttgcacattctgttgcataattggcaaaaaaggggttttattgtgtttcttttgtttgtattctgaattcttgttttccatagccattactccaccctctggcctaaaatgtgcagtcaacttatgtggatgaaaatttgggaaacaatcaattcaataaaatcgtggaaactactccactgattatgtatagaagtttttttttatttaaaaaaggaaacattaccataatatcatatgcaggggagatgctataatacgatcatgtaaaatttcaagatcaaattcaaacatgagaattttcatttgctttgaagattcatattgatatagtttaagttgcatttctctcctttttgtagtccagagcacccattgtctagaacacggggacgctctatgcttggtgatagacagcatggagatggtgtagctgtctcaaggtacctcagtaagtttctcttttgtttaaatttgtttgaagtcatgaatcaagaaacaagcatattctgatctgtttatcccctctgatttgaaatttgaatgcaatgcatgaagcatcaagtgcagtatctatgatggtccaaatatgtcgagtaatgtgaaatacattaatagagtattaaagaatcctttgttctgcatgtagtcgctcgatgaacaattctggattaattaatattgggatcaatacttttaagagcgattacaaggacccaagggacaaatcagcttatatatgcttaaattcaaattttcaaaaacttaatgtggatccagtataagccgtggaagattgcttggttattttaaaacggaatggttccaatttataagttctaactgattcaactgttgttagttgtaattgtcagattccctagtttttttgagttcccagttgaaatttgtgctggcctgcgattctattcagaagaagcaaaacagtcattaatttagacccatctgaatggagttctttagacacgagggaatgaaatgccattacttttgatacttctcttattcgtggtatacatggtatctttcacatgtaggatttgaaatttgaacttcaaatataagctggtttctccttgatgttgcacttaaaggtaataccaccattaaaagtgtccagtgctgtcatggaaaacttatggaagatataatcagtgttctattatcttagcctcatatctttggaatacatgaaggatttaacaaagtacagtcaatacagtttctaatccagtacaactgttatcttcttgagttcttgacatgattttgtatgtgttgcttgattataggtcagatggcgcatcaacatctaatatgcgtagaggacggcgaagaagtataagttttacccctgaaattggtgacgatattgtgaggttggtaaacccgacctttaaccctgagcaatgatacaatgtggttaattgaattgtttattcatagttttgcccaataatacaacttaacaacaatagtaaaatccttgcttgcatctaaatactcaatggaagaaaatttcattttcaaagaaataatagaactataaaaattggttatttggacaatccaggtataatttatccatatcatgcaacctggtt

SEQ ID NO: 68381 - DNA, 521 bp, Oryza sativa
cttaagtaatttgagcaatactttaagtaaggttgattttccgccaccattagggccaacgatagtggtaatcgaatttttataaatagtgagattaatattttgtaatgcttgcttttcagcaaaagtgacctcaatattttttagttgtactaaaatttcggatgtttttgacgatcggtctatgggagtaagcggtttaatttgcattttatttagaaaataaggctataataaagtaagttaaaattagctgattttgattgagctgacaagaatgaatttttatgaatttttttagagaatgcttgtcaaagtacttcacaagaaaaatagagtttgttaataggatatattttgcgacatgtagtactagcgagggaacgccgccgtaagaaattacgctataaaataatgttatttttcatcgcgttattatcaattttaatgagtattttccttgtttcaaaaaatgattttttaaataaggattcgttatctgatgtagatcactatcttat

SEQ ID NO: 68382 - DNA, 25954 bp, Oryza sativa
  unsure (1)..(25954): unsure at all n locations
gggaagctgttcaccaagaagccatcggcgccgccgtatcgccgcccctcctcgagcacgtaggcgtagttcggatcggcgcaatcctggaacccgtcaggaatttcgtcgtggcggagcggcgcgcaaccggggagcacgagcgggtccgggaggtcacggtactcaccgacggcggcgtcgtcatggagctccacgacgctgcgcacgacggagatgaagctgatgctggtcgggaagaacacgtacccgggcacgccgagctcggcgacgagcgccagggccggcgtgccgaagaagtcgcacacgatcgccgcggtggtggagccgatgccgacgacgagcgcgcggagctgcgggacgaagcggcgcatgacctcgtacatcaaacagccgccgacgtccgccgggggcgggagaacggcggtggccacggaggccggcagcgaggagagcacggcggcgtcggttcggagaggccggcgagcgtgacgagcgtgggcgcgacgccgtggtggtcggcgagccgccgcgccagctcggccatcgggatgaggtggccggcgccggggctcgccagcagcacgacgtgcggccggttatcctccgccgtggtgctcgccaacggctccatcggtcgtctgtaagacggtgtagtgtgcgactgtgtgttgtgtgtagacgacaatacgagtcgtatatatagcccacggccacgcagctcgagaaaacatatgcgtcattagcaattccccaattataattgtggcagttgacgatatcttttcttcaacaaagctaccggtagctattagtgaacagtgtgccccagaacctagtgaatcttaaaacgaagaaagattatgtgatagtgtagcagccggcggcgatggctcctacaagacaaatctcggttttgatccttctcggacctgtttttttagtaactatataacattcgacagttatttttaaggaaaaaaaactttcacatgtaactaattataacagttattactgttttgctatacttttttgtgctgttcagctgccgatgtaatagtcaggctaaaaaccctaccccttagctctagtttcagtgctgtcttttgaggttgctcttgttgtcttctctacaaaaccagctaatgtggtagccttatgtatctttctgtctgtacccggaccttatagctctgttcatttctagttatggaaatggggcgtcagcccttgataaaaaaaatagttaattacaacgtatctagtatgaaattgttatataactattacataactaataacttatatgtaacttgatcttttctttcaaaaccacatggcattgcaagtgcctagcgtagcggtcttgcaagcaacaagtcaagggttcaattctcgcttgggcacgtgcgatttttttttatatctcggtatcacgaatctcgaagaacatccgacggtggaaaatttgaaatttttaaagaaataaatcagtcgaaagtttttttagcaaaacccttttttttgttaaaagacatttaaggacatgtttgtagcatcttgtgattgtagtagtttcttcgtcatatagggaaagtgtttatcatcctatcgagggaatactcctagttttttatatgctatctaaattgttataattttcttttaaaaaataaataagatagattaatatgaaatactatcactacacaaatatgcaaattcaaattaaacttctacatgttgtaacaaaaataacacataattataaacatactttaattatttttatttttatttttatttttttctttttttggtaatttgtagaggttgaatttaggtttgcatgttaatagagtgatatattttagagtaaatttcacaaaactacaggtaatttgatcaatctactacaaagctacatatttaataaagtgtaacccaaaactacaaatttaaaatcatatttttcagaaatttataaatttaaggtattatatcataaaactacagatttaatatcatattttatcacaaaactataacttttataacctcaatagtgctatggacataaactttaaaatctgtatatagttatttcataacttcaatattaaatatgtagttttgtgatacaatgctataaatttgtagttttgtgataaatttcacactaaatctgtagttttgtgatacactttttaaaactatagttttgtgctagtctggtcaaagtatatgtagttttatgaaatttactctatattttatattaatctaagttgtgaatatatttgttaaaaaataatataactatttagatggcatgaaagaataagagaatgtctccttgagagatggaaatccatctttctatcatataatttaactatgtgtcattattactaggttataactaaataccctttgggcttaactatttgtcactaaaaagaggtgatatatgaggagaattgtaatgtcccgcttctctcaggctgggcccacttacatttggcagcttttcttagatatagattgcccttacagaccaacacaagtcttttctgtacactttgtccttactcgtgtgcatccgagaagaatttcccgagcttttcttggatatagactgccctcacataccaacacaagtcttttctgcacactttatcctcacttgtgtgtacctgggaagaatttcctgatcggtgatgagaagcttttcttggatatagactgaggagaattgtaacgtcccgcctcccctaggtcgggtccacttacatctggcaacttttcttagatatagactgccctcacaaacctcgagaagaatttcctggtcagtgaggccgggcccacttacatctggtagcttttattggacatagactgtgataccattatgtaacgtctcgcctctcccaggatttctcggtcagtgaggctatgcccacttacatctggcagtttttcttgcctctcccaggattttccgatcggtgaggccaggcccacttatatctgtcagtttttcaaggatttcccggtcggtgaggctaggcccacttacacctggcagtttttcttgggcatagtttgtgataccattatgtaacgtcctgcctctcctagaccgggcccactcacccatcctgaaatagtgaaattgctccaggctaagcatgtttaacctcagagttcgttggagatcggctttcagaaaagaagttacaacttgttggtatgagtattctattaatccaggccaggatgtcacatgtaaaatgtaaggttattttctttccattgcacgaatctttgactcgatcctacacttaaaaatttagaagttgtgggacaaaagaactggcgaattaatgtttcttctagcgaattcgaaaaaaagaaacacggcgatatacaatagagtttctagaattatagtggattcagtttgtttgcatcgcactactaggaaaagcattatcgcaagcggccgaaaagggtcttcgcaggcggggcgatcgtccgcctgtaagccaacgactgtgaagatctccgatcttcgcaggcggggcggccgtccgcttgcgaagataattttcgcaggcggacgttggctagtccggtccgcctgcgaaaataggaatcgtccgcttgcaaaaaaaaaaacttccgcctgcgaagataggtagaaaatattgaaatttaataataatttgcccgtaaattacttttaaattatttaatagaaattcttgcaggtagatttttatgtacatatatcggaagattatcaagcatttggtactgagaaatctacatatattgcataactcaaaagtgttgccaaaatatatatatatattacaatatttttttacattgtcacttcaaataacgtcatctagttacgttatggcatagcagtgttccactcccgaagatccttgaattcgtcacttgccgctagggcaccctctgggtcgaagaaatctcctttcacatgacagcactaatggtggatgaagtggcacagatcacgctggacatttgtgattcctgtatcgtcaaagcttgttcgacattctaatcttggcaactgcatgcattgaaattaatcaatatattagtatcataaatatgtggagctgtctagtacatagtatagagacttacatcctccgcgttagtcctgtaccgtccattaaccctaaggaattcgcacgcataatacccgcaaaggaccgttccttgcggttgcttgtgacacttcaggacatatcatagaaaaaagtagttaaaattttcaattagtgaaacaattggaatacattaagtgagtggagtattaccggccaataggtacgtactagtagcttctcccgtgttcgggtttgttctccacccttgaacttgtagtattggtatgcactgtatggatgtcgtaccatttcacagtaaggaggatatttatttataatacattcatatacaaatgcaagagtcataataacttactactataagattgttagaaattctttgtattgcttgtgactgtaatcgagagggtccaagactaccacggttccgtctttagggtggataagtaaacagatataatgatcgctacatattaacaacattatagttagttagtaccagctaaaataagacatatgtgtataagataaatgtactggacttacttaaaattataagcggccatgacgactctcttattttgaaagtgcaagaaggctcgtccaatgtactgtgcgacagtaatcaatttctccttgtgcaagcccttcttgtattctgctatctcttttggattcttgcccttcagctggtcagaccctggtgctagcctcacggtatgctgtgtttggcagatccgagttggatccaagaagccgatgggttcttttttcttcttagcatccatgtaatgcatcctacagaagaagtttgttagtaacaatcacatggatttgtattgtacatatttttcatctaattacttaaaactcatactcacatgcaccaaataccaacgtagttgacgtccatctttctgacgatatatggctggagatctgagaaatccctttaaaaaggccccccaatacgtannaccttctttgccgaaacaatctgccggtgatcgagctgttatattgcccaagccttttttgctggcctccatatagaagttatgtaaccttctcatctcccatggtgcttctttcagtgcccattccagcaagagtgctttcccatgttcgtacttttccgggcaatcatcggttgcgaagtatgttggcccggctagttcagcagccttctgggggtcgtcatctctgagcttggcacgttccttaccccctctaaagacggttaccatgaacttctccttgttctcatctttggacttggagtcatggctcctaagcactcgtggcacctcggggtctttcgcaggagaagggtcttcaaatatttctggctttgtaccatcccattccaatcttggtacttcttctttgtctgacccgactgatgccacaaattacacctctggttctgccactgtaatctccatgggcacatccggcactggaatctccatggctgcctccggcggtgcaatctccatggctgcctccggcaatgtaatctcaagtggcacttccagcactggattttccttttgcatctctggttcctccgccttatcagtcaccttcctcttaggaggcctcgaaggttttcccaaccccggtttaggcaccacaggtttttgcatggcgtcggtgcccaatccaaaggatatgtcattcttgtgccagagaattacaagatcgaccgcatccccaagtacggatacaccatctgcagtcgggaagtcaatgtcgtaggactcaaacccttcgtgaaccacttgcggctacaccttggcatagcatcgggtatgaactcttcattgtatgttctcccagggatagcaatggctgtagcggcctcaagagttttcccggagcgtccaatgggaacgtgcaatctgcagggtgtattctccttgaggtcatcgaaggggtaatctagctcagattctttggtttcggggcgaggcaaaatcatgtgcttgacgtagaaatccatcatttgcctttcaaactccgcacccccttcgtctctaagtttatcctattttatcggcaaaatcatgtgaactggataaattttctattttatcggcaacgctctacagctccggattttcaaacgatacttttccttcatccgtgatcttcggagttctagctcttacccagttccttgatctctgtgtccactcctccattggtaccggttgccccttcttcctcatttcctcctcctctttagtccactgctccaccattggtgcgtatcccgcggagcctaagcgatgacgaaatttgttcttcttggccaactctgcatacttttggctcctttgaatttcttttggagagttcttcaaggtcagaaagtcgtcccactgattgggggttatgttggcatacgtcgaaaatggtgtgcgtcccgtcttcacaaatttcttgttcaaggtggttttccaaccacgccaagacttagccattgtttacagtgcacaatttctcactgctgcctctgatccatccgggaactggaagattttcttcaactctttccataggacttccttatccccatttgatacatgatcccagtccttgaccgtgatggggatcttttcccttaatattatgccacactgtgaactgaatttcgcacgtgccgtcttagcgtcgagcggctctcctttaggcgaaacatgggtaacaacatggaacccttcatcctttctattcacgcttctctcgcccttccttttcttcgtgattgctgaccgttcgctattctttgtgccggttgtgttagctggtacgtcgtcgtctttggacggaacttttttcttcggctgccgttttgatcgccatggcgttgtttcctacgagaaggtatacatggaagtttcgaattagctcgggctaatagttatcacggtgaacattttacatattaagtctacttaccccttctttagggggaatgtagtccttgttgccttcttcaccgtcgccctttttccttctcttcgggcttgggcttggacaaggatcgcttggcgacgagtactcctcgtcttcgtcacctacgtcgctgtcggaactaccttccggtgcgaccgttggttccggagcaaccacaacagcaagggactgctcctgctcccctgaacccttctcttcagtccctttagtactatcggccatcgtttcaaacctctaatataaaaaaaaagagttatcgtccacattttaaacaactttgtaaacaatatgtcgtatgaacaaatttaaattctctgagatttccaaatttaactattatactaaattaattagtacaaactaatttaaattgcgaaatattattaattagtacttactattatgctaaattaattaatacaaacaaatttaaattgtgaaactaatgactacttactattatgctaaattaattagtacaaacaaatttgtacaaaatttgatatgttattatcaagtagtgcaataattgacagttatatttcatcgacatgttgattaaaaaaatggaaaaggcaaaaatatcctccacatttttttaaaaaaaatgttaacataccctccaacatgttatttaaaacatttgacaaattcacatatcctgcaaaattgaacataccctcccaatttcattcacatatcacccacattcccaaattcacattcacaatcaacgtataacccctcattcacatatcacccacccctcatgcccattcacacccacatgcacgcacatatataccccctcacacccacatgcacccacatgccgtgcgcgcggtagaggggctggcggcagtgtaggggccaccggtggccgcgcgcgcggtggaggggccggtggcggtggaggagctggtggcggtggaggagctggcggcggtggagcgggcgcgcggtggaggggtcggcggcggcggcggcagagtggtggaggtcgcgcgcggtggagcggcagcaaggggcggtggtctcggtgacagcgcctggacgacgacggtcggcggcggcggaggacgacgttcggagagtgaaggtcgcaggcgggcggcggcggaggacggcggaggcgtgcggcagcaaaaaatttcggcagcctgacggcgccaaaatttctagggttcccgcctggacttagaaattttggcgccgcgggcttgcccttatatagggcaacgatcttcgcaggcgggcggttcgcctgcgaagatcttttttcctatcttcgcaagcgggccgtccgcctgcaaaaattggtacagagttgaatatatttattccaaaatatacaaatcttaatattattacaaaatatacaaaccttagtattattacttttcaaatgtataaatcttaattgcacataaaaatattactaatttaaattttttaacaaattttttacactacaaatggtaaaaatggtaattgcacataaaaataattacagttttcaaatattactaattttaattttttaacaaattttttacactacaaatggtaattgcacataaaaattagtacaaactaattaatatgcaaaatgttgagtacaattgttcgtcaatttgcgatatgatcacacatcaccttacatgccaccattaaataactactaacttcttagatgcttacatgcctctcaacaatcattaccctttaacatttttgcccacaccgtccgtgcgcatgtaaggcttcacggtcttttgagtagatgtctcgacattcttaatcttctgtacaaactgactataaagtggcatactatcgtattggttgtaatcttcgacatcttcaatcccatccactcccaatatcttttgtttccctgatagcactatatctttcttcaaatttgaagggtctttcacataaaacacttgtgccacgcgattggcgagtacccaagggtcatccttgtgacccacactcgccaggtcaacaacagtaaaaccgaacttatcaacattgaccccgttcgggtattttacccactggcacttaaatatagggaattgcattgtgtgcccatagtcgatttcccatatttcttcaataaacccgaagtatgattgttttttcccggcttcatcaattgcctccacacggacaccgctgttttgcgtacaagtcttactatctcgggctcttgtgctaaacgagtatctattaatgtcatatccctgccaagaatttactgtagttgatggaccacaagccaaccgcttcatagttatttcatctcggtggtgcgacccttattgttagcttgtattagttcgatatgttgatcgatgtacggctcgacgatagcaagctgatgaagcacgctgaagtgagcttcttggaatgatttgtgatcatgggtgacgaatctcttctttcctatcgttcccctgccactcaatctgccctcgtgtcggggcacaggtactccaattgcatatccatctttgaggtaatcgatacatcactcgacaacctcttcagtactataaccctcaaccattgataacactggatgtgcacgatttcggacgtaacccttcagaaccgccatgtaacgctcgtatgaccacatttgatggaggtacaatgggccaagcgcaaccatctgcggcactatgtgaacaatgaggtgctccatcatatcaaaaaatgatggagggaaacacatctcaagttggcactgtgtctcatgtgcgaatgtacggagatttcctaactcttcgagactactaagggcaggttttataaaagaggtggatgttgcatctaatcttgaccacatcatcaactaataaatgtagagataacatgtacaatatatcacatctatactagttctaatacactagccccaatgtttgtttgcccaatctactcttcctctctctcattttgtcttgaattttgtatagtggttgcctcttgcatgagaggtgactgcttatctctctcatctcttctctcctccacctcactccacctcactattttagcttatgtggcacctaggagattgtacttggatgcccatagtacttgccctaatgaccttctgtgacactgcgttgaaaaagtagcacaaccttgtgatagcaacctttaaatgctccggttttattgcccttattgcaattgcaagaaacacggtgagcaagacatggcagtcgtgtaaattataaccagataccgacaaatctttcattgaaactagtcgactgatgtttgatgagaaacctatgggcactctgacatcacggagtgagttgcaaaatgacttcttctcctcaggtgtcagtgtgaaacaggctggtggaagatatactttgccattcttttctccttcttgagggtgtaactcttccctgattcccatctcgactaggttcatccttgattgcagaccatctttagtcttcttcggcatgtccaacaatgttccaactatgttgtcaaacacattcttctctagatgcatgacgtctatggcatgctgaacctccagatctttccagtacgggaggtacttaaaaaatatggaatgcttattgaatgggggagggagtttatcatctggcttcgaactgtcatcttgcttcttactatcccctcccttcgttttcttctcaggtttcttgcgctttgtcccctttgatggtttcttagtcatttttccaaactcgcaaacaattttctctgtcattgcacacaccttttctcccgatgtaggttttggtgcaggatcagtctcttcagtaccatcgaactctgccttcatcttgcggtacttgtgatttgtgcgtaggaaccgccggtgccgcatgtacacaagcttgttgtaacccgggagatacctatagtacgttccattcaagcagatcacacatcctgttttacctttaatttgacctgaaactgaaaacattgttggataatcgttaatggtcatgaagatgatggccttcactgtgaagtattcccttaagtactcgtcccacactttcaatccctctttccataaatcagccatatcttccaacaatggtttaagaaacacgtcaatatcaataccagactgacggggtccctgtatgaggatacaaagtagtacgtattttcgcttttgacaaagccaggtaggaagattatacatggtgagaagcaccggccaagtactatgtgagctgctcatgtctccaaaaggattaactccatcagtactcagggcaaatctaatgtttcgtgggtctttagcaaactctctatactgagcatcaaagtttatccattgacgagcatctgccgggtgtcgaatcatcccatccttcttgcgtccttcttcatgccagcgcattagttccgcatctcgcgggtttgagtatatccgtttaatgcggtctttgacaggaaggtaccacatcacaagctgcgggatttttctctgtcgtccctcagttgcttcatagggttctaggccagtattgctattcgacttgtaccggcttgcaccgcatgttggacattcatctaaagaagcgtactctttcctgtacagtatgcagtgatttacgcacgcatgaatcttttccacaccaagtgaaagggggcatatgagtttctttgcttgatatgtgctggatggtagtgagttaggcctcgggagcattttctgtagaagttctaacagactgttgaaactggtatcagaccatccatgtctcgcctttaacctcataagttcaagaactgaccggtgtgttgtgaactcactatcacagcccttcgactcatcgtacaaaacttcctttgctgccttctgtaaagcttcaaagttatttaaccctctagccgaccccatcagtacctcgggttctgcatgacgtaacatttcctctaggtcgattttgtcctcaacagaaccatcgtcatgcaccatgtcttcaacttgtgtcggaactacattttcaggcccgtccacttgttcttcaccatgacgtgtccatatttcgtacttgtccataaatccacgagttactaagtgctccttcactttaaaagcatcgtcaaagtcccaggctatttcattcttacagtcagcacatggacaaattatcttcctcatattgttcttctcagggtgtgccttagcaataccaataaatttagccacttcgtttctatatgtagacaaaaacctcggccaatgatacatccattcccgactttccatatctctaaaaaaatacacgtaaaatatttgcacaattaataccaaatttgtagggtttattgaaaaaacttatcgctattcaaaactaattaactaaagttaagtgtaaattaataaaaaatcatagtttatttcaattttttttacatagacatgccaaattagtacattaggaaaatctacaaaatcatttcatcggcatattacaaaatactataactattttttgattgcaccgaataaatagacatttaaaattttattctctctctgtatatgacaagatctagatctagatctagaactaggtggtggatgtgatagcaaaaataaaaaaaatttgagaatttatgttaccacattaaaccactacaacaagaggcatcaagtattacacatacatctaacatcaacatatcaaaagaaataaaattaaaaacatggagctcttcctttacaattttgcatgcataaatccatcacaaattaaggtctaaaaagcttaaaaaattgcatacctagtgttgaaatgagtagatataagtaccgtagaaaaatcccccgaagatttgaagttcaaaacctccccctatatttaagtcactttaggagtgagaaacttcggggagaatgaacagggctcggggaggaagaagactatataggggcatcttttcaagcgggccatataagcgtcgcctgcaaagattgatcttcgcaagcggaccgccccctccaccccgggtactttttttgccagcggggttttggctccgaattacttgcccgcctgcgaaaatcgatcccctacgacgccgaaaatgagttttctagtagtgtcattcacatactatgctctgttatcatacacaaaagataaataggaatgtcaacacacgttacaaattgggtaatttactacagtatatactttacatataaaacggtactagtagtcggaaaggctaaggggcgatcgatcgcccctagcgatcacccctagagcggtccccctcccttcatgtggtttcctttttcggcgccatattacttttctattttagtaaatttatgcacctaaagtttgtacacctcaagtttatatatctaaagtttaaagtttagagaaccaaagtttataagtcaaaagtttatatattcgattcaaatttaaatttgaattcaaatatttattttagatatagtatttctattcatctaaagtttataggcccaaagtttataagtcaaaagtttatatacccgatttcaaatttgaatttgaattatatccgattcaaatttgaatttaaattcaaatatcttttattatagtatttctatgcatataaagtttatagacccaaacttgtcaaaagtttacacacctgatgaatttgaattcaaatattagtttatagacccaaagtttataagtcaaaagtttacatacccgttttaaatttgaatttgaattcaaatattttttatacatagtatttctatacataattttttttcaactttgtttttttttgttttttaaaaatgtatggtgtagtaggaagagaagaggggaggaggaagagagagagtagcttataggggcagaggggggggggggtgcaacgcgcccatcgttatcgttttgtataaatttttcacgtggccagcgacaaccatatatatccaacagtttcttcctgatccacctaggcggcgcgcatgactgcaaaacctcgtacgacggcggcgaggacaaccagctgtgggcgcgctccattgttcagcattttctatgattaaataaatgatagtgttggctacgcatataaatccacaatatctacacggcgtggttataccgatacctggacaaaagaaagtcgcacggataccaacagaaatcaacattttacacttatcatatactcactccgtttcaaaatatttgacaccgttgatttgtttgaccattcgtcttattcaaaaaatttaaataattatttattcttttcatatcatttgattcattggtaaatatagttttacatatttcacaatttttttaataaaacgaacggtcaaacatatgctaaaaagttattgatgttaaacattttgaattagagggagtactgagtatgccgcaagttggtccatagattaggattagaaccacgaattataagtcttcacacaacaatagcttcaaattctttatttagtgttgggatcaatcttcttccaaaataaatgaagcatctgacatgtcttttagaaagaaaggctcagctgacatccgaattccgaaagtgagtgatcacctttcaagtttttgaccaaatttcaccgaacgaaagtgacaccggctaagactgactcaacgatcctcatgcacggcgttcttccacttgccggccacctcctcgagcgcgcggcgcgacgccccgtccggcgaccacgccctcgccgccgccgccgcctgcagctccctcgcccggcgacgcgcggcgctccccttctcccctggatccatgagctccttcaccgccgccgccacctcctcccgcgacaccacgccgccgggcgccaccggacttagcggtagcgccaccccggctacctccgtcaggatggccgcgttcatcttctgctcggcgtgcagcggccacgcgatcatcggcacgccggaggacacgctctccagcgccgagttccacccgcagtgcgacacgaacgccgccgtcgccgggtgcgccagcacgcgcacctgcggcgcccacgacgccacggcgaggccccgcccgttcgtcctctccacgaagccctcggggaggaagtccatcgggttgccgtagctggcgcccatggaggaaaggagcccgccctttcttggcatgcgcaccacccagaggaacctgtggccgctcatctccagcccggcggcgagctcgcgcgtctgctccacggacagcgcgccgccggagccgaaggagacgtacaccaccgaccccgccggctggcggtccagccactccaagcacgccgactcgtcggcgtcctcgtcggaccttggccggacgaacggcccgacgaggtacaccggcgggaacgcgccgttctccccgtctcgcctgaacgcttccgcggcgcccggctccatctccgggaaactgttcaccaagaagccgtcggcgccgccgtatcgccgcccctcctcgagcacgtaggcgtagaccggatcggcagaatcccggaacccgtcggggatgtcgccgtggcggagcggcgcgcatccggggagcacgagcgggtccgggaggtcacggtactcgccggcggcggcgccgtcgtggagctccacgacgctgcgcacgacggagatgaagctgatgctggtcgggaagaacacgtacccgggcacgccgagctcagcggcgagcgccagggccggcgtgccgaagaagtcgcacacgatcgcggcggcgggggagccgacgacgagcgggcggaggtgcgggacggagcggcggacgagctcgaacatcacggagccgaagccgatgtccgccgggaggtcgtcgagggcgacgggcgggagcacggcggtggccacggaggccggcagcgaggagagcacggcggcgtcggtggccgggtcggagaggctggcgatcgtgacgacggtgaccgcgaagccgtggtcggacacgagccgcctcgccaactcggccagcgggatgaggtggccggcgccggggctggccatcaggacgacgtgcggcggcggcggcggcagtgacgtgtcagttgcaccggtggccgcctccgccatggttgagtgcagagtatggagtacgcttctacttatttttggtgtcgtgccgcgtcgcgtcgctttgcagtttgagaatggaaagcagatgccatgtgcaatgaaaattaaggcccagcttggaacttaggaagataaagaaactaattagtaaaaaaaaaaaagaagcatcaggcaaaatttgccacggacatctaaaagctaagctatgtaattagctagaagacactcaaaaaacgcgacactactaataggcaccacaaaatttgtgtaattagctatagtaaatctgagacaatattttatcattttcagtgaaaaagaggagatagaaatttcaaaaggacataaatgccctcggcctaagtaacatgtacccgaaatctccatccaacttaactctaggctaccgatggtgacggcggcggcggcggcaggcgaccgacttcttcttcgacaacggctggtggcggtggcgggcaagcggcttctgcttcaacggtggctggtgacggcggcggcggcttcggctggttgtggcgttgggaagcgacagcggtggtgatggctcggccggtcatggtgcaccaggagctcgccgcgctgcaggagcagcagcaccatgatttcatgccgtcgccacaccaacagcaacagcaacagcagctagtgtagcagcagcaacagtagctagtgcagaacgatgcccaacaacaacagctagcagcagcaacgccgtggccgacgatgccctacgaccaccaccacccgctgctgcagccgctctgcaacgccgccgccgccacggcgcagagctcggccacgtccgcgccaccgacgcgccgccgctgcgcacctgtccgccacggtgctgctgcagaaggcagtgcagatgggctgctcacgaggcagggaccggaggaggaagggaggtcgctctcagcctctcactcgccgagaaccgccagctcctcatcctgctcaacatctccctcgccgtcctcgtcggctgcagcgtcgtgttgctctcgagctcggtgccaccgcttgccgttgcgccttaggtatggtagccgccgcgccttgtcgtcgccggcggtgagaccctggaggagcgccgccgctttttccgccgcgtgcgtgaggaagaaggataggagagagatgtaggcccatgccgcgtgagaccaggtggttaaaacctattaaaaaggacactgtctataacgagaccattctctctatggtcataactagatacctcaatctcatatctagttgctactagtatactcaaaagtgaatgtatttttttttcttcttatggaattttctcttagattactcatccgatttacgatccgattacaccattgtgttcataacaattaaatctttataacaaaatctcacatgactatatttttatgaaaaaatagaaattacttttataatatatctaaattacttttagattttattaaattacttcttagtcataaaagtaattcaataaagcttgaaagtaatttagctatattatagaagtaacttgaaacaaaagtgaagtaacttgttacgacattaaaagaaatctatacattcatgttgtgagttgtttattttataatcatttttagtcaattatgtaatttatgctgattaaatttaatttctatatagactcatgtttttacctccataacggatttacttttaatgtcgtgataaagttactttcttctttttttaagttacttctataatatatgtaaattacttttaggctttattgaatttacttttatgggtctaagaagtaatttattgaaatctaaaagtaatttaaatatattttaaaagtaatttctattttttcatcaaaatataatcatgtgagatcttattataaagattcaattcttacgaacacaacggtgtaatcggatcgtagatcggatgattagtttaagagaaaattatttttgaagtcgacgtagcgtagagcatcacatggcttctaatttggattcctggatgatgccacgtccgtgaatcaccaagccatgtacggacacatcagcacttatgggatcggacaactgatgagcgtgtcgcgcgataaggcaaaacagagagcgcgcgcgaattagattttgcctattaaaaattagattaaacatacactgtccatgatacgtgggtcccaccggtgtttaaagaaagagaaggggcaatccatgcatttagataaatatctcatcccttttgtcccggaaatataataaaataatacgacttgtatcctacggccaattacacgtttttttgtagggtcaatcagccgtgtcatgttttcgcagtgtctctcagccaattaaacgttttttgcgtgtcatttggcaaatctggcctttagtttattttctgagcattagcatactaggtctggtatctctaatacgtactaatatcaaaatggtatctaaggtatcatgcttaccatggtatctaggtaccgaaaaacttggtatctacgagtatcaaatttggtacctaaaaatatcctgctgacattaatacctaaaagtgtttcgttggctaaacggtatatcgttccttagttacccttaaaaaccgtactagtatgaatacaaaagacatgaaatataaatagttagcaaaatctcttgctctcgaagcttgtctttagcctaatggttagttgtatggtgtgtttatatatgggactattcaatttcaactgtcaagtcaaatcatcgatcaaatttggtatatatatgtgtgtccgtgttttggcaatgcacttgatgtttgatgcctataataatattaatgtgtaaaggatacttctttcatattttaatgtatgacgctgttgactttttaaccagcgtttgaccattcattttattcaaattttttgtgcaaatatgaaaatatttatatcatgcttaaagaacatttgatgatgaatcaagtcacaataaaataaatgataattacataaattttttaaataatacgaatgatcaaacgttggataaaaaatcaacggcgtcatacattaaaatatggaggtagtactattttgccggatgatcgaagaacggtcatccaaatggtattaatattgaaagagaaaaggagttacagaagatttttcatggacggtcggttgtaaaggatattcacacgcgtatgtatgcttaggtgtatgggttcggcgaaaaaaataaatatcttatctctaattggtggttacaatcgaagacttcaacacgtatcagaaaattcagaaatggcaaacgtcacacatcatgtgtgttaagcggaatctactcttggttttaattaatttaggaccatgaggtggacgaaagaatgctattggcagatccacccaacaattcaacgaccatatataactaccctaccctagtggttctctaactgattttttttatgcaagctaacgaattccatattttgctgatattaagtcacaaccaagatttaacaactcgtttttcttttcgaaacgaattttttttctcaattttagtgacacagcaggacacatattcctgcaaggtttgaaatttcggttcgaaatttccgaaattcgctcccaccgaaatgctcatatctcgtccgaaactttcggttttttgcaaatttttgtgaatttggtcaaattttattcaaatccattaaaaatcagtcaaaatttcaaaaaatttcgttagaaaaaaaatcctaattttctgaaatttcagttctttcaccccccgtcggcagaaaccgtagtttcgaaatttgaaacactgcattcctgcgtatctaccagtatggacatattttctcaagaatatctcttttttttactcctaatattaggctagaaaaaaaatgctccattgcatcaacgggagtctgttgggccttaatccatgtaacagttagtattttttgaatctctgtaacacttagtattaataggactaattgtagcacaaagtgaagaaacaaaaagaactttatatttagcatatgctcatgaaaccaagacccaaaagtagctccggaaatctcatatgcatccactacaaaattttcaaatattacactctaaaatcaatgagcatgaaaatttcaataagcaaaatcgtttcaataatgctaagaccagctgatccaataatgcaggcctccccgttaatctgcaagtccatggactaagaccaggtggcccataaaagcacacaaacaccgtaggaaaaagtacaccgaaggtccctcaacttgttatcgggataaaaaatgtccttgcaaccagatatacggggtcccttaactatacaaaaccggtcactcgagatccttcggtggttttgaccccggttttagcctacgtggtgcgtgggccccacatgtcagcatgccacgtcaactcccctttcccctcttctctcccttcctcccccctctctctctcgcacttttctctcgcaggccggccgacgggtaggtagcagatgatcgggtggtgagcggggctgagcggcggccggcggaggcggcgtgctagcatgcggaggccggcgaagcggagcggcggtggcggcaagcgggcgagcgtgcggcgaccgacagatggggaacgcgccgggatgtcgtcgacagtggcaaccggcggggagaagaggcgccgggacgggtggtggccgatggggagaacgaccgacgagcgggcggggagacgaggcggcgtgcgtgccgacccgggctgccaaatcttgctatcaaatatttgaagcaacagtacctgtggcatatgagatcgacaatcaaccattcaatccacctataaatggccatatggcccaaggcccacggcctggcccaaagctcgcaaatttggcccggcccaagcacggcatgacccgactggggtcgtgcccatgccggcccggcccgacaaccgggccatgcctgggttgcacccttggcatggtgggccagcccagcactgctcgatcaaataaaaaaaatatagggatgcaaaatagacttaaataatcgtataaggcaaggcccaagacaagaggtacacaaaatagacttatgttccagccatttaaacatagccgacagagttgagggaccaaaaatagactttttctgtgaggaagcacgatgggccacgtaacttcggcacggcccgagtagtattgggccatgcctgggccttgtatgccacccatgggctggcacggcacggcccggtgtatcggtcgggccgtgccggctcgacaagcctcggcccaggcacggccaggcttgggccgtgccgtgccgggcggcccagatggccatctataaattcaccgcaccgaacactattgtttccaccgacaaaactcgcatggcctggagatcactgatgcactgaaccgtggcttccctagtgtgaatttccatgtaacttgggacaggatgattgttgttagcttgcttgacgctggagttggctgacggtgcctggtttcggtctggccatagctgttacgctatcgaaatctcatactccatgcagtggctggtgtggcacgtgtgagtgacttcaggagaggacatggacggaggcgttcttggtggcggcacagacggggcaagcgtcggcggtagcctcgcaggcgccacacaggcacaggtggcggcacgggagcagcagcacggacgcctccgcgacacggcaggccttccacgatgtcgccccggacatcgcgtcggcgtcggcggcagcggcggcggcggcgccgcctggggtctcgaagcatcacgactgcgcgtcctcggcgttgccctcccccgcggcggcggcgacggcacaaggggactggaggagctagttgagcgtggcgcggaggccggcggcgacacccatccacgcatgctcctccgcgctcatccggcggagcttctcctccagctccgcgttgtagcagcactcgcgatccagcttggcctccgccgcacgcaccctacccgtcgtggcgcaccggcgcgccatggccgccgccagcgcccggacgtgtcgctgttgcgctttctccagccctgcgcgcatctgctcgacctgcacgacatccaccaaacaccaacgccgatcaaacaccattcaccaaacacaaacagaggaggccggcagcgtgagcgggtgcgtggcctcgtcgtaggtgaagaagagcgaggcgttggctgtcgggatggggaggtcgccctgctggcctcctctttccctgctcctgcgtcgccgccgccgccgccgcgtcgcctatcgccagcccagagagaggaaaagtgagacagagagaaagaggacgaaaggaaagagagatggtgatgacgtggcatgctgacatgtggggcccacatgagtcccacactgactcagtcgtcacgtaggccaaaatcggggagagccccaagtgcggagagttattttaatcacgtggatgtccacccgttcaatacatataatttaaatagttattaaaaacagtacctttgtgttgaaatggggattcagaaaatgtttctaccatattcttccatctgtcatccttcgttagtcacatatgtgcgatgaacgcagagagaagaggagcccagtccgagtgtctgaccgagcctgtaacgggacattttccaaattcccaacgtgagaacgatggggatagaagaacttttgattgaaatcaacagaagaatctacgggattgcaacgtgtcaggaacctgacgttgctgggtgagctacaggaagctgacaacgcgagggaggaagaacagacttatgctggaagaggagcaagagttcgtaagtgtaacacgcgtgtgtgtgggccggattggaccaaatgagtaccaaccgagcccacgagtaagtctggagtaagagagggagagagagagagagagttgaattgtaataagaacagagcaccctgactttctttcgtatcgatgaagtaagaactggaggcgaaggcggcggcgataccaatcctgctggattcggtgaaactatctcgtttcttgcttgttcttactagttcttgagcagttgagttagggttctaacaatctggtatcagagccttgccgttctctcatttcctggattttgctgcaaaattttttcccggaagaggtgggaattgttgcttcggtgactaattccgcaaaagcttcggctccctcaactgggttagcgagatctagaacgagacgtcaaccacgggcacttacgagaaacctcgctatgtcaccaagcaagccgcgaagatcatggatcaggatgggaaactggatcttcttctcaagaagatggaggaggcggagaagaagcgcgaggaaagtgagaagaagagggagcattccgaggagaagagcagggctgagctcatggcgctcaaggcagtggtagaatctcgtttcccagctgtcgagaagagggtggatgatctacaaggttcggtgaaggatttgcaaggcaaggtggagcagctgcagttggatgtacaacaatttcctcaagagcaacctgctattgcttctatgctgaatcaaacaggtgctctaaaaacctctattcccttccctgatgtgactgatttggatcgatccccttctgatgtagcaaattctgttggtgtgatgggtttggggggtagtgttccaccgatgtcttatcctcagtttgatggtgttaatcctcaaatgtggaagtggaattgtgaagaatactttgacatctatggagtacatgctaagaattgggtcaggatagctggtttgtactttgtgggtaacgcagccttttggcttcactctatgcggtctaaactgtcgggagttagttggccagtttttgctgaacaagtttgtgtcaaattttctaaggatgactaggaaattcttatcaggcagtggattcatcttgtgcaagatactactgtgtctgaatatgtagaaaaatttgacagcattatgcaccaactgttggcttacaacaattcactgcctctcaattattttgtgaccaagtttgtggaggggctgaaacaggaaatcaggtctgcagttctgacgcagaaaccacaagatctggattcagcttgctcactggctttcttgcaggaagaaattttggaaggttccaagtctgtcagtcacaaaaagtctgatcagcctattcttgtcaggaactctttgaagtccttctctcctcaaggctattctaattctgttgttaagggcacttcatcagccccatccgatgacaggagagggtctgacagtaccagggctagagatgacaggctagccgctctgagatcttatagaaggtccaaggggctgtgttttacttgtggggagcgctggagtaaggaacacaaatgtgctacctctgttcaacttcatgtaattcaggaactattggaaaccttgagtcctaattctgttgattcagatgagcaggaaatggaagaaggtaacctgatggctatatccctgcaagctatcagtggtactgagtctgctacttctttcaagataaaagggtgtattcaaggaactgaagtgctaatgctgatcgattcaggcagttctcattctttcttggacacccaagtagctcacaagttccaaggtgttcagtcattatagaaggtgatgtcagttaaggtagcaaatggaggtatcatgttatgttctcaattgattcctcattgtgcttggtgggttcaaggagtaggtttccattcagactttaagctgttgagtcttggagtttatgatgttattttgggtatggactggctagtaaccttgggaacaatgaatattgattgggctactaaatggatggagtattagttggggaacaaaacaatcagaattcaaggaattcaggctcagactgaacactgtgctcccatttcagtggaaaaatttcaggaaatgctaaatctcggttcagtcatgcaggtctttcaactgcaacatctacctccagataaacttgttgaagttcccctgcaattcaggcctcttttatctgaatttcaggatatttttgctgaacctactggtttacctcctaagagagcgtgtgaccacagaattcctttgttgcctaactccaaacctgtgtacatcaggccgtataggcacaatccagcacagaaggacgaaattgagagacaggtgaaagagatgttggcctctggggtgatcagacctagcagcagtgcatattcttctcctgcacttttagtgaaaaagaaagatggtacatggagggtttgtattgactatagacaacctaatgccataactgtcaaaggtaaatttcccatgccagtcattgatgaacttttggatgagttatctagggctcaggtcttttccaaattagacttaagggcagggtttcaccaaattaggttgcaggaaggtgaaagcataaaactgccttccaaacccatactggccattgtaagtacatggtaatgtcatttgggttgactggtgctccacctacattccaagg

SEQ ID NO: 68383 - DNA, 919 bp, Oryza sativa
ccacgtaataaatcatagttataaccattttgtagatctaataaggttaattctgtttcaaatttaactttttctgctgaagaaaggttggtattacctagtgcagcgttaatcatctgtcgccgagttgcattatctgctaaggctaattgtgctttatcaggcacggcattttgtgctactaaattaccattgatagtggttaattcggtctgaatcatttctaattcagtttctaaactcgttaatgctttttgtaaacgccaatcgaacttttttccaacatatcaactgttggcacaattacattttttagtttttcaatattcgcttggctaatgcctaatgcaacgctcgcgcctttaatctctttcgttaaatcttcattatcatttttttgttgagcaattttctctaacaaactgcgcgtttcttctaagtgtttcaccagtgcattattgctatcgttcttatctagcttttttgcatcattaatttgcatttcaatcgctttatagcttggtaattcagccgcaagtagcacactactacatacaaataaattcagcccaaataagatgacatttcgcatcagtttcataattaattttgccctaataatttagttaatgctgtttgcacttgttgtctagcaattttaatgttgccctgttagtcataatcttgaatatttaacagataatacgcgatccacaacttaaatttttctaatttatcggttaaccaagcggtcagctttgtaacattttcagtaaaatcaccattattaaattgaataatcgcaaccggtcgctggccaaattcactatcttctttgggaaaaacaaatacttgttgcacccaactggattgataaatcagctgttctatttcttctggctgaatattttccccacct

SEQ ID NO: 68384 - DNA, 657 bp, Oryza sativa
ttgagctatttcctgtaactgaaatggtttgtgtggccttgttagtccttgtagtttaacatttgtagttgtgatgtactgtagtgtccatgagatattcgtctatttccttgctggttgaatcttaacataaaattgccttgttacaactaactctgtacctaaattgtctccttgtctatgacagactgtaggagaaagttctctggttcgttggatggccttttccagatttaccaaattgcattaagtggagttggtggttacaaagtttcttcagaggactcattgcatttggttgaagccttaaggttcgtttgttcccaccagtgctttagtcatttgttgctacctttgttttggatttgatcaaaatctcaccttacatgttcttgcactcatcagtgtggttatcacgactctcccaccagaccatgctcaaagagcattggagttaatctgccaaccagtaattaatcccttgcaggttagtattgatcttttacagtcatttgatgatttcgattttatcaatgctaatatagtatataccgatataatacgaaataatccaagctggagatgcactgcttgatcaagtttctgttcgggaaattaaccttgcatatagaccgaatatcatgcatttttaggtgg

SEQ ID NO: 68385 - DNA, 520 bp, Oryza sativa
ataattggttccgtgcctcgtgaaatcgtagcccaacgttggtagagttcgtcggtttcgcacactttattagttgtcggtgggggtttgcttttttttttttttacaagcagttgttaattcacggtaaatcacgatgaggaaaaaaaaacaggttatctgcggtgccggcgaaacgcggtggaggtggtgttgttgctgctgcatcggcggcggcggggagcgcgcaatttggcgccggggacagtgagaatccatacgaggtagaatgattgggttattgggagtggctatgttcatgtttaggatcagccttcgttggtgatcaggtgattcaatgattggatgtggctcctggtcttgatgggatggatggtccctgtttgttagaatttggggatcaatccacttgatgggttcaaccatgtgaagatggcctataagcggaggcgaaaggattcccatagcaacaaaaatgccgaacacctgttaaggtgggtttgggtcatgggggttcaga

SEQ ID NO: 68386 - DNA, 607 bp, Oryza sativa
gggtgaacaaaataagaccaaaaaactcggttagtagttcggctcagccatcaacagaccaaaaaattttcgacaaattcggtcattagtttcagttatccgaattacccgaaaagcccgaattgtgatccaatagtcctagaaggcttaccaagttcagtagaaataccaaaccttagaggccagcagggagggagtaagtcaacctcacgccggccataaccagcgctgcttccaatccaacccatccatcacgcggcagccgccgcagcttcaatggcaccgcagccgcttctgtctccactctccaaacgttcgtctccactttcccattgttgcttgcatagagtctttgcaacttgtcaaattcagtcaaaccgagcccgagaccgaatttactggtcgtgagtttttttttacgaaattcggtcatgagtttccaaaaccgaaatgaccgaaaaccaagaccaaatttttcggtctgaccgaacgcccacccctagccttctaggcctccttccgattgtaggaaaaagaaggaattttgttcttatggattggatcactgtagttttatatttgcgtttggctatatttaagttaagaa

SEQ ID NO: 68387 - DNA, 893 bp, Oryza sativa
ttttaagagagccccttgtgcttatttccacacctatcagaaaatttttggagctagttcattgccgatgatacagtatgttcatatggagtccatgtttagaataagtttcttcacactctctggttctgaacttggttgatctttttttagtttcacatttatacaaggactaggccaacattatttttcttttgagtcacaatatagaatagtatgttaatactcaacggcaaagcataaacagatccattgtgagaaaaagaaatttatatatgtgttattctttcatgagaaatatacatgttgaattgtggctattttttgttatgtgttggtgaaatgtttggtgcgagttctctggttctagatgtaaaaatcgaaaatcatagtgtggacattttgtatatacttctgtaccaaatgtttggattagaactgtacccaagtaataaaagtgcatctggaagtattatataaaatgctgtttggagctacctatcaagcaattctacatcatggtattctgtgtctatgatcgatgaatccatgcatttaacatgcaatactttttgtttcattttctttcactcatctagaaaaggacatgcatttggaggaggatgaacaacttgcaagagctatccaggaaagtttgaatgttgaatcgcctcctcgtgctcgtgaaaatggcaacgccaatggtggcaatatgtatcaaccactgccatttatgttttcttctggattcaggttcattttcatttttcttactttagtataactagatactttgtagtagatactttatgtggacatgctattttgggttcattgatgttgaagtgccacataactactgatacgagtattcaccataaagcagtataata

SEQ ID NO: 68388 - DNA, 763 bp, Oryza sativa
tcctctaatagagagagtgatatagcacgagcgatatcttcattgtcaaattctgacgggacatcctaaattgaatttgaaaatagatcagctacatagtcaaaagatgtagattcccattctttttaagcactaaataacagatactactacaatggcatataagctcattatatttggaagcaatttgtgtcatcctgaacctagaggcatatgcacaaaaaatcagtggtatagtttttgttaatacttaattcacattgaccaatcaccaaatcacctgaaactcaaccaacaaaaccacataacagtattacagataagaaaaattatgtttatatgacctactaagcaagatagcaatgtgaagcgatgatgtatttttcagcaggggaaattgcatttgtgcacctccaaattcggagattagaatagtacagatttacaccaacagaactggtaatagcgttatgctctgcatacaaaggaagacataaaacacacagaattgttctccctaaccagggtaaaaaatttcttgttttgtacaagagcgtcaagatatagttacattttacactgtaagtggcgtacatacaccatgctgatgagcatgagaagtttgcaagagttgcaattgtgagtacataggtgcaagactggttgggcctgttgcctcaacttacaacaatgtacatcgtcaatgacaagttgacggagatcagtagccaacaatagcaagtcgagttgaccaaatgtggac

SEQ ID NO: 68389 - DNA, 680 bp, Oryza sativa
ctttttgtggcacggcagaagaaggcaggtgacccgctcccccgtaacaccgcggggaagttggggggttaatccatctgtttgcagcttggtaaccgtgtaataaactaataacactgccttaaaaaaacgaaaattttaaaatgggttggagcatccatggttgatagaggagaaaatggtgagaaaacatgtattcgagaggatttgaacttaaggtcaatgcattagatccggtttagatgggattaaaagtaattttaagtctctatcgcatcggatgtttgggcactaattataaatattaaacgtagactattaataaaacccacctataataagtttttggatctaaataccatcttactctaagtagctgtcctatcaccgagctacgcgccggtgcattactccctctaacttgacgctagatctgtttgttcctgtaagcgaatacgaccgtctaattgtgaattagatgaaagtttacaagttatcgaataattatctgaacagatataaataaaatagcgtaactacatatttaaaatcaaaatacccacttcacaagaaaggactagacagcctatacatccttaaagttgtcatttgtttcttttcccttccagaaagtcaaatatgcagttttgcacggaacctattcgcttatatcggattgg

SEQ ID NO: 68390 - DNA, 509 bp, Oryza sativa
attcgttgcgttcgtacgcctcgtgcgctcgtcagggggctcgatcggaccacggtgtagcgcataaaagttggatctcttcctctttttcttttgccctttctgcactttgcctgaatcttgatctgaatatctgatggacagacacactggtaagaacttcagaaattggcatgtttgcaatattggcctgtttagatcgcctggcaaaattttttcaccctgtcatatcgaatgtttggacacatgcatggagtattaaatataggcaaaaagaaaaactaattacacagattacgtgtaaattgcgagacgaatcttttaagcctaattgcttcatgatttgacaatgtggtgctacagtaaacatttgctaatgatagattaattaggcttaataaatttatctcgcagtttacaggcggaatctgtaatttgttttgttattagactacgtttaatactttaaatgtgtgtccgtatatctgatgtggcacgtcaaaattttt

SEQ ID NO: 68391 - DNA, 1456 bp, Oryza sativa
taaagtccgtgctacagctggctatagatatgtagcccactgctcttctctctcatcttttatctcattaaaatatgtttatagctggctaatagtctgctattgtacctgttctaaggttacagacggcttaggcatatgaaccaagaaaatttgtgagacaaacagatgaatcatgaagagctaaccactcggctgagagatatatctcattaaaatatgtttatagctagctaatagtctgctattgtacctgctctaaggttacagccggcttaggcacataaaccaagaaaatttatgagacaaacagatgaatcataaagagctaaccactcggctgagagataggctataaagatctatacattcagcctggttatattatgattcttgctcttacgtgtgctcgatctgtaatagtacactgcacgatcaattgagatccagtgcagtctattatcgcagtcctgcttgcgttgtctataatctccaagtgatcatatagacgctagcatttggctgtttggttcccaacaatattttgctaggcatcatttgtcaataaaaattaccacactttatctaagatgaggcgatcaactttttagacacaatttacaaaggttgagggaatcttgtcatacttttagtcattagcacatgaaacccaatttattataaaggaatcttgccacaactatagttacaaccgaacatctatcaagttgatcaaatttacctaaccttagacataacaaagtgtgacttgaaaccaaatattcctgcttagtcgcttacttctcaatacatataatgtctaaaaagtctaaaataatttatcatcacaaatatatactgctatttctttcaaataactatctatataaacaattaatgtttagaccatatgtccattccccacagcagtttcggttatgtcgattataaactgtaacagtttattagctataaaaaataatttataaataaaataagagttttaataattaataatttatatatatctttattaatttaaaaaaaatacccgaaaaaaactctagtttctctgccaagcaataagagcgttagttctctgttctggtctattgctatggtcttcacgtgttagattcagggtttcccaaaccgtcgaggccagggttaccacgccccggcggtaagcacagttatcgcgcggtaaccgtgaaaaaccgtacgaaaccacgcaaaatttatcaaaaattcaaattattttttaaatttatttgaatttaaggaggttaccctggtatttctattaccgtaccccgcggtaaggccagtaaccacagtaaccgcgcggttaccgacggtttgggaaactctggttagatttcatgctgagtctggctctcatgtactcccttcgtcctgagttcggctgtcatggaaaccatccgttcaaaaaatt

SEQ ID NO: 68392 - DNA, 1192 bp, Oryza sativa
tcttattcaaacaaatttatgtaattatcatttatttttttgtgacttgatttatcatcaaatgttctttaagcatgacataagtatttttgtatttgcataaaaaaattgaataagacgaatggtcaaccgttggttaaaaagtcaacggtatcatacattaaaatatggagggagtaatatgttaaacattacaaataaagtgtacatggataagtgatagaacattgttagctgttagagctgacatgagggcttccttagtgggacacatgaatattcttggtgtttcatgtgaattgttcagtttcacgaaaatcctcaataaattctctgatgaataatacttctattgaatttgttacttctagccgtcggggttcaaattattgaggattcgtaaatttggaagtgtcacatgtataatccatattatccgcataagctggttagaacagaatttttaattatctttcaactttttaactttttatttttaaaataaactcttccaaattttttttttaaaatgggaaccttttgatcaaccatcccgcctgacgtggacgctgctagcaatgggcgtgccaatcttaactagcgtgaccaaaagaccagatttggttttggagtgtttattttaaacaaaataaaaatttagaaggttcaaaaaaagtttttaaaatcattagagcatcccttaacgatagcttcccaaatcagctctgaaagggatatgtctcatcggatattagattgttatattttggaacgacatagtactcgtaactgattagaacatcccttaacgacaacttcctagatcaagtttgggatcaatttgcttggagctgcagatataaaaaaaaagacttggagtgagagcattactacgaacatttttcaagaagaaattataaacgtgttggaaataaaggggttgtttggatgggagggactttagtccctcacgggactaagggcatgtttggatcagggactaaagttcacatttgatgtttggacactaattagaagtattaaacgtagcctaatgaatctataaccttgctaatttgcgagacgaatctattgagcctaattaatccatgattaacctatgtgatgctacagtaaacatgtgctaattatagattaattaggcttaaaaaaattatctcacgaattagct

SEQ ID NO: 68393 - DNA, 902 bp, Oryza sativa
aattgtcccatttggtcgaaaagaaactctccccttgatcctgtctacaagttgctttgcaacaactcaagtagatgagacaaattttagttgattaataactatcctcccgcgcgacctaccatgataccgacacacaaacttcttccaataggcagtttccaactatttctcgtttattagtttcttttcattttccatatccatcaaccatcagctcaactcatgtctcatatctttggttcccacagctgtccaaaatctctagcccacaccgtgttctgttgggaagcctcaactatgatgtcattcgacatcccagttcacataggactgtttcagaccatgtaatggtcatccagtagacatcatgaccgattttggtaacgatttccaatcccacaaaatgtttgtcacaacactttgcaagcaaacctatgctagaggaatcaccttccattcgcccataaccatatgcatggttgttcgaacagtttggtaacctttgcagagggtgtgcactttactcacaagatgtgatcttaccttatcactggccaagtagggggttcgcgacaaggcctttccaaagctaaccgaggatacatcatgccacacaaaagggttctctctgaatcgagtatcagacaaatctcgaccatcttctatctaggaatctaggatgtcaccaatcaaccgtgcccaacatgttaaaatttagggaaattttgctacaggacacttgttatgtgtggttttagccctagaacactgcccaaacccacttttgggggaaaacactccataaacgtggtaatttgccagtggacaccgcgctgattaaaataatactttccggttgggaaggagaaagaaatcgcgtgaaatgtcaaaaatgccct

SEQ ID NO: 68394 - DNA, 733 bp, Oryza sativa
catccccctgtggagattatgggtaccccatacccacacggcatggttatccgactagttataggggataacttatatatatggaatatgtaacagatcatgacttgggtattacgtttccttatatattacggaacagcctaaagtcctagtttgataatattgtaaagtagatttaggaaaccgataccgtattggttaaggtttctatcttgtaatcctgccccccaccctatataaggtgggcaggaggccctctagggggcatgagacaacctgatcgtcagatctatactacacccggcggattcaaatccccaaacaggagtagggtattacctctcattgagagggcctgaacctgtctaaatcctttgtccctgcatccatccactttaggtctcgtgcgctacccccttttattattgccgaattcatgttttgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatactgatttttaatctcagattaatttcttgctattttttgttgttgttcgcatataactacgcggcactattgaggcgattgatgct

SEQ ID NO: 68395 - DNA, 597 bp, Oryza sativa
ttgtctttcacaacccacccacaatgattcacaaactttcgtcctatacccgtcggggctactggttcgccgtctggggcaatctcagtaacgatgtgccttccctcaagcttcatcgcgggacctcttttcccacgtggcctcttctgtccggccgacggttgactatcaatcccctcctcggtcccctcctagttagcctcctggttaccctcatcgttgccctcctcgttcaggtattggttgggatcctcgttcccctcatcatccacccagtactgactgctgccatctgcgatcgtgtctaacaggatttgttcgtcatcgcggtctgccatctatgcgtgcaaagaaaaaaagacagtgaggtcatggacatcaacatgtacagctcagacgtctaaaccctacaagtatacatgtataattcgctaagtcgttgttctcgttaagtcgttaagtcgctaagtcgtcgttctcgctaagtcactaactcgctaagacgctaagtcgttgtccgtcaaagtcgctaagtcgtcgttcgtgaaagtcgctaagtcgctaagtcgtcgttcgtgaaagtcgctaagtcgtcat

SEQ ID NO: 68396 - DNA, 1446 bp, Oryza sativa
agagaatccaatgtcgcctgcgcagtggttatgtaacgttagtactaagaaccttaacttcaaaaataatatacacgaaggatattggcctcttactcttggttgtgtgcgcacatgatgtactccttgtcttgatgggcccataaacaccggttgacatagtcaaccacctcagtgaagctctgtcgtaaattaacctcgttcaccatggatggatcaaagaacccaacctgattaccaaggcgacgactctcgatccaacacaaccttaaaacatttacgtattagaactaatttaattaggagatatagtccaatcatatcacaagtatagaaggtatgcacttacaaggagtagcattttagaagaccagtgtccaacttccggatcctgaaaaggtcgaagaggtcatcaaatcctatagttatataggcaggcgacgataggaatggctggtggtcatgatgtccaactatggatgactccctcattttccgcttggcattgcttagctccatgtattgcttatgtagctctcggcaagcaatacccatcacggctaacacattgtcctccaccaatggcatgctagctcaaattgggccggcgccctcacgaccttccccgctttgctcaccggcatcgacgtcacagccttgcccctttttggctccggcgccaactccccgaccttccccttgccgcgttcacgcttctggcccttgacaagtggtggggagctattggtctttcttgtggtctttattggagccaagctttgagctatatctgccaagtccatatcagctccaccaggagaatgaggtactgacaatgccggtccacggggagcctcaattgatagcttagacttgggaggtgtaagctccgtcggtcgacttggactcacaactatgtcttctttgggccattgtatgaacgtcttgcgcgcatcgcccaaagtcatgatttcatcattggggggcacgggcagcggatagcctaaccaggtgtcctttactgaatcgatggacaccttggcatacccagctagcaggtctgtgccgtggaccttgtctgtaaccaagggcttgaaagccatgccctcagcgacttcaggagcgaaagttgggtggactctcgccagtaggacacactgtgctgcgccctgcatatgtgaaagtttgaatttaatattggaacgtgtaaaggttttttattagatatggatcggataacatcaattacctcgatgtggtccactgcagctagtggtgcgaccgggagaccaggggctggcacctctgggatgcacaactactcctatgctgtgacggactcgcgtcgtgttgtgcacaagaagttgaatgcccaccaggtgttgtccctcagggtatattcatgtcggcgaggcccttgttaaccctttcttccaccctagcatt

SEQ ID NO: 68397 - DNA, 8308 bp, Oryza sativa
ggtaaaactgggagaagacccaaatgactggcgaaccccgtttgttaaatatatcgaaactggctggcttccggatgatgaagcagaagcaaagcgcttgcaaatcagagccacgaagtataagttaatctcaggccaactttaccgttctgggatgcttcaacctctactccgttgcgtttctttcgccgaaggtgagcaaatggcgaaggagatacaccaggggctatgtggcgctcaccaagctgcaagaacggtggcctccaaggtgtttagacaaggggtttactggccaactgtgttgaaagtctgtgcagagcagattaagaagtgcgagagctgccagcgtcatggctgaagtcaaaccgcgccccactatgacttgcagcccattgcgccaatttggcccttcgccagatggggactggacatcattggcccaatcccttcggcacgaaacgggtataagttcgccattgtggctgttgaatatttctctcggtggggccaagccgaactccttggtgcaattacttcggcagcagtacagaagttcgtgtggaaaaccattatctgccggttcggagtaccaaaggagttcatcaccgacaacggcaagcagttcgactctgaaaagttcagacaaatgtgcgaagggcttaacctggaaataaaattcgcatcggtcgcacacccgcagtccaacggagcggccgaacgaacaaatggcaagatcctggaagcactaaagaaaaggctcgagggggcagcgaaaggcaaatggccagaagagatgctatctgttctttgggccctgcgaacgacccccacaagaccaacgaggtttagcccgttcatgctcctctatggcgacgaggcaatgaccccagcagagctaggggctaactcaccaagggtggtgttctctgggggcgaagaaggacgcgaggtgtcgctcgaactattagaaggagtaagagtcgaagcactcgagcacatgcgcaaatatgccgtaaacacttcggcaacctacaacaaaaaggttcgaccgacagatctcttgcccggtcagctcgtcctaagaaaaaaggcgaacccagtggctgtcggcaagcttgaatcgaaatgggaaggcccgtacctcatcaagcacaaatcaaggacggggtcttttcggctggcaacattggaaggcgaggggctcgaccactcctggaatgctgcctccctcaagcgcttttatgtctagaataggtggcacccaaatcgccaacttgtaaaaatgtatatagtcatgtaagccattcggcactatgtacgcctcccggcaaaaaaaaaaggaaaaaaaaagaggaaaatgaaaaaagaaaaaaaaactggatgtagggttattatccgccatggaggcccgaaccagtataaaacctctgtgtcctctaccttcttttttttattgtgtgattgataacttgtggaaaaaccccaaggcaaacgcctgatcagcgaaaaagccaggggggcgaaacgaatcggccgaagcatcgctcgccgaacgttgaaaccacaacagcttgtttcggaaataactaaccgaacgccattacattcgatcagcatgaaagtaaaagcgtctatcgaaaacggaagacgaaagctggaaaagtcgaagcctattttgctaatgtatgcaaaggggccgacatgttccgacccaacgaaagcacgcgaagtgacaatgcgagaatagcgaaaaggaagtaaagcacacttttattgattcaaaaaaaaaagggaggtatcgaggattacaactcaaacagtgcaatatagatcacaaataaattacatcttcgccctcgtgtcccctttctcccctgtcggctaaagaatgatcgggcgaacaaggttcgtcgtcgctaatatcatacaccactctaaggggagaagggggcgaaacgcaaattatgccataacggcgccgaaagatcgcttcctgccgatcggtcttctgatgattccgccaaaagcgaagccatgtcgtccaaacgtcttgaatgaacaagatcataatcctccagggttcgctcagggtgactccgaagccacccagcaaccttgaaaaccttatagctgtgtccatttatcagcatttcacgatacacaggccgaaacgggcatcgcatcttcggcaaatcttttaaagccacaaatttctcgttttggtttcgccaacttccaaacgggggtcgaatacacagttttcggcgaataccctggcagataatgcagaaatggcaaaaaaccaatcgaatagtgagaagtaggcgaaagcataacaaggaccaacagtaaagggcgaaaggtaggtctgttatacatattttaaatgcccaacgacaacttagtctcggttacaataaaaaggttagcggcagcctgccgaatatacaacggttcgccacccctggcgaaccccaaaaaaaaactatgaaaatctaaagaaagggcggagggcctcacacctctgggtgatcctgggcatcacctccacccccttcggcctccacgtactcttcttcgcgaagctccgccgcctcagccttcgccagctgctccaaaaggcgcgccttagcggtcgagcggccgtccctctgctagaattgttttcgccacgcacgaagtgcgggcgaaatgtcttgtgaactgatttcccaatcccctttcgcgtagttggggaactcggcgacatgctcacagccgaactgctgtaggaggcccgtggtaaaggccgcggacacgcgcgcacagcagtcgccgtacgcggtggcacagtccgaaaccgaaccaccagcctgctaggtccattcggagaagtcaaaggcagaggcatcttcggaagggacacctcgcactttcgcgcccatatcggtaagagcaaggcgaagcgtttggcaagctgttcgcgcggactcggtagttttcaccatctcccgtgaaaaccgccgcgactccgcagcagcgcttgcctcggccttgcagacttcctgccgaagagcctccatcttcgactcggtaaggttgtagtaatccacaagcacggcggagtgggccttttctttttgcagttcggccttcaagcgttcgacttcggccctagcttcattccctttttccagttccaactggagccgcttgttttcggctttcgtctccttcagggtgttagccaggacctccatctcaagatttttgcggcctatttcgtcatccttcgcccgaagacggcttttgaacccgtcaaggcgggctcgcacggttcgctctgttgaacagtgagccgcaaggatctgggcgcaaaacaagagcggcgaagagagcaagtgtcagcaaaagcaaagataagaacagagaaaaaggaggggaaagacgtacccgaaccacaagactttttatagcggagcacccctcattgaactcattaagttcggtgaacaggctcggggtgccggcaggcatgattagattgctcaccccttccacaaaaggaaggaggtctgcccgtgtctcgaagtcgccgggggcgaagcggggcaccgcaagcgaatactctgacgcggacgtttcgccagccgctctctttcccttcgcctcagtcagcggcgatgcaattggctgacgaggaggactgccgaaaactttcgccgcggccgtcacgatcctttccgcggaggccgaagccccagcggcagtgctaccacccgctccagtgccgccaagtggaggagcgggagcggctgagagatccaggctgcggccagcgggcgaagtcagagtcccgtcagaggactcatcgtcgctaaaaactcgagcgatatcgacaagtcctttctttttagccgccttcttgacggggcctcccttcgccgccttgccagaggagaacgcaaccagagccttcgccacgtccaagtctttttggcgaaggggggagctattcgactccaccccagtctcgttatggccaggacttggagtgggggtataaccgggagtttcggcgcgtccctcggtcacctcgaccgcggcattttcgaccgcggtctccgtctcttcttcctccccctctccctcttcgccgtcaagttcttcgccatccttgtcgtcagcgtcagaatctgatgaaacaggagccctacgcttcctaggggcaagcttaacctgaccgcgcggccgcttccgcgaaggccctgcttcgtcaccagccttatggggattcgcccgaggaggcaattcgccgttaaaaacccggttcgcccgaccagttgcctgccgtgtaagcatttggctgtactcaacgaccgatacgtcgccgatcatcttacgggcttcggcttcggcttggtcaagggttagcactgcaaaggaaaggaaaggagtcaggttaaaaggtcaagcagagagagctaaagcgcgaaagtatatggcgaaaacagcagacttactgttcattccctcagggaggaccagcttaggcaagccatcaacctcttcgctcaggttaaccgcaacctgccatgactgggagaggggaaagatgcgaagcatgcagaactcctccaccaggtcgcggcagctgaggcgggaacagactttccttagcagggcgaaccgggcctccatagcgccatccacggcgatcctgggttttcgattcggcgcaataaccctgcgccgacaccgaagagctttcgctgaatcagagccggcctcgaaggggatggtgtggtaaaaccacctcgccatccaatggcggtcccacttcgacatggcagcattcgctggccaaaggtcggaccgttcggggcgaacattgaagttcacgctcccgatcaccgtcttcttcgtcccagccggagtaatcaccgtcttggagttcacggtggcgaagaatatggcgccgaagagagcagcgctaggttcgaacccagaagtccgacaagcccaatcgaaaattgagatccgaaccagcgtcgatgggctcaattgggggagctctacctggaagaggcgaaggatctccggcaatagcacgttgcacggaaaccgtagccctgcctcaaaaaagacggcgaaaaccaccgtccgattgtccacaggcttcggcaccacagctttccccggggcgaaagcctgccccgcaatcaacgccccagagctgactagtttcgccagctcgtcgtcatccacaagggaggcccccaaaaaggtggtgttatcgtcgtcgacccggccagggtccggtccgaccgcctgaacggggtttggtttgcgaggggccatggcgaaaggcgtgtgggccgtggcgaaccaatagggtaggcgaaacacctacggattcaagaaacgctgtggaaggagataacgaaggaggagagcgcacgcagtaaaagtggcaaagtgtgacggtgaaagggaaaggggtgagaatatatagcccaccgagtcgacgtttcgcataccctccaatcacaaagagccacgtggcgcgagggtaggcgtaacggtaaaatcccatcatccgaccagcacagtaaaaagcccattaagggaaagcccaatactgttcacttcggcccggaaaaagtaatgatattttatttgcaggaacagtacgggtttcggcaggagcatcgatcgaaagggggcgccacataccataccacatggtttgcacggtctcggccgaagctccgctctcacccttgcccgcgaggggcttgttggcggatggcatgagtcccttcgaccgaatctgccgaaacccatggcgaaaaccacgagccaaggatgatgcgaggcgaagggtcgcacgagtgcacgccgaagaaggacgacttcgccatgccgaagaaggacaacttcgccaggaccggttcgccccggcatccagcccagagaaggacagcttcgccaggtccagttcgcccccgcgagggccaaagtagccttctcggcccaccaagcatagaggccatagggccggcgatcgcccgatggcccatcaagggcccatgagcccccctttacgttatgtaaccctgtaaacgtccctttcataagggcaactatgtaaattcctcagtacaacctagaccctagaagtgagaatctgtaacggggctataaatagccccctagggccatgtaatacaggggagaaaattcaagaaatcaatatacttcgtttctttccaaccactgttaagtaaccacgtctttcgacgtatgcggttgtcgtttcgacaacacagttaatagcggctaaattgtaaatgagagtaaatagctagactcttctcaaacaactatgggcatcatcttttcacttatgcttatcaggcaaaatttgaattttcaatattaaatttggagctgattttgagatttttttcatcgaagtttatttttcagcctttgcttttagatcgctaagaatacgtatataaaagttttattgataaattatttttcgtttacaaataagccgtttcgcttataccgccaataagagaaacaatggcttcgtatgtctctatatacatatataatatatatagcggcagctatagccggaaatttaaaacggcgaggaatctaatctaacggcactttcaagaataacgccatactatacatacctgagtcatctctatcttgcttgaaatagaggaatccgagcagcaatccagccaacgaactcgtcaaggcaagagcaccttttacggcgccatggccgacgccgagatccctctgcgcggagagggacgggagcgtgagccgctgcgcgcgagtgatgaaattttcgatctgagatcagggggggaaacggagagagactcacgagggtgcggagagcgcgtggcttcgctggcctagtccccgccgccgccgccgatcgccgcgcctgcgcgccgcgtgccgagagcctccggtcgaggagagatgcgagtgcgcggaggaacatgggcctcgaaatctcgatcgatcggaggagacgcctcgatttctagggttttgacggacttcgctgtgggaggagtgggaagtgcggatgcgcaacgggtcgaacggatttccgacaaaatccgatcaaattttgtcaaatcagatatttaaaatccagtttgattttcccgtcggtttttttgtaaacacctgaggagggtcgcatgggccgtgcgcacgcgcaaaattgggccagtatgggcttctacctttccttatagcgcgcgccggtgcaacttggacatccacgtcttgtgctctgccgtgccggcgacggcggcggcggcgctgccaccgtgaaccgcgatggcgggcacggcgatgaagaactccttcgcgccaacatggccgcatggctaacgaccttgtcatgagaaacaccggtctagacctgatgatcctgttttattgtgaatatatacgccactagactattagtaaaaatgcataatttttacaggcaaaacttgacatttattagtacacatacatcaactatattatctcatattagttcttagcgtacacatgttactttggattttggagaaagatgccaagtagctttcgaatttctgtttaacaatgtccggaatgtttaaacgcgtacagttttgaaggcaaatactatgtgggaataataatatcgaacgaagcacatcccagaacatataaatcaattcttgccagtcttcagtacaataggaacagtagcagcagcctactccatatttcagaattcagacagatcctagtttctgataccgcatattgacaggaaaacatttacctctaatcacctagcaagtactatagagaaaaatgaacagaaacaaaacttgatattggacaacttttgtagacagtggctctaatcatagtagtcttcatctgtcagaagaaaaagagaatgctttcattagtaatcttaacaaaaccaccagtagtccattttaggaagagagaaggatagatctgatatgaatagaagttcaaatttaaacttacgtgcttcctcctcttggttccagtcatcatcgtcgtcatcaaactcgatattctacaggaagttaaggtattagagtgctaaagagatgataaattacaattccaaaaaaaaaaaaaaatgattcatatgtgttccaacatgtgaagaaacatacacaccacatcattttgccaaaaaatgagccatctaatagccgtttttccacataaatgaaaacctcaaggtgtaccgggc

SEQ ID NO: 68398 - DNA, 863 bp, Oryza sativa
tcatttcatcaaatatcagtgcatttatgttgaacactatccttgttggatgaaagaaatattcttacttctctgaaatctgatacgtgtgccaacagtcatgattcccaagaatagctgctttggggagctgaagatctgaaatgcttttaacaagttgaacattctcgttgccataatcacctgccataaatggaggacagcaaacaggagatgtaaggaataagcatttaagtgtaacttcacaaagtaacgagtatattatgtagtacagatataatagggcaaagggcgcacctgtaaaaagtaccaaatctggctgcattcacacggagagaaagttagatcttctgggaataagaaacataatgttatagaaaataaatgtagtacggatatttttctatcaaactccagtgtcattttggcagctggactgtacatcagtacatgttgatggcaggcatacaaaaaggcgtagaacatgaataaagaaaaggacagactgcacttcagatgatcttacatcataaaactagagacatgctacaataatcagatgtgaataacttaatgcaatacacagatacaattgactgaatttatctggatttgcaatacctggagaaaatgtagggcttttgagtcttcctcaagggtccaatcattatgctgcaatgttcagcacatcacaacagccaattagtgcattgttctcatcaagaggatattataatcccttgagccataattgatgttataaccaagtcaagcatgcaaataaagtaaaagccatcatattcctcttagtacaagaagtaaagcacatctcgacaggaaagcgagctaagagatttcaaacc

SEQ ID NO: 68399 - DNA, 31796 bp, Oryza sativa
taattaggaactaaccaagaataattctcacgaagtaaatcttaattactcagaatgatatttctattaaagcagaataattaacaaagtacaagaaatagaagaggattaccgaaaactccgaaattcctctgacttcttctattttactatctccctaatttagtatacaatatagtacaatgagcctcttatatttcagctcaagcttggagtgtgtgtgagtgaagtgagaatgggagctctatttatagtcaggtaatggcggttataactatgtgaattgtcggaattgcccggcaaccgccatcaagagagcatctggagcgtccataccaaaacctggatccaatggtgatcaccagggctgaacctggattgggccagatggctcctagatttggtctgggcctctttctcactctgccttatccatttctcctgtagttgggcccattttctgatgttttgatggagtttaagagcccaactcttgtatggatagaattcttattcactttagtctaaatttcctcccaactttagtggtttagtacctgcatccaaatatgcaccaacactcgtggaatatgtcagaattaagccctaccactatgttggatgtatcattatctaagtattatgcaggtattggcggcataaaactagcatttaatagctgccaagacagagcaaccgctgtccaccacaccatgttgccgccaaatccgcaccctcccacgcgcgcccgcacgtccaagcgtgtggaaccgggtcccctccacgtactttgccattttccccactctcgccgcggagataggcgccggtttgcctcgacacgcctcacgtcgccgcccccactttaccggtgacttccgcctcttccagcctcgtatcgcacccctgagccctataaaaaccctccccagacctccctcctcctttttccccacttgcctaagctcctcgcgctctctctctcgtgctccccacgctgctcgccgcctccgccactcaccggagctctctggctatgcgtcaccgctagctccgccatcccgagtagaaccacggctgccactccaattccgcaaatcgcaactgggtcatcctcttccccatgctaccgaggccgccgccgcattcgccacttctggccggcgatagccgtcgaccggtgccaccccaagccatgccgtttcctccactggctctgcagctttaagccgcacctaggccaccacttccccgccatcgggagcagctgaaaccctgcccttatcactaaaggtgagctctacccagtaccgtcaccaccagctgtcgtttctagccgcgccacgctgtttctcctctccctaatccctcctactccttccgcaggtcgagggcgacctcgtccacccttcgtcctcgtgaaccgccgctgccgttcttcgctgccgctaccgttcttcctgccaccttctcgccgtcgcaatggcacggtcagagccatctccccctctcctcttgcccgtcgccctcaacgcgccttctcgcaccgccgccgctcgctgccggagtattccaggccgcgcgcgcgccgctaccatcggttggtcggcattggccacacggtcctctcgctgcgccgcacctgcccgttgctgcccgatcggtcgccctggccgatctgggccgtccacgtggcgagcccgcgtggcaaagccgtgggccacacgtggactctgtccacagtggaccgttgccccttgtgccactgccgcgtggggcccacctttgatggactcggtccacacccgccccactgctgatgcaataacctctgaattcctttaataaaaataattaataattacgcaataaatcgaatttaattctagaaattcatttaaatggctcaaaacttctaaaattcataactaattcatacgaactctaaattgggccattcaacttgcagaatttatctaaaattgagctctacatgtttgtttacttttcatgtactgtttatttggttttattagagtttttcctcattttgcgtgccggcgcgtagattctgcgtttcggaagatcgcctccgcgaggaaaacagttcagaagattgtttgaagaagcaagacaagtcaaacattctccttgagcatgttgaacctaatttacaaatgctttaccgttcgcaaataaaattgcatgttttgctaattacatgggaatagggtttacctatctgctcgcttgtaccatatttacttgatatccgccctttgtcaattttgggtgataatttgactagttcgtgtcacttatgttgatcttgctataatcatgatatgcttcgccatggttaattaccaatatctcacataatgggataattacattaacattagcatcttgatgagctgcaagctcgagatatctggccatggttatttggtcataattatccaactaaaatatggcttaatggtgggctatgggtgcatggttttgctagtcacacccaaggaccggtttgcgggaaatccctggaagacttaatgtgcttaccacaagcaagtatgggcaattgctggacttgtaatatagctttcccctttctgatgttcccaggcaagggtgagcgtgatggagttcggaggagccctacgacggtctattaggctatcggatttacctaggcacgaggggaggctccctactatcggtttaggggtgggggcgaaacccgaggtgtagtgctttggttagggggagttatacgaagggtcttgtcacaatcactcaacatggtgacgtgtccggccgggtactgtaacatgccggtggcttgtgtcttatgggtactgttgtgcacctctggccagagtaaaactattcgaatagccgtgcccgcagttatgggcgatcgaccagtttcaccgtgattagtcccactttattaataacctgacataatgaactggtgtagttaaggtggtttggttgggcctgttcaacatagtgtagcgttgttcagtggagatttaatcctgcctttcaacaataaaataatttaccaccgcctttatgcaaatagccacagacctctatttgttacccattgcacgcctgcatcattggtgtggcttgctgtgtacggtggttatactcagccctgctattatacccccttttcagatttgtagtgcttctgagttggtcctctcccttttcacttaaatggtccgcacgcgaaaatgagcatattttcgcgtacggacctattaagagagccgcacgcaaaaatacacaccctctcttttcctcctacccactttaaataattttgggaaaattggaaccatgccattataattttgcaaaatttgagatatgccatcctaacccacatgtcattgactcatgtgggtcttacgtgtcattgagataccgatggcatatctcaaactttgcaaaattacaatggcatggttccaaattacaatttaattttccccactttctctcctctcctctctgtctttttcttccctcctttcctctatcgtctctatctcattttccccgtcctcattttctccgagtcccgacagcgtaggcggcgatcgtccccgcatggatccggcggccggccagcctctcccccttaggatcccgctcccctcccccgttccttccctcaccagatccggtggaggggaggggcgtcagtggcggtgtggccagaggggagcgcggaggccggcgggcccggtgcgcggatccggcggctggccgccctccccccgcgagatccggctcccctctcctccccttccctccccttccttccctccccagatccggcggagtgggggggggggcccgtcggcagtggtgcggctggaggggagcatggatgccggcggcaagcggcacggaggccgccgccgcctctgacgagggcgggagtggcgtccttggccgacgaggacgacgatgacgatgacaaggaggaggaggaggcggccgggagcggcgacgccaccgtcggatttgttttgttttgaaattttattttttttggttttttattttcccgtgcgggcgacttaagcacccgcaagaaaaatcacgattttcgtagacctttcggtatgtgcgggctgcccacccgcacgtgaaaataagattcgaccgcacggaaaaaccattctcctctaggccaacaacagccaaatgccacctagggtgttgcttgcaactcacatttgcccaactctggtttactggggatttaggggtttgtagacatcgacaccttgttgtcatgctcagggcatttcacagggcatttcaccgaatatatcatgctcatcaatgtattcagcttaagttcgatgatcatccttgatgatatattctctacggactaaacaaatgctggaacgaccttagacatattaccacggatttatggatgtcacctttgatgtaaagacccaataccaactacttgatgtacgtctcttggaataggttagggctgtttcccttaaaaaaagaaaaaaaaagcttaggggatttgtttcaagacaattattttttatttttatgaactccaatgtaatataaaataaatatattttataataaataagataaaataaaggtcaacttatttttaagaggaaggaagaataataggagtacgagcacaaatgctgtgcaggttgctcacatgtcaccttccgctgtcatttctacgcccactctctcttatcttgacttcgccgacaccccttgctgctagtacgcctctacctggacccgcacagtagtctgttgtcgtcctcgatcggatcagctaccggctttccgttgatatctccgcgcttgatggccgccgccgccgcggtcgcctccctcctcggcttcgtcctcgctctccctttctgcttggcggcgccgtccatcacaacgcatggcagcgacggcggcggcggcagctacgtgtcggcggtcggggaccccggcatgcggcgcgacggcctccacgtcgcctgggaggcatggaacttctgtaacgaggtcggccaggaggcccccggcatgggcagcccccgcggcgccgactgcttcgacctcggttggttcctccatccattgctcttctttcttctaatccatgtcgcgctcgcgagattggtcaagttaattggtccgtcgaattgacagtcagagctgggaaattcgcagagaatggcgtggacgagaacggccagccgacgtacaaggtggtgcaccgggtgaccgacgccgacaacaacctccgcgccggcgaccctctcccgggctcgccggcgaacatcacggacgtcgacctgtacgcggcggcgaaggagctctacctgggcgaccggtgccaggtgcccgacagcccgtcgccgtggcagttctggatggtcatgctcaagaacggcaacctggacaccaccgccgccatctgcccggagaacggccgcccggcgcgcccgttctcgcagacctcgaggttcccctgccccggcggcgccggctgcatgaaccagccgctcgtgttccacaaccgcaccgcgctggacgccacggcccggcgcctccgcggcgggctgttcggcacgtacgacctcgacgcggcggacctcggcagcagagaagtgtcgtactactcggtgacgtgggagaaggacatcgggagcggcggcgacggtgggtgggtgttccaccacaagctgcgcactgcgcccaagtacccgtggctgatgctttacctccgctccgacgccaccaagggattctccggtggataccactacgacaccagaggcatgaccaagatggtactacctctcttctgttaaaacttaaaagtgatgtccttttcattttcactttcactgaactgaactcaactgtgtgtcatgctcacgtccaacttaaattccagataagttttcttcacctcacggattcaattttcagcaaaataacatgtgattatttttatatattcctcactgaaaaagtacaaatatgattgctcttatacgattggtagttggtatggcgccttctgtattagattcacagaatattgtagcatgtcgcattcatttggtactttgctttagcgtgtggagaagcagggatttgtcccatcctccactacgttttctttatggattttgggtggactatgtccaaatttattatactaggatgcgtcacgttcatccaaaattattttgtgagatggacatttatggtgtctattattctaaagggttttatcatatctggttagtcttcatatttgaactgtttggggttattcactttgtagcctatttcaaccttacggtttaaatttggacattatcaaattttgttagtgttagatatatatttggtttgaagccttaccaacttttggtagaatttttaagagtgcaaatatctagaattatcaaaatcgggtaatggaacattgataagaatatatgtttagtttgttgaatttggtaaggctaaaatttggtagggttaaaagtggtacaaaagaaccctttgaatgcatcttcaagtgcaaaggtcagaattttgtttttttacaaaaaaggttgaaatgaagtccttttggatggagaaatgaagtactactagaagtatatctgactggaaaagttgcaattcgatagactgaccatgtcagtttcgaaataggagtaacattttttttcgtgaccaaaattagtagccttgtaagatcttctgactaaaaatgtgtaacgccaggtgccggaatcaccaaacttcaaggtgagggtgacgctggaggtgaagcaaggcggaggccccaacagccagttctacctcatggacatgggcagctgctggaagaacgacggccggccgtgcgacggcgacaccgcgacggacgtgacgcggtacagcgagatgatcatcaacccggagacgccgtcgtggtgcacgcggaggcgcatcgaggagtgcccgccgtggcacacgttccggaacggcacccgcgtgcaccgcaccgacgcggcccgcttcccctacgcggcgtaccacgtctactgctctcccgggaacgcgcgcgccgccgaggagccgaccacctactgcgacgcgtacagcaacccgcagccgcaggagatcctgcagctcgtgccgcacccggtgtggggtgagttcggctaccccacggcgaaaggccaggggtggatcggtgaccccaggacatgggagctcgacgtcggagcattgtcgcaggcgctctacttctaccaggtactcattccgtcccaaaatataagacctagaatcgtagatgagatgggatattttctattgttacgaatcagaaatatccatctgaatttagattcttatattgtaggatgtagggagtccattgcatttgtgcagttgatgttttactttggttgagaaatttcaatgcagaatgcagagataggaagtgatcgttcttctttttagcaaaatggaaaggattttgggtgagtgtgattgatgttgttttgcaacatggatgtaggatccgggcacgccaccggcgaagaggaggtggtcgtcgctggacgtcggaacggagatatacgtcagcaagtatgcggaggcagagtggacgctgagtggattcgacattgttgtgccggaggaatgcattgggtcgtcccaaggaggacccgtcagtcgatgtttgtaaagttggtgatcaacgagttaattaagaaacacttatagattcattattggaataatatcgtgttcccttccctcttttggtgtgtgcttggcacatgtctgtctttctgggaggaaactccaaatcgaacgtccgattcctccataaaaatcagatggaccaacggatgaaacattaaattatgcacgatgaaaaaaaattattaattgaaacattaaaaattgtgaaacacaacaagaacacacatgttggaacttgtcgttatcatgttggaactaccgatttgtagtgttcttcgtctttcaagtgtcttaagttactggccttctgtgggatgggccaagatgagaaaaggagagaaggtgatattctcggggcctagaaaaatggtcttcgagaaggcaaacaagcacaggccacggccaacaaggtaagagcagcaatgctggagccaagggattagcatggacggtgggcaagacagcggtgtcgtgactgacatctattgggccttcctgattggcggggcgggggcgcttcaagtacaacaaaactcctgataggtatcgactcaagtgtgccaattcatttaaaattgacaccaatagaaacaatacctatgaagagttctcaaccgacacctataagggttcatatagtagtggctgctcatcatgggaggcgagtagtggttctgggaagaggggcagaggagagggaagggaggccgattttgtggcttagttggtgctggaggtcaaaaagggagcacacatgggtggagtcttcgtcttattttgaaaagggacaagttcatttacacccttaactcttgtctttatctaaaattgaactcaaactctaaagttgtgtatccaacaaccttgttggtattttctacgcacacagataaatcctcaagcacacggataccactgtagcacttgccttgagagtattctaagggtattgagcacaagaaacgtgtgtgtatatctaataacaggattcaaccaaggacaacaactaaatagtaggcttagaataaagaggattcctatggattcaactatagctaacttaagttcccgcaaaaaaaaaaactagctaacttaagttaaaggtaaaactctatcaaatgtttcgggcaccgacccttccctagtctgtcaggctaagtccggtcttaagctctatgatatatccgaacgtggagagacacaaaggatgaacagggttgtcaccacctgtcgtctaactcactttccgtggagcacacaataaacgaagataacctctaacctagacactatgtctacactatcagaggaagcaaaggcggctcggccgaccccttaggcccacctcccagcctctctttcggctgggaggctacttgatgggcctccaatatcttgtactttggttgggctcaattttaggtggttttgatggatatgtgggcccttcaatccatgtaatcatgtcctgattgttaagaggtgtattttgtcgcatggcgggtggtttttgtccataattcacctgcataaaaatattcaccatgacttgtggaaatggttaataataactactacctctaagtttggtatttcattttatattcttttatttgcttttatgcatgatttgatggtcgaatttggtacttggagaagaacaattgttgttctgttcatgaagttcttggataattctacattgatatgtaggcttttagcatgaaaggcatatatatttggaaagcttatcaagtctactttccaacggatccaatggcacatcattcagagttttctatcaccagtaattgtaagttaaagacatgttgcacaagcagcggcatcaaagttggatgtgagccttgtacaacatgtttggatggggttctattatcccaaggcccatcttgggttggtatggagtctatttacaggttccctacgaattgaagccttccaaaacaagaagtttgaagataagaaagaaaagattcagtttgaactcggtttgggctagcttggacatacctggactaaaatgcttgtttctctcttgtctggagtctgttttggacgtgtgtgcacttgttggaaagctaacttcatgacccaagtgacggaggggccaacagaaacaaactccttctggttccactacacgagccaaaagaaattaacagtgttgtagagaggtttccatattgtgttgtatttgatttctagttagtttctaacccatgtatttgtaaaaatttgctcttgttcttctcctaggttttgtgctgccaccgcaaaacaaaagagagggattgggagttctgccatatattgttcttgcttttccttgtagggaattgagggggcaatagatccacttttgtttggtcgagtggatcaacctatcaaagctagtggtttttgcgaattcatggtgaaaggtgcgttgcaaggtaacgtattattcattcagttcgtgaggtttcatggtgtatccgaatcctacgtcacgaaggtcgggctttccagtattgaagtgctgaacggtgtacttcatgcgaaaacaacttattttaaaatatcagataaaactatttttaagtttaaaataattaaacacatttaaacatatgttaatattttttattttacgtgctcgtacttaatcttcatcatcagggcacagttcattggatgacatgcatgtaacaacagctgagtccaacagagaacgggttcgatgttctcatacattagatatccctcttcactcctcacgatcaactgtcaccatagacgatcctacagcagtcgtgcttatcgatcgtcgatcgccaggaatccactaaaaagatactttccatattaaaatataagcatttttaagattcagacatggtcgagatgctactttgactatccatatctatacaaaagtaatatgttttaaataaaaagagttacatgttatgatagtttgtttaatgataaatttagtaacatcaattttacatgattgatcttttttattcttttgttgttaatagtgaaagttaaaaaaatttgaattgtcactattttaaaaatgcttatatttttttaatctgccaacagagaagtgtacttcagacagaaggctctgataacaacattcttcgtctgctgcctgctgtgtaacgaagaaagcgggtgaactcataaaagcagatcaattcttttaccttagtcacaggattgcgaatgaagtagatgtagaatattatagcttttcttttacctagtcacaagattgcaaatgaagtggatgtagaatattataatgctgtttgtatgtcattggcaattccaataaccaggtttgctgtgtttctgcaatatagaagcgtcaatatactgccccggaaaagaatcctgccatctaaaagttatagaaagtcgatatgagggcaaatgatgtgctattatttccaaagtatcaatacatgaagaaacaatatgacgtcagcactgtactcataggcaatatctcgttttttttttgcgtaaacaactaaggtcgcagtattgcttatccacacacagcgatatatttcatccatatgttatattacctatatattaaatacagcatgatacatcaacaacatttgatattacatgccagcatcacagttgtgtagttatgtattctttttgttatcagaatgcgacaagcggaggtccattgactgcagttggttcctgaattcctcattctctgcgatgagacgctcatactcggtaagcaaaccttcagattgcttctgtaaagccaaggtattcgcttcagctgtttttagttcctcagttttcgtttctgacagacgcttgaattcttgcacttgctcattcaacctggaaatctctttctgatattgttgaatctcctctacactcccatgttttgcttcttctaaggtcctgctctgctttgttacagcctccatgtttttcttcatggtccgtaactccctgatatagtgatgtagccggtcaataattaacccaagaaacagagagtatcctgcaaaagaacagaaaaaatgtcaacattcaatcaatctaaaagttaaaatctccaccaatatattttagcacaagaataaccatattatggcacttatttcttgcctgagtccataccaatcgttaattaaaccaaaaacaggcattggagtatgttcaacctttttttgtgggaccttgaatacccaagtttaccagaaatcaacccaaccaaacccaaatatgtatgttatcactccaactaacaatatcaggaatttgaatccagccccaccaccacccaaagccaattcacctgacttcagagttcaggccttatagggaacacaacattcagtttgttcttccatgtctcactaataaaccgaataagaggatcaacagactacattaagtgaccaatgcatatagaatagcctctcgatgtaacgtatcgaggacaatgtgaagtcttctttgaaattgtgctcatgtgaagccacggatactcaggaggggacaaaaaagtaacactggcctagaattagtgtggctctctcttagttgttgactaggcatggcatgataggttagatttacaccgcattcttcattgcacaattgcacaaatgggtggattggatttgtgaggggagcagagtcaacacaaagttccttagtaggagaccacaaatatgtcagctaagggggtggggaacagctaaaattatttcaaacgcatttgatatctttttttttcccgaaagaccagcatttgataccatcgatctctgaagaatagtgaagatagaaggtctgtgcttttgtaatatgaagcttctcagtgacaaacttatgtgataagcaatcttgcaagctacaaacatgtacataatgcactacatgaaactcttagtcaccatgaaaacaaaaggctcaaaagaagttttaaacatctgctctgactagttactattctaggatgactagtggtcctagtggatgctggcaaaagtatacatgaaatgcaaaattcacgtaatgtgcaacggaattgaactatgattacagatagagaaaatgctacacttagcatatattatggtttaattctattaaaaatgttaatgaaatattaaatctcttgggtatgtaaaccggcaaaatttgtgaaacagtagtagtaaattttaaaacatactccaagttagcatcaataagtgggtttgcagttaaatcatgtttctttttcttcatttgaccaggaaggaaaccaaacatttactttttcctacttgttgagcttatagcattcatttccgcaaaggtgtcaaggccaatctaagatgtatcaacgtgtcaacatcaaaagttattgtttcattggatatcatctgacatgtgtactggccgtttccacctgtctggtaagtagtaacagaacagataagctggaacaattgagtgcatgtggctttgccaaaccaaagaaggacatgtcgtctcaataattcctttttatttaataaattctatcttgtttccatgagattaacaacttcttgtggatttacatcatctgaataacatccatatggcctaaaaatgacaaatcgacaatttcaattgcatgttcatgtttctttaatgggcacagtcaacctgtattctggcaaaagtacagatcatcaaacaaaaaactatggatatggaagagcacaaccgtcaaaactcaaaagacagtaaacagtctcaaaatgtgatcttcttgatgaaacctttggcaagagagtattgaattgtgaattgtcataactttttgagggacaataattgtcaacgttgttggatgaacaataattagatgaagaacatgcatgtgcaattggggttaggttgtcctatcaagaccttctgcaagcaaatttctcataagcacaatgcaattctttcacgtctttcctaaacaaaaacctccagaacattataagtttataacataataactattattactaaacatttatcgctcaattttccaattaaccagagatccccaatcaacgggttccaattagccgcggagaagaagaacaagggaaggtgacacatacccatgagggatgcctcgaggaggtggcggctggcgagcacctggtcggtgggcgtgagctggccgagatccccgacccggcgccggatcttggcgatgctgtagccgctggagcccagcacgacgagcatggtggcggcgaccgtcttgaccatgacggggccgcgcccgcgcttggcgcggtcgatggcgagcagcgcgaggcgtcggaacggcgtgcggaagagcagcacgagcaccagcgccgcctccgcggccagcagcgtgaagagcagctggatcatggctgcggtggcgagtccgtcgatccgtcgaacaggtggtgggcacggaggaggaggaagaggaggaggaaatgggggaggagggatgtggaagcggggggatctcgaggaaggcgatatggggagacgggatcaggtcttctagaagtgaatccagccgaagaattcacaatggacggcttctggaagctgtactcggggcctcttctttttgaccctctggcaacagatctataaaaattatagtttttggtgaagtacggcagctgcgctgcttgtcttgctacgcagtcacgttactgttgccctgttcatctgcttgctggccattggatcagcccatgcatgtttctaatccgatgcacgacgagtctttaggtcttttgcctgcttccagcgaacccattccccatcgttctttcccgtcccctgtacaaccacgccgccgccggtggtcgcctactcgccatacgcccgtcccatcatctggccgctagaggacggtaggaaatccatatcgctgtcaccgccacggtcgccgctgtcgttgccgccgtcgccgccgatgtaaatctcggctcaccacggccgtcaccgccgatttgaggtcgattccccaccacctcactaaactgttcccctgctcatcaaagcctatcgaagatccttccctgcccccctaaagttctaccattgcctcccaacaccgctgtcaccgccgtcgccaccgatgtaaatttcggctcgccatagtttccaccgccgatttaaggtcggatcctcaccacctcacgagactcttccgctgtaaataggtgagcacggattgctgatagcatcggcagctgcagcttgctcgacaattctgggacaagctgttcagcctctaggggcgaagccaggatttgatattaggaggtgtggggtgagaagccatgagaccgaataactaatatttatagcaaaggaggtcaaatagtcaccgtcaataataatcaatgcgtaaactagtcctttaacaaaatcttgaattttagctctttaataatatcattgaaagtttgaaatagtcttaatttattgctaaattctttcaatgtaaactattgaataatctcacaaataagtattatctattttactttgaaaaagatgagaaatcacaaactaattttgtatatcatgtttcttgctaatatttttacatctgctaactaactaaagtgataatactttcaagctacacaaataaactagataaatacttatcttagttaaccttaatacagagtaaaaacaggggatgtagtggggataggggggtgttggcaccctccggcacccccctagctgcgccactgtcagccccagcagcctcaagctccaaccgaagcgcccaatcactagaaggtaatgcccctcgatcctccttgcgtgtggctatgctctgccggactatttttgctgccattgctgatttgtgtaatgcacggttactgttactatcattggtagagctgacataaagatcggtggttgcgccggagtcgacaccagattgcatgtctcctcctcagctgcttctgagcttcattgcgtttgcccgtttgtatttagtgaactacatttctgtagtgcttatggtttttagaggaaggccatttgaaatccatgcctcctgagtttgaggctacattgtgcaatagtttggaagggaattggattgtaaaaataggtaattgatgtttgaactgatcctaaaattacaagttagcactttagctgtgcctattgtttttttttgccataacgtataaaatgtagctggaaccatttttatgtgctttcacattgttctcagattaggggtcgcgttggaatttgggattgctttttttagttttctttatgtaataagaatttaatgtacttccattccctaattagcagataacaacaaaaaggaaagcactaacaatatataattatcctttctacgctgagcaatgcatggaacaaactagccaaattggaatgacctttgttgacctatttaaattaggctatcaataaaggtttaaaatacaaaccatccaatgccgtgccacaaggatcattgcaatgtgctgattgcatctgctaatattataatgtgtcttaattaagtttagcggtccttccgataggctcttacaattgttatcgtgcctttagcttctatgacctaggctatgtatgctcctgccctccatgcctttccttgatttcttccttgatgtctaatgaattgttcatgctttcacacatccatctacagctcaggccatgcatcaatggctgagaatagtaacaagaaccaattagttttgggtgggtgcatagtctgagcatcatgcctgagtgcagtccaatattatcgcaatctgcgtgctgagaggaatgatatcttgaactaattatgtgataattgcaagatgtaatacatctcaacatattgtacataatgtcttcttaaatttatactgtttgcacgaagaaatgatgtgcttatgtatttgttaggtctacacataagaaagtcagtggtctacattgcaaatggaaagctaatctttagaatcagccatatcatttattgagttcctatcaatacattagtagcttatatatggaattatttatcattgttgattcccgttctacactgtatttggtgtttatcatgcttcgctttgtcagttggcgacttgacatgattggaaatatttttgccttttgatttctctgtggatagaatgacattatttgtttatctgtttcttcaggaatcaagatttggcttaaatgggggaacgatataaattctttagtggaagtttcagctctaacactgacttggtatgatgttgctgtacttatctatttccctcgaagatcttccctggtcgcagcaagatccgcccaaatcccccaatctgtacaaggtatttggaagaaaattggactataagactcaacataaacttccaggtttaacaaattagttatgcctgttgttttttatcatggattataaaatgtagccgttctttcagattgctctgtacgtatgatgaggttggcatttaggattgttcttttatttgcttaatatactaacctcctaattagcaaatctgtaatagtaataaaaaggaaaccggtaaggatatgtgcttattctttctaggctgagcaacacatgtaacaaattagccgattggaatgagcttatatgtcgataacctgatggattagttagttgacctatgcagccaatgtgacgtcaactacagagcatccggtattgtgttgggagtatcgttgccatccactaaatgcatatgttaaccctgtaatttgacctcacaatttttagtgctcctgccgattagctcttcatgtggttaaccttcctggtaccttttacgcttacgcttttcctttcctccactcctttacttgctgtctctttagttattcatgctttcttaccatccatctaaatggtcaggtcatacaacaatggctaagaatagtgataacaaccagctgattttggatgggcgcattggattagtgtcatctctatgtcaagtcgaacctattcttcgcaatccagaacgtaagcggaaggccgttgtattggaccaacaattcaaaggtcagctaacaaccgatgtttcgtacactcgttatcttttatttcgatttcgtggtgttacttttctggctgtaccagaacctgaacttgcaattttggttcaggtgtcttttgtgctggacaatcaagccaatcaacaagccatgttccagatgtatgcgctggagactttatatcaacctttcacctaccatcaaggcgaacaattaggcgcaggctgagctttgcttctgataatgtgcctatcccaaccggtgacggtctctcatcgggtagcccaacacttcgtgccgttgagaccgtttgtggtgagctctccattagactatgtcctctttagttatctctcttttttttttacgaaaaatagcaagacagcctcctactgtgctaccatattagtatagatattaaaaagttacaatatttagttctctctctgagctcaatgaaattaacatgcctatcactttgcgattttggccattatcattatgaccttaccctctaggttagtcccagatttatattgttatattcatgcaatatattctgttggtcacaggtttaccgcatccacctcgatgtgttgctgccaagtcgcgtaaaaaacgcaaggtagctatgatttgcaggagagaagaaagtaagaaaagacattctacactaataaccttatagacaaatttgttttgttagatttgtgatcatttggctgttgttccagggttatatgctgatactctctccctttcatctcggtctgttcggcggcgcaaaatcccaaatgataatattgtacaccaaccacaccatacacaactacgtcaacataacccaacctcagctgctcagccaggtggcgatggtacctaatttatttcttttcaattttcaataatgtattgtgatgacaagaaatccttaattcttctggtctatctttttcttgcaccagatcataggcagccattccccggtcgacaccgccgtaagttctattactttttttcaatcttactgttgtcatattcattaactatttcttagcatatgagaaacatgcacgctatgtgtgtttcgaatatgcctaggagatatatctcctcatattgcctcagactcacgattagttttacacaccactcgcctacagatgtcatgctgctcgactccgcagttcatcttgctggttactctatgatcaatccattgcttgtcgatgaggtttcattacaacgataattactatgattctcgccgcagctgattcatggcagtgatgacttccatatggtaatgataacaaagcatattgtccattccgttgctctatattttctctgtcaaatgttttcttatttcctgtttgtcttttttaactcttaggcactatattttcacctttataccttggaggacctgatcagacttgccgatattgtggtgctctcttttggtatgaggagcgtgcccgtggtcaaggacaggtaacttcacctgtgtacaacaaatgttgtaggggaggaagtgttcgtttacctccatacagaccacctccagaaccattgcttagtttgttgactggacaaaaccatgcattgtctgcccatttctttgataacattagatgttacaactctatatttgctatgacatctatgggcgtcaacatcataaggtctattaacgatggtggaggaccttatgttttcaagattagtgggcagttgtgccatcggataggatctctaattccaagacatggtgcttggccagaatattgtcagctatacatttttgatactgaaaatgaagtccagaataggatgggggttgcttccgttcgtggtagttttcagccaaatgaagatgtcattagatcttttatgaggatgcttgatatgaataacccaattgtgcaagtgttccgaactgctcgggatagattggctaaccaatcagaagaccactactttgtcaggctatttgctgtgcctaatcaacatggtagtgtttatagtgcccctattgcatctgaggttgttgggttggtggtcaatgatctaggaaccactgatcaaggtcgtgatttaatagtacaagatcatgcttctcatctacagaggataaaagaatctcactgcaagtttatgactatgcagtaccctctcctgttcccatatggggaagatggcttccataaggatctcaagtactgtcaatgccagcgctcaggagccattaagagatattatgtcacgatggtagagttttttgcatatagactacatgatagagttggtgacttcaacactcctttacggtgcaagaaacttactcaatcctatgaggttgatggtttttgctgtgttgaggatggtcgcttgagccattacagaattgactcatttcagaagaaatatagagccagcccatacaactctttggttcaggctgttagcaccggcatgacacaaggatcaacagcaggtcaaaagatcgttttgccagcttcatttaccgggagcccacgttattactatcagaactaccaagattgtgtggcactttgtcgtcggtttgggtgcccacatctattcatcacttttacatgcaatgctttatggctagaaatagtagaagctttagcacccatttcaggacagtattcctctgatcgacctgatattgttgatcgtgtttttcatatgaagctaagaatctttatggatgacatagtaaaaaaccagttttttggtccaatatctggaggtaatttccatagctccttaattttgcgcactatgttctattacataatgtatttcccgttgatatttcccatctacatccaaatttttcggctattttttttggcctgattttccccttcgatacttctcaattagttttccattcccttttttgtagttgtctacacaattgagttccaaaaacgtggattgccccatgtccatataatcgtgtggctcaaaagggacggacctcttgatgctgattggatagatgcttttgtatctgcatagctaccagatccatctgttgatcgtgttggttatgaggccgtttcaaggttcatgatacatggcccttgtggcagctcaaacaaatcgtctgcttgcatgaacgatggaaaatgcagtaagttttaccctaaagaatttacagagaaaactatagttttgcccaatggacgtatcatatatgctcggccaaataacaaaattaccacaaacaaaagtggtgtggatgtcgacaacgggtatgttgtgccccataatgttgacctcttggttaagtaccaggcacacatcaatgttgaaattgttaatcgtgatgatatggagaagtacttattcaagtacacaaccaaaggaccagattgtgctaaggttggaatacgggatggaggcaacgaaatacaacaatgtcttgattgtaggtgtatagcacctaatgaagctgcatggcgcttgctacaatttgatatccaccacaccgatccatctgttgaacgtttacctgttcatctcccgctagaaaataatgtggtgttttttgaagatgactatcttgaccaagtcattgaaaatccactaagcactatcaccaaattgactgcatggtttgatgctaacaggatatacccacatgctcgccaacacacttatgtggaattccctgaattttggacatggcatggcgatggcaagtattggaaacaacgctctaagagtcataagggcaaggttggtcgcattgcaaatgttggacctaaccaaggtgagcgtttttacctacgcatattattgcatgttatcaagggtgctcaatccttttctggtgtacgcactatcggtgacattcaatatccaactttccaatctgcatgcgaagcattggggttacttggtgatggctatcactgatgcagcacaatgggcactcccataccaactccgacaattatttgtcatgatgcttctattttgccaagtatcaaacccaaccaaactatttgatagccatgttcaactaatgggtgaagactttgcatatcgtgtgtgctagcatacacctgggatacatcaaactatccttcaagaccatattagattatccaccttggatgaactagacaaattactgagagatgcaggatatagcttggatcatttccagttaccgcagctaagccatcatgcttttccaccattggagtataggcttataatggatgaacttgcttatggaacaaacagtgtgactgaactgcttaatcaattaaatccttatcagaggcatgtttacactgccatagaatcctcagttttaaataattctaggcaaacattttttgtttatggatatggtggcacagggaagacatttctatggaataccctattgaacagcattagaaatagagggaaaatagccttgacagttgcatcttctggtatagcatcattgttacttccaggtgggcgtacacctcattcacgctttaggattcctctagacatccaggaggactctatgtgtgctattaagatgaacacccagctagctgaattgattcagcagacatctctcattatatgagatgaagcacctgtcaaccataggcattgttttgaagcattcgattgaacccttcgggatatcatgtcatcagtcaaccatgattctgtgaacatgcagtttggtggtataacagttgtcttgggtggtgattttagacaaactctaccagttattcctaatgcaaggaaacaacagatcttgaatgcctcaatcacccgttctcgcctttggcaaaactgtgtggtgcttgaattaactgaaaatatgaggctcagctgtccaggcctttctcttcaagataaatctgagcttgaatagtttgctgcatggcttctatccttaggtaatggtaatgtccatgacagtgcacctgctgatcgaccggacaccacctgggtggaaattccatcatatcttttactaccggatgaagagaggaacctcacatgtttgatttcttttgtgtatggttcacggccgcatatatcgcagctaccagcttacttatgtgagcgtgcaattttggcaccaacaaatgagatcgctgctggtataaatgcacagattatcagccacatagccaccgaagaaatgtcgtactatagctttgatgatattgatgatgccacaccaaactattgcaatgtgcagtctctttatcctacagaatttctcaatacaatacacatgagtggtctgccggataatcatttacaacttaagattggtgtccccattatgcttcttatgaatttagatacaccaaagggattatgtaatggtacccgtctcatagttacacagctgactcatcgcataactgaggctgaaataataataggaaaatccagaggatcaaaaccatacataccaagaatagtcactacttcgactgactcaaaatggcctttcaaaataaagcgtcggcaattcccagtccgtgtttcatatgccatgacaatcaataaaagccaaggacagacactcagtaaggttggtgtgtacctaccaaaccctgtattctcacatggacaattatatgttgccttctcgcgtgttacatcacctcaaggtcttcgagtcctcattgagaatagcctacctgggtatgaatctaagacacataatgtcgtatattctgaaatattcagtgatattgcaaatcagcgtggttagctttaccaggtatttttatacgctctgtatctcaacatatatgtatatgtatgcctcggttttatacatcaatcgttctaacgtgtggactgtgcgtgcttccaatttcatctattcttattcttctgaatgaatgggtataactcagctagctatgccttttttttatatataaatgcagatttcactacccctatgttcacccatggtacccaaagtcattgaactagaagatatgaagttttatgattattccttggttcttttccctattgcaccatacagttattcaccaaaaaaacaaaggtaaatttctttaggactgtatgggttcagcttgccctcagtatacatggattcatcatttgtagatgccctcctgtcatgtttgatatgcacatggtagcaaatattgatgcatatatttatatttagcaaatgtaggttaaatatctattcgtattctttacatttccttcctatggaccgcttaccgaattctgttattacaagacaaaaaaaatgttccatacattccaactattgtgcctccacacgtgcaaaattagttcactcttattttacttacgcacgcttatagtgtgtagtacgtgctatttattctcattcaactttgtgattaactaaacgaattatggacagttctatatgtatactgagctcagtgtggtacacttcaaaacattatatgttgttttactctgcccagagttgtgaactcaatttaatcattttgcttactttttaaacttaacatgatacattatgctttgattatttgttatcatgacaatattctacctacttccctttttttcatatgcttacaggtttctcaggttgtccttatggtttggtgctttccgtatgggttgatcggtgcgaatgacaaccaaacgcgcaaaactgctgtcatttactatcatttgttttgttaccatgctatagctttttatatgtttgctattatccgaacttttctgcgcaatgcactaggcagaatatatgattatgttgtatacgctccaacatcaggcgctcatttggcatgatgtcaatgttcttatgcctatcatgggttggtgctgtatagcgtccagcttttgcaatttctatcaactgcaaatatttttgtcatgtgctatactgttaattaaactaataagctatcgctaatattcgagcacatataactttgttactcttgcatggtgatgtttaggttgtctccatacggttcatcttttatcaacatatttttttattgtatttaggtgtttgtttctcatttatgtttataacagtatccgcggctttgccgcgggggtacatcctagttagtatagagattagagagggggccttgatgaatggtagtactccgtattaaggatttggtactagatggttttaatcacggcttgggacgcgactcgcccgctgcgtgcttgtgctcccgtacgcgtggccgatgcagcaatgtgaaacttcgaacctgtgttgttgtgatggctacgacgaagggtccgtttagcggagatgcacttgattggtctagcttctgaaaatttaagttagattttttagattctggcttctaatttatttttttaattctataacatcatcttaaaatttagattaaaatctagactgtttgaaagagcttctaatcaacttccactatgtgcggctcgcggctagggctctccatgcgaggcgcaccccctgcctccttcttaaggtggatatcgccaaggcctttgacacggtcagttggccgttcttgcttgaggtgctcacccatctagggttcagttagcgctggcgtgattggatttctctcatccttggcgcctcctcttcccgggtgctgatcaatggggtgcaaggtcctcgtttccctcaccggagaggccttcggcaaggagatccgctctctcccatgctctttattctggtcatggatgtgcttaacgcgatgctccgcaaagcctctgactcaggctggttccttccgctcaacgatcgtgccttgcgacaccacgcctccctctatgctgatgacttggttctcttcctctccctggttcgtcaggatcttaagttcatccagggcatcctctctgtctttggtgcagtgtccgggcttcgcaccaactttgccaagtgttcggttactccgatgcgctgttcggctgaggacctggagctggttcagtcctgctttccctgctcgatctctgattttccttgttcttatctcggcattccgctatccgttcgcaagttgccgagggcggccctgcagctgcttgtggataaggtctcccatcgtcttcctccctggaagggacgactcaccactctgggcggccgctttgttttggtccagtctgttctcctccattccggtccatgtgtctatggcgatcggccttccagcctgggtgatcaaggccattgacaagaagcgccgcgccttcttgtggacgggcacggactcggctcacggtgggcagtgccgggtttcttcgatgaatgtctgtcatcccagagctttcggtgggttgggaatttctgaccttaggttggtagggtttttcctgtgtgttagctggctttggctccagcgctcagggcatccctactgggacggcctaaaggccccagccgagcgagccgtctctgacatgtttgaggcgtccaccttcttcgtaccaggtgatggtgagtcgattcttttctggtctgaccaatggatctgcggctactcagtagcttccttggcttcggatctcctcttcattgtgcccccgcatctacgtggttcgcacacggttgcttctggcctggcaaaacaacgcctggatttctaacatccgcggcaccctcactgtcccggtcatctcccaatttctccttgtttgggattgggtgctccacattcagcttacaccgggtgtcggggatcgtcttgtctggcattggacgagtgaccagcgctactcggcgcgttcggcgtaccaggcgttcttctttgaccagcactcctttgcttgtgccgatcttctctggcacgcgaagggccctgctaagtgcaaattcttcctctggtttgcatttcagcagcgctgttggacagctgatctcctccagaagcgcggcattgatagccactcggcctgccccttttgcgctcaagagcttgagacggcgaaccacatcctccttgactgcatgtttgctcgtcaggtctagttacgggtgttgtcttctcctggctgggctgccctctctcccctccgtggcagctggctgcaggattggtggccatcttctagggcatgtttacctgatcatctgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcggaagactagggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcaggataaatgcaagggagtacaagggggttataatataaaagggtagggtttacagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattctacattttagttgttaagcaggttttaagaattaaaacactaacttgggtacattgctcggcttgcccataaccgcgggcgcggctattcgaatagattatactctgatcagaggtgtacatctttacccacaagacacattttcctcacgtgtaaccacgtgccacataccaccacggtatacggacggaagacgtgacatagtttgcaacccatcctagccatagacaagagtactgacccaaccccacatacggccggaacccccgggacaggtaggcaggactaagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacaaaggcccaaagaccggtctttatatggccgaggtgctactatcaaaaccatgcaccccgagcccaacctaaaaccattttgaggattttgaatagagggggaggtgtgaatccaattccacaataatccaaccattccatagtgtccaggtgatatgaatatcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctaaataaaacagtgataacgcgggaatttaaataaagcgataatgcaataatttaaatcaacataattttataaactgggattcaatatgttcaaggatgatgtgacttgccttgctcgctttcccaaacgtcggcttcaacttacacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattttaaaagggtttattgcgtcagccgagaggagggggcgcgcggaccgggtccacgggagtggggcccacgcggcagcctcatggtccacggtggaccgggtgcactcgggctcacaccggccggcgccgtgggtcccacacgtcagccgcacccgagggcgcgggcggctgacggccgggccccacgcagcagccgctcggtgcgcccgaaggcggccacgtcggcgcggccggcaggaggcggcgcgcccgcgcccctatggtcactggcggcggccatgggcacatcggagcggcggccgagagaggggagggaaagggggaaacgaggcggcggtcctcggctcaccctaggtcgaaggcgacaacgaaaaaggcggccggagcggagtaaagcggcagcgcggctcgggtcgacggggtcgacggtgttccggcggtccgcgggctcggcgagggggtggacggggtcgacggcggtgtggcgaagccggaggaggcgacgcaggggcgggagacggtcccggcgagcggagaaggccggccggaggtcgtcggcgagggaggagagagagagcgacggcgcgagctcgattccggcgaggaggaagggcggcgagaggcggaaacggacggaggaggtgcggggagggtttaaatagggttggaagggggagagagcggccggcggggaaggaataggcgcgggaggtccggccgccatcaatggcgccggcgagatttgcgggggcaaatccgcccgtttgaacgcgagagagagagggaaaaatgggggaaaagggagaggggatcacggggagtgatttccccctctttattgcacgcggggacggcgggaggcggcgggattcgcggcggcggcggcgctagggcgcgggcgaggcggcgggagcggcgggaggaaggggatgacgggtgggccccacccgtcagcgagggtggcgggtggacccgcccgtcaacggcgcgcgcgcgaggagaggccggatgggccgcggggagaggagagggagggggagggagatgggccttcgccgcccatgtaataaattaactatttacgcttccgcttgataaactctaaaatgtatcaacttttggtgtaccttgcctcctgggataaggaataatacacgcacgtaaggaacgcccgttgggttaattccggtcgtgacatcatctctgtgccagcttcgactccctagtcctcctagtctcatggcaactgtggaaggaacgtaactccagggtctttgactctgtgctctcttcggtcgcagtagtcctagagtccatcctttcagagggccggctgtggtcgttagcggccatcgcttcctttggggaattgttgggagcgtagagtggctctgctccctcccgctgtttggagtagagttaccgtcgtttcgagtttttttcctttcctttctttgttttttatctttgtttttcttccttcctaggcataagccggtctggctgagtgtgtcgtgtatcaatactctattcttctaatatattgacgtgcaattcttctgcgcgttcgcaaaagaaagagcttctaattctaggagaaaatagcatgagctagaagctccccaaaacagattcgaagatgcggtggcctcctctttgtgtaacggtggagaccaacttcagcccccgacgacgcacgcagagcaaagccaaggcacgacgaaaatgtaggtggtgggttacggggaagacgcggtggaggcagcttcgaatggcaaaggcagcagcatccgatggatattgcacggacgcatagcatgaatgtagaatggataggatgacaaaatgaattcgcatctcaatggtaaacttcaaaaattgagcgatatttttttaaaaaaatagtatggtaaatagtaagaatttttcaataattacttactatatatttctaataatataattacttagataccgtatgaacccgcagaagggatccacggtacccagcccattgatctgctaggcttcatcagtcatggtactgccaccagacctggccaccatcagaggcatggggcagcaagtttttttttcttcgaacgatcaggccgttgccgacgttttacataaagaagaagttgttttattttaaagagaaaacgagaccaaagcttacagtgcatagttaattagggaaaactatgcgaaaaccacaactattccctgttataattatgagcgcaaccagtgggattataagttatgtgattaatagtactaactataaaagtaaattacaactatcgacggggaatacccgtagaccggatatagagggtactggggtacgctggtacgaggatctacgtagtacgacatcaagcagacaaaaaaacaaagattatactggttcaggccccttgataggtaatagccctaatgtcacgtcctgataaattcatcccgaattaaaaatcattctctaaaaggaataatagaattaattaaaattcgaaaagaaattggcaaacactaaaatacgtacaagaaaaattcaaatgtgacccggagaatttttgttaaattctccttggtctaaaaggagccctcaaattttagtgggattttcagagcacaaataataattgagaagaaataaacaaagttgaaaaggttttataaaaagaaaaatcctaaaagaagttcttttcccccccccttccctcttgggccggctcggcccacttctccctccctctctctctctcctcccccgcggcccatctgtcttcccgcgcgcgcgcgccgttgacaggcgggccctcccgccgatctcgctggcgggtggggcccacct

SEQ ID NO: 68400 - DNA, 3420 bp, Oryza sativa
caaaaaaaaaaatcaagattaccttggactagttccacagggaaatttgcaggagttagtataagatatgacgcaagagcttcacgtttggaatgtgtcttacgtttcctatcagaatacctttcaatctctttatcatcattctctgatgggatatcaacacacaaaaaaaacttatcagaaatagctctacaaaagcaagcacaaatctctacaaatgcaaggaatgaagcaaaaccagaggatgcttgattgcttggaaggaaaaaaaagaggctgaaatgttcattaatttgtaaaaatgtttcaatggagatatagatagggctaatacaaaagaagagtaggtactaaaatgatgaatttctggttaaattgagctcgcagggaagcaaggcccaaaagaatattatgatttatggattctaggccccatatcaacaccaagctgaatgcaagagaaagttctctgtgcatgtcgaagtcaaaattatgtagtccatcaaagttcaacaatatataggaaaccataacaggttccactcagtaaaacagacagtcagtccaaataagccagagctccagtaaaacacttcagtacccaattctttgacccaacaactcaaaataaacatgaattacttcttgtaacatgtgttaactatctgacctatgctacatatatagtcgatttgtattaatcgagaagcaagatatcctaatgggcaggaagaagaactaagcattgtcacgataagttgagccatagtagtacttttcttggggacatcctcctccaggtggtagcaagaagtcttccagaaatcctcaaatttcaaggtggactgtatcagagccttctcctccatggtcgccctggcgcacgtcatctccggcagggtgatgtcctgaatataccgacgcccaaatccggtgaatcgccccaaaaaaaaatcacaccacgagcatggcgaaaatcgcattcagcagcaacaacgagaggagagggaaagaatgggtgcagggaagtgtggggatggcggagcggggaatggagtggagaggagaggaggttcaccgggaaatcctcgtggggggtgtgcttggccgggtggtcgaagccgtaccctcctccccgcctcccccggcctctcccgcggccccgggacgccatctggaggggggacggatgtcgatcgaggcggcgaacctctccgcgcggcagaagcgcggccggagaagagaacagcggcgcggcgcgaggggaagtgcggcgtcggcggcggtaccgcgcggcgtggtggtcccgggctggctgtgttagggtaggcggttgggctttttatgggcctcatggtgactattgggctttgcgagctaccaggttgcacgtcagttcggctgtagatggaataagttcgagcatgtttattttgagggactgtctgaaaatcattcgacagatttttagtagaaaatcagtcggattttcaagccaccacgacgtgcggttcaaatgaaaacatatccacgtacgtcagtcaccggacggtaatcacgtcaatgatgcttaaagaaaaggaaaaacaagcaacttacatctatttacatcaacttacatatataattttaaaacttacagtgtaaatacaccgaaattacatatgtaattttgaaacttacagtgtaaatacactaaaattacatatgtaactttgggtacttgcaatgtaaatttattttatgaaaaatataacggtatatatagtcccaaaaatatcaaatcacacctcaaacaattaagttaactatagtgcaacaaaacaacgatgagtaaaaaattccgtacatgtaaaacaaaaattacacccgcatatacttaaaattacattgtaattgtagtgcacttacgttttaatcgtggtataactatgttgtgagtgggtgtagtgtaactgcagtgaaagttttaaaaaaagttacgcatagaaagaaagtagtcgtttgctgcttgctcagttggtacgatgcatgtcgtagcatcccgacatcatgggttcgattccctgttctagcgacattttttttttcactcaatggcacatacacgtatctcaaagtaaatcatacggtcaacaaatcgactgatttttaacagaaaatctgtcgccagatatgtagcaattccgttattttgatgccaaaaaaaccttaccaaattttggctatggcatagttactaaaattttggcagggtttcttatatagttaccaaaatttgatagcaaactaaatatagccactttttgtaactttaccaaaatttagtaaggttaaaaatagcatcaaagtgaacacgcccttcattttaggtccctcaacttgccagcgaaattgatttttatatccttagaccgaaatatcagatacaacgggtcattaactgttaaaaccgtgtaatgtaggtccgacagaagtatgacatgtggttttgtccgacgtaaaaatttgacccgaattaataatgttgagtcagtgtgagcctcacatgtcaatgcctcttcacctatatctctttgttcagttgtgactgagaagcatggcggccggcgacgggtggtgaagaggacagtcgctcacgggaaaagatagctcgatggaggaaggacaccgacggtggccatcgatgacggcgatggcaaggcagactagaagagaggcaagatccgggagcatgacatcgtcctcccctcacccctcgctcccctcgcccgttcttcccccacagccgcacgggacgggagccggcctcgccgcccaccggaggcagcgtcctgtctcgagttcgctcagaagccgcttgtcctcctcctctctccacgaccccatccgcgaacgccgcctctaccgcccacatcaactcctccacccacatcgccgcagaggtgggtggtgatggtggctgttgcagagaggcgcaaagaaggctctgtagtggtgagcccttgccggaaccaggatagccacgcagacttggaatagggagacctctagtaatgttgaacccgagagcctatcggcggtggcgcgcggcgcaaattggtagcggggaagagccagtggaggaagaaatcggggcgacgaataccgaagtcaacgggtggaggtcccctccgcttgccggccatcggccatggcttgagccccacccttcctcatccccttactcctcgtctcctccttgctcacgccttttgccgcagtggctgcattcgtcggcctcgagtccttcctggcggcggtgactacccgcgacccctctgctggcaataacaccttcggcgccctccccaccccggtcctccgtcagttctcggcctcttcaccttcttcagatgatgagctttgcagccccacgag

SEQ ID NO: 68401 - DNA, 671 bp, Oryza sativa
tccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgaggatgtagacatccaacaacggcggcataataggccagccgtgtaggcggaggcaccactcggcggcgacggaggcaagccggcggtgaagtcgtagacgcccaacagcggcggcataataggccagccgtgtagccggaggcaccactcggcggcgacggaggcagg

SEQ ID NO: 68402 - DNA, 2708 bp, Oryza sativa
ctaagcagccgtccgtcgagaatgaagaaattcagactccggatcgtgccgcaattctgttcagggacgattttaacgaagactatggcaataccctgaactattttagcaagaagaaatcacttgttcctttgccacctcccgatcctatggaattgggcttcctaagggaaactgttcagagttaacatccataatgagtgacgaatggctaagggaggcagagcttttatccgaagtaattcggatatgccatctggaagggaacgacgtcagtattctctacagtccaactatcggggccaatctcgtctccgagtcttttgcattagcttatttatggcaattgtatttattaattaggattttaatgttggtttaaattaaagacatggtatgagtcctccatgtggtcttgtttgttgtttttatctttaggaaagtttgagtcatgtccataatagacaagttttgtactctaggtataaatataaacccaagatcattataaaacaggacgaacttccaataaatacaactttcggcgcatcgccacctttttctttaagtttttgacaagtttttgcttcgagtcggggcatcggttgtgatctctcgacaagaggtaacttgtctcgatggtttgcattaatggggctattgcgtcgctttagatgtaatggtctcatttttctagctatcgtttatcatatatcttacttaatctagtctagtatctcgatttagtatcggctgagactcgctttaggtttatactggtattggctaaattacctcgctagattagattagctaaggtatctaccatcctgaaaattagttaattacttgattgtttagactttaggtttctttacatactttgagatgcatcaaccctagtcttgtctagaaccctaaaaactaacctgtaattaatcataattagggatagtatcagagtttcagctgatcttatctaatatataatattgcatgctagagtaaattaactggtgctacatggagtatgggctccaacaatatccaccgtatatgtgctttgagatttgtgctgctcaaaccggagtattagacatattaacgggtaaacccgattagatctttccatttttagagtacccgcatgatttgcatgcgtgcatgtattgcaggacgtgattgcctttccatataaacgtactcacatcgtttccatataagcaaacatgtacgtaataatttccttccgattgcatgataatttatttccatatatgatgcatactttcctttttttttttgcacatgctcacatcgtttccctatgattgtgtgaatttatttccatatctgagatgacactgaatcaaatccacaaattttgagtaattccactaattaggttgtaattgatttatttccataaataccgattaatattttctactttttgtgtacatataaaatggtacgacatttcattttttacacactccactgtccagtccacgctattaccctgccggccggacgtcggcgagcttttcatcactgccggttgtctgcaaggtttcgttgccgttgtcagtcatccgttagcttcgtaaccacgccgttacgcgccgcgcgccggtcgttcgcaaggttcgttgtcgccgccgcaggtcgcccgtgaggaggttcatcgctactatcaccgacggtcgccacgcgtggttcgtgtgtaattcatttcaatttattcttgtattttgacaagtccctgttctaccgttttcgcagattgagtactgtaacaatttcatttcgttgtcaagaccttaagatgggaatgcatcctactaataagtttttggtttgtcttcctagtgagccaaagactgtacatacgtatgttgccctgggatcatgcggagaagatggtcgtgggcagaagaaacaccagttggatgcacgcgctaagagctagtgtattaacacaagtttttttaaactgatgttcttttcagtgtattaacatgaaatttgcacgttgtaatcatgcaaattaatacagaatattttggtactatgtatatacctaccatcctactatttcataaatatcagcaccaacttaatctacatcggtagaatatacatagcacacgaggcttatatacctacatctataaatagataggcatatacccaactagatttatatacttacatctacttacatctacatgtatctaattacatctggccaagctacctagctagagtataaaaaaacttaactaaaaggcctagctagcttcaaatttagttcaagaaaaaataagctacttgaaaattaaacttttttgacgcgcatttggataggtatataccaaactacaatctaaaaatgggtgtccaaaatatgcaatttttaatgggtatatacctagaatgtgtgtttagaccagtatatacccaaatagaatatggtatgtcacacatacccaatatacgtgtttaaatacctaaaaatgtgtatcctaaatagtattatacccaattaaatgtacatctcaaatgcattcatgtaaatacctagcttgtagtacgtttgaaacgtatgcacgtcacatacccaaaaagttagaaaacacaacacacgagacttatatacatacatctacatgtaccgaattacatctggtcagctacctagcgag

SEQ ID NO: 68403 - DNA, 635 bp, Oryza sativa
atgggttgccaccaaagtctttaagcaccatgtttgtcttgatgagatcctcagtagttctacctaactttctgaacgtagtataaggcatcaaatttaccgcagccccaccatcgaccatcatcttagacatcggcttcccattgacatagccatttatatacaatggtttaagatgccgattttctatcccctcaggcttttcaaagactgctcgttccggtgatagaaccaacttagccgattcctcttccagttcgtcaacatcggcctagtcaatcccgaattcggctggcaaagtaaagaccatgttaattggcgccgttaaaatacttttcccttttgccaacctctttgcttcgtcggctgcaatatcatcggctccaagaacttgattcttaacacgccactccttccttggctttgctttcctcagccgatgaccaatttcttgctcgacctcctgaaagcgctccctgctcctcaacctttgaacccttcttttctgattctttgtaaaaataccagaaggacaccactgagtcttcgcgttctcgtcttcctccaagtaatcattttgatttaccgggcccaacctttgatgaacgggaattctcgcctgcttcagccgattg

SEQ ID NO: 68404 - DNA, 3281 bp, Oryza sativa
aagtactcaggcttgtagcgcggcatctaagacaagtgaaaggagggaattaagtcatttatcccgttaatagcacaagtttttgggttaatttgaataaagttagaaaatcaaagtaaaaggtaaataaataaagtaaaccaagcttgcaagataagttgaaacagttggaaacaggatcacaaattttgcacttttgaacaacaggtttcaaaaaaaaaaaaagagggttataaaatcaacatgctaaatttatttcattgcagcaagattaaataaaacaatgttgtaaaacgctttgctggtaaatgggccattagtacagtaatagatgtacggtactgataacacaggaataataaataaattttaaatgagaacaattaaaggaattataaactgcatgtgccattagtttggtttaattaaaagagaaagggaggagaacagttctacttttccaatatttttagagggcttgtatgggtaaccatttggcataacctagggtcaaggaggctctgataccaacttgtcacgcccggaatttctatccaaaattccaaacgcttacatgtgtgaaccctcgtccaggaatcagccgaggcacacaataacaaattgataatagagtacaattattactctaattaataagcgaataaaatgtcattacagatgtagatagttcctctcaatcaataaagatctaagcagcggaaaaataagataaacggcgcagacgactccactccacaggcagcttgaccagggctacacctaatcctccacaccatcagcatcactgtagaactcctcctctgatgaatgattgcaaggtgagtatatgacatactcagcaagccacgcagcaaatatgcaagtgcacgggataacaaaggatggcataatatagtctcatttgcataaatagcatttaataaacatttcagaatttcataaaacagtaaagtatttcattaaacagtattaatccaacgctatacaacaaaccctgttgcataggcccaaccattgtgaacaaccaatcccggctgcacagttctatctccaaaccaggaatatatcattccaaaccaggagctaaacaaattattaacatcatcatttattatggtgtgaaatatgagactaatcacgaaagacattgttagacccgcccattaccgcgggcacagctattcgaatagtttaaactctggccagaggtgtaccactgtacccacaagacacaacctcaacatcatgtcaaccatgcgtcgcgatacttaacaagtacccgaatagagattgtgacaataccctctatataacacaattcaaagcagtgcaccattcccggatcataatcacccccttgcaaacaaggcatggactccccagcgacccccgtgggcttatcttcgccacttcacagtctggtgctctacaatgaaccatactatacagaaagtaaagccgttgcccacgctggcttgtggttggcacggtaaatgtttcacaaccgaaaatcgtgaaccggtccttaattgtcatgagcacgaccatcaataccatgtgctcacatcccaccattatcaggttttagttggcaaattaattaattaaccaatcatgattaaccatcatgagctatcattaagccatcattcaataatagtgaatcataagttatcccatttatatgagctagtgtctctaagcatggctaagcatcctattcactttagctaaaaccatataatgttctagctaatcaaattattaacaaagtgacaaagaatagggaaccaatagcaaaagggctataacaaggcaataggttctttccacccaatgacatttaaaaataaatgcagtagttgaatagaaacaatagctttaaacgggatcaacatgctcaaaggattgttttgggatctgtgtgacttgccttgctggccttggaactcttcaaaatcttctcctgcaaacacagactctccgggaacgtcggaatctaaacagaaaagagcaaaatcaccaaaacagcacataaacaagcatgaacagtacatgtggatatttttaacatgtagatctcaattttagaaaaatttagagacttgaaccaactaaatccgaactaagatgacttagttatgaattttcaaagattaaatcggattaaatcctttatatagattttaattgaattatgacgcaataaagaattatttttgaaaaggaaaagaggattattgcatcagcgggctcggctcacggaacgaacggccgagatctatcctatccacaacggacggccgggatctatcggcccacgaccggtccacgggacacagcgacgatgacgtcggcgatgacgtcaccaccggcggcgactcgggctcacatgctcgccggcgaacgacggcgcggcggctcaaacggaggacaccaacgggttgtgggcattgcggtgaactcaccggtgacctaaacgacggcggacgatgaccggacggcgacggcgtcgaggaagaagcggcggcgaccttcggcttgacgacaacagcggtgttccggtggtcttcggcaaaacggaggatgggacgaggatggcgatgacttggcgaacccgacggtggccttcccgagtgacgacgacgaccggagcggcggcggatcacggctagacaagcggcggcaacggcggcgcacgggctcacgaggctagggcgctacaggcggcggcgagctaaggcgagggtggcgacggatagaggaggtcccgggggtctttttatagtggctaggggcagcgatggaggcccaaggcaaccggcgacggaaaggaaaggttagggttcgagagagagagaggaatccgattcgagatcgaatccaccgctttccaaacgattttagccgacgattccaaaagagaaaagatagaggggatcccggggatcatttcccctctattgatttcaccggagaaggaaaggcgcggccgaatttggaaggagacggcggcgcggctcggctagggttcggccaggcgacggcgcaaggaagacgacggccttgacaggtgggccccacctgtcagcgggcggacgcgcacgcgcgagcggcggctcggctgcgggccgacttgggccggggaggagagagagagggttttgggccgactttcggcccaaatccaaaagagaatttttaaaacctttttcaatttaaattattcatgaaatgcaattccatttattaaaaatact

SEQ ID NO: 68405 - DNA, 764 bp, Oryza sativa
cgacttcgtaggctgtggtggatgtgttggcggtaatattcgatgccctaggtcttgcccagggggtcccttttataccgctggtcagttgatctccaagtaggactcagagatatcggacccctcacaatatggtaaagactcagtctcgtccgagtaggactccttccacccgtggattctgtttctatcacgtgatagatttccttaacgcatataggatctatccgtatacgcgcgggtataccgtatcggtactcatcgtatatccaggatagatggtataccttatccgtaactctgacacagaccacagctaatccatggattatgaactggtttgcctccacacggaggggaatgcagaagctgcaggggcaaaacaggtgagctaaaacagcctaacaccaccatgcatcaatacatgcagcctactagcagacttgaaaatcccagaattttattagaaattactaaccaaaggttacagctactaaccagggattacaacattactaaaaattatagtgttactaataactacagattacaggctcaacacttcacatcttcagcaaagctacctaaacatgccattcaacaccatgaaaaataacagaacatcaacagttatttgtgtctccatctttagatcaccttctaagagaatcaaaattccttccaattctcagtcacactttcttgagaaggtaagcaaaataattaattatgatgatgcaaatggtggtttctgaaattcagag

SEQ ID NO: 68406 - DNA, 2046 bp, Oryza sativa
  unsure (1)..(2046): unsure at all n locations
gatctcggtgcgcatgggggtgacgcggacctcgacgccggagtagccgtcctccgcgagctcgcgcgtcagcatctcgttcagctccgcgaagaacaccccatccgccacgaactgcgagccaaaaaaaagggcgcatcaaatctcgaaatccatgggtgacgagatcgagactgctctggaatggataggtctcgatcggagccttaccttgcgcttcttgctgatctgcgtgtgagtcgccattggagtggagagtggaggtgggggaggaggnagncggcggcggaggaggaggaggaggatgaaaccctagacttggatgagagctgtgaggtgggggagcgagtggaatatatagatgggagccggatcggacggtaggggttcgtcgggacctttttcatttcagtccctactttccttctaatttttgacaaagtatagagtcgagcggtcaagccgtcaaggtaataacatagggttaattgaatccatgtcattataaatgtatcggatttaaaaattatcattagtattcatgaaccaggtggattccattgtacttttcaaaaattagaaacatgtcactccgtcatgacttctatcaacacatcttcttcctccttgttctcgaatcttcttgtggacgcaaggagttggatgagactgcacgaagctatagggggttgagcttgagggcggatggctgtagggcaatacattggtggcaatcttgacatctacagatggcttgtcagagatcgcatgcatgcgaagcaaccaagcaaatcttagcaaagagtcaaaactctttctaatatccaactttcggctcaatatgtgcctaagcaaacaagcactataaaaaagacctcaaaatttctaaagaaagtctagcacagatgcgagcgagtctgatctacaaaatcccactcgacctccccgaggacacaggctcagagaaccaccatcgccagatgcgcaaatcgcagtgtgacgccctcagctccatgaccagtgagcttgagccacgttgtgcaccacctccacaaggcaagcgtgatttgagggccaagactgactgcaacaaggaaatgaggaatcttgtgcaccatcttgtccatcttgctcgtcgctgtcctgcttaccacaagccaccaccaacaccccattgttgccgccgctgcctgaccctagaacatgcgaggaggatgtgggtggggggagaagatgaccagtcagccaatgctcatggcccgttggatctgacggaggtattgacagaacgaagtgacatagctataatttcaaaataatgtaatggtatccaccccgatttcgttaatagtaatgacattttattcaaatcaataaaattgtaatggcatgaatccaattaactcaataacataaagttgcttaaggtattttctccaataatctgtgcgccttttttaagaataaactcgaggtcaccactcaacaaagagtagcttaggtaatttctccagtaaaatagttcgaattatatcatcgattcctcaccatctcacgaccaatcgaaatacaccgaatacaaaacctgaaatttcagagtgttacatcatgagaatacagtactacagttttcagctaggtccgtttatgtatccggtgctaaagcttttctcctagttctgtcaatgtgtactacggagtaatatataattaagggaaatcagcctctaggaaatttctaggtccgtcaatgtgcaggaacaattgctcaaaactactccctctgacggagcgtggggctcctcaccgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttggtggattcgtgtatgaaggaactacaaagtatgagccagcctctccctcgttctgggttcccaatctggaaaag

SEQ ID NO: 68407 - DNA, 37046 bp, Oryza sativa
cgtggggaagaagctagacacggtgcagtgcagcgacgaagagaaagtcatcttcgccgcccaccagctgcaggggcccgcatctctctggtgggaccacttccaggctacgcagccagaggggcagccgatcacttgggctcgcttcaccgccgctttccggagaacccatgtgcccgccggagtcgtggctctcaagaagagggaattccgagagttgaagcaaggcaaccgctccgtgatggagtatttgcacgagttcaacaacttggcccgttacgcccctgaggatgtgcgggaagatgaggagaagcaagagaagttcttggcaggaatggaccccgagctgtctgttcgtctagtctctggggactatccggattttcaacgactggtggacaagagcatccgcttggaggccaagcacaaggagctggaatcgcacaagcgccgcttggcgaacttccgcaatcagcagggtgctaaccagagggtccgctacaccaatccctatccagggggatcctcctcgcaacagcaacaacagcagcagcaacctcgcccagcgccccgacctcaattcgtggtgcgcgtcccacagccgcagcagcagaatcagcaagggactcgtgcatcccgtcctcctacgccagctgtgcagcccgttcaaggccgcagggacgcttcaggtccgcagcggctgtgcttcaactgcttcgagcccggacactttgcggataaatgcccaaagccaaggcgtcagcaaggccaagcgcctccccgctccaacaacggcgggaaggatgtcattcggggccgtgtgaatcatgtgacggccgaggacgtgctgacaactcccgacgtcaccgttggtacgttcctcgtccattccatccctgctacaattttgttcgactctggagcttcccactcgtttatatctgtgccattcgtggggaaaaatcagttgggggtagaaaggcttagaaaccctctgctcatcaccacccctggaggggttatgacagcaaagtattatagccctgccgtccctatagaaattcaggggattccttttccctcggatctgattctgctagacaccaagaacttggatgtgatccttgggatgaattggttggcccaattccaaggagtagtggattgcgcgaggcgcactgtcactctgtaccgaggaccagaacaaccggttgttttctttgcacccccaacctctgtcagaagttcaaaacttcatcagatagaactgtcagaaattcccatcgtcagagagttcggagacgtgtttccggaagaactacctggtatgccgcccaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtagagaagaaagacaagacgaagaggatgtgcgtcgactacagagctctcaatgaagtcaccatcaaaaacaagtaccctcttccccggatcgatgatctgttcgatcaactcaaaggtgccactgtattctccaagattgatctccgttccggatatcaccaattacgtattcgtgaagaagatattccgaagaccgcattcactacgcgatatggactgtatgaattcacggtgatgtcgttcggcttgaccaatgctcctgccttcttcatgaacttaatgaacaaagcgttcatggaatacttggataagttcgttgtggttttcatcgatgacattctgatatactcacaatcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttgggtttggcaggatactaccggaggttcatcgagaacttctccaaaatcgctcgacccatgacacagttgttgaagaaagaagagaagtttgtgtggagcccgcaatgcgagaaggcgttccaaactctcaaagaaaagctggtttcctcgccagtgttaatcttgccggatactcgcaaggatttcatggtgtattgtgatgcttcgcgccaaggattggggtgcgtgctcatgcaggacggtcatgtggtagcctatgcttcacgtcagctacgacctcatgagggcaactaccctacgcatgacttggagttagcagcggtggttcatgctctaaaaatctggcggcactatctcattgggaaccgctgtgaaatatatactgatcacaagagcttgaaatacatattcacccagtcggatctgaatcttcggcaaaggagatggttagaactcatcaaggattatgacgtgggaatacactatcaccctggtaaggctaacgtggttgccgacgctctaagtcggaagagccattgcaatactctcaacgttcgaggcattccacccgagcttaatcaacagatggaagccctgaacctaaacatagttggtcgtggattcttggctgcgttagaagccaagcccaccttgctcgatcaaatccgcgaggctcagaagaatgatccggacatgcatggactcctcaagaatatgaaacagggtaaagccgctggtttcacagaggatgaacacggaaccttatggaacggaaagcgggtatgcgttccagatagcagagaacttaaacagctgatacttcaggaagctcacgaaagtccttattccattcacccgggcagtaccaagatgtacttagacttgaaggagaaatactggtgggtcagcatgaagcgggaaattgcagagtttgtggccctatgtgatgtgtgccagcgtgtcaaggcagagcactagcgaccggctggacttctccaacctctccaagtaccagaatggaaatgggatgaaattgggatggatttcatcaccggacttccaaaaacccaaggtggatatgattctatatgggtaatagtggatcgattaaccaaggtagctcgattcattcctgtgaagaccacctatggaggacacaagctagccgagctctacttcgctaggatcgtgagtctccatggcgttcccaagaaaatcgtatctgataggggaagccaattcacctctcacttttggaagaagctccaagaagagcttggtacccgactaaatttcagcaccgcgtatcacccgcagacagatggacagaccgagcgtctaaatcagatcttagaagatatgcttcgcgcatgtgtcctggacttcgggaagacttgggataagagtctcccctatgccgagttctcctacaataacagctatcaagccagcatacaaatggcaccttatgaagcgttgtatgggcgcaaatgccgaacaccgctattgtgggaccaagttggagaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgattttgtgtaccttcgggtcacgccattgcgaggtgtgcacaggtttcagacaaaagggaagctcgcacctcggtatgtgggtccctttcgtatcactgctcgacgcggagaagtcgcttaccagctggagctgcccgcctccttgggcaacgtgcatgatgtgttccatgtgtcgcaactcaagaaatgtcttcgagtgccatccgagcaggccgactcagagcaaatcgaagttcgcgaagatttgacgtatgtggagaagccagtgaaaatcctggacaccatggagcgcaggaccaggaaccgggtaatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaatcgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaacaaacaaagttaaaaaggttttataaaaagaaaaccctaaaagaagtcctctttcccccccccccttccttcttgggccggctcggcccagtccctccctctctctctctcttcccccgcggcccatcggcctccccgcgcgcgcgcgccgctgacaggcgggcccgcccgccgctctcgctgacgggtgggacccacctgtcatcgccttcctcccgccgcgtcctccgccgcgcccgtgccctagcgccgccgccgccgcggattgcgccgcatcccgccgtccccgcgcgcattaaagagaggggaatcattccccgcgatcccctctcccgtttcccccgatttcccctctctctctccctcggatccgtccggattcatcccgtaatcctcgccggcgacatctatggagcccgagatccccgcgcccgtttccttcctctccggccgcgttctccccctctcggtgctatataattgctccccgagctccgctcttccgtttccgccgctcgccgctcgctctcgccgtcggcatcgtgctcgcgccgtgctcctctctctccgccgtcgccgccgagctccgttccgccgccgccgccgctccggtcttcctccttactcggcgacacctccatccgcttcgccgagtggttgccgaccccgtccgccgctccgcttcgcccgccgaccgccggagcaccgtcgtcatcgtcatcccgagccgcgccgccgctttcctccactccggccgccgttctcgtcgtcgtcgttgtcccggggtgagccgaggaccgccgttcgccttcccccttccctcctctctctcgggcgccgctccgccgcgccggtggtcgccggcggtgaccatcggggcgcgggcgcgccgctcccgtcggccgcgccggcgaggccgccctcgggcgcgccctcgcggctgccaagtggacccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagaagtcaagaacccttttttgtgctttgtttctgctgttatgtggagtttagtagagtaaaagcctttttcttttccgttggtcgtgtagacgctgcagcttcggaagatccgctcttcgtggaagtcgaagccgtcgtttgggaaagcgagcaaggcaagtcacatcatccttgagcatattgaatcccagtttgtaaaattatgttgatttaaattattgcattatcgctttatttaaattcccgcgttatcactgttttatctagccatgcctatttacctttgttatgaccttattattattgctattgatattaataccttgttcaccctagaataaacaaaaccctaactagtggacattatattcatggttccactagtataaatttaggtagatgcttcgctgattaattaggcaacattaggtggttttataactttagactttgggaattctcatatcatttggacaccatggaatggttggcttatgttggaattggacacacacctccccctcttttcaaaacccccaaaatggtttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatatggcagagggttggtgccctgctgctagggggctcagtcctgcctgcctgtcccgggtgtcccggccgtagggggattgggtcggtactcttgtttatggctaggatgggttgggagctatgtcacgtcttccgtccgtataccgtggtggtatgtggcacgtggttgcacgcgaggaagatgtgtcttgtgggtaaagatgtacacctctgatcagagtataatctattcgaatagccgcgccctcggttatgggcaagccgagcaatgtacccaagtcagtgttataattcttaaaatttgctcgacaactaaaatgtggaatggttggcctgggttggcttgggacgagctgggacccagggtcgggttgccagttcggtctgaatcatcgtaggccttgggttaaggcaggttcgtgagggttcacggccgtgattaataatactgtatagctctaggatcgtctttataaaatggctttgggcaactaagtgacttttaaatgctgtttactgcaaaacttaacccctatattattatccccttgtacccccttgcattaatcatgcatctgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacctaatccagttgatatgggattatatgatggaaaccacagattacaaagggaattgcggaactcgatgataccgacgagattgtaatcgaacaggttcaattagatctcccggcgacttggcttctgtaggcttcaactccgtaggctgtggtggatgtgctggctacgagattcgatgccttaggtccttccaaggggtcccttttatatcgcaggtcaaccggtctccaagtaggactcggagacatcggactcggcacgatacaatgacgacctagttctgtccgagtaggagtccttccatctgtgaacctcgtgatgaatttccttaacgtatgccggaaccgtccgtattcgcgcaggcatacaatatcgatatgtgacgtatatcgaagggtagagggtataccttacccataaccctgacagtagccccccgacttctgcttaaatgaacttgtgtaaccgatcatgacttctgatgtcgaggttgttgtcgttctcggtgtgaggactgagaaacgaagagtaatcgacaacgccaagtgaagctcaacggtcatgagtgaatttaaattaaagtccgacaaactgccgcacgtaacggacccagaaatttccggcggccatctcttcttttccttggaattcgcaccatcggaagtgtgactataaaagggagttttggggatcccttttgaagtccgcctgttgtgaaaaaactctccaacctccaagcattcctcgtcttctccgctcccgcaaaaaccctagctagctcatttcggtcccttctccggcgatctccagcggcaatggatctcgacaagtctacctccaccagcgcgtcgctgaagaagctacagaaggatggcgcccttcccggtcgcgggaccatggagagagaagtaggaggtactgaaccccagcctgtcctgggtcacatggttgcgatcgaggactatattctctgtggttttcttctccgccttctgaatttcttctcttggtcttgaatttctacggcctttccttgctccatttgaaccccaattccatcgccttcctcagtattttttcgcatcgttgtgatgactacattggggtacagccgtttcttggtcggtttccgactccgggatggcctgaagtcacgctatatccccttccagcgcccttcttctcgtagcaaatggcgggtgaggtggttctatcttcagatagaaaattctgatccagtcttcattgttcctgaggaacaaccagacaagattttcgtcttggaccgcaaaacctcccttgaccccttctcttcaatccttcatcgatgccatcgatgacctccgagtatgaggtttgtcgaggtatgaagtcgctgccgacttcattggtaggcggatccagccgctccaggctcgagcccacccagcctttgactattctgagtcggaggacgcgacccgggtttctcctcagggtatatttcttgtatttaaattgacttccttatgtgcgtgttcctcctgacttatcgaattctagttctcgatctacaggtttgaatagcgaaaccgtggagtgctgcgtcggccaattgatgatcagcggcccaacaacggcgagcaacgttcccgtcccctttgcgagaagggggcagccgaacgcgaaaccgccatcaatgtaagtgtactcggtagcccttttgcatttttcttccaagatcgcattgtgacttcatgaagtgtaggctctccctctgactgatatcatcgggccgctcgtggaccatcaggtggcggcatcgctgaaggagaaagtcgccaaggaggcatctgatgttgttgccgctgcggccacaacgagtggcggcaacgttccgtaaaagggaaggcaattctcctctgtgatcggacatcgtcggaggacgcccaccccctcggtaagttctcctggtccttcatcgcgtagtcgggaatcttccacctcatatcacgcccgttatactccaggcctcggatgcgtctcccccgcctccatgacggcagcggcttgtgacgcttggcgagaagtaagtggatgaactttgaggttttatcacttcatcgagctcttgcagcatgtctcaattctagcctttcacagggcggcgcgggcgaaagcggcgcaagacgggtccggagggacttccagcgcgtctcctgctatggcctcgacagatgtcgtggtcgtacccaggagccacgaggtgacgccgagcggcccagccagcgatctcgcggcaggtcggggtccgccgactgccgtcctcacatgggaggagctccaggtcgagatagggcgcctcctcgaggcttgtgctcgcggtgttagctgcgagatcgcggaggcgagggcggtggcggcgtcgtcggcgaatgagcgcgccgaccggctgacgcgtgtctggcggaggtacgcgaggacctccagaagatgagggaactggtggccggcaacgagcgacaatggcaggggctcgagcatcgcatgtcagagctcgagaacaacttgtcggaaatccgtggctcgttgcgggtcacctacactggtctgcaccagctcgccggggagtgcggtatcaagtccaccatcccggcgaatcccaatgagttctcgctgacgacttcgcttgcggagctagcgacggcgatggaggcgatcccctccaagcacgcggccaggatcggagaggagacatctaacgggatatataccggggcatgccatgtccttgcgtgtgtgaggttggcgcatcttgaactcgatctccagaagatcttggatcagggggcggccagcgacgcgcgcaaggatgtgatggaagaagtcggcgatctgggggagtccctcctcccgctttttgaagagtaggatttcgacccccttgtactctttagtcatgctttgtaaaaccctcattagttctaaccgcctttgtgcgtgcagtcatcaccttagttttctttagcattttgatctcgagtactttgttgtcgtttgtagaggtgttgatgtcgaggatgtccagcagcgcgggcagcctaagttgccagtgattgttccggcacttgcgttcgagccacatgtgccggagggcgatgtagatcaaaattcgcctgtggaaatgggcatggcgacgactcccttaggttagttatctttgttttcatctcctttactcttccgtctggatcgacttgatttgttgtattctcgggagagaagagcagtttgacttagtcgtttccatgcagagcagacctcgagagtgcgcttgctgaccagcatcgtcgcatccagtattggaggacgaagtttgaggtcgtggaactcgagaggactatgctggaagtgaagaaggaccaggccgtggagacactccgaggtcgtgaggtgtcattcaactcgtatctgaggagttgctgcacatccatgtcaagagtctgtagagagctccgagtaccccgtggggatcccgaggaatcggcggtcggatacatctcgtggctgaatggggcctgcgcccagctcgaaggcatcggccagcgtgtcgacgaggccctgaagcaggagtgtcatcgatcaagccgatatgccggggggcatgtattggcttgcatacaagatcatcgtccgtagctgcacctcgagttcctccacaaagggttttctcgttctcggagaactcctacggagatagacggcctggcgaagtcgatggcgccactggcggagaaggtcttccagtcatggactggcgttggtcttcctggtagtgtccgtatcctgtgacaaatgtcttagggaaaagtgtaatataattttggatttttatggaattgtaagaagtacttgtgaaatagaaaagaaatctatctaactaagctttcttactctggacgtagcgtgtaagagtgtcttctcactttacgacttcgatcagtcgtttgagttatacactctccctagcccccagccttgtcatcggagaattcttctcggaagatatggctctcggacctctgacctgcctcggttgaacaagcactgatcctagcccccagccgtgaggttggaaaattaatttccgattacacagcttggttaatacgtacggtgagaactcttacacgaccagatcttacatggtcttttgtcttatcttacatggatccgacaatgccttatcggctctaggcgtccccagccgaagttcctttaggttcctcggaggccttgtcaagacggcgtaaagggacatgaggataggtttcaacgctaggtgtcatctgggtaagggatcatcaggaaggaatactttgattgtaatatgtacctgaaaataggcttaattgaaactgtaagatgtcttacaagtatggatactattgacttatacatagaatttacataattgatcaatgttccaagaatatgccaactcacgaccatcgccgtctgcaatcttgaatgcgcctggccgcaaaacttgtgtgatcgtgtacggtccttcccatttgggtgagagcttgtttcgccctgcttggatttgaaccagtcggaggacgtaatcgccgatcgaaagcgtgcgtgctcggatgcgcttctcgtgataacggcgaagggcctgttggtagctggctgctccaacagcaactcgttcgcgatgttcctcgagtagattcacatcatcatttcgctgctcctcctgatcctcatcggagtacttctgtactcgtttactttgatgtcgtagcttggtggggagcatggcctctgaaccgtacacgaggaagaagggtgtctccttgttagacgttgtcggtgtggtacgcacggcccatagtactgatgggagttcttcgacccacttcttgtcatgtgacatgagcctgtcgtagacgcgggtcttgattccttgtagtactatgccgtttgctctctcgacctatccattgctctgagggtgagaaactgaggcgaagcagatcttgactcccagcctgatgtagtaatcctggaaatcggcactgatgaactgggagccgttgtccgttatgatacggtgaggcaatccgaatatgcaaaatatccctttgatgaatttgatggcgttgtcggccttgatttcccccgtgggtgtcgcttcaatccacttagtgaatttgtcgatcgccacgaataggaacctgtagccctatcctcgtgggaatggcctgagtatgtctagcccccagcacgagaacggccaagtaagagggatagtctggagtgcttgcactggtagctttgtgtgtttattgtggaactgacaagcttcatactgctggaccatgtcgcaggcgtctttgagggcggttggccagaaaaatccttgtcgaaaagcttttccgaccaatgtccgaccggcggcgtgtgacccacagatcccttcatgtatgtcgaggaggagatgtctactgtcgtcggacgagacgcattttaggagtaccccgtttggtgccttcttgtatagatcgttgccgatcatacagttgatttttgctttatgggttatttttttggcttctgcgtcgtcctcgggcaactcttcgctgcctatgaatttaatgagtggggtgcgccggtcgtctgtggtctcgatatcggcaatggcgcgctctacctctgtagcccccgagctgatgttgagggcgaccgggctatcttcgccgcttgcctctttcactgatgggcttgtcaggacgtccagaaaggtaccaggttcgagtggctctcgtctggacgcacgccgtgctagatcatccggctcgatgttatccttgcggtatagatgtcggacctcgatcccatcgaaccttttttccagcttcctgacttctgcgagatacttggataactcggggctagagcatttgtaatctttatgcaccttgttcgcgactagttcggaatcccctttcacaaccagtcgcttgactccaagtgcagctgcagctcttatcccggcgagtagtccttcgtactcggctgtgttattagtcgccctgaagttgaggtgaattgcatgcttgaattgatcttccgaaggtgatgtcaagatgaatcatgcccctgctccttggctgttgagcgcgccgtcgaacgccattatccacgtttcgttgtcgatttggttgtctgacctgttatcaggcatagtccaatcagctacgaagtcagcgagtacctgggacttgatggctgttcgtggcacaaagtggacatcaaactggcttagctcgactacccatttcgcaatgcggccaacaacgtctttgtttctcacgacttcaccgagagggaaggaggatacaactgtgaccctgtgggcttggaagtagtggcgtaactttcttgatgtcatgattaccgcgtagagcagtttttggatctatggatatcttgtgtttgcgtcgtggagggcttcgctgacgtagtagactgatcgttgcaccttctctctctcgacaacaatgacagtgctaacggaatatggcgtggcggcaatatagaggaataattcttcattaggttggggggcaacaagtacagggggatttgataggtagcgcttgagtgcaatgaatgcctcttcggcttcctgtgtccatacaaatttgtcttgcttcttcagcagagcgaagaaaggttgtcctcgctctcccatcctagcgacgaacctgcttggtgccgccatgcatccggttagtttctgtacttccttgagtcttgtaggcgacttcatgttctcgattgccttgatcttctcgggatttgcttctattcctctgccagagacgaggaaaccgagcagcttgcccgatggtactccgaacgtgcacttctctggattgagcatgaggcgatatcgtccgaggttgtcgaacgtttcctgcagatcgtcaatcaatgagtcacttgtcctggtcttgacaacaatgtcatcgacgttggcctcgacattgtttccgagttggtcgctaagtgcgccctggaccgtgcactggaaagtgtttcctgcggttattagtccgaacggcatcttaacgtagcagaataccccgaacggcgtaatgagtgccgtcttctcctcgtcctctttcgccatgctgatttggtggtagccggagtaagcgtcgagaaagctcagcaactcacaaccggctgttcagtccaccagttggtctattcgaggaagagggaagtgattcttgggacacgccttgttgaggtcggtaaaatagacacacattctccatttcccgttgaccttccgcaccatgactgggttggctagccactctggatggagtacctctctgataaaaccagctttgagaagcttgtcgagttcttctcgtatggcttgttttcgatctggtgcaaatctcacgcagtttttgctttactggcttggcgtccggtcgcaccatgagtttgtgctcaatcacctccctggatacccccagcatgtcggacggctgccaagcgaacacatcagcattgtcgcggaggaaggtgatgatcgcgagttcctatttctcgcctagtgatgccccgatcttgacggtcttgtcagggttggcactggagagtggaacgattttgattgcaccgtccggtttcgccgtcttgtttgttttgctcactttcttgggtggctcagctgtggtgggtgggctgggcgtgtgctcgaccatgtcgaggctccgcttgtcgcattgcactgccagcttagcattcccttgaatagtgattgttcccttcggtcccggcatcttgagcacttgatacgcgtagtgagatgcggccatgaacttcgcaagtgcaattctcccaatgatagcattgtatgctgtatcgaattcagcgacatcaaaggtgatctgctccgttcggaagttatttgcttggccaaaagtcataggcaacgtaattttgcccaatggtttggacgatgactgaggagtgattccatggaaaggttgatcggtgggtgtcaactcgcttcgtgggatccccatcgcgtccaaagtgctagcgaagagaaggttgattgagctgccgccgtcgatcagaactcgcgcgaccttgatattccgaatagtgggttcgaccacgatcggatatcgccctgggatgacagcagtcttggggtggtcctcttctgagaattctatcttctgctcagaccactttatcttgggcgcagctccctgccatgttgaacagacttcacgttccactttcttgtattctcgctttgaggagtatgctgtggaacctccgaagatgtgcgagacatggagatcagagtctgggtatgctgagtccgattcctgagtagccgccttagcgtccttctcggccacacgtactcgcttgcctttttccaatgccatgtgttttgcgagcgactttttgaagatgaggcaatcttctagagagtgtctgtccgacttgtgtatagggcaccatgttttcttcgtgtcgctgctttgtgggtctgggcgcttgggagggtccgcgtattctgttgcgagaacttccgcttgagctttccttttcccactcttgcgatttttcttcttgcttgactcaggtgcgtccttggctggtttcttctctcctccggtctttggtttgtcgttcttgcgtctcagtgcgtcgtccgcgtgagcacatcgatcgacaatttcgaataatctccgagtagtcgtgacacacctcgttgccaactcctgggtagtatagcgatctctgacaccggacttgaaggcgcagattacagaagcgtcggtgatttcggggattgtatttctgcactcattaaagcgttgaacataatccttcaaggattcacccgggttttgtgtcaacgcatataggtcgtcttcgatcgtatggcgcttgtaagttccttggaagttggcaacgaactgctgccataggtctgcccacgaagaaatcgagtagggcgggagatgcatcagccatgaacgcgcagagcctttcaatgcagttggcaaataattcaccaacacgttgtcgtccgctccggcagcgtagagtaccgtggagtaaacctggaggaattcttctgggtcggtactcccatcgtacttctctattgctcctggtcggaatctcttaggccatcggacatcacgtagcgaacaaccgaaagctctacacccagcgctgggggtggtgggttgtcggcgatcgtacgtccttcgtggatgtctatctgatgatgaggatgaggaagatgacgacgatggtgatgggtcgcttggttgcggtgtatgattacgaggacgtcggccgggttctcaagaatcctgtcgtcgtctcccattgttgtctcgacgccgatctccatcgtcgtcgtcattatggcggcgtcctcgaccagtatcgcctagcgcccgccgttcgcgatcgtcgtgatcgtggtggtggtggcggttatcacagtctcggtcttcgctcgaacggcctcctcgttcttcgttatcatgacgccgtgaagagacgcgatgtcgggaatggttctcgttgtctcgtgcgcgtcgcgcctctcggcggccattcaggtgatcgcggagatcgctggtgccgcgaggtggagggatggctcgatgaggcgattcccgctgttcagggttttcgccattagcaccgccagttggtggctgttccgggtgcgctgcagcagcggcctcttcgaacgcgttgctgaggttggtcactgattcccgtaaccgttctgtccaccgtgcgagatcgtcgttcagaacgggatcgtagggggtttccgtcagtattgtgttgacggccctgatgtgctgggccagtgtagtcacttgattctccacttccgcattagcgtgcgctgacgtgccgatctcatcgatagccaatacctcgcgcggcgtactcgttgacgatgagccatagtcttcgagcaggtgcaggactgacggttcgtggggatcgatgtcgattaccccaacgaatcggtctgaggttagcgtcgctccttgttccttgtcctcatcactgatggggatacgtgactgctagaccttaggaggtgacgtcttcacggcgctgagaaagaccttgcagcttgagaggtcgtgattctttgtctagtgaataggacagtagacatcacgagttggagaagtatgctgaattccacgctctttgcaggcacgaatttcagcgtggacattgagaaagacccagcaggcttgcaaggtgtgttttctggttttgtggataggacaccaggaccttgtcacctcggaagtgatcctcgtcggctcgtgattcttgtcagaaagacaaggtttggccgcactaggatccttctcgggctcggatgttgtcgacgttcagttctccgctttggcgggaggatccttcgacatggagtcgtcctgggttgtagccactgcgttctcgctttcgatcattgatggaccagccgagatcggcatcgtggcgtaaaccgggaagacgatttcgccgacttgattccacaccagcattgttgaagcaggaactccttggttgaggttggtgttgacgctgttgtcgacgaagctggatgacatagttgtagaaccctgagcaccaagtccccctacctggcgcgccactatcgatggggaatacccgtagaccggatatagagggtactagggtatgctggtacgaggatctatgtagtacgacatcaagcagataaaaaaacaaagattatactggttcaagccccttgataggtaatagccctaatccagttgatatgagattatatgatggaaaccacagattagaaagggaattgcggaactcgatgataccgacgagattgtaatcgaacaggttcaattagatctcacggcgacttggcttctgtaggcttcaactccgtaggctgtggtggatgtgttggctatgagattcgatgccttaggtcctcccgggggtcccttttatatcgcaggtcaaccggtctccaagtaggactcggagacatcgaacccgacacgatacaatgacgacccagttctgtccgagtatgactccttccatctgtgaactccgtgatgaattttcttaacgtatgccggaaccgtccgtattcgcgcaagcatacaatatcgatatgtgacgtatatcgaagggtagagggtataccttacctataaccctgataacaaccactatgcataaacttgtatggtagatgcaaatagatgcaatatctatttggccggatagatagagtaatatgaaataaagacatgtgaattgggtgaaaatttcttaaaaccctataaattggatgacaaattatcggtctgaatataggatacctcgtactcatactttgagtacaaatataccaaaatatacaagtacaagtatgagagatatcccatatccagaagacacaaatagtaaacaatgattacttactactatcttcgttttttaattagtttttactaatacatttaacggttggctttctcaagcaccaatattttgagcaaaagtctaagaaaagcattccgtagcgacaagagccgcagaaagtgaaaaactaccgtagtgaattaggagcgcaacaaattaaggggtaaactgacgacaaattaagggatctaaggtgaacttattccataccgtaggaggaacccgcggaagagatccagcccagtagagcccaacctggtacttagcagccctgaccatcatcagaagcatggggctgcaagttttccctgttataattaggagcgcaagctgcgcaacaaatgcgactgtaaattctgtgattaagtattaactagaaaatcagcatgtttgttggcgcaccgaccagttttacttttatataagtttaaggatcactgcagcatatgagttttcgtaaaattcgttaaaaaaatcattcaaacatctctatggattttaattcttcgtggaactaatcaaattacagtggggattgtctacagtgttacagctgtagtagcagccgctgacatgtgaaaccggcactgctactgcaaatacagtactgcagagcatccatatccatcaaattaggatagtaatatatggctgaggatggcctgtttaatttttacctagctgtgttcggtactcttcccaactctcctctctcgttttccgcgcgcacgtttttcaaactactaaacggtgtgtttttttgcaaaaagtttctatacgaaagttgcttaaaaaatcatattgatccatttttttaaaaaaattagctaatacttaattaatcacgcgctaatagaccgctccgtttccgtgcatgggagatgggttcccaacaccaacctccgaacacagctagagtacatttctctttacgcaatcttttattagatatttctctttaaccattctttagccaatatttttgttttcaaccagataattttacctttgttacactttggatcaccgtgactattcttaaccgtacggatctcaaatatactagccacttagagtcgcgcgtttgcgcgaccataaaaagccatctttgttaaagattaaggttgccttttttttcctgttgcaactaaaatgatcttggccctaaacattaatacgaagttgcccatatgttacatacatgaccaccgtagtatttctttttttttcacagaaacaatttatactacctatgtttttaataaatgacgccattaacttatattcacacggttgaccatttgtcttattaaaaaatttacatatttctaatttattttattgtgagttgtgttacaaactgaaagtacttcaagcatgatatatatcttatttatttaaaaaagaatttggaagacaaatagttaaatatgtatctaaaagtcaatgatgccatatattaaaagacaaagggagtattgttttacttggtccatgtgtcaaatttcaaaaaaacccaacttatgaaattgaagcccattaagtttcataagtgtctatctgtgttgcttgctctctttcatgctggcaagtacgtgaggagaggcactagaaggctccggagggataatgcagtacgtatttgatcggacggtcaacatttatccaatcatgcatctgatggcctttgttttttagcttacgtggcctaatgtgcttttgagaaagattagttccttcattactttagactagctcctacttgtcaatgaaatcccatagccgtatgtagataatttctttgacatatgacaaattaaaatcatatggataaaagacttgatagtggttcaaggtatcacaaatgtcaaattattcggttcaaattaagtgaaaattagtttaaaggtgatgcaaagcgaacattgataataaagagtagcctaaagtgaaattcactcttacaaattatacttgattttaatttcaacaacttatttttcgttatttttgttaatacattttttttattttcaagcaatatataggacataatagacacaggtaaactacatgcctcaatttttgatgaaacctattacattttgtatttggatgaagaaccatcctagcaaaatccattgtatttgaaaaggctaaaaatcataatattccttgtttttctctctctttttacttctttaactttcatctcctcttctcttttgtatatacatttttaatctttacaaatttttttaagcttctttcatctgtaaaatgtaagtaacttatctatatcttatcacttctatattttagagtttgtctacattattttttccacccctcgtaaggtgggcagggaccaagcccgagggaagcttcacgcctgtgcttgccccgtttcggccgagcaacgtgccgtcgtgccctcgtgaaagcgccgtactcttatcctagcaaataaaaggcacactgttttttttaacaaaaatttgtgtgtacataactatcttttgataaaaatggacatatgagatttagccatatcattaagagtacattttttactaatgatttaatctgtgagtaaaatttttcattggctgcaccctcatacacaggaaccatatattgataaaaaaagtaaatttcagccacatcaatgcctcagaaaatttgacattttgatccaatctcaacttacactatagatggtaagtcatccagccgcaagtttccagcagtgatagataggggtggaaacgagcctagccaagcctagctcggctcggcttgcagtggctcgcaacaaactaggcttggcttggctcggcttggttagggaaacaagcttaaaacttgagctcggctcggctcgtttcctggctcgagccagctcgagctggcttgtaagacttcctgttaaaacacatcttcatatatattttgtaattattaaaaaaagcaagaacaaattattaacatgtaaaattaaaataaatttatggtaaatttgaagttgacaaataataacgccatataaaatgaaataatcgatataaacacaaaatggcctaggctcgcgagccaaaataagcggctcgcgagctagctcggtttggctcattttagcaacgagctgaaaaggaggcttgggcttggctcgtttggcttacaagccgagccaagccaaccaagctcgacccaagcccgagctgagctcacgagcctgagctttttttccacgactagtgatagatatttggtttggtatgtactctaacattgtaagcgactagtaatttcgttgagctctaatggtcttagcagctaattactctctacactaatatgaccagagcaggattatacttttttaatttatttctgcttttggcttaagatggaaaaactaccccctataatccgctggatcagattatctcgcgacaacgtcaattcagtaaccacaccctcctttctttctgaacacacttgctgtcgataaccatccaagacccaactttatttagcccatctcaatcagcaacacaaatgaccctgacccacgatccactcacaagccattgctcgagatttgagcttgaactcttcttggcgggacccaaacagtgcacgaatttcagacgcattgcataatcaaacccccaaaaaggaaaaagccgtcgcctttcaccaagttcgaattatttttcgcctttggagacggcacaaaaggcaagaaaacggaggaggaaaactaggccacgcattgacaggatcttctcccttgtgttcttgctgcttttctgctccatgtcctgctcttggagatggccatggctctggctctgagctgtggcaggaggcagagagggaagaaaggcggcggcggcggcggcgactgcggcggccgccatttccatgtccactaccatcttcctcgccgggtctgcgcctcctcgtttgttcccaatttgctgcctcgttttttctcgctgctgtcagcttgcgtgctggttcctcctgtgctgttcttggctgtgcttgccttcctcgtcttgtttctctggttcaccttgctgtattttattcgctccctgtggaacaaagacatcaacggtgagaccttcgagaggagtagcaacgatcatggcagcgatgctgataaacgccttggagaaggcgttgcagaagaaggaaaggcagagaagaaaactctgaagatttcgtctgaagattgtgctagaaggtttgagatagaagaggtactacatgttaattctgatgattctcaaaacttgcctagtatggtgtcatctgatggttgcctgaactgtaagatgcatactgatgatgaaaaactcatcaaagaggtgactgtctttgagataaaaagaagggaatcgggagctgctattgtctgttctgatggtttgtcacaaaagcgtcagccacgagatatgtcagttgattggtttgaggaagaaactaaaagtggagatatcatcaaatcaggtgattcatctccaactgtactgtcaactttttcatctgaatttcatgatttctctgacaacaatgaagtggtagggttggccacggattttcttgatgtaaacaatcaaaataaagcagtattgctagatagttcatctcatcgtggtatcatggacaatcattgcaaatgtggtgaggaattttcttctgataaggaggctccagcttaccatttatttgaaaattatgattttgttgacaagcatgaaacaaaagaggtggtacttggtgatacagtagtcttgacctttgtagatgatttagccaatgatgactctgaatatagggaggatatttcagaacaaaaggatccaaataatttatcaggattgcttgataacgttgcagatattttttaccagcagcaagaaatacataaggtggttgtttctgacgacaacaagccacctgaagttttgttcctcagtggaaagcaaactgtcagcagttcaggtgaatttagttctcctaatgagaatggaacatcaggatttccttttgattctgtttgtgaagataaaaatggaacagtggcctatcccagcgtagcatcccattataatatcggtattgaagatgacaaatgtgaggatcatactgacaacaacatagaggaggcatcaagtatcgcatctacaaattgtggttctgctgataagcatcagactatacaggtgttgcctgtttgtttagcaaatggagataacattgatgatgttgcttcattggggagttcaatttgtgaagacgttgaagataaagacaacaaaagtaatgctaattgtatttcagaggtgagtacaaaaggaagtttcgcttaatttctgaaaattgtggctgttagcttgttatatatttctgaattttactgctattgtatgtttcaaatgaatttgaaagggagctccacatggaaacggaatgccacttgttaggtccccagcatcatggtggaatttatgtggagttattgatgtgtttgctggatgtaaagattgaattgaggtgagaagatagttcattccaattttcacaccgtgacatcgtttgaattttgaactgagggtactccttttaaaacaaaacaaaaggaatccagctgcatggccaattattttgttgatcatcatctgctgcaccgtgggttcgcacaattgttacttatttattttcttgtcaatattgtctaacacaagagagatttttcttcggtggtttttactaagtatgatactacagtaaaaaaactaaattgttgatttattggggtataatggtattttttttcctctctatatgatttgggttttttatttccctttttttccccaagagactggcgttactcgtgtggaccaccagcctatctcacttaaaacgaaatataccaattttactggaattttgccatcctgcaagtatcatttccttttctcacccaaccccgacatagttcttagatgattgcttgattacaaagaatgatctgtaattttattatcgtcaactctcttcgcagtatttggacatgacacattttctgttgtatgcagatgttggcaggtcatgggtggaactttgggacaacagaaaactttagatgctcatcctaatcctgtgttgacaatgaagaagtatttgacagtttggattgaggtattgaattgtttatagtgaggctgtttgttttgttggatgtatatatttttttgttagattgcctgattagtttttgacatgttgtggttcattggctttttctttaaaagctgagtgctattctttctcaagaaagaaagcttcaacttactgtaattgattttgaaagggaaatggaactggaaatgcttgttgacttgttgtatagtgtatactatatgctttgagaaatatgtcttctacagttgtctggatgtacagaaatctgcctgctacattaaagcctacgtatttttaacaagaaaaaataaggcattttctatcccaaactaatttactggatcacttaacccccctgaattatttaaaaaacaagaagaatttaaaaaaatgttgagatgtaagttacaatgcatataccattctacccaaaaaaaagagagagaaatagcgtcagggagtaaagtaaaatttttttagtagttgggagtgtaaaattagcaaaaacaactaatttaggggttgatgtgtctgaaatagttcctggcgagtaaaatgaactttgtttttctttttaacaagaactaggaaacctgccagatcaatattaatcgacggctgtttcgctgtaagaaaatgattattctatcttagtctaacaacataggcaacttgttctggagatgaataatttaataaccacagtaaaacttcacttatcgtttattggcatgtggtaaagtcaaaagaataaaatgagaaaaactgtagaatgcaagtatgcaacaattaatagtagcattgcatcgtatgtgtcagtagaaatattccccgaagtgattaatcctaaccctatatctgtaaagcaaattaacaacaacaatcatatctctactacttaaaataaaaaataagaggtgcttccatcatccataaaaaaaactggacgataaaaaccaaatataccaaatatgtccgtaaaaaaaaccgcgtggaaaaaaaaaggaaaaaaaccaaacctgtccaataaaaaagggcgaaaaaacgaaaaaccgggcgaaaaaaccaaatatatccgatctagaaaaaatatctgtaaaacaaattaacaacaacaattatatccctactacttaaaaaataagaggtgcttccatcgtccgtcaaaaaaactggaccgaaaaaccaaatatgtccgtaaaaaaaaccaggcggaaaaaaaaggaaaaaaaaccaaacctgtccgattaaaagggcgaaaaaacgaaaaaccgggcgaaaaaaccaaatctatcggatccagaaaaaaccgggtgaaaaaaaaacctaaacctatccgatcccaaaaaaaaaaggggtgaaagaaaagggaaaaaaaaaccggatctgtccatcaagaaaaacgaatccgactctgggtaaaaagaaggacggaaaaaaattaaaaaaaaaaagaatcaatccgattctctatctctaaacgaaaaaaatccaactctatatccgattcctccttaaaaacgaaaaataaaaggcacctctcctctaggaggattggagatctgtttgcaaaaacataacctacatgttaagagcataatatttttatatgttttaatttttgggtatgtacttttgcatttgagtccctgtaatttttatatttatatttaagtccctataatcttgcaataaggtatttgaggtcgttttttaaaaaaaataataaaagggagataacaaaggcagaaaggtgcatcaaaagaaaaagaaaagccgcaaaaaaaataaaggaaaaaagaaaaccaacaacaacaacaaaagtctgtttccctaagtggcaaaaaaaccatagatccgaaccaaaaaaatcctattcctataaaggcaaacaaaaagtggtgaaaaaaagctagatccaattcctttcaaaacgaaaaaaaaagtctgattcctataaaggcgaaaaaaatctgaaaaaaacatctaaaaaagttcgtccgactctctaagaaagtggcaaaaaaaatggtttgtaaaaaataaaaagctggttcgtataaattaaaaaatgaacgcgagaaaaaaatagaatgggtgaaacaaagtctcagtatatatctcttctctatttctaatctaatctaactatttaaaaagagaaaatgcatgagaaaataaaaacggttcaaaaaaacgcgtgagaaaaaagtgagaaaaaagcgaaaaaaacactctaaaaaggttttccatcttccataaaaaataaaaaaacatgtgagaaaagttatttccatcgtcgatttttttaaaaaaacttgcgaggaaaaaaactggcagaaaaacgtaaacctcgcaagaaaaaaacaccgtctattaaaaaaacaaatcgctttgaaaatactattagaaaaacgctaaattgatggacgcttgagtcggatagaatccatcaatccagcagcagccgccgccacgctcacccgccaccaccgcgctcgcctgccaccaccgcgctcgcccgccgcccctgcctgcttcgcccgccgcgcgctcgctcgacggggcggcgatggctttatggagacgtgacggcagcaggacggaatgtgagggaggcgccgagcgagacggtgttcacagactccgtcgacgggagcagctccagctctggcgccgcatccaccgacgagtggccggtgacgatgtcaccgcccaggcgcccatgaagacggtcagcagcgccgctgcgggttcatcagccactgcgtccttctgcaactggcgtccctagaaacgacgctggcgaggctcgaccgacaagtgatccaagcgagaacatcttgagctgaaggaatggccacccgaaccgtccacgtgggaatggctccggaacggtggggacgtagagcgtgagctcctcggtgaggttggacaggctcgtcatctcgttgacggcgtcgccggatttcctcggatagctcagcagcgaattggcgatgacaatgccgtagttgaaccgcttcgctggaggaactcgccgaccagcttgaccttggtgtagcggacgccaagctcagctgctcaccgccggagacgccgaaccagctccacagctcgatggggtgcaccgtccattggaatgtcagcggcggaaagcggcgctgccgccatcgccgtggggtgatctggcccatcatgatgctgccgtggtgccggggaaggtggtatgtgttaaataaatgaacttctgtcagttgggatttgatcttatactcttatttactttctgttagtttgttagctattttccctcctcccatggttttctgctcgctctgttttgagtcagcgtggccgcgatttgttcggtcaagtggtggagcttgacgagcgggagagtatcgagctgagaaaacgagcagcaccatgaactagcgtcggtgagcaccacctcccttctgctcgagctcggttgagggctgggagcttgacctccgtgcccaccgcccaccgcccaccgccggccgccgtcgcgccgccgtcctcctcctctcccgcctcgccccgtcgatgcccgcgttgttcgcgccttccagctgcccgcgacgcctgcacacgcccgcgcctccctgtcgacgcctgcgcaaggtcgctgcacgcccgcgtcgtggagctccgccgggctaccgtcgggcatccccactgtggccgccgccggcggccgccattgcggcgccgcgctcctcctttcccccctcgctccgccgaccgacctacaggcgcagagagagaggaggaaccaaggaagagaagaaggggaagatagatgactcagcggactcagcctgacatgtaggacccacgtgggtcccatgctaaatcagccgtcacgtaggacaaaactggtgtcaaaaccaccgaaggacctattgtaaccggtttttattagttaagagacgctgaatatctggtttatggttggaggacgattttgtaactccatcacaagttggggaaccttctgtgtactttttcctctttgcaatcaataggtgtcaaagtgtcaactgattttacgtgctgtttcaaaaaggttaggatcactttcattacttcattcatagtacatctctagtacggattattattaattattagattagtagattgaatcgggtgctgccaaataaaatggccgccgcaccattgccactgttcgccaaagctcaagagcatcggttcctctttcctcctggttagttcttctctctaccgcttcttccgtcctgattcttgctcgacatccccgttttgagatggccacgccgcatcagttgaacggcccaacaaaccgcgtggggtgccgctggcattggctgcgagccgtcgataggcaagcttcaacgctcttggagcgcgcgtgcagcgggcgacaatttagtcactggctcaccctctctcttccagtctggctttttagggcccatttgaatagcaggaatggaaaaacgaaggaatatgaccctctctcttctagtctggctttttagggcccatttgaatagcaggaatggaaaaacggaggaataggaaaaacgtaggattctgacatgaatgcaggggtaaaacagaggattggaaaatacagtaaaaaacaggaatgaccgtttgattggaccacagaaaaaacgtaggaatcggatgagatagatagactcaaaggaattttttcaagaggttagacctcttgctaactttcctctaaaatcactataggattagccatttcataggaattttaaaggatagtataggattcaatcctttgtttcaaaggcttttataggaattttttccataggattgaaatccttcaaattttctacacttttcctataaatcaaaggggaccttagtctacgtgtccaccttgttgtcggctaattgctctctattgtagctctcagtgctcatgccatggaagctgctaccggcggtcttctgcattatgctgccgctgttagtgatatgccctagaggcaatcatagagatgattgtatcacatactatgtttacatatttttccgattttgttccttgaaatagataaactcattattggttaatgaatatgtgattctttcataagactttttatgttatgtgttgctatttctaaaggatccctgatcaaatatcatatgtggaacaaatatgtttagatgatcaacacatgtattaattgatgatcatgtctcatggatcatggtatagagataccaaattaataatgtggacacatgttagtgaacatgttgttggatagacccaacatgagacactgcaagagccatatgtgttgtgtcatcagttatctcatttagtgttggtgttgaatccttagacctgagattatcatggttcccaacatgtgtagtagcttacttagggactgctaaacgctactccgtaattgggtagttataaaagtagttttcgggtatgttatgaaacatgtagtgggatatgaataatcaagatgggatttgcccatcctatagagagatatctctgggcccctcgatgttgtagattatggaaatgcatgaccatgccaaaggtgattgaggagtcaatcataagttatataatctatcaacaggttcgagtgaatgattgagctattagaggatggcacatatctagccttgagcttaatcgatatcatgaggcaaaagggttcatacaagtatacactagaggttcagccgatctgatctttatgtatgcccggtgggtcaatacgttctgctaggggccgctgttgacgcgtggaccgaaaatgagttttcgggttacagccgagtatatatgaacctacagggttgcacgcttaatgggccggaataagggaattggatagagatccaatatgagcttaatgtggataaggatccgaataggagtcctacgggccttggaggcccgagtgatggatcctatatattcgtgaggggtgtgacaggcggaggcattgcatcacgtgagaaaccctagccgtcacttccctccccgagcaaaaccctagccgcgcgcgggtgctagcacatctgtgcgtggcgttccgtccctgtacgtgtggataccagtaaaggctctgctggtttgcggtgctgatcggcataggagtacagcgaggagaacgcacgaggaggagaaggtcgagccggtgcgatcgactacttcctctacatcgacgcgcgctacttcgcgagagttccttcgacttctcagcgtcttcttccgctgcgcagtgcgtcgagtggtaacgatctatgatctaatacttgcatggttcctggtttacgcgatagaaaattttgatttatgctattgtagcctacgcgtatcccaacagccgcaacggcgcaaggtcacctcgcctccccacaacagtgcaacacttcgccacagctacggcccgatgaaagttcaagtgccattaatttggttttggtgattaatgataaatccaattatgaaactaatgttatatgagcatttatttgccttgcctcgtgtgaatatgaaagtggaatttgtgagaggtgattcctagacttcatatgagttgagatagaaacgttcattgatggtggatctaaataacaaggattgcatggagatcaagctatatgtatcactctttctctccatgcacatattgatatagttatatagaatattccatgtgattgacatatgcatgtgagtctaatgttttgtttgagtcttatctcttatttagtttatttacattgagaacgtggagatgatgaaggtatgcatttattttaatatctatatttgataaatgccttctattttttataggataagcttccaatgtttcatctctatttatgcatactcttgcttcacacaaatattccgtatgcatatatttaggggagcaaatcctataccttagttatgaatgtacttgatccatgttattcactttcgtttaattgggatctttacatttaagtatatgacacttggtattaattaatactcatcacttgttcatatcatttaatatacacgatcggttggtcaacatgtggaggttaacaaccggatcattaggactaataatttcattgagttgaatgagataattagatcccaaggattgtaaaggtgttgatgctcaagtgatatcattacacctaaagataccaatgatgacaaagtgaagatattgaagatgtaagatacaaagtggctactatgccaagacggtgaagggcaagtgatgctcggtcacgatggaccatgcggcggtgaagggcaagcaatgggcttggcgccgaagaaccaaatccagtggtaaagggcgggtgacagctttgtcattgttggaggtatgtcacgagggccctcggctgaacttgccaaaactatcaaatcagcgagacgccgactgagtccaggaggttcatctcaagcgaagccaaaagacgaagtcaagagggttcgccaccaagctcggagggctcaccaccaagtttcccctctaggcgaagcctcaagtcgaagcatgaagggtttgccgccaagcccgaagggctcaccgccaagtctcccctctggtcgaagcaggaagggttctccccatggaagaccggcttctccaaggagcccacctagcagcacggcccatgaaggccattcgccttttatgggtcgggccagggtcccgtcaaggggcccatagttagaatggacactgtatgccccttttaatgtcctatcataagggtatccatgtaaattcctctgaacatattgaaccatagagggtatgggtatgtactaagaatataaatagcccctagggacatataagggagcatccccaaaaattttcataaattaatacattatttactattcaaatcactccaccgagagaaccatgtccttcgacgtgaagctcttgttgtttcgacaacagccatgatggaccgtgcaagaccatttgaagctccaaataactgcatcaataatttgaagaatatatggtgaaatggttttggtgttggcgccccttaagataaaggaaggaagatgaaaagaagtcattcctattattatattcctcttcctatttaaatttgagtataggaatgttgtactatcaagagggatgcaacatcgatgtgtttgtgtatgtctcggtgctcaaagtgacctatcatagtgctaccttgggagaaacccaagatttaacctatcctttgattggttttataccttgtttttttgttgagttgggtagtcctctgagtgagctttctatagagtccaaaatcataaaaaacggactcccgagcgaaaagttatggtcgttttactctgtgcttttcgaaaattccgaaaaaaatctcaaaaagtccgaaaatattttggaaattctgaaaatggccacacttccacttctctaggggttgtgccacatcgacagttgaacaggcccacaaaccgcgtggggtgccgctggcatcggctgcgagccgtcgataggcaagctttaacactcttgaagtgcgtgtgcagcgggcgataatttagtcgctggctcggcctctctctcctcgtctctctcctccaacctagctttcgagtctacgtgtccaccttattgtcggctaatcgctgtgttgtactcgctcttaggttattgtgtgaaagttaggaaccacaatcttcccagcggtggtgtttgttggagtcgaacatagctggccaaatgggcggccggcctagcacggcacaggcccgctggtggcacggcccattaggcatgacaactgtagcgggctgtgccgtgacggcctacgtgccaaggcctcagcctaagaaaaaaattgaaatttgaggggaaaaagaaaaaaaggcagaaaatataatatgaaggaaaaaaaaggataaagataggacaaatgtgagggaaatttagaaaaaataggaaatatgaccgaaaatatacggtaaaaatataataaaatatggggaaaataaaaatatgagaaatataagggaaaattagaaaattgtaggaaaaataattgggccgtgctcgtgccgtcctgttgataggcgtgccgtgtcgtgccggcctatgggttaaggtgctgacccacaggccggagtgccgtgccgtgcctaggccggctacagtaaggtcgtgcctaggctggcccagcatagcacggcccatttggctagctatagagtcgaattgttgggcctttatgttcactgtagttgctgttggagtattgggtggcattgggggttcctagctggcgcttacgcgtcgctagcgcgcaccttccagccgcctaactatacttaacactaatgagtgtaattaggaaagattttttttaagtaaccgattgaaaaaaattttaagttagatttagaaactttcgatttaatatttaaattttgaagtcaaattttgaaaacattcaactcagatttgaaaactttcaactcgagatttgaaaactttcaactcagagtcaaaaactttaagtccagatttgaaaattttgaaaactttcaacttgagattggaaaactttcaactcgtatttaaaaactttcaagtcaagatttgaaaattttgaaaactttcaacttgagatttgaacattttcaactcgagatttaaaaactttcgactcgattcgaaaactttcaagtccagatttgaaaatattgaaaactttcaacttaagatttgaaaattttcaactcgagatttgaaaattttcatatccaaatatgaaaattttaaagttaagatttaaaaattactagtaaactaatcattagtaaaaattggaaactaatttaaactaattatcctatccgtacggcaggaacaacagatagaagaagaagaaaaaaacagcagcgtccaaaaaaagaaaaaagagagaagcgcgcgcttgcatgggcctcatgggctaaaacgcgcgccggcaacgcgcgcgcgcgtattagctgtcgcatgtggcattaggctacttatcgcattgaagaagattaactacccgtccagtaaaaaatagtgatgtttggaaatacatgcaatcaacgtgcttaaactttggtcatcaacgtcttcaaatattttgattcacattttggaagtgatatagtgtcacgaccggaaataacccaacgggctttcctgacgtgcgtgcattaatccttgtcccaggaggcaaggtacaccaaaagttgatacaaatcagagtttaacaagcggaagcgtaaatagttaacttattacatgggcaacgaaggcccagcacactcaaagacaacgaaaaacagcggaagactagggcgacgaccacaggcgcttgacggcaggcacgagctagacaccaaagccttcatcttccaggaactcctcatctgggcttgggaaaattaagcaagactgagtacaaccaccgtactcaacaagacacacccacaaatgcagaataaatgcaagggagtacaagggaattataatataaagggttagggttgcagtaaacagcatttaaagacatttagttgctcaaagctactttgtaaacgcgatcctagaacgctacaaagttattaatcaaggccgtgaacccacacgaacctgccttaacccaaggcctatgatgattcagaccgaactggcaacccgaccctgggtcccagctcgtcctaagccaacccaggccaaccattccgcattttagttgttaagcaggttttaagaattaaaacgctaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttatgactagactgagtcacaaactaagccttacccattagacatgtggaagtacggtagtgctttgcaacagaggcccgaagaccggtccttaaacggccgaggtgctaccatcaaaaccatgcaccccgagcccagcctaaaaccattttagggggttttgaatagagggggcggtgtgaagccaattccacaataatccaacaattccagagtgtccaagtgatatgaatatttcccaaagtctatagttgtaaaaccacctaaggttacctaattagattgcgaagcatctacctaaaattatactagggataccatgagtagagtgtccactagttgaggttttgtttgtctagggtgaacaaggtaataataataacaataacaataataatatggtcataacaaaggtaaataggcatggctaagtaaaacagtgataacgcgggaatttaaataaagcgataatgcaataatttaaatcaacataattttataaactgggattcaatatgatcaagatgatgtgtcttgccttgctcgttttcccactcgacggcttcgacttccacgaagagcggatcttccgaagctgcagcgtctacacgac

SEQ ID NO: 68408 - DNA, 656 bp, Oryza sativa
acgagcagcgcgcgcacgccgatcagcaagccgccactggctacttaaagccgtagcctgtagctcagctccaccgcgcataaacctagccagctagcaaccgacaagccaaggcgacggcaatggcgccgacgacgacggcacggcggcggcggagcaggcgccgccgccgcagcatacgaggaaggcggtggggctcgccgcgcacgacgactccggccacctcacacccatccgcatctcgcgcaggtatgaacagccaaccgtataccgctccatgctaagaggatctttgtcgtgctcgatgattgctcgatgattctcccgcgccatggcgccattgatgggagattgggagacatatggagcttttttttttctctccagagtttaagatgatctatcgtgtttgaatttgactgttactctcgtagcaacaatagtttacaggatgtccacatcgaattagtgaaaatcgccgtttggttcatggagttaatagaatctgaagctctcatgagccagcgtcacttgagctttcgatttttgttttccccttccatttccagtcatttccagccttctcatcggatttgtagattgtagttttgcatttgatttccctgcgagcaacggtgctcagcatttgcacatcg

SEQ ID NO: 68409 - DNA, 941 bp, Oryza sativa
  unsure (1)..(941): unsure at all n locations
tataaatattttcatgaacgccatattaatattaatattgaattttttattgaattaaaatccccttaacacaatccaaagtagttttggtcctatattatgacagctcaatcaataattttcataataaatcagtggaacccacctgtaagaagagatggacgggtcctaccaattttttttttaaaaaatattgactagtctatcacataagagcaaaaccaatctaaagtctaggtggtaattcttactcactcactagtttggaggtctaattcaaactttttttcctttccctaatccctagtaccaattgtttcagcgtattatatagtaatatgaccattgacaggtcgttcgtctttatgataaagagcattgcaatagaaaaaatagtcttatatataaacttcttccttataatgatttcaacattttatttaattagtcgcgagttataaaaaaaaaatcaagattcgttcataacgtggcacaatcaacatttttataagaaatttgtatgtaaccaactccactaaaaaaaattaccgcatattctctctctctctctaaacttctgtctttttgagcgggtgtgctgggagcctgggatggccaaactggagcctgcagtttcaagataagcttcgctcgtgtgatctatggtgcatgtttattatgcttttttttacaaacacacgtttactcacccttataaacacacgtataccatatttctacgtgcatatccgaaaaactggaccgacacatatttagattgatgaagttatcatgaatgtccgnnnnnnnnnnnnnacgtcgcctatcactgaaaaaataaataaccataaatgcgagcatccgtgtcaagtctaggattttgaaatcgggtagattgattctcccaaaggaacctaactaaatgagctatgctcacttcg

SEQ ID NO: 68410 - DNA, 660 bp, Oryza sativa
ttagtacatatgaacaagacttattccccatataccctatttacatgttgttcgattaatccttttcacatggcaattggagggtattgggcaatcaattaatttcacatgagattaaggagattaatcccacaccccttcaatcgaataaacccttaagataggagggatgtgagctgggttggctaatcagattgtggtgttagccaatagaccctaggagaatcctatgaaaattctgttgagaacaagtagaattttggaagggattgattaaagaaattgaaggacttctacggtacaatacactagcaatatatatttttggcatatacaaagatacactaggaatttccatgtacaagttcgcgtgagcatggtggagagtggggagttgggcatcattgctgctgcctcctccaggtagaggaactagctagggttttgggtgggtcggaaattgagaagacgaaagaaaggcaattcgaattaatttacaggcaggcaggcacaatagcgtggtgcgcgtgaacttgcagtgcgtgtggcgtctctctatggcggtatggcccatgatggacgacaactacgggactggggaatgaaatcaagtgaggaacacgtctagcattgtgcatttatgtacaacagttgtcgggt

SEQ ID NO: 68411 - DNA, 968 bp, Oryza sativa
tcagagtcaatctcttaattgattggagcgaccaagcccaaagtaagccttaatttgatcgtggagggatattgcaacaatacagtgatcaatgtacaacttgtcttatgggaatgtgatgactatatgtatgttgatgcatgttaatttattgaccagtgtgacgatctccatgcatgacacagatgattctcaataggtagtatactgccccgttagaatcagcttggctatttccttgattttcatgagcatatttttcaaaatgttaaatgacagacttcgtacaaaaaatttatgtataaaggttattttaaaaaagatagataaattttttatttttaaataattattactcaaattatatacaaatcacgtttctcgctttatgtgcagctaatgagttgtttttatccctggtttagaacacacccttagcttgttttcgcctagctaattaactagcacaactcgcgtaagagaaacatgcttgtaaatagttttactcttactctatataatatgtcggtattatctggtgctggttcgttaaaaaaaataattggccagtttaacgaagtgagcatagctcatttagttaggttcctttggtagaatcaatctacccgatttcaaaatcctagacttgacacggatgctcgcatttatggttatttattttttcagtgataggcgacgtacccgtcgatagcaagacattcatgataacttcatcaatctaaatatgtgtcggtccagtttttcggatatgcacgtagaaatatggtatacgggtgcttataagggtgagcaaacgtgtgcctgtaaaaaaaagcataataaacatgcaccatagatcacacgagcgaagctcatcatgaaactgcaggctccagaatggccatcccaggctcccagcacacccgctcaaaaagacagaagtttagagagagagagagaatatgcgg

SEQ ID NO: 68412 - DNA, 553 bp, Oryza sativa
cccatattttatttttatataattttcttgaatttaattagagttaattcttattccgacatttttcaatttaattgatacaaatatagtggtaataatattttactcatttctatcctcactaaatattattttaaattgtactttaattatttacttagtcaatttacttttcagggtttattcctaactaattatccattattcgcgatttataaactccgaaatcaaaattcaataaaataatcgaacaaaattggcatgatgcaactttatttaaaaagtttttgaagatccgtatttttagagtttagattttgtcgtcgaatttttagggtgttacaacaaccatactcttttttcttttttctatgttattaaatttacttgtatagaaatagaaagaccactaataaaaaccgttgtacgagtccttagtaccctataactgcgcgattatcggcggtttgaaaaactcttgtggggacaatgggccttggcacaaacgtggcatcggcgcatcgccaacattgtcaagctggcatgaaaattg

SEQ ID NO: 68413 - DNA, 1161 bp, Oryza sativa
acccaactaaagggaacaaaagctggagctccaccgcggtggcggccgctctagaactagtggatcccccgggctgcaggaattcggcacgaggttggcagtttaattaacggtagtaacagtgatttcacatctaggtttaccgctgagaaataaggcaagatgtaacttagtgtactgataaaatcactctcgtcattggtgtctagctgctcactcccaaagcctgacaagttgatgccactgctgtctgagggctcctctggctcaacaatcagctcagtgcttgtgtagttcttccgggcttgtaacaccttcatgaacgctccttctggattccctaccgatgcttcttcagctgtcaaaaaagaagagactgctttgatcatgaaagatgatgggatgggatgcatcagtccatagctgtacaccccagtcacacagagtaggagtcagcaaacattcgagtgccattcagagaggagaaacacacacccaatcctaaacctatgaaatggcaacaacaaaaggagaaaatacatcttttgaaaacacggccacctacttggaacattccatagtgtgacatagagtaactctgtttaggattatttcgttgatccccagaggccaattgcccagtgctcagtcaaagcccaaggtggaagacaagtgcttccctgatgagctggcctctctgcagactgctccgtaccctgtgctgtcctgcctcagatgcagagagagcacaaggctcctgctctcctcgtcctcggtgcacctgtgttcgtgctaccatcacagctgaatgcaatgaaaggcggtcctctaaaaggagcagggtggaaatgctaaagtggaggccccgtcccattgctgatagatcctcatttggcatgcgctccaccctccccattttttgctcccacgtatggtagccccatcacagaaaatgcgacatggaaaaacgccctgtgtcccccctagtttttaaatttgggcagggatttggggtgtatgttaaaagtttttcaaatttgccagattgcatgcctatgttgttaaatacccaatgaatccctggtaaaaaaaaaaaaaaaaaaaaaaaaaaaaaaaaaaaaaaaaaaaaaactcgagggggggcccggtacccaattcgcc

SEQ ID NO: 68414 - DNA, 1383 bp, Oryza sativa
ctaatttatttgtgtactatttatcttgtattggcgtttatgagtttgtgtctgcttcatgtttgaaagagttttttttaagttttctatcgaaacaagatttcggcaataataaaagggggtggctatcaagctaggaaagtggatgggtttggagacaaggaattttatacaggttcaggccttcttattcaagaagtaataccctactcctgtccggggatgattccgccgagtatgttattgattgtatgattgggaaaaaagaatcgtcccgagaggaacccggacccctccttatataggggaagggatccataatacaaagtacaatccatatcctaacggaatatgggattacagataaaatacaatcgtaaccgactaggatcccgtgtagtttcttgacatacaagtttagaatctaacccgagtcctcataaagatattctatctatatttggtaccgtatatccggctggaatataaccgccatgtagatatggggtaaccataatctccatagtagcccccgagaccttcgcagttgaccaaaatagtcttctcaaaacaaaaaacaataatccgagtgcttcaattcaacttgctccggcttgccgagtgctaaaagactgtgaagggcgaaaataaaacatggtgcatcgagtagatgcacctaattaggtgtagcccccgactatgtgattagttgaaaaactaaacatatagttgagaaacaaaataataacacaattgtgcatcatatgacaaaagcatacacggcgcctagataggcatgctagccgactgctttttagccataatgaaaagagtccgagtggtttacactctaaaaggttcacgaatgaacacactggacaggcatccgaatataaaactctaaagattacccaccaagtattataaaaattatggtaatgaataagtctaatagcctgggccatgactatttaccataatgaaaataggtatatagcataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaggtactgttcaggcctaggcccatttgcacctccgatacccttaacaagaagtcccgagatccaagcgacgcttcgtcttccccgccggaactctcgccattttccccactcc

SEQ ID NO: 68415 - DNA, 5212 bp, Oryza sativa
cctatatacatttctatatatatatatatatattatatgtatatatatatatatatatgtatatatatatatgtatatatatatatatatatacatatatgtatatatatatatatatacatatacatatatgtatatatatacatatacatatatgtatatacatacatacatatatgtatatatatacatatacatatatgtatatacatactacatatatgtatatatatacatacatatatatatatacatatatatatacatacacatatatatatatgtatgtatgtatatatgtatgtatgtatatacaaatatgtgtgcacttaagtaattagaggccatatgcatatatatattaacaaaatatgagtttgcaagtaagtaaatatacatatatattaccaaaccaagtacacaaaagtaaatgcatgtgtgcatatatgaatacatagatatatatattacaattcgttcggacgttgtaatatttgtttctgctactacgacttggtgacatcggaagaagaaggaccggctttatgaatagttgatccatcgtaatagaattctcctgtgggatggagaatatgcttgttgatgaatcccattatctgttcttgaacagcccttatgaaatcatcgtgggtggtgttatctatcaggtaaatcatatgttatttggaaaaaaaatgggattatatatatgaaaccagtaagcaataattgacggaagaataaatttacgtacttcaaggtcctggccagtcctgatttggtgtgctaagcagtgcatgtaatggcatacgtagtagccgcacaagttagtccccttttcctgctttgcacactgaaagagaaacaacgagagatttagtatgcatatctgatttagaacaaagaagtgattcaatacaaaattggagctagcatgtaccaaccggaaaattgaacctccgggtgagtttttcattccagatcccgcggaccaatgtacggaaccgaatccatgctctatttagagttgttaggaaggattaatttattatccgagatctagtagttatacaatgattcataatgacagtgcaatatatgacaatacctatctatcacttcaaaaatctttgcgaaagttttctccggtttatccactgaatcgtagacatgaactttggatttctcaaggtcgaaaagaagaaggacccaatggaatctgcaatttgcattacatgatacatagtatgattgtaggaactttgtaggaacaaaattgaaggaacaaaattgaagttaattatgattgtaggaactcacgatgtgttgtagggaagaagtatgaacctcttataatgctgctgcaccaggaaatggacgatattgtcctcggtttgtttctcgtattgttgtatcatcagcgtgttcactttgcgtgggtccatgaattcagtattgaatttgttgtgttgacggcacaactgaatctccattctacaacggggaaaaggaatgtgtgtgagcaacgttcaaaggaggaacaaaattgaactataaacagtacttacaaagtccacgcgctgagaatagagacgtcgagggccttcaggtggtataagtcgaagacttctttgtagcggatccaaataacatcttctccttggtaataatctgagtttcgcaccctagctccgaacatctatctacccatcactgatttgtccatgtaccattgatggaaccggtacatctgtgtaggtagctctctgatcttatcaggcatgactagcggttcaccgagtttaaacgtgtacatgactggagccgtttcgataggtgcatcctctagcaactgctccatactcagtcccgtatctttcaagaagttgcatatctctagttgtgccggttctacgactaacgcttcaacctcttgtcgtggctgttgccccagctgagggacttcctttccgcacttcactgctaaaggcttggctttaagagccttcctcaatgttcgatcatagtcagaaacttcgaccggtttgcccggttcggccatcttaataaagtgatcctgaacctccggggctatagggatcttcttttccggactacgtggcttcaactgctccctaacttccgctctaacggcttcatcgagctcctccggagtcaagtcgtacgcccttttcttgagagcggggagccatggctcgtcagatctggctttcttcttcgaccttgatggtgcgggttcatatgggcgggaccttgacagtgtagacttggcagcaagtgcacgtggaggagtagttgcccgcgagcccgacggtgcagacttggcagctggtgcacgcggaggaggtggtggtgcaggggaaggagccagaggagactgacgaggcggtgatggcggaggagactgtgcttgcggcggggaaggaggagcgggcggccgttcttgcccgggaaacacgatgtacttcttacgccagagtatgatggcgtgggctatgtctccaagtttcttctccccgtctcctccggggatgtcaagctcgagatcctcgtaggttcgttccactagctctatctcgaccttcgcatatccatgtggaatgggcctgcaatggtatgtactcgaagggtccgtggatatggccatgcccgacgtgaccttcacaagaagtatagttcattaattactaatcaacatatatatgtaacaaatttcgcatttcgcataccttgatagacaagttcctgaatggagtatgcatatcgcagggtgttcgctgcgtgatatcaccaacggggaagtgggttgcttcgtgagctgccactgcctcaatgccctctgatccaacttggcccgttgatgcgcagctgctgcggttgcccgaggggctcaccatgacgggcgcttgtgtttccattccgcgctgctcggccaggcgttggtccacctgtcttgtcacctcctcttgcatccttgcctcgtaggtggacaccctgtactcaagatcgacgatcttagcttctgtatccctcttgctcctcatccaactcctatacgtgtggatgtcctctttgaatccatatttccaaggaatgacgccttttcctcgcattcgtcctagatgctcaggattctgtagtgcgagggtgagctcgtccttctctgtcgggccggaaagtcccctgcgtagaggcttcaattgcatccgcaagtcggcgtgctgcatctcgaatctcatcgccgaatatgagggagccatcacctggattgagcgatccaccgtgtgcatagaaccagttcctcgatcgctcaggccaattagccgtggccggctcgataccccttgctatcaagtcagcttccaacttgtcccacttggggattgcctttgcatatccgcctgacccaagccggtgatggtatttcttcttagctgcattggctttgttcttttctatctgtgcttgcccttgcgctccagtcttgtatgccacaaacgcatcccagtgatccctaaacttgttatgcacgttgaaattaggtatcaagcccttgaggatgtatctcttgtacagatctgatttgtagctctggaatagttctgccattttcttcagggtccattctttgcatctgggacgatctgcctcagggatcgtgaatgtctccagcatggtggtccacaacatgtccttctctgtgtcagggagaaagctatcttcatccccgcgtgacctagttcgacgccagtatactatgctgatggggacgttgtctctcacgacccaaccacaatgattcacaaactttcgtcctatacccgtcggggctactggttcgccgtctggggcaatctcagtaacgatgtgccttccctcaagcttcatcgcgggacctcttttcccacgtggcctcttctgtccggccgacggttgactatcaatcccctcctcggtcccctcctagttagcctcctggttaccctcatcgttgccctcctcgttcaggtattggttgggatcctcgttcccctcatcatccacccagtactgactgctgccatctgcgatcgtgtctaacaggatttgttcgtcatcgcggtctgccatctatgcgtgcaaagaaaaaaagacagtgaggtcatggacatcaacatgtacagctcagacgtctaaaccctacaagtatacatgtataattcgctaagtcgttgttctcgttaagtcgttaagtcgctaagtcgtcgttctcgctaagtcactaactcgctaagacgctaagtcgttgtccgtcaaagtcgctaagtcgtcgttcgtgaaagtcgctaagtcgctaagtcgtcgttcgtgaaagtcgctaagtcgtcattcgtgaaagtcgctaagtcgctaagtcattgtctgtcaaagtcgctaagtcgtcattcgtgaaagtcgtttagtcactaatacgtcgttctcgctaagtcgctaagtcgctaagacgtcgttctcgctaagtcgctaagtcgtcgttcgtgaaagtcgttaagtcgctaagttgctaagacgtcgttctcgctaagtcgctaagtcactaagtcatcgttcgctaaaacgttctcgttcaaacgttccaccgtggagtcggcggtggagtcggcgcacggcggcggcggcggtggcggcggcggtggagtcggcgcgtggcggcggcggtggtggagtcggcggcagcggtggcggcggtggcggcggcggaggtggagtcggtgcgcggcggcggcggcggcggtggaggtggagtcggcgcgcggcggcggcggccggcggtggagtcggcgacgaagatgacggcgaggtcgatccggtcggccggcgcgtgtcaagatcgatcgagagagagagaatgcgagatcggaggcgcaagatttgcgcccctcaccttgagggaggcaacgctgccggttgcgttcgcgagggcagatgagcgcggcgagcacgacgacgatgacggcggaggcggcgacgacgtctggggcggtaatggcgcgggaggaagaagatcgatcgtggagaagtctaagtgtggtgcagggaagccgatgcagtggatatttatacccggtaatcttttgtcccggttcgtggcttcaaccgggactaaagatatctttagtcccggttggtagttacaaccgggagtaaagaa

SEQ ID NO: 68416 - DNA, 10752 bp, Oryza sativa
ccacaaaccgggacaaaagatgttttcccgctattccaaaatttgtattggtcccggatactgttaatagccaggactaaagatgtgtacacaaaaccgatttatggccttcttaaattgtcttacaagtcgaaataaataccaataaatccaatataattagcacatggccgatttatatggtttcaaagtccaaataaattccaaaatcgtacgtaatttacgtatggccgaattaaatgttttcaaaattttaataaatagaaataaacatgatatgcctaagtaaatggtctcaaagtataaataaatagaaataatcatttataattaacataaggccaatttaattatattcaaagtgtaaataaatagaaattatcatttataattaagatatggcctacttaattgttttcaaagtggaaataaataccaataatcagttataaataacatattgcctaattaattgtattcaaagtgtaaatcaatggaagtgaccatttataaatatcatatggttgaaaaatagtaatacattacaaattaagcagttgagaataatatattgatccaaattgttcgaccttcaatacaatacaaataatttacatcttccatcaaacaacctaggtcactgtcttcctcacgtactttctcctcactattgttccttcgctatgatcgttgcgtgagtacggcgtgtcctcctatgatagtatgatgctcgggtcaaccatcactgcaaacggaggttgcccctcaaacagatcgtaattttcgtcagtcttatcctcgactccaacgattttcctcttgcctgggagaacaacatggcgtcttggctcatcgggccctttccccttctttggtttgctatccatgtccttcacgtaaaaaacttgtattacatcattggctagaacgaatggttcatctgagtatcctaccttatttaagtcaaccgttgtcatcccgctgtcatcaatcgttacgcctccaccagtcagcctaacccattggcaccgaaacagagggaccttcaggggtccatactctagttcccaaatgttgtcgatgacaccgtaatatgtgctagttggaccatcgtgtcctatggcatcgatacgaacaccactgttctggttcgtgttctttttgtcttaggctcttgtgtaaaaagtgtatccattgatttcataaccttggaatgtagttaccgagccggagggtcccctagccaagaaggctagttgtcggtcagttgtctcgttacccaggaggtgttcttgcagccaagcggggaaagtatcaatatgatggcgtgtaatccaggcttcggacttgccactgttttctgagcgaacaatcgcaaggtgctcatcgatgtaaggagcaaccaacgaagattattgcaaaaccgtgaaatgtgttttacggaataaatcgttgtctacagtcataattgctctccttccaagtgtgccctttccccgtagtctcccctcatggattgattcgggtaccccgattggctcgaggtcttcaataaaatctacgcagaactcaatgacctcctctgttccataccccttcgcgatgcttgcttccggacgagaacggttacgaacgtacttctttagaacgcccatgtacctctcgaaaggaaacatgttgtgtaggtacataggaccgagaataccgatctcttttacaaggtggcacagaagatgcgtcattatattgaagaatgagggtggaaagatcaactcaaagctgacaaggcattgcaccacgtcatgctgaagggcggctaaactttctagatcgatgactttctgtgaaattgcgttcatgaaagcacaaagcttcgttattgttgcccgcacattatcaggaaggataccacgaattataacaggaagcagctgtgtcataagcacgtgacagtcatgagactttagttttgtgaacttcttatccttcgtgcttattattctctttacattcgaggagtatccggacggtaccttgatgctctctaggcattgaaacatactctccttctcttccttgcttagggtgtagctcgccggacttaagtaatggattcctttatcgttcggttccggatgaaggccctcgcgttgttccatatgcttgagatcattgcgtgcttcgagtgtatctttggacttcccatatacacctaagaagcccagcaggtttatgcaaaggttcttagtaaggtgcatcacgtcgattgcgtggcgaatgtccaagacctcccaatagggtacctcccaaaaaatagagtttttcttccacatcgctgcgtgaccatcttcgctctctataggttggctaccaggcccctttccagatactactttcagatccttcaccatttcgaacactgctttcccgttgcgatgtttaggcttagtacgatggtctgccttttgttcgaagtgcttgccttttttccgtacagggtggtttgcagcaaggaatcgacgatggcccatgtacacaaccttcctgcaatgcttcagataagtactttcagtttcatccaaacagtgagtgcaggcgttgtaccccttgtttgattgtccggataggttactaagcgcaggccaatcgttaattgtaacgaatagcaacgctcgtaggttaaattgctcctgcttgtcctcatcccacacggggacaccctctttcctccacagcactttcagatcttcaaccaatagtcttaggtacacatcaatgtcgttaccaggttgcttcgggccttgaataataatcggcatcatgatgtacttccacttcatgcatagccaagggggaagattgtagatgcacatggtgactggccaggtgctatggccactgctcatctctccaaatggattcattccatccgtgcttaaaccgaacctcacgtttcgtgcatcttcgccgaagtctttaaatgttctgttgatatttcgccactgcgacccgtcagcggggtgtctcagcatcccatcctatttacgttcttctgcgtgccaccgcatcattctagcatgtgatttgttcctgaaaaaccgcttcagccttggtattatagggaaataccacatcactttagcaggaattctcttcttcaaaggctgtccgtcaacttcacctagatcatctcgtcttatcttgtatcgtagtgctttgcaaatagggcatgcttctaggttttcgtactcactgcgatacaggatatagtcgttcggacgcgcgtgaatcttctgtacttccagacctagagggcagactatcttcttagcttcgtacgtactttcgggcaattcgttcccctccggaagaatgttctttacgagtttcaataactcgccgaatgccttgtcactcacaccatttttagccttccattgcaagaattctaggatggtactcaactttttgtagcccttctcgcaacctgggtacaacgttgttctgtggtccgctaacatgcgctccagtttctgcacctccttttcactttcgcagtcctcctgtaagtcccgcaatatttgaccaagttcatcagcaccggcattcccttcaacatccagctccgcctcgcccattgtgttttcttcaaatccgccatactgagcccagtctggaatgttctcatcttctacttcatcttcttccattgcaaccccaacctctccgtgcgaggtccaacaattgtagctacgcatgaacccccactgaaacaggtgggcatgaatagttcgtgtggtggaatactccttctggtttttgcacttgtcacatggacagcttataaaaccgttacgcttgttatcattagccccacccaaaaaataatgcacgccgtcaataaactctttcgaccaccaatccgcgtacatccattgccgatccatctatatgaaatacatataaatcgtaattatacaaaatccaagatttacaaggtaattacataataacacaataattgaatataattattcatacaattaatcattattattaaattcattgtacatatttttcatgttttaattacattataaacaaatatttaatatgtttttcttattttaatattaaattagcttagttttataatttcatacaaaattatatgtaattattcaaacaagtatttataatcttctttattccctacaaacactttctctctcatcatcttccatcacattttctagagggaaaaatatgtaaaaaaaaatagctccaaatgtagatgctaagcaaaacaaagagtaggatgaagttgctaaccttttgaagacctcaaatttgtatattaccaccaaaaaaatttacttaaaattttgacagcacctccctccctcaaagcttaattttgaagcaatggctcgggctggaggaggaagaaggggtatataaagctgtgcaactttagtcccggttggtaacaccaatcgggcataaagatctcaaatcactttagtcccggttggtaacacgaaccgagactaaagatcccaagccccccgacagaggtctgacatgccctgtcaggaggtgaaccgggactaaagatgatctttagtcctggttggtgttaccaaccgggactaaaaatcccttcgtcccgttgaagtaataaaccgggactaataagccactttagtcccggttcgttttggaaccgggactattgtggaaattggccgaccctccaaatacctcttctccagtagtgaatccaccatcggaaccactggtatacattgctaatagttgctattatgtcatgtatgctccatctagtttgagataatgtgattgaaagagtcttgaggattgtatatgtcacctagagggatgaataggtatttccaaaaatttcttaaacttacaaacagcttagaactaactggatagtccggtaccactgcagacaatctgactatagagcagtcggatagtccgactgcatcagaacaatccaatcagagcatcgccagagaaaaactataagtgacctggaaaatagaaatagaaatgaaaaaataatggtggtggtggcaggatgtagcgtgggttgatcgtttagaagcacgaaagctccttgaggcagccggtggcagtgcccttggcattcttgcagacggccatggtcttgttgtttgtgccagagtactcgaccttgatgtcattcaaggtgacgccggtgcacggcagcttgtcggagcagaggaggctaacggcctcgggcgtggaggaggtgccggtgatgttcttgaaggtgatgtccttgatggtgaccttggagttgcagttggcagtgcagatcttgttggggcagtacttcatgtcgatgatgatggggttagcaacgtcctccatcttgatgttctcgtaggtaaacttggaggcggtgagcaccgaggcggcgtcctcataggacttgatccggacgccattggtggacttcttgagcacgcagttcttgacggtgacgtcggtcacgtccttctcgtccttgtatctgcccaggctgccgacgctgatgccgtagccggggccgcaggtgacgccggagatgttgatgccctcggtgccggggccgatggagatgcagtcatcgccggtgccgatgaccgtgtcgatgatgctgatcttggaggagtcgcatatgtggatgtcgtccgtgttcgggctgtcctccggcgcggtgatggtcaagtccttgatggttatgttcttgcacttgaacatgttcatgtggaagaacttggggttcaccagagagatgccgctgacgagcccgttgttcacgaagtcgagcaccaaactctgcatatatatttatgtccatggatcataccaaatgagatcgatgcatgtctctatcatcaatacatgttgtgtagatgcatgcatacgttggggaggatcttgcagatgtatttcttggcacaggtgttcttgctccagacggcggcgccctggccgtcgatcttgcccttgccgctgaattcgaggttatcgacgcgcatgatctccatccagttcaccttgaacaaggcgaggtcggtggagccgagcaggttgccgtcgagctggatgacgatgtcacccttacatggcccggtgaagttgaagggacccgtcacgaagtcgcccttggggaagacgatcgtctgcttgccggtgccagcgcacgccgccgtccacgcctcgttgaccgccttggtgctgtccgtcttgccgtcgcccttgccgcccagcttcaccacgtcgtgggtgctaccgccgccgccccccgaggcggcggccggcccctccgccttcgcgccctcctccttggggtagtccttcgcgtgcgccgccacgcacaccatcgccagcaggaacagggcacggacgaaccccatctttcttattcactctagatgtttctctccttattctctcttcgccactggtgggatgatctgggaggctggaggagtaggagaatataactggcgccaactgctatgttaaggcgcgccaattttagcgttttgcttttgctcgtgccatcactaacctttggatagtggcccatgcgacgtaggtgcatgtgtgagtgttgtccctgcatgtcctgtgtatcctctttgccgttgacgaccacttgaacctttcttccccaattgccggccacacatacatattttaatttcgtttgttttggtcgctaactcgatcgatctcaggcaccgcatccgccgccgcagagacctccgaggacgccgtcacggtccctatgtattcaacgtggttcatcagctaatcacgtcgatgacaagttagatgatttattgaactgcagtactaagctaatttgttggtctaaattatagtacatgtttcatttgtatgtattttgtgggaaatttacgcgttgtatttgtccccaaatttgtgtcgttcatttcttcctaatttatttgtgtactatttatcttgtattggcgtttatgagtttgtgtctgcttcatgtttgaaagagttttttttaagttttctatcgaaacaagatttcggcaataataaaagggggtggctatcaagctaggaaagtggatgggtttggagacaaggaattttatacaggttcaggccttcttattcaagaagtaataccctactcctgtccggggatgattccgccgagtatgttattgattgtatgattgggaaaaaagaatcgtcccgagaggaacccggacccctccttatataggggaagggatccataatacaaagtacaatccatatcctaacggaatatgggattacagataaaatacaatcgtaaccgactaggatcccgtgtagtttcttgacatacaagtttagaatctaacccgagtcctcataaagatattctatctatatttggtaccgtatatccggctggaatataaccgccatgtagatatggggtaaccataatctccatagtagcccccgagaccttcgcagttgaccaaaatagtcttctcaaaacaaaaaacaataatccgagtgcttcaattcaacttgctccggcttgccgagtgctaaaagactgtgaagggcgaaaataaaacatggtgcatcgagtagatgcacctaattaggtgtagcccccgactatgtgattagttgaaaaactaaacatatagtcaagaaccgagtggttttatagcgaagcacgcatggtacttagtaaaatacccagccgactgcttctcaacttgaatacatcaaggacaaaaaatacaataagggccgagtgatgaacactcaaaaggtccaagaatagacatatttgataggaatccgagtaagaaactcttaaaatgattcaccaaacatgataaaaaaatcatggtaattaatgagtctaatagcctaggctgtgacccttaccataactaaaagaagcatataacatgctaaaagaatgactatgaataaaccagtcatctcaaatcaacccaaacagcttttgcagcctaataaagcttacaaaaacggtataacacctttctgtcaggcaccttttgtttgcatcgtgttaattttaaagaattagcaaaccgcattaaaaaggatttaatcagcattgggccacaacattgtgagcacaaattgccaaagcaaaaagtgcctaagtccctaaggatcacaacaggccatgctggaaataaaattgggctgaagtactgtacaggcccaggcccattagcactcccgataccctaacaaaacaccgaagtctaagcgacgcttcgtcttccccgccgagactctcgccatttccccattcctcgctacagtacaagactgcaccgacggagctagggttcatcaatccgctccaatccaccctcaaaaacttcacgaaatttctccccgcgtccaccgctccgattccccattcctctccagccatatctcaaactaaatcaaatcatccagttcacatttatggcgggagaaagagaaagcttcgagagtcagtgggcgccctccgatgtgacggaagacaatttgaaggagatggtggcgcacggcgttcttccagcgaaggagattatcgggtggcgaccggcattcggcgaagcattcccgactcccgatacgcatgaaatcgtggtatttgctcacttcttctatggcggattttctcttccaacctcgagatttttccggggcattctgaacttctacgggattagcttgcatcacttgaatccaaactctatagtacatattgccaattttattcacgcctgcgaagcttttctaggcattaggcctcatttcgccttgttccgccgcatcttcttcctcaagccccagccaaacaaaagcaaaccgtgcattgttgggggagctggtttccaactcagaggaaccttgagccaaaaatatttctccatgcccttcaaaacctcaaacaaaggctggcatgcaaactggttctatgttcagaatcctgagcccgcactccccgagtactgctgtcttcctccagtttaccaggacacatggaactcattgcctatgggagatgaagccgctcaggcagtggaattgatggaacgcatgctaaaactgaaggaacaaggtttgcaaggagaacagatcaccaggcactttatcaagtgtcggttagctccaatcaaagaaagatcccgcacagccttcgaattcgacggcaagcatgacccaaaccgtgaagatctagattctcttgacttcaaggtcatgaaggaaaggatgtataagatcttctcaaacgccatcggtgtcagctactcacacttgctgctagtcgtaccgttcaatgcgttcaaccctcctccaccggtaagcactcaaacatttcaaccttcctcaaaagtatgcttttactctctgttaagctaattgaaagttcgaaatatcatgcccaggaattcgctttgatgaaatcggatcctccaattgctcaacgccgatcacctcgccagcagactggtcaagcgagtggaggaccaaaaattcgatctgacgctcgaccaagtgctcccgatccagtcagccagtcagatactcgcaagaggaagctggttctaagtgacgatgaagccgatgatactaccaggaggcctgaagaccgagagacgaccaagaaactaccaaaacaggctactccaaggaagaaaacatccagtcgccctgtgccaaagatcaggaagtcttctaggtgcaactcatataacgatctctcttatattgatgcgcacccattgcggcaataatactgataatcaaatttgcaggaaactatctgatatagacccatctgggaaagactctgacccgactaacatggacacgagttcttccaaagaaaccgggccaactgttggggatcacccgagtgacaatcagccggcaaccgataatgtagaatccagtgatcaacctccaactggaacccagtcggtcgaagctgaagccggagttaatcaggagcccccgactggaaaccagtcggacgcaaggtcaagccaagagactccagaagtcgaaacccaagcagatagccctcatggacaaaacgccagcaataaccagagatctggatctcctttaaaggcatccgaatccactcgtcctcgtccagaaatcattacgggtaaacacttttgtttgaaaccatgttgacccaaataaactctgatcaattgtctaacctttgttagcgaatacattaggaccaatgattagtgatgaagaagaaatcccccgtatacaagcagccgaagattcgtgccctcccattctggtcaagtggtgggatgataacttgcagcctcaaggaattgtaataaaccggcaaaaagaagacgaagaggtctgccaactgaaaaaggcactcaaccaagcgactcgcattgtaaatgtaagttctctggtacctgatctcaaccatcttgtttgccatttaattcatgcgctaattaaactgtcttgcagaggattcatctcaggaaggaagccaaaacggcaaccttagagaagttagtccctcatctcggaaccctcgaagccaccaggaatcaactgcacgaagcgaaagagcttgccaggaagaatgaacatgacctgagggatcggatcgctgagctccagaaatcaaat

SEQ ID NO: 68417 - DNA, 5873 bp, Oryza sativa
caaagagacctggctttaaaggaagttgaaggtatcaacaatcaatacctcaaaagccattatcctccatatgctgacttattaatgtgaatctgttggtgcagaccgcaagatcaaatctcaagctcaattcgacgtcctagtcggcaagatcaaaaaacttgaaggagcccgggatgaggtcgctaacgctgctgccccaattgttcaagcgatgttcttcaataacaacggcccgagtgcacttgatgcttctgaaattttcgatgaccaggcatcttcatcatcatgtaggtgtagtgtgggatggccatgaacttggctagagccggtcgtccgagtatagcatgatatgctgtctcgaaatcagcgacttcgaaacaaacatttcctgtgcgaaaattctcccgagtgccgaaggtgactggaagagtgatctggccgagtggtgtagctgacaatcctgggataacaccatggaagggtgcattactcggctttaattccgtgcgaggaatctgcatatcgtccagggtcttagcgaaaaggatgttgagtgcgctgccaccatcgatgagagtccgtcggagcttgacattgcgaaccactgggtctagtaccagggggtaccgccccgggtggaccactcggtcgggatgatccgagcggtcgaacttaattgctgtctctgaccaccgatattggggcgtgttaggctgaaccgcattgatctcccgttctgttagcttctgttttctcttggactcataagtcaggggtccgccgaagatgtaattaagttctttgcgatgatcttgaaaaccagtcggggcatcgtcttcatcatctctcttctttgatgtgccttgatctccgtctgaaggtttacgtgcgttcttgacatattgttctgtgaactatttgtagacgaagcaatctttggccacgtggttggagttgggatgatgcggacattgggagttcattatcttgtcgaaggtgttgacgtggggacattgtcgggaagatggagaggtggtcgccacaagttcttcgggcttacacttgtgatccttgtggttgttacttccactcccccctgcagtcggcgtgtccttctttggcttccaagtggtgcccgactgtttggacgcggtgatatcatcttcggctttggcatactcgttggctttttcgaacatctgcttaaccgtcctgggaggtttacgtccgaacttgccgactaggtcctcgtggcgaatgcctttggtgaaggcggcgatgatgacgtcgtcggtgatgtcggagatcttgttgcgttgttcggagaagcgccggatgtaatctcgaaaggattctccagacttctgaacgacgttgtagagaccaaactgtgttccggggcgttcgaaggtgccctggaagttggcgatgaagtgatcacgaagttccacccatgatccgatcgtgccacggggtagtccgtggagacaggatcgggcggagtccgctagggccacaagtagatagtttgccatggccttgctgtctcctcctgctgcgtggatcgcgagtccgtagacggtgagccaagactctggattagtggtgccgtcatacttctcgattccagtcggcttaaagccgactggccaatccactcgacgcaggtcattagtgaaggcagctactccatccacgtcgtcatcgtagcgatttggtgaatggcggtgacctcgtgctgcacggcgctagttgattgtgtcgcgaagatcgacggggcgctggtgaggtggagagcgaggccgttcgactcggcgctccctgtgacgttcgggaggcgagtgaatagatcgttcgtcgtgacccctgctcctgcgactagatcctgtgccggtgatgctgaggtttgactgatgatgatcatgagatcggaggtgagggactcggctaccagtcggggtacgggtgcttgcggagttggctggaaccgaggcagcgatcatggtcttcgtctggttcaagatgttgacgacatgatcagcttggttgagtgcgtcttctttgaggagggtgtcgagaagagtgattgctgcaaccgcgttctgctggggggtgcgaaagaccgctgttccatcgacgtcttgttgcccaatgaactctctcgctcgtcacccggattccaaagcgcgttgccgtcgatcttcagcctcctttgcaacccgttcgcgatcttgttgctcacgctgtattcgttctcgcttctgtcgctgtcgcacttcctccagtcggcgacgttcagcttcttgtcgtgcgcgatcttggtccgcttcttaggctcggcgctgttcttccgtttcgttgtcagccatgaatacgccgaagaagaggggcgtgtagttatcctcatagctgtcgtcgaagttgtcgaagtcaccgtagtcgtagtggtagccgaagtcgtcgtagtcgaggatctcggttggtcgagaactgacgccgggggagctgaggtagccatccaactcttccatcgagactgtcccaagaggttggagtataacgccaacctccctggatctagactggatcggggccgatgccggagctcgcctagatctccgagtgggagatgttttggatgtgaagacggcggccaagtcatcaggaagtttcatcaagattgagggataggactcgtcgtcttgatctggtcgcggaagagtagattggatctcgtccgagtggtttgaagccgactcgggagagatgatcttggagtaggactcggccgagttcggaataccgaatggcacgggaacctagtctctccccgactggtttgaatccgagtcaaggagagagatcttgccgaagtcattggtgatgaagttgaggctgccgaaccggaatgcttgcccgggagggaaggcgaagtcgtcgttgtcagaaatgaaacccatcgcacttagtcggcaagaacttgacgtcgcccctacctggcgcgccaactgttgaaacaagatttcggcaataataaaagggggtggctatcaagctaggaaagtggatgggtttggagacaaggaattttatacaggttcaggccttcttattcaagaagtaatatcctactcctgtccggggatgattccgccgagtatgtaattgattgtatgattgggaaaaaagaatcgtcccgagaggaacacggacccctccttatatagggaaagggatctgtaatacaaagtacaatccatatcctaacagaatatgggattacagataaaatacaatcgtaactgactaggatcccgggtagtttcttgacatacaagtttagaatctaacccgagtcctcgtaaagatattctatctatatttggtaccgtatatccggctggaatataaccgccatgtagatatggggtaatcataatctccacattttctttgagttgcactcattttgagtgatttagtgtaataattgattgtaactagcttaagcaaagatcaagatggttttctatttcattatctaaaaaatttaaataaaaatatgataaaaaaattgccgtccgaatatgaggatcgacacatgtttgttgccttgcagcattgctgagacgaaagcatctttgatactccatatgtctagtatacaaatgcttccaagtacccaatctaacttttggtttggatcgttttggttggtatgggatatgatgggctgagattccatcttggattggagtggattggactctcaacaaatgtgggttggattggagtggatgcagactgactaaaaatgttgattcatggactaaatccatgggttgaccacatggattggccccaaaactgaagaaatgagtactcgagtagttgctagggcagacagggccgttgctccactccgccgccatcatcgtcgggcggtgctgctggttgctggtcgccctcgccggcctcgttggctttctacaggtgactccatcggcttcctccgccagtcctctccaccaccgccggtgttgctgccccaatcgtcctctcccagcaccgctccgccacctctaacctcctctactccctactgtcggcaccaaaaatggttcaccaccggccttctagatcgtcatcgagttttctttccaggtgtgtcctaagctgattggatccttcacctcatggttcagtttactcttctaccaatctactctctgttttcatcgaacacttaattttcttatttaacatgatctttcttggttctgatcactaaccctgggtgatctcgtgtgtttggaagcagttattactttgcgagtttggttttctttacctttatagctctgtttctggcatgtttgatgctatctgctaactagagttcttgttttgctttgctttctgaatattgctgaacttctctgaatttcagaaaccaccatttgcatcatcataattaattattttgcttaccttctcaagaaagtgtgactgagaattggaaggaattttgattctcttagaaggtgatctaaagatggagacacaaataactgttgatgttctgttatttttcatggtgttgaatggcatgtttaggtagctttgctgaagatgtgaagtgttgagcctgtaatctgtagttattagtaacactataatttttagtaatgttgtaatccctggttagtagctgtaacctttggttagtaatttctaataaaattctgggattttcaagtctgctagtaggctgcatgtattgatgcatggtggtgttaggctgttttagctcacctgttttgcccctgcagcttctgcattcccctccgtgtggaggcaaaccagttcataatccatggattagctgtggtctgtgtcagagttacggataaggtataccatctatcctggatatacgatgagtaccgatacggtatacccgcgcgtatacggatagatcctatatgcgttaaggaaatctatcacgtgatagaaacagaatccacgggtggaaggagtcctactcggacgagactgagtctttaccatattgtgaggggtccgatatctctgagtcctacttggagatcaactgaccagcggtataaaagggaccccctgggcaagacctagggcatcgaatattaccgccaacacatccaccacagcctacgaagtcggagcctacaggagccaggtcgccgggtgatctagtcgaactaactcaactatggtctcgtcggtatcatcgagttccgttattccctttgtaatatgtggtttccatcatataatcccataccaactaaattagcgctattacctaccaaggggcctgaaccagtataatccttgtcttttgtttgcttgatatcgtactacgtagatcctcgtaccaacataccccaataccctctatatccggtttacaggtatgccccgtcaacagtcgacagtctgagaaatgggtttaacccatggattgggttgaacttggtttgaggaacgttgcaagttgggttgggtggggttagctaagagagtttttttgattggattggatcgacagagttgttacaagcgcttttggactgggttagattcggggtggattctgacccattagcaggcttaaattataccctcttatctgtttactaccgttaaagatcaacggtttgtatttatttaaaatccatcaccggtccctaaatttgtaccgctgtgtcatcctgatccctaaactcgtaaatcgaccgttcagatccacaaacttattcgactgtgtcatcccggttctaaacttgcagatcactcgtttaggtcatccaacttgttcagttgtgtca

SEQ ID NO: 68418 - DNA, 1662 bp, Oryza sativa
aaaaacaaaaagaagaaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacagttcaatcaagaggaatcaacaacagaacaactaatcaaacgtattatgaagggggttaagatgctgatacatagcaagaatattacttcaaccccgatttgtaacggtatttttatttgattaatcaccggaggggagagattcctcacctgaatctttcattgccaaagaaagatagttctgagttacagagattgggctataccagcggcaagccattacagattaaacagaaaaaggggaggagatataaagaatccaaaagagaggcccccaccttcccaaagagacaacaattgatgttaggcacctgcaaaaaacccaaccaaaaaccagagcaacctaaagctatcacctaagctcatcaacaaacattttcttatgcagacttggaaacgccagtactcctcactgaagggcctttctgccacaaggtcagcttggtttaacagcgaccaaaagactgtggaagtcaaaaaccacccgcatcagccatcaagaattcaacttaaacttgttgctgcttggatcagtgcttgctgacgcaatttgtgggaaggaagccccagaagagggagggccactgaaggttgcggccataggccgcccgtatcgagtcttcttcaatccgactataacaattgcttgcaagttccatgacctccaaggtcctttcagggaaggaagcctcaaaggaggaagggccgctgaacaatgtggttgaggacatgccaaggtaaagagaggagacgaacagggagctagacaagagagaagtggcagatggggggaccctacggatggaattccaacaactgcgacagcagggaagtgcttaagatcagatgctaagccagccaaaagagagccatcagttctaacaacaaagacctaagccatcaagcaaggagcatgcctaaaagagatccagagagaggtgaggcacgagcaacacctagatgatggatgaaagcctagctggtcagggcaaggagcagcgcaaggatcggtgactagagagacatcacagttgtcggtgacatgggaccgggagtatcatgactagaggcttgaggcagacacaatcgcccacgtggcctggcaccctcggggggtgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtctt

SEQ ID NO: 68419 - DNA, 732 bp, Oryza sativa
gatacaaagacctaacaatttctcaagacaggactgattgtgtatatagaggttctgaccattcttatactaccagagagaagtatttaggttgtgcttgcaaaaaaggactatgaagatgaccacacaactgaatgtactataagaatctcctagaaaaaagaatgtactacaaggcatacatgttccgttgtctaaatgaatatatcttcagccaacaatggaaaagtgattacgatagctcactaagaaagaaagaaatggatcacagcaagggttgcaattaaaccacaggatgaaggtacattgtttgataggtcaccattatgatggcctcaatgtcacttgaacaacttctacaagcatgagtgcatcaagctagaaagaaagtatgatcagcaaaacacctaaatggcatactgatcatatgtgtagtaaacacttatgtaaagcacacatgtcagtgttccccccaaagcaactaaacaactaaccatgcaagtaaaggaacaatgaaggcaatcttgccgaacaaaggatttaaacacaccaccaaccgctcagtccatgacaatgaaaacaatatgctttccataagctacagatcatggccaatgtggaccacaattgggtacacgtgcgacaactagtacgcgataaacaggtaaagtcgcagcagttacagtgtaaggcagttgtaagcatattgcaagtgcacacctcctggggtac

SEQ ID NO: 68420 - DNA, 2287 bp, Oryza sativa
  unsure (1)..(2287): unsure at all n locations
cactagtaagagacaagtgtggaatgatcaaaccggtgttgnaatgtcttgagccattatgaatatcttaaacaaacttaatgattcacaactagatgcagtcacgtgagcatannttctaaaatccttttttgttgctcaatttagttctaagaaaaatcagatgtctgattgatcaatgcattatctcttgcagccaggtctttctcgcagatcctttgttcttatccaggtttgtttgcttatttccagttatatttgtttatttttcagtattatttatcattaacctattttagagaaatgctagtgccttgagaactagagtatatgcagctacatgtgctctacttgttgtcacctgccattcatatagaactccaatgtatatttgtaggggcccccaggaacaggaaaaacacaaactatccttggactcctcagtgctgttctccattctgctcctgcaagaatgcaaaccaagtaatatcttcacctgtgtatatttattactgagtgaaatgtagactagtatctttctgttatggagaggagaaaccttgatatataaaaaaagagatattagaagctaaaacataaatataagtgttcaatacagtttccaaaagctacatgtatctgacatgatttacgttcttgtcatgcagaggtggttttgatgttaaaaaacacggtccagagcttgatattgagggcaagtatgttaatgaattggactcttttcaattgcttcatcctcagctaattttcttgttttgtccatttcttctgcttgcttttttcctcctttaaacaagttctctatggtgtttggaaataacaaattcaccttactttatggtacttctcttagtgtttgttagagggagaagattgtagctatttttacatttgtactatcatatttagtgatcactcagcatgtggattttatatgtagtatgggaactgataaagaaattcttttcagtgtatttttttcttttcttactctgtggaattatgcagttcctttatttgctacataatactgctgcaaatatctgttgcactatcttactgcagagctcatgtgataggcatgcacactggatgaaggcctccccgtggctgattggtgtaaatcctcgagatttaattatgcctgttgacggcgatgatggtttttatcctactgggaatgagctagtaagcttctgtgctctgtactttgctatatttgccatgatgcctgtatgaattttgtatttttgttacatggtaaacacctgtcttgatagaaacctgaggtcgtaagttccaatcgcaagtatcgggcccatgtcttggtctgtgctccatccaactcagcacttgatgagattgtgctgcgagttctgcaaacaggtaaaggggtttctgtgctgactgatccaattcagaaaaatgttctgacaataaaaatactctttcaattgcatccatgtgctacaaactaaacaacatttcttaggctcatctggtcactaatttattgatcggaaaatcaatcatctaaattattattcttcttcctttcaggaatacgcgatgaaaataacaacacctataatcctaagattgtgcgaattggactgaaggcgcatcactctgttaaagcagtttccatggattaccttgtacgtgattttagttgctaagtattttctgtccaactcaattacagtgagttgataagttgatatctttgcagatacaacaaaaactttctggtgtggatcgctcatcagatggtgggagacgaggggctggtgaatatgatcgaattagatcttccattcttgatgaagcagccatcgtacattcattttcttatttcacattcttttgcttatttcagtattccaggaatcatttaatatttgattctgactgtcaagcaaaatttgtaggtgttttctacgctaagttttagtggatcatccattttcagcaggatggctcgtgcttttgatgttgttataattgatgaagctgcacaagctgtgagtgtttgctttatacagattgttacacgatggagcatttagccactctcagatttagataatggtattttatgagtttctgactttctgttatgttgaaattctgaagtttggcatatccccttcttttttcaggtagaaccagcaactcttatacccttgatccatgggtgcaaacaagtttttcttgtatgacatccacctatctacgatttatgnggccttctcttaactatgaa

SEQ ID NO: 68421 - DNA, 1349 bp, Oryza sativa
tttggccgctagccggagcgccagctcgcgccttgaccgccaaagtcggtttccaaaccgacattgccgccccctataaacccaggcgccctcccttccccttttcccctcccaatcttccctgtttctcgcccgcgccattgccgtccttctcgccgaccgcagccgtcgcgtgtgtgccggaggagccggtgcgcactaggacgcggaagggaacttcggccgcgccctctccttcctcttctccggcccgaggccggagagattactcccgcgccatcggcctctcgtcacagcgccccgacccgcacggtagtgcccctctccgttcttcctcctcgctccatctcccccttagtcttcggtggtagcacgagtagactccccgtagctagccggcgccgccccaaccattgccgtcgctcgccgtgtgctcgccaccgtcgccgctcgagctccgtagcacccgcacgtcgccagcctcgatcggcgtagctccgccaatccgacgctagcatcggattcccgtggccgcgtggatgctctcaccgccgggaatcggcccctcgtggcctcgtcgccgtttccctcttccctccccgccgggttgtcgccgccgcgattcgccgccgtcaagcttcctccggcgaatccgagccgttggctcgtctcccctcgtctcgtgcaaccacccggcgtgctcgctttcgccggtatcgccgtggttcgctccgccgctcgccgctgttgtccgccgtccgttccggccggcgtcgtcgtctacctcccgccagcccacgtggcagccacgtaggcgccacgtcggcgccagctcagccgaggtcgggacgggccgaccccggtcagcccctcccgtgcgcgcgttccaccgcgagccgtgaggctgcgcgtgggcccgccgcatccgttcctccgcagaccgcgcgcgtgcaccacgtccctcccccgcccgcgcgcgtgcgccgcgtgctccctccgcacggtgagccgagccgctgacaagcgggtcccacccgggaccgcgcacggtgagcccggtccaccggccctctctctcctcccctcccgcacgcgcgcacttgggccgccttgggccggccggcccatttagctcggccggtccgctccttttcccttgggccgcgccctaagccgcccgaggaaaagtctataatccctccctctttccttttcttttctttttcttttccaaaaaggatttaattaaatccttttcctttagaccaaaaatccaataatcttagaaattcaatatcttcccaaccgtaaatccgtttgactccgttcaacttccaaaattcctcaaa

SEQ ID NO: 68422 - DNA, 1299 bp, Oryza sativa
  unsure (1)..(1299): unsure at all n locations
accaatcggagagggagtcaatgcgcgggggccgccaaacagcgaaatcgaaaaggataggtggggaccgatgcgcgtggggctggcgccgtagcaagatgcggtagatgagagaagaggagctatgcggtaggaacggccgatctggatccaacggtgaggacaaaaagggtgacatggaagcaccaggaagcagagaattctaacagtgaggatgatttgtataggtatataggatatcatttattttactgtgacatattttattattaaagaagccttgcctgtgacttatatactttaggctaatttatcctaccgagaacgagagagaaagctgagagaaagagagagaggagatggagacttatacgtgatttatctcttctattcaattgtaaataaatattctaataagtgtggtgtccagcagtaaattttttatgatttctctcttctattaaattagaaataaatattttaatagatacggtgtccagcagcgaatttttgtattttgtatacaatgattaatgcgctaaccacagcacaagtaattgaagccccatttcatcaaactttcgtttgtggatttgcatcggagttgccccatgttcgttgggggtacttcagaaatgggctcaggcccattacatggccataaccattagcatcgcactttctctctgtttgctctcatctcgttccttttccttctttccagagcgaggctgtttgccgctgcagcgccggcggctcactaaaccccagaacccccttctctcgccgccgccccaatggcggtggacaaatccggcggcggcggagccgaagccggcgcctcttcctcctcgtcgggcgtcgccgcctccaccatggaccgcttccacaagatcgtcctcagctgggactacgtccgcctcgtcgcggactccaaggtacgcccctccccgccccgccccgagcgctcgctttgcaatcaccgacaccacctttgaattttttttctatatggcggcttgggaggacagggcgggcagcagcaggcgaaggggctggggcgcgtgaagaacacgtacgcctcggtggccgagtacctcgctgtgttcgagccgctgctgttcgaggaggtgaaggcgcagatcgtccaggggcgcagcgacgaggaggaaggtgggtgggtgggtggcgcgcccgatttcgtgttgcccccccaatttgctgtcggtttatttaacagtgtgtgtgtgtgggtgtgtgtgatganctnctgcagtgggccatgcaatcaaggccgcg

SEQ ID NO: 68423 - DNA, 2543 bp, Oryza sativa
ttgcaaccacctgaagcgacttgaattgggagcccaacactatatccacatatgtgatccactccaactccccattcaaatctaccatgtacttgtgtgaaatgggtcctgctccaacatcatatctaccttgtatagctatagactgattgctccaccccatcacatcctttgtatgacaaactaactcctcaaaactaggtcctccaccaaatatacggtgtttaacactcatcccctcgaaattgttaccactgttactttgctctaccacccaaccaccatattgcaatcgacactaatctatccatctacaacattaaccgacatattagcatattcgcattctttaaaaacttgaatttgcaataaaaaaaaaactaacctacaactatgtcccccaaccaaattgcccataaatatctaaacatacgcaaacttccatttcgaaccacccatcctaaattcgaactctcgcattgtgacgaaaattaaacaaaaaagaagtgttctttactaatttgggggaaaaattagggttcttccctaagtgccgaaaatcttcactaaaaattagggttctatgagcatctaaccattacatcaccaacaacaactacaaccacagagtagagaaccaactaatttgggaaaataaccccaaatcacgattctagggttcatccatcaatgagcaaatccaagcaaaaaaatgcgaaatgacgagaggattctgaggagaataccttgccactatgtcctccaataatttcccctccaaaatgcgacgatttagtggagattttttcgattttttggaggggaggagagagatggttcggcgccgccgcgcctcagtcgagagccactgaggaagaaagaaggcccgggctgctgggcgcggctcggccaagggtgataggacctccgcgccagacccgatggcgctgaggtcccgaagctcagcgccaagtcggtcggcgctgacattgcgccgttccgtccatcctccccttagggccgtcaagtactcagcgccgatgcggttggcgctgagttgttcaacctcagcgccgtcggccttggcgctgaggtcggggttcagatctggtgatagtttttgccagggaccaaatttgcaaatagtttttaaaaggggccaaattgtcaaattttcggcagtgatcaatgtacaacttgccctatgggattgtgatgactatatgtatggtgatgcatgtttactgaccagcgtgacgatctccatgcatccccgaacttgaagcagagtactagctatatgtgaaatcactgtcatgattattatttgtgatgaataattggctgtgcgaatgatttattcaaagaattggtttgagagtttgtgtgaatgttggtgtgagtgcgtgtgactaatgtgggtcaggttgtgatatctgtgcccaggaacggttgttttgtctgattgtgtgcaggtgacttgaggtcggccttggtcaatggtgaggaccgggactatgctcagggaggagcagaggtctagtgtggtcgggataccatatgagaaggtgactagagtcaggattcttggaggtcaacttcggtcaacggtggagatcgggactagactcagggaggagttgaggtccagacggttaaggataccggatgacgaagttggatacgagatggcacacggtggatggatatcgtgtgggagagatcttcgcaacgggcttcacgaggtgtgcgtgcaagcgtcggtgttcgcgaaggaaattgtgtgataatatttggttactcgtggtactgtagcatggtgcatatgcatgctgttgcatatgcatgtgtgtgtttgcatgtacggtgctgtacatgtgcagcttgctgcttgctggttggctcggcctgggaggacaagccgcaggagcgagttagctgggacgagcgtaggagaccgagtcgggctcggttgacggcgctgagatttgctatatggctgggattctatgtggattgaattccggtttagatgagtttggaaattaaggtttgagtcctattgtgaataggagtcctacgtctactttgagtaggagggtttttcatgtataaatagaggaggagcgtgaggcttcccgcactacgccagatcctcacacctctgacgggatatctgtgacgggcaaacgatttggtcactggtgaccatcacctttgacgggtcatacgggatgccgtcatcggtgaggcatccggccgcggcccgtcataggtatcccctcacctgtgacgggccgaaaggaaaactcgtcacaggtgagtcagtgacgagttttgcttccaacccgtcactggtatcctctcacctgtgacgggccgaggcattataaaacgtcacaggtggtgggcggcttttttttctggcccgtcacaggtgaggggataccagtgacgggcaactggtcatacctttgacgggcttttttaatctaaccctgtttgaggtgtgtttggtctataaatacccccaacccgccaac

SEQ ID NO: 68424 - DNA, 6486 bp, Oryza sativa
  unsure (1)..(6486): unsure at all n locations
gtggcnattgatgtcgattcacagtagcgcancacctaactaatagatagaatgaaaccgagatgccgtggtctttacgaatcctccttgaatggtttcttctggatctgttttctattaccagattgcgtacttttgtgtgccagggtcattagaacatcttacctaatactagcattacaaccgttgctggcgtggttagagcaattctatgacccatcttgaggaatgctcaaacatgtcactcattttgttttaggggtgcacatgatataaaacatgtgacgtgtggggatgtccacaatgaagttatactgctatcttaaatttttttttgcaaacactgtcacatggtccataataagcttacatgcgatactaacggtagtaaaatccaattaaaaatagattttgatactgattgccaagtataatatggtcgtgttcattgaaagccagagtagtagcatatacatgaaaaatatgattgttaattggtaattttagtgcttgccctgtccagtacatggcttaaaaaaatgtaggtcaatacgatttccaatttgaaaaacaaacaatccatattgttatgtatttgataagatttgcaccatctaacgaagatgggtgaattatttgagcaatttacaagatgactgactaaactgcacccacctcgtaagttgtgataccaacgctgcattttactcaggggattatcaaacccgattacagtattttagggtgcctctaatacccatctatacatatagatacgctgctagtataagataagaggatagaagaaaagatttttttacacgcttagtttcctaatgtgttcgatgtgggtaacaccgtaacaaccttaatactgtaggatcgcacaagaccaaacaaacctaccagaggggggagtgaatggtaagaaaaaccaaaaacccaaaatcttttgtggaattaaagattacccttgaacgaagtcgatgacgaagtccagtcgccgccggtcgaaccgccttcctgccaccggtcagaccgccgaagcctcgccggtcagaccgcccggatacttgcggtcagaccgccgctatcccaccagtcagaccgcgcacacacctacggttagaccgttgggacccagaaacaatggtagatgataaactcgaagatgtagattgaaactttttgactttattgcatcaactagtatttacaaagtgcaccaatagcactcctcaccaaaatctcaaactaaactcgaaaccctaactctctatcaactctagtctctctaaaaccgataccaggaggcctcaccctctctctctatttatacatgaggtagactgtgcaaagcccacgaatctattacaacttagaactcctaacccacgtagcaaaccctctcttgcaagtatacaactcatctctttccttatctcaatcaaacttcccgaattcggactcctttccaaattcgactcctctttccatacgtacacaacccctcttgtataccatatggatttgttcatcaccatgtgcattgtcctctaacctttagtatcccgcatgatctcttgatccctggacatcaacttctcccaagttgactccgatctattaccggcaacactctgccgaggccttaagcaacacctacacatgcaacaaccaagaaaccatattccgagcccaagttcgttccaacttgactcacattagtataacaacagtatccatacgcatagaaaccatctagaagccaaatccccgaaggaaatatccaaatccaacaaaacaatccgaaaccgacatcgatcaggatcctgcgggtcagatcgttgggccgaccggtctgatcgccgcaacacctgcagtctgactggcggcacacgaccggtctgaccgccagggtcaaccgaaactgtacacttcacaaaatcaaccatctataaaatctccaaattaacattagcaaaccaccaatattttcatcataaaatctaaatcaactccttgattttacaaatacttgtataaattaatctaggacatatcatatcaagtataaggggtagcaggcttagctaatttgccaccaaactaaccttgatgggcaaagcaatgggtttgcagtcaatggctaacgaaaaagcttcttcctggtgtgaactcaatgtggtgtgatttcgaatttaagtcctaaatttatatcagaacatgacctctcgtcaaggtaaaactcaagatccaaataggagaccttattatcaccgtgctggactacctagtcattccttaagtggatgggatttcctggtcctctcttagggcattcacagtgggttgagttggcattcagccttatcgatcctcaacaaatattgtgtgccacgtttgtgtcacgcccgaaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaaatgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgtacagatctaactccaaaccaggagctaagcaaattattaccaattaaagcatcttttacaatgatgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaatcatgttatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaaccatcattaaataataatgaatcataagttatcccaatagtgtgctaatgtttctaagcatggctaagcaatcacatctaatatctagttgaaccaatatatataaagctcaactagtccaattataataacccaaggtatcaaggaatagagtaatcaatgcgaataggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaggaaaaagactaataaaaaccaaataaacaatacataaaaagtaaacaaacatgtagatcataattttagatgaattatgagacttgaacggcctcattctgatttcatatgaatttattatgaattttacaagatttaattccaattaaacctattaaacggagactattccaaattaattaaatcatttacaaatgatttataacggagataaaggattaaagcaacctccggaaaagattggatcttatttggtagatgacatatattaaaaagaaataatatgccactgaaaagaggagaggatttatattgattttggacagctgagattaaccttgaccgagtcgactaagatcggatggcttggattgatttggcaagcgggcctcacgagataccgactcaacgagtcaactccacgtgacacgggatcacccaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaaaccggtggactagaaacgattcacggtaaagccccggtacgacaaacgataggccggtgggaaactagggttgcacctacggctacacaactcgactaaaagcagcggctaggtttaagcggcacacagctgcgacacggcggcactaagacaacttgactcggctaggcggcggctaggcggaaacacgcagctagggttagggtgacggcacagccggtagcgaccatgcacggctagagcagcagggctacgacacagcgacgacgacacacacgtggcttacataaacatcttccctaggaatcggagaggaggcctcaccgggaaacggtagtgaacggagaggaagaggcgatggctacggtccgacgacaacacacagagacgatgatgacgctagggccaaacaagattagattagatggaattaagaccctaaggataaactacaccggtgaacgacaaagaagcggcggttgccggcgaaccacgatacgacctcgccggagatagagcggccggctgcggatttggagggcatgcacacgtagaggacgacgaggcgaacccaacggtactcaccacaacgacaatcgacgtccgacgacggccggcaacgacggggaacgggcggcggctcggttgaccggcggcggcgaagaagaacgggcggccgggcttcctcactcctcggcgcacctcttggcggcggcggcaagcggcggcgacggcaggggcggcgctgcggcgcggctgcaacccggccgacggcggcggcggactaagcggcgtcgacggcgagctacggtgcacgggagaccacgggagagggggcaaacgaaagaggaggactagggggtcctatttatagccatgggagctcgggtccgggcccaaaacgacgggaaaaactcgggaaagtttatcttcgccggaaaaaggaaaggatttgatccgcgaaattggaaaggatttccaaagaaaattttggggatttcttggggaaaaggaagaggagattgagaggattccattcccgcaaccaatttggaaataggagcaacggggaggtcggatttggtggaggaagcggcggctgcacaggtacaggacggcagctcgggctctgtccaggcttgaagatgaacagtgccagggagggaaagtagacttcttgccgggcttttctacttccaaggactgattaaaggagggacgcaaagcagacttcgggaaagagaggaaaagggctgcaggctgagaggagactgggccgagagtgagaggacttttcctaattcggcccgaaaaggaaaaggtgaattttaattacttttccaattaaattaatcactgaaatgatcttcgaattgttaaaaatacttccaatgctcaaataattccaagaaaaatcttgaacatacttggacactcaaagtacttaaaaaaattataattagaccatttaatgattaatttaatatgtgggtaattactgaaatgctctttgtatgattaaaaattaggaattgagctccgaaaaatccgagaaaatttcagagagttgacttaatcatggagaatttaataaaaaaaaattaaatccatccatgctttagatttaagaaattttatttcccacattttacttcacttgaaaattaaagaacatttaatataaattctacaaataatttattaaatattttataaatcctgaaacgaaaatcaggatgtgacagtttgctactgccatatgtacctgaagttcttgtgtccaattttggtcactcgttcttcagtctaattctgagtgagtgcgtggngtgaggcaccgtgagcacactgtggcgcactgtgaagatctgatccctgctttctncactgctcagcctgtagatgtgtactttgtctttttcccttggtcacggcatgaggacccgacgcagtgtgaatgcccttaggtggacatgattctttctttatctttatccatatt

SEQ ID NO: 68425 - DNA, 28572 bp, Oryza sativa
atgatattcaaatccaaatttagggaccggggtgacacatctgaacaagttggaggacctaaatgagtgataagcaagtttagggaccgggataacacagtcgaacaagtttgaggacctgaacggtcgatttacgagtttagagaccggaatgacacagcggtacaagtttagagaccggtaatgaactttactctttattttactactagtaaacaacaccataggactcataatacagttgcagtgtggggatgtgactcccatgttcctccctctgtaccctgttcctgttccgaatccaccatattatgtaaccatgtaaatatttattttttcatcaattaattatcaaaatattcacatttgtataatataatattatcagtgttttttagctttataattatttgatgatttttctagcgagtagttgggaaaaattatctaagtagtttcagtagaattttatttagaatgcatatttttgagagcgagcacgaataaaattatgtaaatatatgtaggcacgttagaacgtgccctaataataatgagcagcagtagttcttattactagtaggtttagtcccaagtcaaaagtacgataaaaacttgactggcttataaggaatgtagccccgaagtttcgaatttttgccaaaggaaaaaagaaaaagtctatatacacatgtaaactttaggtgaaagtccatccggcacccctaaactttaaaaccaaatatcgaaccccctaaattttggaatatcatttatattatcccgtaagatggttttagatagtggttttgcgtattcggatgcttatatgagtgtttttgaatacttaatatgtcgacggggatacccatataccggatgaatagggtattggggtacgtacgttggtacgaggatatacatgatacgacatcaagcaaacgataagacaaggattatactgattcagacccctcgtaaggtaatagtcctaatccagtttatatgagattgatatagaaaagccacagattacaatagagaaccgatgatctcgagattaccggtgagatccctcgtcgagatggtttcgacgagatctcccggcgagtaggcttcacgttctccggattgtagactatggtggttgtgttggcgctgtgattcgattatttgaacccctcgggggtatgccttttataccgtgaatcaccttagtctccaagtagaactcagagactatggacccgcacgatatagcataaacccaatcctcttcgagtatgactctgatattcacttgcccgtgaggataatttctataatctcatgttagtttccttatcgtatatggaaatatatcgtttgcacgaagatatgccatatccgtatattccataagtcgtaggatagaatgtatgtcttatccataatcatgacataatataacatacttatatatcgtcctcgattctcaatttatactccatagtgatgtcatgtgtagtgatatattgttgacattcatttgttagtgagagcgaaagggtttaaaaagaaatatttgggtaaaaattttaacacatatgtccaattcgtatcttacgtagtcaaatttatctaaagtatatagagataagatataaaaccactctaaaaagttatataaacggtactgtaaagagtggagggttggatgttcggttttaaagtttacggtgctatagaaactctcgatcaaatttaaggtagtatttggattttattttaaaaaagaaaaagcataaagggtgttgcaaattgcaatgtagctagatatgtagcatgaacaatatttcagacacataattttgaattgcacctttttcaaatctgtttgttacaatctaaaaacagcctgtaaaaaaaattcaaaatttgatcatttaaacctgccgtgtatcctagagctattaaaaggttaaaacgacccgaaaaacctatagaaaattagaaaccgagctatgcacaaaagaatttcgatcgagacgcggagaactcgccggcgggcggcgccgtcatcagaagtcgacgctgccgtcgccggctgccctgcacatgcacccgggcgtcctcggctgccggtacacgctccgcccccgcggccgcgcgctgacccgcttgtactcctccaccatgttcctcaccctcctctcgaatccgccccacccgatcccctcctcctcgcccaggatctgcgcgtatcgcttccggttcgggtgcagcgtcggcgccctccccctgccgtggtacacccggtacccggacaccagcgacgacagctggctgccggagtccgtcaccgcgaacacgtccgccgaggcgcacgcgatgaagtccagcgccgcgagctgcattttgtttttttttttctttcggatgtcagaataacggaggagatggcgttgcttgcaggggaggtgtttgatgttttaccgacccgggaggagaagttcttgaatggggctagctcggcggaggagaggacgtcctccttggtgaccaggttggggaagaggcgcgtcagtggcggagccgcgcggcgccgccgtatatctgtgacccggcgacgtagatgaacgtcccgcggtcgtagccgagcgcggtgagcacgagcccggcttcctccggcgtcagcgggcaccgccccaggctgcgctgctcctccgggacaccgacctgcacacacacaaacgcacgcgatggcggcggcgccaccgtgtcagacaagacaccacgccggcgatcgggttcttccgcaagagatcgagacggagacgtacgtgttccggaggcgcatggcgagcgtcgggaagtgggtctccctgtacgcctgcagctcctccctctccgagtcgccgcgcctgaagtcgcagagcgagtacgccaccatgtcctcctcgaacctcatgtgcagcgccaggtacctgctcggctcgccgccggcgaggagggcggggacgtcgagcatgttgctcccgaacagctgcttgtccatctccgtccgcatcgcgccggcgcggcgcagccgctggaccagcagggagcccgcccgctggatctccgggacgaacttgagcgcgtggaagttgcacctgcatcgcagcctctgcaagaaccgacgccgacgccatgagcaaagcagaggatggatggcaatggtgcttctctcatctcgacaagtgcgacgatcgaggaagatgaactgtgtgcgtgacctgcagatgaacgggcaccgaatcgaagccgagccggttgccgaatccgaggaaatggacaacgccattctgctggagaattgggagcacagctttgatgaattcagatggcgcagcttctttcgagatgtccatgtctgtgatctgtcatgaaacagagagatttcgcatctgtttagactttagagggcatgaattctacagaaatttctcaagatttagtgaaaaaattatgatcttcaaactgatcatagatttttttttctcagaatcaggtagcataattgttagagtagagacactaacttggctgccgattgcttcgagatccagtgactgaagatggggaggcaaatctttcacaatgtgcacatcgctcttcatgtagttcacaaagtagtcctcctgatatatgtcaccgaactggctggtcgaaacgaaaggttcggcgaagcatatcagacaaaagttaccaaaaattatttcttgataaaaagatggcaaatagtatcgcagtttatcaatttcagttcaactgataattgatacatgtcagcaaaagcataaactcagttcggtgtgcttttctttccataatgcgattagtagaactgcaatgattacttacaataaaagtaaaagaaaaaggtagaaccaagcttatactggcagtcatagttgcagttctaaccttgtgtccttccaaacgctgctgtaaagaaacctggggaggactagtgtagcattaagcagagctgcaacaacaacagcattacacacctggaagataaaaattcaactattagctactgaatctgaaaataacgtagtatggattttgtgagcatttcagcactagatccttacagccacacgctgttggttcagaccaccattcgcgctgatcagaatgaacccattgttgttctcttcaggcactgtgaagcacaaatccagtgtgagagatgaaatagttgtgttaaaccatagtattttcccatgcttcagaaacatttcagggtgtaggcatatgctagatgttgatggtttaagaattcaaattgcagaggcttcaagcatcaataaaaaaaagctgcaataagggctttcattcttttaatacagaaggggtgggttaagaattctttttgtcacctgatatggtgatgataatgaaactaattgcaattgcttgaaaggaaaggcttcaccttcatcaggtaaactatgctttgcagcacagggcttccatttacgtgcttgtttgtagggctcttcccatagtgaaaattttacactgtcactgtcagactcgttctgcactggcagggagggaaaatttgacatgagtaaaagctaaatatatgatgtcgtaaattacactacttctgaagctaattggcagtttggtgccgcgtatgatggcagcgtgaaacctttgtgacaactgaagttgccatttgcagaagccttgggtgcattatctgctctgctttctccgtccttacagaattttgcttcagttccttcaattcacaaaatgggattatcaggtcgactgattcgacgagaatatgaagaaatcaattaccggtgttctatctaaatttgcaatacgatttataatatgtcagcagtcagcgtgtcatataatgctgctaggtcctgatcattccttctacaggaaccgtacttcatttgaatggaaattcaagctgctagactgacttccattcagttttttattgcattgagagcgcattggttccaatgaccatgccaaatcagtacatttttgttttcattttgaaaaaaaaaacgcaccatcagatatttttttggatgaaatatcattgcaatccgagtttgtaagaaagcccatcataccatgagacttcaaccaaaacaagtcaaggactagaaaaaatgatgaaaatgggatgcaatttggggacgcttttgtgatgatcaaactgagcttaatttgccatgatttgattcgatgagaggagagcagagcagaggtaggcagcgtacctgaaggcccctgaagctcctggaaatggctgcgttcctgaactgcacctggtggacggcggacatcatcagggacgccaccagcaggaggcaccccatcactcccaccacgccggcgaacaccctcaggtgccacgccgtcacgccgccgcccctcgccgccaccgccgccgccgacgacgacgacgtcttcccatgccgcagcctcccgatgttggtcgccccgaccctcccctgccacgccgccatctgcccggcgccgccgccgccgccaccgccgcaagaaccttccatggatgcccggccgtcccgatcaagaaaccatcgtccttcacacctagcttgtcatcgaggacaacctcctcaccagctcacaaaagcctaacgcaacacggcaacaaccattcgtgtaccgagctgttgaatgattcgcttctcctttttctatttctcttcgtcctcctcttgaccagttcatggacaacgtggccatccaatggcagcacactatagcacgtatgctgctggcgccagattaaagaaacggtaggtcaaacgaggcagcagcagcagggtggacagacagaaacacaaccaccggatgagcaggtgatgattctgatccgatcggatgcagatcgaagcttcggcgcccacgcgcgaggcaacgacgattaaacaaacgtgctcgcctcacaggccaggagggagatggtggtgttaaaaatatgtgatttctatgatagaaaatggttaggaattcaggggaagggaacaacctaacgtgagagggactctcccctggagctatcctgacgatggcttgatcgttgtcaggtagtagccatagcgtagcggagtagaggcgttttgtggaagcaaaagggatggcatttcggttgggaagttgattggattattgtgattgatagcgagaaaaagcaagggagtgggtagccgcctagctagcttagccgcttattagcaggttggttggtgcacagtacatgttatgttagtgttacaagtgtacctgcgagattgtaggtagctgaatactcgtagtagctgattcgctcaactgttgatcccttaatcattgctaatctgacgctgtcaccgattaaacagtgtctgtttggtgtgcagcagctgtgaactgtgaggtatcaagcataattcgattgatccccaaatgtgctgcactgcatgtgtgtgcaaccgaaatggcgacttagtattattgagatcggcgggtgatgacgccgggcgggcggcgtttgatggccggagctaaaagggagaaggcggcttcacgagccgtggctacggtgactcgtgaacaaacacggctttgggttggggaagtcagagcagcgccggccgcacggaccacggtacggggatgtcgccttaacggtgaagcagacggtgcaccggaaagaagttgacccaggaaataaccaacggacggccgcacgttctttaacccgtgatggggtatttcaaatagcatggtggcccatacagctttcgcgactaacatcactatattttctctcatataatagcatatatgttttctcaatatattattcaaatatattaaaatgacaacataattttaaattttgcaataaatttacgaaactactactaatgggtaatattcatattgtattttgtatatgtggtagttattaattatttttaatatcaaattttaattatttgtaaattatatctattcctatatggactctagactcgtcttttaatatttcttttttttagttccaaattttctgtaaattgtatttctatatagactctatgctcttctttcaatattatttatttttatttctgaatttttattatttttaattgtatttctatgtggattctaaactcatctttcaatattctttaatttttaattccgaatttcagttacttctaaattgcattcctatattgactatattgactttaaattgttctttccatgattttcttaatctcgaattttagttatttgtaaattgtttttatatatggactataaactctacttttaatttatttatgtttattccgaattttagttagttttaaattcctatatggactctatactctacttctaatattccttattttttaattccgaatttctatttttttcttaattgtatttctatagactctatactctacttctaatattccttatttttaattctgaatttttattatttcctaattgtatttctatatggactctatactctacttctaatatttcttatttttaattctgaatttcagttatttcttaattgtatttccatatgaactctagtctactcttctaatattccttattttttaattttgaatttcaactatttctaaattgtatttctatatggactctagtctcctcttataatatttctttttttaatttcaaatttcagctatttctaaattgtatttctatatgaactgtcttttttttctctgattaatatgagaatttctaaaccatgagagcgaacgtggaggctcctttttctattcctctaataatataatagattgcttttaaaaaaattttaataaatgttttattaccaggagcaacactcaaactatagttatcaaatgtgacggtgaagtgtgccgctcagttttcgtgatggttagacttatcgagttgttcgaatcaataaactgctcggtaaaccgggtaaccaagaaaaaaattaaactaaaattcaaactttttcgtaaattttgtattattttgatcagtttttttttcttaaccaagcaataatcgtgattctcgacagaaccgataaagtgttgttaagttaggctctgtttgattcagcttaggattattataatctaacttattagtagtaagctaaaacaaacaagtaaattattatagcagattattactctctccattttttaatagatgacgccattgactttttctcacatgtttgaccattcgtcttattcaaaaaatttacgtaattataatttattttgttatgagttgttttatcactcatagtactttaagtgtgatttatatcttatacattcgcataaaatttttgaataagacgaatggtcaaacatgtgagaaaaagtcaacgacgtcatctattaaaaaacagaggtagtatcatctgataagttgctctagaggagcttttttcagattattgagtggctaaagacccactactcctacatatttgagaaaaattacccacctataccatcgacctaacagatagctgagggcattatagactttagcctttcaaacccaataatccatacctccaataatccagacaaacaaacaactcacagcttattatatatcagcttattataatccagcttatagtaatctggattaataatctagattataataatcataaactgaaacaaacatggccttaatccctcccacgaaggttgagggggatttggaggggtggaattaatccacctcaattccctccaacccttaggcctgcgttcttttctgtgggctgagaactccttccctccgcatggcaaatagagcaatttattaacgtttgattaattaagtgtttgtttttttaaaaaaaatggatcaatgtgattttttaaagcaacttttatatagaattttttttttcaaaaaacacaccgtgtaacagtttgaaaagcgtgcgcacggaatacgaggaaaaggggttgggaacactgagcaaagaacacagccttagttttgttaatccttatggttttgttcggttaatccattcactgagagagattgaagcctgggcttatttgtttaggcttagacttattggcacttatatgatttataagccgataaattgaaagttctaagtttaatggtggtgtcataagccaaaaaaaactttttttttcttaacagtgagtgatttatagttttagaaaagccaaatgaaaagtactttttggcttataagcctataaacaaagagggtcttaagtgagattaatttcacacctcaataaaaccttatcggaagaatataaagagcggcgggaggggcgtgggtggaatttttgcaaaaaggtcctccgcttcgcgtgtaattcggtcgagcccccccccggtgaacagtatccctaagtggatgctttacttataggcccttcgaaagactggatattctatgcgaaggagagaaaaatcgctaattaggaccacgctgtagaacttgaaaggagaggggcttttgtgcaaaacggtgcgcactaaccccccgccccaaccctagtgtatataaattgaataggccctcaaggagcagcattccctgaatgcaccgggctgtaacagtaacatagtagtattctttctcggattgactccatcaaatattgctccaatataattcgcatccctcaatcgtgataacaaatatattaaccctcaccccctaactattgaaacggatgtaatttaattcccttagcggctttgagagttgttttcgctaacatggcatgttgacggctgactcaagatgtggaacccatatgtcagtgtcacatttccttttcccttcccttttcttctctcactcttcctttcctctctgctaccatgacgacggcagcctcgagaggccggtcagtctagatagtggcatgtgcggcaaagaagctagcgccctgacggcgggcatggtcaaccatcctcatgccccctacccacgtcgacgtcaaacagtattagccagcatccccacctcctccctctctgccctggtgtaggcatcgagctcactccctgccttcctctctagtggtatggcggggacgtactagtcaaggaagtcgaataggagacggttgatggtgtcggcgctgtaggtggcgtcaatgagccatccgatcccaggttaggggagagcggtgttccaattgagggcaacgctttgggctcgagcttcggcgccaaccggctctagtgaggcccacgtgcatggagacggagtggatatggcggcacagacgctggaggaacaagcatggttggaggaagcagatctagtggcaggcaagatgctgaatctcgagtaggggtgaaaacggagcagatattatccgatccgatctgctctgaatccgtccgaagtgaagatatggtaagggttttgatatatccgtccggatgcggatagttgcatgcggatgcggatatggtatcggtaatatccggcggatacggattatccgctattttaagcggattatccgataaacgttttggcgaataatccgaatttcacagcccatataaccactcaaattggcccatttgacatgagcgttttcattgtgtaaagattcagcccatccaggtccaccttatccatcaatctatccaggagttcagtccgtgactccgtcggcatcgcgtcaaccaattttttcatcgagacttctctcgatcatctccttttgaccttagctgcatatgtgtaattatgtcatatgcaatatgcaattcattagtagtactgtatgagaattggacatcatttgtggacctccaatgttctatcacctatgtcatgtgatattatttttttctaacatttgtgaacttctatgtcttacatgttatgtgaatacgatatatcatgatgtcaatattgtatgtgtcgattacatacttttggacagaagacaggtcaatgttaacaacttgacattatattatgatgtgatcggtgctttcatgagtcatatgaattgtgatattggtacctcattgttgctcattgtatagatgatcagatgttatatcaattgtatatacatgtcacatccgattattttcatccgttttcgagccgagtccgcaccgactccgcactatttccgacatccgaaataatccgctccgcatctgcatccgcacattatccgcaccgcctccgaatccgattaaaaaatatggtataggatatggtatgactactatccgtctgaactcgatccattttcacccctaagaaagaggagaaaataagaaaaggaataattccactttgactcccttaaaagtgatccgaatctaattcatgaccctcaaccgcaaaaccggataggacgactcctcgaactattgaaaccagtgcaagttgactcccttagtggttttggagagcggttttgctgatgtggcgctgacgtggcgatgctgacctagtcttcatcccacgtggcgcttacgtggcagtagaattaaaaattcatctgtgggacctatctgtgatgcacacattaaaaaatattatggcccactgacatgtggagcccacatatcatcccctctctcttctccttcctcctccatctctcccttctctcttttatctctcatggcgcaatcggcggtctgggcggcgacggtgggtgggagttggagcgggcggcggtggtgggcaagggttccccacctgcgagcggagcagcagaagcaaagcagagcggagcgcgtacgaagaagccaccgccaccactggcggccgccgccttcctcggccccgactcccccatccaggagacctcccagacggcctacatctcgccgactcctcaagatcctcgtccacagtatgcgcgcgcgacacgcgtcgaacaccttgtgtttcttggggtcggtgctcatgtgcggcgacgtgcagcggcgcgggagtcgccgtggcgccgatgggggtgatcctgggcaaggaggtggacggattctcggtgtgtggaaattatggataccccatacctacacgacatgtatagttcgactgagtatggggtgccatgtatagatagaatatccttaaaaggactcgggttaaattccaaacttgtacgtcaaggaaatacccgggatctagtcggttacgattgtatcttatctgtaactacctattccgttagggatatggactgtgctttgtaatgcggaccccttcccctatataaggaggggtccgggtgcctctaggggcacgatttttctcccagatcatacgatcaataatacactcggcggatcaatccccggacagaagtagggtattacttcttaattaagaaggcctgaacctgtataaaattcattgtctctcaacccttccacttttctagcttgatagccacctcctttagtattgccgaaatcttgtttcgacacggtgcgtgtcgtcgacgccttcccgctgccgcgttgcgccggtggcgccttcatccaggccatcgacctccgctacatcgagggcatgctcgccatgctcaacaaaaccgacaggtaacgagcgcacgttgatctgttcttcttgtgttcttggtcgtgtcgtggtttcttcttgccttgcttacctacctgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtgttattgattgtatgatttggagaaaatccaacatccgcccctagaggcacccggaccccccttatatatgggaaagagtccgtgttacaaaagataatctatatccctaacggaatatgtaaatacagataaaatacagtcgtgaccgactaagtctcaaggtgtttccttgatgaacaagttaagaaacaaacccaggatacacataagatattctatctatattcggtatcctatattcagtccaaatatcatcgccgtgtagatatgggatatccataatctccacagtagcccccgagacctttgcagtcaaccatcagagccttctcaaagataataatccgagtgcttcaaaacttatcatgccaaggcctgccgagtagcgaagacgaagactgtaaagggcgaaaagataaaaatatggtgcatcgaatagatgcacctaattaggtgtagcccccaactatgtgattagttaacgaactaaacatatagttgagaaacaaaataataacacaattgtgcatcatatgacaaaagcatacacggcgcctagataggcatgctagccgactgctttttagccataatgaaaagagtccgagtggtttacactctaaaaggttcacgaatgaacacactggacaggcatccgaatataaaactctaaagattacccaccaagtattataaaaattatggtaatgaataagtctaatagcctgggccatgactatttaccataatgaaaataggtatatagcataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaggtactgttcaggcctaggcccatttgcacctccgatacccttaacaagaagtcccgagatccaagcgacgcttcgtcttccccgccggaactctcgccattttccccactccctgctacagtaaagaactgcgccggcaaactagggttcaccattccactcaaatccaccttcgaaaagtgatcaaaatccttcccgtgatccaccgcctcaattccttacctctcccaagccatccctcgaatcagatcagcgcattcggggaaaatcgatggcggaagagaaagaaagctttgaaggccaatgggcgccgtccgacgtaacggaagagaacctgaaggagatggtggcgcacggcgttctccctgccaaggagatcatcgggtggcggccagcgtgtggtgagattttttcgacccccgatacacacgagattgtggtcttctctcatttcttctatggcggcttcgctcttccgacctcgaaatttttccgcgggatattaagcttctatggaatcagcttgcatcacctaaacccgaattccatagtccacattgccaatttcatccatgtctgtgaagcctttttgggaattaggccccacttcgctctgtttcgccggatcttctttctcaagccccaaccgaacaagaataagccatgtgtagtcggaggggcaggatttcagttgaggggaactctgagtcagaagtacttctctatgcccttcaagacctcaaacaaagggtggcatgcgaactggttttatgttcagaatcctgagcctgctcttcccgagtattcttgtcttcctccggtgtaccaagacacttggaactctcttccaatcggagatgaagctgcccaagccttggaattgttggatcgcatgttaaaactcaaagaacaaggcttgcaaggagagcagatcactcggcatttcatcaaatgccgactggcgccaattaaagaaagatcccatacagcttttgagtttgacggcaagcatgatcctaatcgcgaagaaccagactctctggatttcaaaatcatgaaggagagaatgtataaaatcttctcaaatgccatcgtcgtcagctactcacatcggctgccagttgtgccatataatgcattcaatccgcctccgcaggtatgcatctgaaatcttcaatctatgaccaaaacattatcttgtcttcatgttgaattaattaaccgtggaagcatctcatttaggaatatgcattgatgaaatcactcagcgccggtcacctcgtcagcacaccgttcagggaagtggagggccgacaatcaggtcagacccacaacctcaaacctccaaaccggctgggcagataggtcctcgcaagagaaagctggtgcttaatgacgatgagggcgatgacagcaacaaatctggggacaagggcactcccaacaaactcccaaagcataccatgcccaggaaaaaactggctggccgtcaaattccaaagattagaacatcttccaggtataaacctctcgataccattttatttcggcatgcttctcttatagaaattatgctaaatgtcaaaaggacactttgcaggaaaccatccgacatagatccaactggaaaagatcctgatccggctgtgacagagccaaatttatccaaagacgctgagccgactgccgaaaatcagccgactgccgaaagccagccgactgccgaaagtcagccgactggcacccaagcttcggacgacaaggccaatccgagtgatcagccgccgactggaaaccagtcggcaacaactgaaactgcaacaacccgagaacccccgactggaaaccagtcggatgtagatctaaatcaagagattcctgaagctgaagcgcagacaacttctcaaggaccaaaagttggtaatgactcagtgattgggtctccagataaagagcaaggatcccctcacgctcagccaggcacatcctcaggtaactcatcttctcaagtgatgccactctgaataactccagcttgttcgtctaatatcttgggaatacatcaggtccactaggcggcgacgaagaagaaattctccgcataaaggcagctaatgactctcgtcctcctatcttactcaaatggtgggacgagaactctcaagtttccggcattgttataaatcgccaaaaagaagacgaggaagtgtgccagctgaagaaagtacttggagaagccactcgcattgtgaatgtaagtcttctaggtggttgcctttgatgactttgtttttttgttagcaaaactaatccctgaaccaccgtgcagagaatccatcttcgtaatgaagccaagactgcaaccttagaaaagctggttccacatttgggaactcttgaagccgttagggaacagctacacgaggctaaggagcatgccaagaaaacggagaaggaattaagggagcgaattgcacagctccaggactccaacttcgagctgagtggttcatcaaaaggtaatctctagatctgtcccatttgtgctgtcataactggatcctcaaacatttggatttcaaacagcgcaagccaccaggatgactcaaatggagaagcaaatagaagccttgaaaaaagacaaggtagaactggctgcggaaagggattcagccttgaaggaggttgaaggtactgccagctgacaatttgaactgccctctctgtaaggcagcagattcttattataaatgtgttttgtagaccgtaaaatcaaatctcaagctcagtttgatgtcctggttggtaagatcaagaagcttgaaggagcaagagacgaagtcgccaatgtcgctacaccacttgtccaagctatgtttcttaataacagtggtccgagtgcacttgatgcaaccgagatctttgacaagctaagagttgcaccggatgtgtacttcaagaacatcaagaaagctggaagtatgggagctagcatggcattggcaatgaccaaatccttgtacccgagaatcgaaattgataccattgatggctttgcagacgggacaagtgaagaagctgctcttgatcttatcagtaatgctcaaagtgcggctgacaagattgcaagtgatgttgtagagcaattccgcaacaacgaccttcagccgagcaataataactctgatgatgaaaggattgattctgactgagtgtaaatgtagcaaatggaggctcaatttgtacaatactggtgtatttatgctgtgcttgatagttctagccaagtctttgatttcttaaaagcttttatcaagctttgttgagcctaaaacccaaagaagctattaaaaactttcagtcctcgcagactaagtagaaaaaatcaaacaaggcaatgatagaccaagtaagcaaattaaattgataaaaaatcacactccattattatgatgatagcccccgactgacaacggcaagaagaaaacttgatgttgacagtcaagatagggaaatacaatgataagcttaagcatagaaacgacgaagatgttcaatgttccaagagttgtcgacgagagtaccgtcttcgtgcttgagtcggtaggaacctggtcgggtgacttcagagatgataaatggcccctcccataaaggagataacttgtgccgatcccgtgtagtttgaattttcctcaaaaccaggtcgccgactagaaaggcacgggatcgaacattgcgattatgataacgccgcaacccttgtaaatatcgagccgaccgaatcaaagctgcttcgcggacttcttccaatcggtgcaagtcatccactcggtcctcttcgtagcgttcttcacggaaatttcgaaagcgcaaagattcgaattcgacttcactcggcaacattgcttctgccccatagacaaggaaaaaaggtgactggcctgtggcccgactgggtgtagttcgcaaagaccaaagcactgatggcagctgttgcacccatttgccggcatagggttttagccggtcaaaaacacgtgctttaatcccttgaagtatcatgccattggctcgctccacctgtccattgctcatggggtgtgccactgaggcataacaaatcttaattccaaagtcctcacaaaagtctttaaaaactccaccagtgaattgtgtgccattatcagtgatgatccgattgggtactccaaatctatgcacaatgtgatgaagaagtctcgagcgttatctgctgtgattgtgacaaccggtttagcttcaatccacttggagaatttgtcaatggccacaaagagatgtgtgtaaccgccgactgcctttttaaacgggccaaccatgtcgagcccccaaaccgcaaacggccaagacagcgggatagtttgcaactcttgagctggcaagtgaatttgtctagcgaaaaattggcaaccttcgcacgtgcgcacaatcttgtcggcgtcggacactgcagtaggccagaaaaaaccctgccggtaagctttgccgacaatggtgcgtgcagcggcatggtttccgcatatcccagaatgtatgtcctgcagcaattgtctcccttcctctaaagatacgcagcgttgcagaattcctgaagggcttttcttgtataactcagcttcatgcataacataaagtttgctccgccttgaaatccgctcggcttcatctttgtcttgagggagttcttgagaagtcaaaaatcgtatgaggggttttcgccagtcggtttcaaccatagcgacgtcatgagtgcccgcaacttgagtggtatctttgtgaggtactgtcggcgtataaaggtgttcgacgaaaacatcagagggcgccacctcgcgcttggatccaaagttgacaagtctatcggcgtcttcattattatgtcgaagaacatgactgagctcgagtccatcgaacttatcttccaatttgcgtacctcttgtcgatatgccatcatgttgtcgtcaaggcaggaccactccttcataacttggttgacaaccagctgtgaatcgcctcgaactattagacgctttatccctagggaaattgcaatccgcagtccatgaaggagggcctcatattcggcgacgttgtgggacgccgaaaaatgtatccaaagcacgtagctcaatctttctccagttggggaaatcaaaaccactcctgctccagtgcccgaaagtcgtttagatccgtcaaaatgcatggtccagtgctccatgttctccgcgggggcatcctcctggcactcggtccattcggcgacaaaatcagctaacgcttgggacttgattgaaattcggggcttgaatgatatgtccaaagacatcaactccaaagcccacttagcaatacgtccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcggtcgttggactttctggacatggccttcttcgtcgcgttcaacgaccaagactgtgctcacaacctgggaggtggctgatacatacagcaacaacggctcctgcgggtgtggtgaggctaagactggtggctcagtgaggagtttcttgaaatcttcgaaggccttctgtgcttcgggtccccactggaagttatctgttttcttcagcagcttaaagaagggcatccccctgtggagattatgggtaccccatacccacacggcatggttatccgactagttataggggataacttatatatatggaatatgtaacagatcatgacttgggtattacgtttccttatatattacggaacagcctaaagtcctagtttgataatattgtaaagtagatttaggaaaccgataccgtattggttaaggtttctatcttgtaatcctgccccccaccctatataaggtgggcaggaggccctctagggggcatgagacaacctgatcgtcagatctatactacacccggcggattcaaatccccaaacaggagtagggtattacctctcattgagagggcctgaacctgtctaaatcctttgtccctgcatccatccactttaggtctcgtgcgctacccccttttattattgccgaattcatgttttgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatactgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgagtggatcctccgcctacacggctggcctattatgccgccgctgttgggcgtctacgacttcaccgccggcctgcctccgtcgccgccgagtggatcctccgcctacacggctggcctattatgccgccgctgttgggcgtctacgacttcaccgccggcctgcctccgtcgccgccgagtggtgcctccgcctacacggctggcctattatgccgccgctgttgggcgttacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcttgcctccgtcgccgccgagtggtgcctccgcctacacggctggcctattatgccgccgttgttggatgtctacatcctcaccgttggctcaccttcgctgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccactggccgcctcgtccgccgccgactagtacttccgcctgcacggctgacttattatgccaccgttgttgggcgtctacgtcttcaccgactggcttgccttcgccgctgccgactggtgtttccgcctgcacggctggcctttatgccgccgttgttgggcgtctacgtcttcaccgaccggcttgccttcgtcgccgccgactggtgtttccgcctgcacggctggcctttatgccgccgttgttgggcgtctacgtcttcaccgaccggcatgccttcgccgctgccgactggtgtttccgcctgcacggctggcctttatgccaccgttgttgggcgtctacgtcttcaccgaccggcttgccttcgtcaccgccgactggtgtttccgcctgcacggctggcctttatgccgccgttgttgggcgtctacgtcttcaccgaccggccgccttcgtccgccgccgactggtacttccgcctgcacggctgacttattatgccaccgttgttgggcgtctacgtcttcaccgaccggcttgccttcgccgctgccgattggtgcttccgcctgcacagctggcctattatgccgccgttgttgggcgcctacgtcttcaccgaccggcttgccttcgccgccgccgactggtgtccacgcctgcacggctggcctattatgccgccgttgttgggcgcctacgtcttcaccgaccggctcgcctttgtcgccgccgactggtgtcctcgcctgcacggctggcctttatgccgccgttgttgggcgtctacgtcttcaccgaccggctcgccttcgtcgccgccgactggtgtcctcgcctgcacggctggcctattatgccgccgttgttgggcgcctacgtcttcaccgaccggctcgccttcgtcgccgccgactggtgtcctcgcctgcacagctggcctattatgccgccgttgttgggcgcctacgtcttcaccgaccggctcgccttcgccgccgccgactggtgtcctcgcctgcacggctggcctattatgccgtcgttgttgggcgcctacgtcttcaccgaccggcttgccttcgccgccgccgactggtgtttccgcctgcacggctggcctttatgccgccgttgttgggcgtctgcgtcttcaccgaccggcttgccttcgccgctaccgattggtgcttccgcctgcacggcagacttattatgctgccgttgttgggcgtctacgtcttcaccgaccggccgccgcatccgctgctgactggtgtcaccgcctgcacggctggcctgttataacgccaactgatgctaccttcttcacggctggctacatcgctgtcactactaataggcatcagtatcttcaaaacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcgacttcatctttattatcttcggcactggcaaactctattgctgctacttcgcaagttttactacttcaccaaccacgacgtctttgtgaacctcgacatctcggcatgcaataccatgatattttactacaacaagtgactctccaatattcaggatttctacttggacaccttcaacacatatcttcaatcaagcaatgactactcgacgacaagaagctataattctcgactctatgttcagttgtttctcaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactaccgatagaggatctcctcgttatcatcggctgctacatcgctatcgactggatcaccgacatcgtcatcttcatcaacatcttgtcaagcctcatcaacatagccaactctgctgccgttgatgggaaacttcgtcatcatagtcggctatctcggttgccgctaatcatcagtaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgttagctgacctgactgttgccgactggtttcttcgcctccacggctatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaagacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatatattttggagtatctcataagggataatcactcagatcagaagctattcatatgagctacacctggtctatatcacccggaagatttattactcgagagcatgttacatgcgtcatcctttaaagggtgtcgaaggcatattttttggtctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttacccggattttataccacatatgccatatatttccaggtgtggtggaaccatgtgtcttctagggacttaagcacatctgttaaagcagtgtgcgcatggcgtatgcccaatactttggaaatttctttattcacagcattcaagcttctttatagctattttgctatatcactcatcatgttttgcaaagcagttggtatatcactcggatcatgttatttggagaatcacaccgcatatgctatatattgatatcaagtcacttggttgattacgattatcaaaaccactcggttggttggattatttattccttgactacatgcttggtttgttcaattaaccacattgtcgggggctacacctattaggtgcatctagtcggtgcacctgactttatttccagccctccacagtcttcagatttggtaaaagtactcgggagaccatgacaaagatgattgaagcactcagctttggagtaatctggttcgagagaagattatcttttcgactgcgaaggtctcaggggctactgtggagattatgggtaccccatacccacacggcatggttatccgactagttataggggataacttatatatatggaatatgtaacagatcatgacttgggtattacgtttccttatatattacggaccagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctatactacacccggcggattcaaatccccaaacaggagtagggtattacctctcattgagagggcctgaacctgtctaaatcctttgtccctgcatccatccactttaggtctcgtgcgctacccccttttattattgccgaattcatgtttcgacacccccgctcgccaagtcgtgaaacaaatcggctgagcgccgccatgcatccagtcagcttctgaacatctttctgggtacttggcggtttcatgttgaggatagcagtaactttctccgggttggcttggatgcccctatgagacaccataaagccaagcagcttccctgacggtactccgaaggtgcacttttcagggttcaatttcatcctgaaagcacggatgctcgcaaaggtttcttctagatccgagatcaaatcatccttttgcttggtcttgacgactacgtcatccacataggcttcaacgttgcggccgatctgcgttgagaagcatctctgaatcatgcgttgataagttgctcctgcgttttttagtccgaacggcatggtgacgtagcagtatgccccaaaaggcgtgatgaatgaagtcttcaagcagtcggattccttcagtcggatctgatgataccccgagtagcaatccaaaaaactgagaagctcacggccggcggtcgagtcgactacctggtcaatgcgaggcaacccaaaaggatctttagggcaggatttgttgaggtcggtataatcaacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactctttgaaatcttggtagcgggctcttctccttcgctcgccgtggctgcagccagtcggatatcctctcgggcagacgccatctcgcgagtttgggccatgtcgcaactctccttgtcgcatgtgacggcttgcttgatgtcactccgtagggataggactcctcggggaccaggcatcttcatcatcatataagtgtagtgcgggacggccatgaacttggctaacgccgggcgtccgagtatggcatggtatgctgtctcgaaatcagcgacttcaaagctgatgttctctgtgcgaaagttttcccgagtgccaaaagtgactgggagggtgatctggccgagtggagttgcggataatcctggaatcactccgtgaaaaggcgcattgcttggttttaactcggagcgagggatctgcatatcatccagggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcgatctctgaccatcgaagatattggggcgtgtcgggctgaacagcattgatctcccgttcagttaacttctgcttccgtttagactcataagccagggggccgccgaagatatggttgagctccttgcggtgatcttgaaaacctgccggggtgtcgtcgtcgtccttcttcctcgacgtgctttgttcttcgtcagaattcttccgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacttccacctcctcccgtagccggcgtacccttgttttgcttccaactgggacccgactgctttgatgcggtgacggcgtcttcagccttggcgtactcgttggctttttca

SEQ ID NO: 68426 - DNA, 19009 bp, Oryza sativa
  unsure (1)..(19009): unsure at all n locations
tccacctgatggtgtaaaagccattgagtgcaaatgggtctttaagaaaaagacagacgtagatggaaatcttcacatctacaaggcacgattggtggtgaaaggtttcaaacaaattcaaggtgttgattatgatgaaacattctcaccagtcaccatactaaaatctattcggattgttttagcgatgctgcctatttcgattatgagatatggcaaatggatgtcacaacagctttccttaatggaaatctcgatgaggatgtgtacatgacacaacacaagggatttgttgatccacaatcagctaaaaagatatgcaagttgcagaaatccatttttgaggcaatcatctcggagttggaatattcgttttgacgaagtagtcaaggcgttgggctttgtcaaaaacgaagaagagccttgtgtatacaagaagattagtgggagcacactagtgtttttaatcctatatgtagatgacatattgttgattggaaatgatattcctatgcttgaatccgttaagacatcgttgaaaaatagtttttcaatgaaggacttaggggaagcagcatatattctaggcataaagatctatagagatagatcaaagaggctaattggattaagccagagtacatacattgacaaggtgttgaagaggttcaacatgcaagattctaagaaaggtttattacccatgtcacatggcattaatcttggcaagaatcagtgtcctcaaacgactgatgagcgaaacaagatgagtgtgattccatatgcttcggcaattggatccatcatgtatgccatggtatgtacacgtccagatgtttcatatgcacttagtgcaacaaactgataccaattagatccaggtgagagttactggatagctgtaaagaatatcctgaagtacttgagaagaactaaggatatgttcatattctatggaggacaggaagagctcgttgtaaatggttacaccgacgcaagcttccaaacagacaaagatgattttagatcgcagtctggatttgtgttctggctaaatggaggtgctgtgagttggaagagttccaagcaagatacagtcactgactctacaacagaagccgaatacattgccacttctgaagcaacaaaggaggctgtttggataaagaaatttgtttctcaattcggtgtgatggctagtgctcccagccctatggacctctattgagataatagtggtgccattgcacaagccaaggagactagatcgtatcaaaagtccaaacacattttacggcagtatcacctcattcgtgagatagtggatagaggagatgtgaagatatgtaaaatacatacggatttgaatgttgcagatctattgaaaaaaccactccctcagcctaagcataaggcacacactagggcaatgggcattagatacgtgcatgattgactccagtgcaagtgggagactattggtgatatgccctagaggcaattatagagatgattgaatcacatactatgtttacatacttatccaacattgtttcttgaaatagataactcattattgattaatgaatatgtgattctttcatgagactctttatgttgtatgttgtaatttctaaaggatccctgatcaaatatcatatgtggaacaaatatgtttaataatcagcacatgtattaaatgatgatcatgtctcatggatcatggtatagagataccaaattaataatgtggatacatgttggggaacaagttgttggatagacccaatatgagacactgtaagagccatatgtgttatgtcatcagtgatctcatttagtgttggtgttgaatccttagacctgaggttatcacggttcccaacatgtgtagtagcttacttagggactgctaaacgctactccataattgggtagttataaaagtagttttcgggtatgctatgacatatgtagtgggatataaataatcaagatgggatttgcccatcctatggagagatatctctgggaccctcgatgtatagattatggaagtgcacggctatgccaaagatgattgaggagtcaatcacaagttatataatctatcacaggttcgagtgaatgattgagctattagaggatgacacatatccagccttgagcttaatcgatattgtgagacaaaggggttcatacaagtatacactagaggttcagccgatatgatctttatgtatgcacggtgggtcaatacgttctgctaagtgccgctgttgacacgtggaccgaaaaggagttttcgggttacagccgagtgtatatgagcctataggtcgcacgcttaaagggccggaataaaggaattggatggagatccaatacgcattcaatcggatagggatccgagtaggactcctatgggcctcgaaggcccagtcgcggatcctatatattcgtgaggggaagtgaccggcggaattaacacaccacgtgaaaccctagccgtcactcccctccccgagcaaaatcctagccgcgcgcgggtgctagcacatctgcgcgtggcgttccgtccctgtacgtgtggataccagtagaggcgttgctggtttgcggtgctgatttgcgtgggagtacgacgagaagaacgcacgaggaggagaaggtcgagccggtgcgatcgactacttcctctacatcgacgcgcgccacatcgcgaaggttccttcgccttcttagcgccttcttccactgcgcagcacgtcgagtggtaacgatctatgatctaatactttcatggttcctggtttatgcgctagaacattttggtttatgcgctagaaaattgagcgctcgccggtgatatcacaactacgcaaccgtggcacagagcaggcaaagtcatggatcggaggcacggtggatgtaaggtgtctgacgcctaggctgcatcttgagtgctccatggcccgctcaacacaccgtgcctcggtcagctctaccgcgtcctcctaggctcctctcaccctccgccacaactccaacggtgcgcgcggcgtgatggcaatgccggcgaaagaggggatggcgacggcggcgaaatagatggctgcacgaggtgaatcagaaccagggcggtgttggaggggcgcgcggcaaggactattagccgatcaaggcgcaccggggaggatcagcatccaagcggagtggagcggagcgcgactgggagaaacgatgaccaagtgtgattgatgggacaactggataaggcgatgggcgcgagggtgattgagggtatagatgcggaattgctaatgcgctatactcctccctcttctcccccttcctcctccccttcttctctttctactaccgtgcaccacaaatttttttaaaaaaacaaaagttagaaaaaattatgtatagaaatactatatgtaaaaaaatttgaattgacttataaactttggatctactttagttgtataaactttagatgtatagaaatactatatatagaaaatatttgaattcaaattcaaatttgaatcagatataattcaaatttaaatttgaatcgggtatgtatacttttgacttataaactttaggtctataaactttaggtgtataaactttagatgtatagaaatactatatatagaaaatatttgaattcaaattcaaatttgaatcagaattaattcaaattaaaatttgaaacggctatctaaacttttgacttataaactttaggtgtataaactttagatgtatagaaatactatatataaaaaatatttgaattcaaattcaaatttgaatcggatatataaacttttggtctctaaattttataaacttgaggtgtataaactttaggtgaataaatttactaaaataggaaagtaatgcggtgctaaaaaagaaaaccaggtggagggaggaaggagggaggggggcaaatctgattgctacccgatccccagggcgatcgatcgcccattagaagtccccgtatagatggccaaacgagcagcatggcctaggcacggccgtgctcgggccagaatttatcgggccggcatggcccgaccaacacaccgggtcgtgtcgtgccggcccacgtggtcaacctgtggcccaggcacggcccaataatggtcggaccgtgccgggccgacccaaaggcacgggcaacccatcgtgctttctttgaattaagtctatttctcctccctcgtctttcagcatatacatagctaaaataagtctattttacgtctctaatctttgggccgtgccataaaataagtctattttacgtctctaatctattgggtcctccctaatctttgtgccatgtcttacatgcggttaaaaataagtctataatctccttgaagttcgtgccgtgctgggccggcccaccgtgccaagccataggcctaggcacggcccaacagccgggccgtgtcgtgcctggtccgggacaaaatcccgtgccgtgggccgggccatcgggcatcgggccttatggccaactatagttgaggggaggcgtcgtttgtggggaagtcggtgggtagatcgtgattcctatcttcaattgctaggcacagccgtcagtgttcaatttaagccgttgaatgaaaagatcgaacagttgttaaatgaagaggggatttctatgtacgttttgtttggtgaatgtagcaaagaatacaacttctacttttatattttatattagtatagataataataaaacctcctgtatcttgtcaaactacataaagggctatataagaagtattattgaaagggaaaaaaatccaaattacaccctaacagtgttcgcatagagcgtagtctggattgtctggaccatgtctagacactagacgatggattatcatctagtttagggcctaaaccatgaattacactgtttcaccgtctagtcggtcaaagaaggtcctagattatctagactgcacaattagacaacagcaaaatgagtatagaccatttaactgttgtttaaactgtggtctgggcaatggagcaatgcattttttttagtaggagctaaaacttcgtgccccacccaaggcccataggtcttagtgtttttacccccattccaaagccttcccctctgctctaatacactcacaaacacaaagctacgttgccttgcctctactagttgccactgcggaccttgctctcacctctctctggtctatggctctacgcgagtggatgcacctatcataacatcgctagttcttcaatattttattagacataataagtgccaaaaaaaatacgaatagtgtaccatatagtatatcttctagactagctagattcttgtaacgacccgcctctcctaggccgggcccgcttacatcctcactccgtgcgccccggggagaattntccggtccgtcacccatccccaattgctccaagccaagcacgcttaaccctggagttctttggagatcggcttccggaaaagaagttgcaacttgttaatatgagcattctattaatcctattaagccctaggccgggttgttacatcctcacccccttaagagagatcgacgcccccgtcgatctaccccaggcaggcgggcccgcttacatctggcagctttcataggtcatagactgccctcacagaccaacacatgtcttttctacacactttgtcctcactcgtgcgtacccgggaagaattttccggtcggtcacccatcccaaattgctccaggccaagcacgcttaaccctggagttctttggagatcggcttctggaaaagaagttgcaacttgttgatatgagtattctattaatcctaaacttgtcacgcccggaatttctatccaaaattccaaacgcttacatgtgtgcgaaccctcgtccaggaatcagccgaggcacacaataacaaattgataatagagtacaattattactctaattaataagcgaataaaatgtcattacagagatagatagttcctctcaatcaataaagatctaagcagcggaaaaataagataaacggcgcagacgactattgacagaaaacacgaggcctgggagatctgcttaactccagtgcaggtccaaaactcgccttcggatgtatgagcgtgccagttgatttgatcctgcaatcaacaagaaataaaacaaagaaaccgcaattaatcctataaatgatagccgatcggctaggtgccgatgacatatcatttatttcaagccgatgtcatgcgtacatcgatcggcaaatatcaataagcaaatcagaactaaatctacttgatcggctgtagatattaatgatatataatccttatatcgatatatacttaaatcaagtgattgggatatatcggtcgccttgccgagacagtataaatcacttagatcgaaatatatattaataatgggattatatacatttatagcatagccgatcaagtggatctagcatgtatcggctaatactccgataccactctatattaagatgttaaagcaagtagaatataccaaacagaagcctaatatacttagatgcgccaagatcttaacataaagggcagatttaacatataggttaagcatatggaataaaagtagttagatcagataagatcggctgaaactccgatactaccctaatcggcaactgtggacccccgtttttataacaggaatcaatcgtgtaaacagtaccatttccctggatcaagtagtttggtacacacgaattcatagctgaaataccaagtgcacatacacgagagtctagtacgaattattacatcataagctcgcagccgcagtcttaaatcatcggaccgagcggtccggaatacattccaaaaacagaagtaggtaaggcagcggagttaaggcagcggcacgctattgccacaggcaacgaccgtaactaagacctactgagtgccatcgtcttcatcaccctcctggtaatatgcatagggatcctccgaagcttcatcttaggcctctaattaagtttatatttgcaagggtaagtaccaaccgtactcaacaagccaccatagcaacaatgcatatgacaggggtattcaaaagatggctatggttcttttgcgcaaagcaagttttgtaattcttttcacaaacctaagacctagcacagactgatcaaattttagtaccagtgttcatattaaataatgacggttctgtccaccatccattgtgatcccaaggatagcttcccgccattgaatcgtcatggttttctgaggacgtccaccttccctcctctcaggaagtggctccatcagcatagaaatcatcatgcaacatcccatcccacacaagttaagaatttagagtctagccaagtgtaatacatgtcccgatgctcaataaccgcgagcatggctattcgaatagatttggtttactcacactgcagtggatgtacactttacccgcactccgcgactgcccaacacatgagccttgtcccaacacatgagacatgtcacggcaaagcttttcgataacctcgcattggcagtacccgctccatgaactttacatcctcatgcactttaggcgtacacggtttctagcagtgagaggagttctggcgcacccgggaagggaagacttacacatgcattaagttataatttagattctcacatggcagtcctaccgatggcgacatcattgtagacacccgcctcgcggtcctaccaatggctgccccaccgtagagcccctgcctcacacatcaagaaaccactatgcatggatattgcctccgctcagctatctactccgctaggtctatacccattcgagaagtacggttatacgggggtcgtttcatgcttaacttcatggctcggtccttaattgaccagggacggcactagccttttttcggataccacccaaatcctccatccgccccagtcgaaaacatttgtttagtttcattttcctttcacaaatcatgtcatcaatatcgtggcaatgtggcgctcatgtctccacatgccgcatctcaattaccttcccaaaggtaattgctcaagcatatatcatttgataaatatgaatatgcataaatctagagtagcatttctaagcatttgtcatagttgactaaggacttatacgtaaatcatggttacaaggatttaagggtaaacaataatcaaggcatggcataatcacaagtaggatgttcatcattgcatacaattttatttgtaaacaaaataatttcgcacttgggatcaacatgttcaaagaatagtgatgacttgccttgctcaaagtcttgcgggtcttggccttcacttggccttcacttgctcaaattgatttgaattcggttagaattcaaataaaaatccaaataaatccaaatggaagtcaaatgcgaaagtcgattctttttattaactttactattcgctaactagggcaaaccctatttcgatttatacatcctaaactatttttgcgggtataaatattttgttaccataagtttttaatttaatctacccgagcattatatccatataataggttagaaatttctatcgcgagctaaatatcggacaaaatcctaaaattatcttataatattgtacgatttaatttagtctatgactaaacgattaaatataatacacggctaaaattcctagtaattgaatctgaattcctaccgtgaatcgatgacttatagagattacgaaaaataatctataataatctttaagaattcacctaattgtttagttattaattacatctaaattactaccgcgaattgatttcttatagaaattaccaagaataatccataatttatattaaactttgcaattctacgactataattaatctataattaaattctaattattttaaattttctaaacttccctaatctccctctaatttctatttatttttttcttttctttttctctcctcttttctctcttttcttttctttttccttctctttctctcttttcttttctttttccttctctttctctcctcccggtttctctccttctttctttctttctctcccttggcttctcccttcctctctctctccctaccagaggcggcggcggcgacagcgcgcaaggaggggggggggggggcggcggcttaccgacggcggcggcggcgacataaggcgacggcgacacccggcgcggcacacggtgcggcgcggcggcactgagggcggcggcgcgaggacggcagcgcggcggcccgagggtggcggcacggcggcacaaggacggcagcgcggtggagggaaagaggggaggaagaggaaaatggagtggggaataatggagaggggtggggtgtttatagggaaaaggagaaagagggagagaaggaggggggtgacgcgacggcgggcggcgcggcgcagggatcggggcggccgggcgcaagatgacagggcgctcgcgcggcgacgggacggcacgtggcgcgaggcgcgaggcgcgacggcgacggccgacggcgcacggcgcggcaggcgacagcggcacagcggcgatggcgacaggcggcgatggcgacggctcggggcgcgaggcgcgcacggctcggggctcgcggcgaccgcggcacgcacagtgatggcgacgacgacggcagaggggaggcggatcggcgggcggcgcacggggcgcgagggcagcgcggcagaggaggggctagggctagggaacgcgatcgaacaccttgggagcaatgaatagtgacttttcctatttatcccgattttagtctatttcctatataaattccattctataattcctaatttttacatatactaattttactcaatatttgtgttattccaaccaatgcattcactcaagattaattttacccatattttatctttatataatttactttaattagagttaattcctattccatcgcatttaaatttaattgataccaatatggtcgtgataatattttatttatttctatcctcacctaatctttattttaaattatatttattttgccaatttatttttagggtttattcctaattaactattctttattcgcaattaatgaacttcgaaatcaaatccaaataaaatatgcgaatgaaatcggcatgatgcaattaatttaaaaagttattgaaaatccgtatttttagagttttgtttttattggttaaatttttagggtgttacagcaaccagaaagcaggctggagattgcaattctaagcacgacttaatagatcaaactcaactaatgcagcattaagtatgaaaagaagaacaatatctagacaatcaagccaccggaagtttcatagagtggtagatatatcacataatctaagttaacgtcattgtctaacctaatcggctgccttccattaacagatgttagccgattataggttagataaagatattatcgaagattatgtgagatatatgataactcgacgaattatacagacaagattagagtatcataaagatggaagcactaatcctgagaacataagtcgtcatgacaagttttacctcttgttgaggatcgaaaccgatgcagctcaacccgagagtacgaactcatcgaaataaaagtaaagcaaaatgggtggcgatgcgccgagattgtattggatgtgtgtcttttttttacatagggctcgggtctatttatacccgagaattacaagatacgtccataacagacatgactattatctctaacaaactctaagataccataagtctttacggcagacttttgcccaaacatatctctaaggaaattacatagaatatcctaattaatagatacaattgcctttccaggactctatccatgcgtggcaatcatcttgaagcacatcaacttgaacccgatgacgtacaccgagtcatattatcggaatcggctgtatcggctagccccgtccgactcgaactctgccgacctgaccttagccgatttggactgcagccgattcttactctattttcgcaacgatcttcatcttggattccacttcaatctgatcttcacctccgatgccaatagtgatagaatttactaaatttggtcgttaacacatgccccccaagtccggaatattggataatgtttcggatttgccatataccgactctgagagaaactcgcacttgctgttttcccgaccgttatcgctctgctttaaatactaatcgttgcccccaagaatcttcacgccgtgattttcgtcttcaccgctttaaacagatcccgtcctctctctctccagtgacctcctcaacgcgcattgcgatttccaggcgattccactcccggccagatcttcacccgcgacgatgtcgacctccaccaatccgaccgccgcatcatcagccgaatatgctgaggtaagtccccatcagctagatccccttttgcgttcatcagaccggttttcgctcaccttatcttgttttcttcttcgctattcttgtagcatgtttccaatcttgttgcggttcccagtctgttgcatgaccaacaatactttctcggtccaatcggcaatctagaccccgctgagtttatcatagccgaaaccaacagaaccccttttaggtcggccaatccaaacacaagccattggaaaaacaccttcaaatcctggccttctctggagaaaagctggcctgtatggtataagaggatatcggctagcaaacaagcctattgggatgagatcggaatcagccaagccctagccctcacaatagcaaattcggccaaagatgaacccctgatggctgctgcaacttatttctggtccaacactctcaatgctttccttttcaaccaagggccgatgaccccaacgctgctggatattatcatgctcactggcctagatgtaacctcatcagctaaccccatgaacctgaacaccaagaacacttttgagttcaaaactaagagcattgggggttggtcaggatatatcacagcatatatgggcaaagggccagtcactcctagagaacacgtagcttttttgctaatgtggttggaaaaattccttttctgcggatcaagctgcggtcctacaaccaactagcaattcttagccaaggccctagcaacgaagaaacaatttcccttaggcaaaatccttctctgctatctataccagatattaaacaacgcatcggccaagataattatcggctcagtggttggagcaggtggaccatggtggctcttgcaatcctggctgaacctggtagtcatgaaagttgtcaatcggccatctgtgacagaagctgaatttccaaggttggagccgattgtggaagatgatggagaagaacgcacccatcgtagatgtatgtcatacggagaatatgcatctactccagccgatgcaggagcaaagttatcggctgaacttctgaaggactggttcttcagcttttatgacggattccaaaaagatgcccgagtctggttcttctatgccgactcaatggatttcgaactgccagccgatttcaggttcgaggatattaatcatgaaaagtttcagcaatccagagaaatctttactactgctatcagcccatgtatcctcccagtcggcatccatcaaggaagaaatatccaagtcttggaatgggacaattgccaatcggccagacaacttggaatgggacaattgccaatcggcctgtactttgccaacaagatccaatgcagaggcgacatctcctcaactttaatgatggatcggctgttgaacatccctggacctccgttgggcagcattgagaacataaagctggcaaggttcaggagtagggcatttgacagatggtggggcgagtggaagctgcatctgttccatcaatcggcttccatgtacatgacagacttatttcctgatgctatccctcaggttaatcttcatttcttcaatcttgcttgaatagtcactcagccgatttgaaccttgactaacttttcttctgttttgtagacaacagaatcttctcctcctcgccagagcaatagcggcaaggtcattaagtatgctccgggtctaattcaaaatggaggtgggccatctccttctaccatcggcttcaatgcccccaagtctttagcacttcttcaagggctcatcagagaaccagccgatgctagcaagaagcggagaaccagatcatcagctgcagatacttcagctccggctccgaagaaaaaaactaaaacaaagaaagctaagccagctgatgatctgcccgccctagatccatccattgaacaagctctggatgaagaagaaatcgaggaagacatcgaccaggctacagccgaaataagcgatactgaaagaacaccatcggcttcacctaagcaggctcctccatccccttctgcttcagctcaattggcaaaggtaagcaactttctctgtccacttttgcagtcatttacttttgcagccgattcctcacaattttaataaataaagagaaagaaaatcgctgtgaggaagagatcggctacttcaacccctaaaccagctccaccagtaagatacttttatcatctcattaactgatttgggctgattatatctaatatttatccctttaacagcctcctcctccttcttcccctcttgtgcaggcagaatcagcggccgcactccatcggctgcaggcagtcatcatgttgaagaggaagaacaatgagctgcacctactatcccagtaagttttataaatttgagatcagccaatcatatcttgatccttaatcatccatgatattgtctcttgcaggtcttagccgatctgttctcctttgacatcaaagattacctcgatgaaacagaagaagacaccaccagtaaagcaacagttctcctgtctgatgatgtgaagaaaacactcgaagacatctcccatcggctaggagcatcactagataacctggtgaccaattgtggctcaatccgggcaagatttgcagatatccaagcctttcttccggacgaattaaccgacgctcttactccagctgtttacctcgagcagcatcaattcaaactggagaaagccaggcagaggttagccgatcgccgggagcgcaaggacatcgaggctacaatccaaaccaatcggcagtgtgttcatgaagagaaagccaagcttgatcatttatctgaaggcccgatcaaatctaatattgattggcttgaagctcgcaagattgaactcttggcacaactttaagaatgcaatgctgaactggatctagagcacaggaagttagccgatctcccgcaagctgtcgaagaacagaaggcaaggctaaaatcagctatcaagaacgttgctgagatgactaaatccttgaaagtcattcctggaaccgatgctcaagacgcccaaactatcgaagaaatagatcaaattaggcaaagggctatatcggctatccagcgatacttgtctcagtgatttccatgtaatagtctgcagaaaactgttgtaatcggctaagacaccctaattactttgctgtttatacaatccctgtgccatccttgtgccggcttgttcaaaaatttgcaattttctttgcaattctctatgtatgtgcccccctaattttacaatgttgaaaacattgacaaaattatagaaacaactaagggcgatataacaatatcggccatttgcacatcggcaaaccacaaccgattacaatagtgaaaagcaactaagggcgatataacaatatcggccatctcaaggcgatgtaaacacatcggctatcatgtatcggcaacactagccgatcatgcattaacccaaacactgggataatatttcttcaagtatttgccatttagagctcggccataaacttctccatcgagtccttgcaacatgtatgctcccttagataccaccttataaatttggaacggtccttcccaattcggcgaccacttgccaaatttgttatcccgagtcccaatcggcagaatcaacttccatacaagttcaccttccgaaaagtccttgggtactactttcttattataatgccgggcaacgcgctccttatccctagtaacctttgcaagggtcgtagccatgattgaaccagatcttccctttcatcggccataaggttataatactcattggcagttaaagtattttgcaactctgtcctcctcgagccgattcgaacttcccatggcagaacagcctcatgaccataaacaagtttataaggaggaacctgtatcaatccatgacaagccatccgataagaccacaatgcttcagccagccgagtatgccattgccgaggataatcagaaatcttcatcttaatcaacttgatcaaactcttattagatgcctcggcctgcccattagcttgtgcataatacggtgaagaattcaacaatttaattcccatgctatcggcaaattgaacaaactcatcggatacgaaaattgaaccttgatcagtcgtaatagtttgagggataccaaatcgatagattatatgctcttgaacgaactggatagcgtccccagaatcaactttctttaaaggaatggcctctacccacttggtagaataatcggttgccaccaatataaacttatgtcttttactcgagggtggattaatcataccgatcatatcaattccccaacctttaaaaggccacggtttaataataggattcatagccgatgccggcgccctttggattgctccaaacttctgacaatcttgacaacttttataatatctgaaacgatcctccagcattgtcagccaaaaatatccagcacgtcggagcaaccacttcattttatgagccgactgatgtgtaccacatatccttcatgaacttcgccgattgcaacttttgcctgatcgacactcaaacatttaagcaacactccatcaatcgtccgataatagaggtcatcatccaataaagtatatttcaaagccttataatgcaatttccacgaagccgattgagatggattctgtaaatactgaaacacatcatatctccaatcatcggctataatagtagcaatctctatctcgatatcttttgtcattggcttatatcccaacgctccttgagccaaactattacgactctatattctgttctcgagatatgtgcttcaaattcaccagcctagattcacttatcaacgttcggaacttttcgtaataaaccatcaatgtatcatccttgcattcatactctcctgccaattgactaatcaccaacaacgaatcacccatgatttcaatagcatcggctgctacttcctgaagcaactgtaacccttttaagaccgcctcatactcagcctgattattagtcacacggtgtttaatagcataggcaattcaaaacttgccccccaaggcgcaattataaccaagccgataccataaccatgactgcatacagatccatcaaagaataatacccaaggcataatgtcaaccaagccgattgaatcatcatgatgacccacaataaaatcggctacatcctgtcccttaatcgcctttggtgattcatgctgaagatcaaactccgttaaagaaaatatccacttgccaactctcccttttaaaatcggagccgatagcatgtacttaatcacatcggctttacacaccatagtgcattcattggacaacaagtaatgcctcaacttagtgcaagagaaatataaacacaaacacaatttctccacaggagaataccttgtttctgcatccaagagccgacggcttaaataaaacacaaccctctcttttccttcaagttcctgaatcaagaccgagccgattgacttatcaccggccgacaaatataaccggaaaggaatccctttttgtggaggaatcaatactggaggagaacttaaatattctttaatattatccaaagctttctgttattctgccccccaagtgaattgctgatcggctctcaatcttaacaatggtgtaaaaggttccagtcttccagacaaattagaaataaaccttcgaacaaaattaattttgccgatcatctcctataactctgtcttgttttccggaggcttaatctttttgatcgcattgatactcctctgaggtatttcaatccccctctcatgaaaaagaaatcccaagaactggccagccgatacaccgaaagcccattttgtcggattcatcttcaaaccatatttcctagtcctctcgaaaacctttctcaaatcggctatgtggtcctctatttctctggatttaacaaccacatcatcaatgtagacctcaaccaaccatccgatcagatcatgatatatataattcatagccctctagtacgtagctccagcgctttttaagccgaaagtcattacaacccattcaaacaagccgattgcaccaggacatctgaaggccgtcttatggatatcttcttcggccataaagatttgattatatcccgcgttcccatccataaaacttagtatcttatgtcctgaagcagcatcaaccaactgatcggatattcatccttcggggtagctttattcaagtccctgaaatcaatacagaccctcaccttaccatttttcttgataacaggaactacactagaaacccatttagcatatcggcaaggacgaataaaaccatcatcatacaaacgtttgatttcagccttgacaggttcaagcatatcggctttgcatcttctcggaggctgctggtgtggtctaatccctggttttaaaggtaatcgatgctcgacgatcgatcggctgagtcctggcatctcataatactcccaaccaaagcaatctctaaactctttcaaaagctccatcagcttggttctaaattccgaagacaaattcttactaatgaatgtcggccttggtcgatcacccggacctatatccacttcttccaaatcatcggccgacataaaaccctgaccttgcttgtatcgagatcatctaccgtgtccttggcgtagacgcttgaaccctccacaacgccctcaaaataatagcttggattcttcatcttcaatcagctgtcggctggcacaatctcaaccttgtcaccttgccattgaatcaagcattggtgcatggtcgaaggaatacaacaattggcatgaatccaatcccttccgagcaataagctgtaagaaccttttccatcgatgacaaaaaatgtggtagggatagttttactgccgattgtcaattattctacattcagaacaccctttgttcccgatgggttgccaccaaagtctttaagcaccatgtttgtcttgatgagatcctcagtagttctacctaactttctgaacgtagtataaggcatcaaatttaccgcagccccaccatcgaccatcatcttagacatcggcttcccattgacatagccatttatatacaatggtttaagatgccgattttctatcccctcaggcttttcaaagactgctcgttccggtgatagaaccaacttagccgattcctcttccagttcgtcaacatcggcctagtcaatcccgaattcggctggcaaagtaaagaccatgttaattggcgccgttaaaatacttttcccttttgccaacctctttgcttcgtcggctgcaatatcatcggctccaagaacttgattcttaacacgccactccttccttggctttgctttcctcagccgataccaatttcttgctcgacctcctgaaagcgctccctgctcctcaacctttgaacccttctttt

SEQ ID NO: 68427 - DNA, 7031 bp, Oryza sativa
aggtaggtgtggcctgtcccatcgaagtgtcattcggggggcaaccataccaacctccgtccataaagagaagaaaagtccagtttggaagggagagggtacatgtggtatccccttaagatataaaaggaggaccatgcccacaaagagaggggactggattttcccgggagaggagagggctggttgatattttgtaacttgctcttacacagatccacaaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcataatgcctcatagagtcaaagcatgaactaatttctccatattttcatatatggaagcatattgcttgtgcgttaatatacagtacatgttgtacaaacgttaaattgtaaatgttgtgtatacttaaatgtacataaaaatattttaaaaaaaatgtgagatgtgcaacatgcatgtacaacacgtaaaaatgtaactcaaaattatcatatgcggcttgttttgacttagtttctacttatttttaagtctagctattatcttactcccccttagtctcaaaataactttacttttagcctctacctcgtctcaaaataagtttacctttatcaacttacctatcatgctctaatccacaatttgatgaattttttttactccatcaatatcttttacctatccttacctacctatctacctatccacgcatatatactagtttcctattagtgagcgacactttggtgtttttttcttctacattgttttgaacgtccaagtctaaacttaaagttaaagttattttgaaatggaaggaccgaaagactattatcttattaaagtgtaattgcaaagaaataagcttttatgtttgctctcaaattacatattaatatgagaaaaaaaatctaaaccgttaattatagggtggatctaaaatatagctgtgtggatttattggatgagctcttcatggaaaacaaactccatatctccaatctatattcaattcaaataaaaaactcaaacgatgccatacacattacataaacattttcacaccacccacaattatatatgcatattactaattattatttatctaattacattacttagtttgttctactgaaggttaattatataattactcaataaattaacaagcaaaacaagggctaaaccatcatttctgtgaccatagagccaaagcaacacaactctatagcagaccttatctttcgtggataataaactactacgcaggatccgctcacctctaacggatcatcagtgactgttatgaagttatctatgataaatagtctatgaagttattgttcggttttgtgcatatatatagtttttatatctaataaggcttgttcaggctaaaaaaattcatacacacgtcactgtttgaatgctttccatctcgagagcaaatagatgtttcttgctttatatatattgacattatttttaaagatacttcctctcaccctaaatatttgacgcaattgattttttaaaatatgtttaaccgtttgtcttattcaaaaaatttaactaattattaatttttttcctatcattcaattcattgttaaatatacttttatgtatacatatagttttacatattttacacaagtttttgaataagacgaacggtcaaacatgttttaaaaaagtcaacggcgttaaatatttagagacggagggagtaaaaaaaaactagcacaaaatttctaacatcttttgcatctctccaagctaggatagcgagcatcatcacccactcctcgcacccagaacaccaattacgaaagatgaagctcaaatatctatttacttgcgggaaactattctaatccctcgaggggatgttttctcgtttgctcaaaaaccatctaaacagttatgaaaaattctagaaaaatttgacaacattcatacaacacatatatataactccacaaaatcttaagtccaaactcaactcacacgtcgagatataaaaaagacaaattcagcgtatgaatagtagcgaactgtttatatataaatttgtcttttttgtttctcgatgtgtagatcgaatttgaacatgaattttggtggactagtaggtatcattatactctacatttttaatttttttcagaatttttcacaactatttgcatcgaatttagaagaaaaagatgtcccctcaatccactcccacttacttgcaacttatgcaaccatcccggtgctatcagttgctcacaataatcacctatataaacacacacacacatcttactatagcgcatttaggatgtccgtaatatcattgacaattaaattcaccgccagttgccgggcgaacatgatcagaaacctcacgatgggactgctaccgccggcccagccgccgccgccaccggtggcaggccaacccctcgcaccagctggagcaccgccggcgccggccggcgaaacgcagccgatgtggagcatgaacagacataggccgcaccggtaatgccagatggagcagtcccggtggcacgccgcgcactccccgcgcgccgggaccaagttgaggacgtgcccgtggcacccggcggccgggtggatggtcatcggcagcagcgtgcacagcgggtgcacgtcgaacgcgcactccgcgcagcggtacacgaggcggccgggctggatccgcccctggcacaggtcgcaccacccggggttcgccgaggccacaaccgcggttagcgggtgccgcgggtgcgcgaagaagccgtggatcgtgtcccgggcgaagcggtcggcgcaagcctcgtggatggtgaagtcgctacagtggtggtggttgcagcggtagccgacgccggtgatgggtagctcgcagatgttgcaggcacggtggctgatctgatcccgctggttgtatgtgcacctctgaagctggtgctgtggatgtgcaacgtgccagcggttttccatggccagcaatcactatagcttgatcgctctcgctcgtatagctcgtgcggtgtactgtttttacgtacgtgtgcactgctcttaatttgtgttgcgctttgagttccgggtgccaatatatatacacagagagaagagcacgcttacatacatagacataagttaattaacttgttcttttttttatgttgcatttgaccttatgtttcatataattaatctatcttgttaattatttttcatatatttttaataactatttaaatatcatgtaagaaataaataaaggatatccccagatgaaaatacttttcttagggcctgtttagtagagctccaactcctaaatttagctacaggagttgggtctggagtggagttgtggagctgtgtttattttgtgagagagctccgtccaactctgctcccattttaggtggagctgaaactgtttagctgagctccaactctagaagagatggagcgagagctggatctgtactaaacagacccttacatacacgcatgatgcatccttggagggggccagacagtggatttgcaagagcttttacaaggtcagtcaactatgggttcacgcggttaattcgggtaataagtacagagaggaagatgaagatggagattaagagattaagtgtttcacagaaaaacgaggtggtaataacatgtgattaattaggttttaattattacaaacttgaaaaatggattaatctaatattttagaacaacttttatatagaaagttttcgcacgaaatgtaccgtttaaccgtttgaaaagcgtgtcatgagtatccaaattttcatccacttttacagaagaaacgaacgggagactcggttgtttcgctccggtctgattcagtttcgatcgggtatgtacaagagatgttgaaatgttaggaaatgtagtatatatacattgatttgaacctgtagtaaatagtactaaatacgtaccgaacacgacatggaatgcaacagcagcaaactgtgacatgtggaattttctcatcgaaaattcagaaaatttacaacatgctggtactctagtcgaatttgagaacttaaggtatcgtccttatagctgaactctggctagtcaaaaattctgaaaatttacttaactacatgcgtcgtgcgaaaaagttctacatattttccctatcccaaaatataataacttatagcatttaaaattgttgtaaaatataacaactttcccaccatattcaaacatccatatcgtttcgtttatgattatacttgtacatatggcttattagcaaaacaaataataatttgtgcttacaattttcatatactttcccttagcaatcaaaattaaatgttataatataaactaagataaaagaaaccacaaaattaattaagttttagtatttaaattttgcttataagtataagtatatataagcgaaacgatggggctgaatgtcttcctctacttattattctctatcaatcacaatattgtctcatttaattccacattgttttcttgatactcgtatctaaccttgcaaatttttacatttttggacgtagtcggtataatttttttttaaaaaaatcaaataaatctatttataagtttgtaatcgattatattcaactaatcactcgctaagtcactaatgacgtactatctcgttttgagtgtagcacaaataactcaggctagctggtacccgctgcttcgggcctgtttggcatagctccagctccagctccacctctccaggagctggagctcagctaaacagtttcagctctaccaataatgggaatggagctgggtggagctctctcacaaaataaactagagttgtggaactgggtttagacagctccacaactccgctctagactcaactcctggagctaaattaggagttggagctgtaccaaacaggcccttctaaccggccggctatgttcgatcctccataatctattttcatgattttcgtaagtatatatttctcaaactgtaaaacagtgtgtttttaaaaatgaattctacataaaaattacttttaaaaattatattaaattatttttaaagtttttttctatagctaaaacgtagttaatgggtcatcacatcatctttcgtgccgaagaggaaagatactaccacgattcaatcgcagtctaagacttacttcctccatcccataaaaccaatcctaatatgggatatgacatattctagttctataaataagagtacgggatgtaacggagagagtacaagtcaggtcatatctcatatctcatattaggtttgttttttatgggacggaagaaataaaagtcaggtcaagttaactctgattttaatgccaatcggctactccaagagataatgaattaattagaagtaatcttgcagtccgtgttgcaccgctacttttctctcttctcttttatcttcttaattaattaaaatatgttggtttatagtctgctattgtatatgctcttagcgggtgctgcgggtgcgcgaagaacccgtggatcgtgtcccgggcgaagcggtcggcgcaagcctcgtggatggcgaagtcgctgcagtggtggtggactggtggttgcagcggtagccgacgccggtgacgggcgcaataattcgcagatgtggcaggcacggtggctttcctactggttgtacgcaggtgtcctccgaagctagctagctggtgacgtgaggatgtgcatggtgccatcggttttacatggtcacttggtcagcaagcaatcacacgttgcactgtttttacgtacgtgcctctgctagctctccgtgttgcacttgtacgcgtacacggccgcatcgttggagggggcagggcgcggtggactggctaggtcaagtcgactctgggatagctggtgggagttcgatcacacggttctggtaaagtaatacagcgatggaacgacgaagacttgcattatggctgtttcgctccgacctgacagtttcaatcgggtttgtacaagtggatgttgaaatgttggcacatatacattgatttgaacgtgacctagcaagtccatggaacggttccattcgcggtggacttgctagggtctaaacacgacatggaacggtagctgcagcagcaacgacgtctgtgacatgcatgtgttgtagattactcctacatgcattgatgcttatgcattgtctgtcctcttccaagtggccggacttaaaaaggctagcttacaagtcaggtcaagtcaactcggagcaagtgtagtactccctccatcctaaaatataaatatttctggacttcgacacgatcttcaagatattttttttaccaacaatatctatagaaataaaatgttttaaataaaaagagttgcatattatgatagtttgtttaatggtaaatctagtaacgtcaattttacatggttgacctttttattttttatattgatagtcaaagttaaaaaatctttgacttaacactatgctaaaaatgcttatattctgggacggagggaatgaaaactggagcagtactacggtctggcatgattttaatggcaaccgcccaatcggctactgcaagacaacaataatatggtatatggaaaggtactcgcttcgtcttaaaatatgatttggttagatgtgacataatcctattactacgatattaagatttatagtaccaacatgtgtccaatctaaccaaatcccttatattttgaaaagcaattttgtcatccaacattgttaattaccttgagatgccacaaattattggtacctcgaggtactttctagtgtaaaatttggtacctagtaacttcatgttaggg

SEQ ID NO: 68428 - DNA, 5969 bp, Oryza sativa
  unsure (1)..(5969): unsure at all n locations
ataaggtagagagagggttgagggaggtggttgaggtacaagagataaagaaagagataaggtagagagagagggggagtggttaccagggaataaagggaaaaatgaagagggagaggaaaaatttaaagtgagtagagggaaaggagggaggaatatcccgtgcggttggattaggacgcccgcacggggaaatcgatttttccgtgcgggcgacacctagcgccgctccctcaatttttccgtgcggttccacttatggactgcatagaaacaaagaggagggacgtccagaaaaatcaatcgtgtagtagtgtgtcatcttagctattaataataaaatatttttaagtggtagtagaactcataaatcaatggcttaaactgcttctatgcatagatatagtagaatggtactatagtagagaccaccgtgaaaaagtactcaccaacaaacaggccaacaatttgctccttatctccgcatccaagcttagtttgcaggccaaaattagctatgatcctctcttctaaatgggaactacacgtgaaaatataagttatcgtcacttatacacaaattataaatcataagttggccactcttggtcaggctttatagtgcactctaatacatttgcaccctttcagtttcctcttccatgctccaaccctcgcatactaatccttggttctttaatttctttccagcgacattgatgtgaaatgtagatcatttactagagagtaaaggtgcgcacgtatcattagagcgtgcaaacttcgaaactgtcagtatatttggggcttgctcttgcatacaattctcttcgtcttaaaatataagagatcttggacggatagaacattttaaaggactgaatctagataatcctatccatccaaaattccttatattttatattttagagtagagagagtacgaatatcgctatgtagggcatctaaaaaataagtgtttttgtaaatcttcatacaaagggatcaaatttgtggtttcatgtacagagagggtcatagatgtactgcacattggtccggataagaacataagcatgccgggccctctcgttgctattactcgttgctattactctaagccctccatagctgcctatggcctgcagtaataatcagtactgtaagctgaaaggatgatattacccccatgtagcggtgaattttgttttagctatcatgcatgaacttcaattaggtaatttctatggttgcggacctaatttttttagataatagaatataatatccataattaagaaatggttgcggacctaattgagtgacatttgcatcaacaaaattaatatgcataacaagggcatgaactaggaaaaccgctaaaaaaatataacccaagtgtttttaaagagttgatcatactgttgaacgaagatgtgatgaagctcaagtaaaatataaaaggaagtgcagtgaactctactgttagggcactgagaaatccacggcactcaaaagggaactgacgaagaccaatttctgtgcacagtgcgatcaagagctgagcctggggagcaaaggggtattctcaacatcaccttgagttatttcttcatttaactttagttcccagtgccccccaatcctactgtccacgagcatacttctccgttcttggacctgcatctcatgttgtctaatcaacctttggcacatcttgtgcagcatttaaataggcttttcgttcctcctctctccgtcccatagaacatcaacctagtacgagatgtgacacattctactactacggatctagacatacatctgtccagattcgttatactagaatgtgttacatccaatcgtagattcattttttgtggggacgaagggagtacaaggcttcaatcattaatgcgaggatgcctagcatactaaatgattgacacaattcatgctatgttactcctttcgtcccattttaagtatagttgtgagagtttctgtgttcaacgtttaacctttcgtcttatttggaaaacttacgaaaaaattaaaaaaataagtcacacaaacaataaaaaatactaatcataaaaaatcaaataagacggatggtcaaacgttaaaaaaaaaactcataattatacttaaaatgagatagatagagtagttgtctttggcagcctgtagctcggcagctttgttttgcaacagaatgagtgtaagttgcatagatgatgcaggaattctgaaatgagctactactctgtcccctaaaaagacaaactctagctacgaatttgaacacgcatgtatccaggtttgtagctaggattagactctttttgggatggagggggtaggttacaccccgagtacgtatgcatggtgttttggtgagcgaaatacgtagtcaaagttcaatccacatccaaaaatgagctagtgatgatggttatgctcagtagatacgagccaaggtaaatgaatgatcataatactcaccttggttagtgtgacaagataaaactgtcacgtccgcactgtgtagcgtgtcagtgttgttttgttatgttaggcaggctggtgtggccaaaaaattcagatgagtttattattaaaattaaaaaaataaaaaagttcaaaaaataaaaaaaatcaaagctaatacagggttcaaaaacagcatatcataagatcacattatctgccagttctataactttagtcttattaccaggcagccggagccatgattctcttaagaatttacatgaatatctctctcgcgtacgagttatagtttcttcatgtgaagtataaacacctcaaatcctataaatgattaaatagcttagccttggagttttaacccctagctactatagtacatagggcaatttatcatcccccgcttatctctgcatctatggtagagcaaattggaggccaatgcaaattgatttacgaccctttctccttatggcttaattattcagttaatctttatgagaaaaggattgaaaaactcccctcagttaatcccatctaaatcccctcagttatgtcggagagtgattaaccgaacaaggcctaaaactacacatgtgataatataggttattctaatttatacacgaactataaaatagtaaattggcacggagtagtgaaggcgcatgcacaaacatatcgcgtggtgcggcatagattgctagaaaggtactcacagctcaccaaaacactagatctggccaggctgagcacatccgagctcaacacaagccaggacggtcacacacagctgaatagacctacctttcatatcccagcagagcagctcaacatgaaacatatctgttgccgcttcggcctcaagccggtaccctaagcagtgaacatcctggtgcctcccaatcccacaataattcagctaatctcaaggaaggaatccatatataagcggcattgattcaatcacgaatggtaaatgggcagcaaattaggccttattaattatttgtttgatgccattcagtgtatctctcatgttttttatcctagcagctgaatatatatagtgggcaagtgggcaaaaatgggcaaatgtttttgatcctagcagctgaaagctcacgagagaaaagaaaaaggtaaatgggcaaatggcctggtggtattaacgctatttacctactacccaggttaagaggaataattatagcgcatgtgctctccattttatgtaatgaatgccagatattcttttcatgtttttttatggggaaaaaaagaatggaagacaatgatacacacgtagagatgcttataattctcaagttcataattagcactggcaattagaaacatcaaaacagcactaccgttttcaatttgttttcttcttgtacagttgtacaatgtttcttagataatggaatagaatcttggcctttgctacaattgtactatgtagcgagaggcatatatgatcccataaataagtgatcgagagattttacagatcttcgtatacaaaaaacgtcatgatcaatccagttgtacaaaagctattaagatcatagttgtaccaacacagcaagtacaggaggagcatgcctctgatcctctcgtggctctttctgatttagccttgtattgctgcctatagctagcctgcagcacatgcacttgaacctaacattacgcgaggtgcttcatggcctggaaagtccatgtgcctcccaatcctatggttcgagctactaaggaaaaaggaaaatagaaattgatacttgttggccttagcatgtccagatcactttaccttgagcatatgaaaaggagaaaagcaagagaactgccctaggaattaatccctcacacacacctctacttctcttgctctctgccttctaaggccaacagcccaagagtgcagaaatctacatatacacccatgcagcatcacagcagctgaatgtcaaatgaaaataagttgtagctatggccgcaatatgaactcgggctatatatatatcaaagaatcacggcactgtatttctaatttaaatttgaaggctcaacattcctatgctttgaacaaatgaaaaatacagcagccgacccgcttttaatttggcactctgaataatgtcatgacaagttgcttttatgatttatgtaaattacttttaggttttattgaattttttttaataaatatctaagaagtaatttagtcaaatctaaaagtgatatttacatatgtgacaaaagtaatttaatacacatatatatttttatcagaatataattatgtgagatcttattaaaaatattttattgcaacgaatacaacaatgcaatcggatcataaattggataagtattgtaagagaaaattctataagttgagaaaaaaaagacatgcatgacctgtagcaaaatagttcttcagcttgtctgtagacatacagtagtagttctctcacatatggtcggcgtcgcttcttaatctagtgtagtgtgataggtcaaagacgagatgcctcccgatttagattttgcgtttacgtaacatatggttgcagaaaattcacttggtataggaccagttaacaattgcactcatttttttccattattgtaccacccataaattaaacttaaggaaacacaaaggtgttcgttgaattgttattctcttcccctttttacgacctaaatcaacctaacgctcttaattcggacatgagctctgccagctacctcatgtgctagagctctgcaattcagccctaagcctaagccagaaagatcattttggtttttaagcatagtaagttagtaacacaaaagtcacacatacaagtcgacttcctttaaacaggaagcaataagcaaacttaacatttcgcatactgcatgctaatttcttttagtaagacacaaggaaaaagatggatcgaatcctttcagatcttctacgtagcaacgtgaaaatcacaaggcaatattcatacccaggcaaacaatcagaagacagagcaacctcaaaagaaactgacgattgctttacttccaggctacagctgacgaaaatttctgtcctgattgctactggtggagaaggcaccgatctgatggtgattgtgctttcaattctcttcgcctgcgcaaaatccaaggtagcaggcatacttgaattcctgatacatcccaagccccagaattcttgccagaattatattgagaaccaaactcatgcctgattccatggccttgtgtatgcatcatgtaggcatccaacttccttctgcatcaattcctctcggtgtgtgtgtgtgtgtgtgtgtgtgtgtgtgtgtgtgtgtgtgtgtgtatggtgttcctttaatggctcatcacttaacaaggctattgatggncngttgcagaagcaggctgtactgtccgatgcgccg

SEQ ID NO: 68429 - DNA, 5002 bp, Oryza sativa
tgtcatttgtcagaccaacccaacctttacctcctgaagtaagaggagtttcgctttgataccttatgctaaagctccatacacttatctgttgagatccctctccagaagcattcacgtactacatctgcaattatgcattgtctgtctgtctctacgataaaccttgacactccggacttccttggcaagttcaattgctctcgtcaagggacacgatgattttgctgacatgatctgtaaaagaagcaaagtcgtatcagtttgatgatcattaaggaatgaaaacaaaagtacaaattcaaatgcctgtcagcatcacctctttctttccgactaactggtgtttgtctgcaactcggtctgacgctttgctttgtcatgcattgcgagtagttcccttttcttctgttctcatccaaagaatgatcaaaattacacgatgctccaaaaataaatatggtgcagcttgttggaaagatataagtatgctttaagctaagccatcattcacagtaaaagtagatcatttgcatttggagctgcagtttaggattttagactatggtactacaaagactgaggcaaaatccaaacagcacaagtgttattcacatctactaattactgtacagtttctacttcgctatgagcctatgattgctgtgcaatgatgacttacaactagccagaatatcagatcaaactagttggtatctgcttctcgaatataacgaccaatagccagaacaattttcaccaattggatatcgaaaggctaattcgctaattctaaagcagcatttatcacgggaacacatagattaaaatataattgctggcttccaaaacaaaagatctgatcctctttatagtagccatataccgagcaatcgcagtgtggatgtgatcaaggtactcatcccagtctgaatcatcagccatagtgataccaagtcgctcaacctcttcatcggtgtagtccgctaattcggtaggggcagctaaagggcttcgcattccgcgcttgatgtttaactcgttgatgcccttcatagccttcttgaaattctcataccgatgagccttctctttcttggttatgtatatccggccatgctccttcatccagtcttcgaattttgccttcatggctggctcatccaccgcgttgttgccatcctcgtctgtgtcggcggcatcagcatcgacgatggcctcctccaccttgtcggaacatttctggtcatagtttggtttccccccgttcatctgaacgcggaggtaaccgtagtactcaggataggcgaaggcgccatctttccttgtgaaccttgccatgacggatggctcgatcacgtccctccactttacggtctcctcctccttcctggtatactcccaagctgccacaggtacaaacaggtagggaacgaaacaaatcagtgtattgaatagtaggctaagacatttaacggtaacctctctcaaacagtttgttggcggatggcatgagtcccttcgaccgaatctgccgaaacccatggcgaagaccacgagccaaggatgatgcgaggcgaagggtcgcacgagtgcacgccgaagaaggacgacttcgccatgccgaagaaggacgacttcgccaggaccggttcgcgccggcatccagcccagagaaggacggcttcgccaggtccagttcgcccccgcgagggccgaagtagccttctcggcccaccaagcttagagaccatagggacggcgatcgcccgatggcccatcaagagcccatgagcccccctttacgttatgtaaccctgtaaaagtcccctttcataagggcaactatgtaaattcctcagtacaacctagaccctagaagtaaaaatctgtaacggggctatcaatagccccctagggccatgtaatacaggggagaaaattcaagaaatcaatatacttcgtttctttccaaccactgttaagtaaccacgtctttcgacgtatgcggttgtcgtttcgataacagctggcgccgaccgtggggacctccgagcgaaaccactgagagcgaatgccaccgaagaaggtcgtgaaggagaaggttacaaggcgaaaggaaagcgacgccggggcggacatggccgccgaagaaggagcggaaccttcggcatcaatcgccgaagtgggaggagccccgtccgcttcggcaccggcaccgtctgcttcggcgctgatcacagcattgctgccttcggcccctgccacctctgagcaggcgccaagggtggatgaagtggcgaaggcggctgcagcggcaagggcgcttcagaccagggcggagatcctttcggcaggacagctgctggtgccccctgccgctccgtcgcagccaacagtggcccaagccgcactccctgccgtgcaagttcaagtcaactccgaccctgaaacacaagccgaagccgatatggaaactattaggcagaacatggcacgactccaagacatgcttcgccaaatgcaagaacagcaacaagcgtacgaggcggcgaggcggtccagggtcccttcggcaccaatcctccaatattcggcagggtatgtcccgcctcaagtctgtccacaagtgcagtcccagcccgttccgccgcaagtctcacaggcatcggtgcacttcgccgggcagccggcagccgcagcagtgcaccaggccccctatggacaagctcagcagatcgcggcccaagtgtagcctcaaccacttggccaggtgtcgcaaaccgtagcggaaggggcttcggctctgcaggcgcaattccaagctttccttcagcaactcaatcagccccacaacatttcgagtacagctccctcgactcgtccagaggggagtacaggtcaaggtgcacctagttggttgccgccgaaccagccgaatctgggggcttcgccatggagtcagacacctcagtacgacttcgtcaatgccgcccaggcgcaaactgttcggccgcaaggaccgacaccaggctttggaacaagccaagcaccagcccaagtcgccatgacatggtcgcagccagttttcgacccatccatggcgacccagcaagtattaccaatcgcaaccgggcagccgagcaccatggctcaaactcacgcgcaagccgtaatttcacctttcgccacgccgtacccgcagcaaggtgcagcaaacagagcggggggcgagaaggggctgccgctgagtgggggaattaagaaccgcccaattccaccccagttcaaattcccacccgtcccacgctactcgggcgaaactgacccgaaggagttcctatccatctatgagtccgcgatcgaggcggctcatggcgacgaaaataccaaggcaaaggtaattcacctcgctctggacggcatcgcccgttcttggtatttcaatctgccagccaatagcatttactcatgggagcaattgcgcgatgtttttgttcttaactttcgaggcacttatgaggagccgaagacgcagcagcatctgctcggcattcgccaaaggccgggagaatcgataagagaatacatgcgtcgcttctcgcaagcccggtgtcaagttcaagacataactgaggcgttagtcataaatgctgcttcggccggtttgctcgaaggcgaactcacaaggaaaatcgccaataaggaaccacaaacacttgagcatttgcttcgcatcattgacggttttgcaaggggtgaagaggattccaagcgacggcaagccatacaagctgagtacgataaagcttctattgccgccgcccaagctcaagcacaagttcaagttgccgaaccacctcccctcgcggttagtcagcctcaaacggcgatccaagggcagccgccaagacaaggtcaagctcccataacctggaaaaagttcaggaccgaccgcgcgggcaaggctgtgatggccgtcgaagaagtgcaagccctccgcaaggagttcgacgcccagcaagcaagcaaccatcagccggtccgtaagaaggtccgaaaagacctttactgcgctttccatggacgctcttcgcataccacagagcaatgccgaaacatcaggcaacgtggcaacacgcaagatactagaccacagcaaggagcaaccgtcgaagcacctcgtgaagcagcccaagaacaacccccggtcgaacaacgtcaagatgcacagcgaagagtaatccaagtgattacgagggccgacccgctcggccatttgtccaaaaggcagaaaaagatgcagatccgagcggtccacagcatcacttcgacgggggagggggcgccgcagtatatgaaccagccaatttctttcgggccagaagacgccgaaggagtcatgttcccacatcaagatccactggtaatatcagctgagatagccggctttgaagtccgacgaatcctgttcgacggagggagttcggctgatgtcatcttcgccgaggcgtatgctaagatggggttgcccacccaggctcttacaccagcaccaacgtcactccgggggttcggcggagaggcagttcaagttctcggccaggcacttctgctgatagctttcggctcgggagaaaacagacgcgaagagcaagtactgttcgatgtcgtcgacatcccgtacaactacaatgccatcctcggccgtgcgaccctgaacaagttcgaagccatttcccaccacaactatctcaaactcaagatgcccggcccagcgggagtgatagtggtcaaggggcttcagccttcgcctgcgtcgaaaggcgatcaagccgtagtcaacagggccatgcacaatgtgaagccgaactccacagccggccaaaacacgcgccaaaacccacacctcacgcccagatagtaaaagtgcaggttgacgataaagaccccacaaagctcgtctcgctgggagacggcatgggcaaacacgaagctgaga

SEQ ID NO: 68430 - DNA, 3852 bp, Oryza sativa
  unsure (1)..(3852): unsure at all n locations
tagtcaagaaaagacaatcgtcaattcttcatttctgtatgtggatattggtctttttcttctgcccattcgtttacccttcagtctataagctgcaacaaaaaaaaatataacctaattttggagttgtttttgggtttttctttatcgtagtttaaaattttatactatgataccacgtgtatttgggggtttactattttgatataccacgtgtatttctcagtgcgaggtatctaataaggtgaagcaaattacctataagctcgagtttatgggcatctgcatcactgcatgcagtcgctgcctccgtgtaaatgaattgcacagaacctatccgatgtgacatatttcaataccaatgtgatattttcttggtaaaattagttgtgaagataaaggtcatgtaatctttgcatatggtgatttgaaaaaaaaaactcttatttcttcagatcagtacagaaaaaaaaacagataactacaccgatgtttgtgccgttggcttgaattggttgagcttgatgtgtttaggccagcaccactactggaattacggttctgttcgtccgttgagttctaccgcccaatacctggagattaattagccattctcatgtttgccgattggggctaaacaaactagcaaccggaaccggggctatcccggacgaaagctctattaaattataatatttttgaataaactgacgatgaaacttttataataaatgatagttacagtgaaatttgtctgggctcgaaaaattttctaaccccaccactggccagaattgtttaattatctgtaggttttgaggtgttgatacttcacatgaagaaaacaggaacacaaacacaagagataatagtttgtacgtataaatttctcaagataggaatatggctctagagtctttcaactttcaagactacaagcacaaccgtagctgcattcttttggggttgggaaccttcccctcatgcaaaaccggaacggtagactaacgaatattaattaagtatcagctaaaataacttgagaattaaatttatatgatttgttaagacaacttttctacataacagtttgggaagagtgtagacagaaaacaagagggtagaagttggaaaaataaaggtaggcagagatagttatagggttaattaggagatgatgagatgttatggtgtgcttcttgcaggtttgaatgccatattatcagctatgttatctagtattatcatagatactactagaaaaatcaattttacagtcggacaaatcggcttttcgtaggcggccactcgaaccgcctataggcaaaggcccacgaaaatagtgtatttgcagatgggtgaactggccgcctgcaaaaactgatttttcgcgggcggattccttaacaggtccgcctgcgaaaatatttgcatagcgcaaaaaaaaacctgggaaatttctaaatcccccgtacaagcagattcgaaagccctaaatccattcaacaaatttatcaaatcctcaaatccattcaacaaattcatcgcaattctcaaatccagtaaacaaattcatcacatatcaacacaacgaaacaaaaattcgtcgccagtcgaagccgtcactgctcacgaacaaacctgtgacagatctaggcgcccgaggacaaccaacggtggaattgctctcccgacgacgacccaaggcaggccggcagcggatccgcgtgcccgaggtcagccggcggtggatctgcgcgcctgggtgagccggcggcggatcaaggcgtcgtcgtcgtcatcacagccggtggcaggacccaggcgtcgacgccgtcgtcgtcgttgcggcagtcatcatcatcgtggccgaggccagcttgcagtggatccgcgcgcctaggcgagccgacgacggcagatccaagtggcattgtcgtcgtcatcgcagccggcggtaggactcggcaccgtcatcgtcaccaaggcggacctcctcggagccgttgccaaggcgccgacgccactcctctccctagccaatgcgtgatgagagagagaggaggaggggaatgagtaggttgatctgtaggcatgattttcgtaggtggaccacataaagtttcacttgcgaaaatcaattttccaggcaggctccttaagaggtccgtctagattttcacaggcggggttaaatctagaggttctttagctattttcgcaaacggttataagagggtattttttttggtccgcctgaaaaaaaataaaaagccaacgttgataaaaatcgtttttctattaatgtgaccatacatgtttggagaggtagcatgtctccaaatagtaacggtccacgggtaaatttggacacgaaacacatgcttagatttgcgttttgacctacataacggagactaaattgttggttttttacttgtgcccaaagttattgttggcatgctagcgctgatggtctctgtatatgtgctaaaggctgatgatgcgacagctagcgcgagatgcaggggccaagaagaataggattgggcggcactaggaactgatgaagctgaacgacgaaccaacttggggtgatcttgatcagaagactcctttggtccccaaaaacttctgatcttgcttcgcagcgagattgatcctggtgatttcatctagctgttgtggttaacttgctgattgtcccaactgaatagaggggcgccctgcacttctccttatctctacatataccaagtttgatttggatattttgaaagatgaccatgctcatctgtttacactctgtttcgatatcaattctttaagttaattagtgcttggtattacatggtaggatttgctaggatcgatccagtgtacactaaattttagtttcaggtatatatccaaaatcccgagagggagggaaaagcgtggtgctctctactgttagtagaaattaatttaaaccgattatctagtttatctaagggtttagatctttttatatagtactaccacattagtcaacagtagtagaaatgtgtataaggtataattgtccaacaaatataggagtatatgggtaaaattataatttttttccactttattttgcccagaaagtgcgaactgcagatccttaactaaagtaaagataaattatggacttgtacgtctacagtgtttcagttcgaaaataggactcgtagaaaacttcttcatggaatcaattggttccacatatatgatagagaaaatcccctgtgtacccctgaaggttcacctaatcccttctgtatccctgaattttgctcaatctcttggatacccctgaattttagtttggatctcttccatgccctttcaactagttgaccgttagttgaccgttaaattcttatgaaaaagtccattttgcgctttggtataaagaagcatataaattaatagagtatattgttggagcatagaaatgtgttatatgagactattatgtttatgagatagctatgcaccatattatttgcgataaatatacttttagatatgacataaaaaattaatacttatttatttttttagcatatgtattctgatagtaataaacaaatatgttatattactatgaaaacacatatgctacataaaagaacttttaataactaataaataagtattaaatttttatatcatatgtaaaagtaaatttgtcacaaataatatggtgcatcgcagactcataaatataatagtctcatccaataaatttttacattccnncgagaggcttcattaattcaaagtgtttctgtgatggggctaatgcactctgatatgcaactctcg

SEQ ID NO: 68431 - DNA, 14332 bp, Oryza sativa
ttccgcggccaccgccgacagagcagccgccgcggtcctcctagtcgcgggcggtcattgttcgtcgttggtcgtcgtggtaagaaccgttgggttcgtctcgtcgtcctataggtgtacatgtcctcaaaagtcgcagccgaccatccaatctccggcgaggtcgcaaacccgggccggccatggatgacgtcatgctgacgtcatcggtttttctttttcccgtagattaaatcttctgaaaatcatatctaaataaccgtagatccgtttcgagtggttcaagttgctaaattttttctaaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatttacatgtttgttaactttttatgaactgtttatttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacacaatcctttgagcatgttgatcctatatttaaattctctatttgtttcaactgtgcatttattttcgaatgtcaccgggtggtgtgaaccaattcctttgttatggccaatttgcattgaatatcctattccttgataccttgggtaataaattgattagcttgaaccttatgtattggtttggttcagctaaatgttatatatatataattgcttagcaatgcttagaaacattagctcactaatgggatgaatcatatatactacattattatttatggttatatttaatggtagctcacgatggttaatcgtgttatgataattaattggtatttaaaatatgattaatggtgggttgtgagcacatggttttgaaggtcgtgctcatggcaattaaggaccggttcgcgagctactgttgtgaaacatttatcgtgccaaccacaagccagcatgggcaacggctttatcttttgtatagcgtgattcattatagtgcgccagactgagaagtggcgagaagtccatgggggtcgctggggagtccatgccttgtttataagggggtgattatgatccaggaacggtgcactgttttgagttgtgttgtgcaaagggtattgtcacgatttcccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacatctctcacaataattatggatgttatacctggtaataatttgcttagctcctggtttggagttagatctgttcagccgggtatggttgttcaggatggttgggcctgtgcagcatgggtgtgttgttcagtgttgattaaaatttctgattaattactctactgttttactactcttaactctttgctaaatgctgctttcgcaaatgagcctatattatgccatcctttggtatccttgtgcacttgcatacttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagattttatttttccgctgcagttttcttcttggtgaggactaagtgcctcttaagtaagtatttatcggtttagttattatgatggatttgtatattaaattgtcagtttgtgtacctcggctgattcctggacgaggattttatgcacaaatcagtttggaaattactagtgaatttccgggcgtgacaatggtgcaaatcttatcaaatacataacaatatggattgtttgtttttcaaattggaaatcgtattgacctacatttttttaagccatgtactggacagggcaagcactaaaactacaaattaacaatcatatttttcatgtatatgctactactctggctttcaatgaacacgaccatattatacttggcaatcagtaacaaaatctatttttaattggattttactaccgttagtattgcatgttagcttattatggaccatgtgaccgtgtttgcaaaaaaaaaaattaagatagcatataacttcattgtggacatccccacacgacacatgttttatatcatttgcacccctaaaacaagatgagtgacttgtttgagcattctacaagatgggtgattaaattgcacctacctcgcaagttacggtactaatgctagaatttggtaagatattttagtggatttggttgagaaaagaacgcaatctgctgatagaaaacttatccagaagaaaccattcaaggaggaatcgtgaagaccacggcatgacagtttaattctatctattagttaggcaagattcaataattttccttttatctttaggaagtgtttatctagtattcgatcaggacttgtaattttccttttttttctttaggaaagtgtgtttagtgtccgattaggactcttaacggcctacgggtataaatatgtacacctagggccattgcaggacatctttcgatcaatacaacttcggcgcatcgctactctttttatttgtctttctcaacgagttctcgcttcgagttgggctacatcggcttcgatcttcgatgaggggtaaggcttgttatggttgtttgtatcggcggggttatggtctcaatactcttggcttgtcgatattaacacctatttatcatatactttaggtaatttaagttgatgtttcaatttacctgtattggccagatcttttctagggttttgttggtattagttattgtttcatcgatctagattagcaaaggtatctatcacccttaaaaagagtcaaaggcttaattgtttagatattatgtttcttttcatactttgctgcatcaattggttttggcctactaagtcatgtttacaaccataatgtctagcctgttttttgattgccaataagagtttcatcggggttttagtcaatgagctatctaggctttgcatcggctcacaaggattacatataagttggatttagccgatgacaacaaatgttttattaattatttaatcttttggatttaatgacatcggacctctagccgatgtatgttttaaccttcggatcaacacttattccatcatatcattattagccgattggtttctactgatttatattcttgtcttatcacattatcaccactcgattgtctttatatcattgtttactcaagtatcagaatatacattggatatatagccgattgttcaaaaccctatcaacatcggctgacatcgacgtcggctctttgttgatcatcataactgattggcatgtccgcatctaatcgaccttaggatctgtattggagctaagcataactccccgtatcttattaactttaggatctgtattagagctaagcagaacttctagacagtaatgttcgttgacttaaggtcgcgtcaatatatatccagcaccatcggccgaacgctctaatccctttatttgaggagagaccagaatccttattatacattccgttcgctatttgggttggttgggctatagaaaagcccgtgtatcgccatttcgcccaacttcccggccttccttgtccatctcccttttctctcctcctcctcgcgtgctccccgcgccgcttgcgccgatctctccgtcccgctgccggcggcgccgcgcccccacccctgctgcgtgctgctgcttccgcggcatcctcgcggagctccccctccgctgccgccgatccccgtccctcgtagcaccggggtgctggcgtcgtccgccctgctgctgtgctgctgctgctgctgctgcttcttcttctcccgccgcatcctcctcctcgccagtgagccacccgtgcgcgcatcccttccttccttcgcatccggtctcgatctggaagagttttgctcttcgtattaaccttagtcattactattaatcagtttgtttggggaaaaaatatttggggggagggggtggttcaaactgccccacgttaggtctgccctttttgtgctttgtatgtatgtatctcaatggcattgtgttggcagttttgctatctgttagatgactaagaactgtaataaagaaaagatttagtcgagtttgcgcaccgtcgaatccatgtgggggatgtgtgagatttgtgctctagttgtcctctttagcggcatcctgcggtagggggatggcggcggcggcggcaccagattagggttcatggtggggggattgggggagggggtctttgggcttatagcgatgactggagcggtggtggccgtggtggggtgttgaggcgacacctcggccttggaagaggatgagggcgagttccggtgatggcagtgagggaagattctcagataggctaagaggggtgggtgggtggttccggaggttcaagctggaggagacaggggaataaatgggatgagggaggctctcaatggagttgaggagagggcaatgagatagtggtgatcgagggtggcctggtagggagggagtggtggcacggaggggctgaagattgggaggatgaggtggcaaaagaatgagagaaagagtaagggctaagtttgtgaaggctgcacgtctttgaacaatcgtggctatcaaaaagtgagttcagttgaccaatgaatagacaacccctaggttgattcaattgcatttggtaatttttgcgctctaatttgaatgtgaaaaattagtaccatgctgcaaaaaaagagaggaaaatatggttggaacattaaacttgattctcgtagcactggtgaagtggtaaggcaagtgcaggataagttcctcttgcattgcctctgctttgcatatataagtaccagaggtgagggggatgggacgggagtaagttcacccccgagtcaccagccaagtacacccacccaaaatatgtgaaatggtgagagtattgtttacatctgacccacccaaaaatccttgttctatccccctccccccctcgcttcttcactttctttctctttatcctccgtcttcgccctactttgtactatcccacacaggcccctcttgcgctaatttaaccattttgcttatcaaaaccagattagagtctgttccaggaaaataatctgaaacgttgggcctccgtgtatacctgagtgtgcataccccgctcattatactaaggctgtcccactagccagcagaaagtacagagtgaaatatttaccccatttcatagcccttaaatctagcaggtagactcgattatttgattttgtcctctgcctaagacttccaccttggcccgagtctcatttggttgcactgcaaaaactactacctggttctgagcagcatctgtgccaattttggtttgatgtgtttatgagactgtcaagtattgatttacatcatggcataaaataattctagctatttaagtcattaacatgtaatattgtgtgactatatttttttttctgtggaggaattgggatggtgttttttgcagctacctagtcatcttctttggagttctagtgtcaatggggacattgaaagttattttatttgcaccaggaattctgtgtgtgaatgaattatatgaaccccattatttgttcctggctcccatattagcatgtgaatatgggatagcataaacacccaaacactcgtaacatggaataatcgggaatcttgcgatgaagaagctggaatgggattgagttgtttaccgaggacgagggtcgacggttcaggaggtatgtggcggtggctagaccttcggcccaataggagggtggcatggaggcttgtaggaggagggtacggacggagttgttgagggtgcgaatcatgcgttcggccttgccgttctgcggggaagtatatggacaggagagctgtaacagggaacctctaccagcgagaaaggaggtggtgttgtgattaacaaactcggtaccgttgtcggcttggagacacttgaggcggtggccgaactatgtgtgggcatactcaacgaactcaacaatatggcgatgaacatcggatttctggcaaagaggaaacgtccagcaaaaatgagtaaaatcatcaaccagcactaaataaaatttgaagcccgaaatgctcataacaggagaagtccatacatcacagtgcacaagttcaaaaggagaagaggtactggaggtggacttattaaaaggaagacgagtgtgtttccctaactgacaagcatggcaaagggaattatttgtcttggagcgaggtatggcggataaatgttggagagtggtgacggcggttggacccggatgaccgaggcggcgatgccataatgtggaggaggtggcaaggttgcagtgggcggcgatggaaggtgcagcggccgggagggtgtagagctcgccatggctattgcaacgaagaatcacgcgtcgggtctgagggtccttaatagaaaaaccaaactcatcaaactcaatggaacatttattgtcacgggtaaattggcgaatagagagtaaattgcgaaccaaagagggagcaacaagaacatgacgaaggtcgaatctagtggtgccaatagggagaaaggaagtgccacggcaaacaaccggaatggagtgaccattaccaacggtaatataagtttgtgagttggggaggcgagtaacgagtataccgtcggtggaggacatgtgcgaagtggcacccgtgttgagaacccatgagttggggttgtgaagcgtcattccattgagagcggcgacaaggccggcttggtcccaagccagctggacagaccctgcaggcggtggcgaggagtatggcccggcgaaggcagtgtgagcctgaggatacggcccaagtatcccggcgctgggagaacgccagggttgctgctgtcctgcccagggcaagaacacccatggtacagcttggcatggagcagggacggagaaagtgctggtgccgaagctgttgctgccgttgttctatccaccagggcggccgccgaatccaccgccgccgttgccgccgccggcgcggttctgctgctgcccaccgctgccagaggagtggcaagtgcccccggtgcagttggagtgggcgctgttggctgcgacgagggcagtctcggactggacttgtaccgagttggcgttgcgaagctccttgagaaccagcgtgttcctcgcagaggcgaaggacggcaagacaggggcgctcgcgatgttgtcggccgtgctggtgaagcgcgagttgacgccgcggaggaggttgaggacgagctgggactcggtgacggggtggctaacgtcgcggagggcatcagccgccgtcttcatgcgctgacaatagtcggcgacggagagatcgccttgggtcatggagtggaactcgtgatgcagatagatcgtgcgaggctccttgttggcttgaaagaggttgtcgatggcgatccacaagtcccgggccgattgatcaggctccatggcgaggtcgaggacgtcgtcggcaacggagccgaagagccagttgcggaggcagcaatcggcctgttcccaggtggcgtcggggttggtgagaggagcagcgtcaagaagatcgaggagaccgaatttcccacacatcgagcggaagaaggccttccacttgttgtagttggggttacgaagctcgagggagatcggaacatgggacttgacggtgatggtcgcatacgggttgacgaaaaccggggcgacggtagaggtggaagacgacaccgtagcggagtcggtggcagcgaaagtagctgaggaagtggacatggtgagggaagaagggcgtggcagccagggaggcggcgacgctcggtggacatagcgaccagagaggaagcagcgctggagcagcggaagaggagaagaaaacttggaatctgataccatatagaatggaatggggagaacaccacacacccaatgggaggggtggccatgtattaatataggaagcacatgtacaggatcctcaattagaggagaatacaaggaaagaaacaatacaatacaatctgtacatatatggcaaagtattcctaataggcactgggcgagatgcaacaaggaggaagaggaagcggtgctagtcgttggtatgctcgtgcggtcgtacctggcagatagtgggaaggggaagggtgtttatataaactgatgataccccgctgcgttgctgcggaacattgtaatagctaaatcagataaattgtaataacttgaatatgattaaaaaacttctatgttgtttcaagagtgctatgtctatgaggatattttttcataaatcaaacaaaattggcaattaatagtatgaggatactaaatttggttgttagtgtcatgatgttttatgttaggatcctccagatgcggtagtgcaacttttgtgttaggagaagggataacatgatggtcatataaagggtcaataatatgaaagggaacacatctggaggataaacacatgggttacaatctaggaggagaagaaccgttgttggtaggttgttcatgtgtcatgagttacaaagagaagattagcattgcagttttgcagcctgaaaattttatggaagagaatgttttttccatgatatatttttggaatcaaccagcaattgaatttgtacctatggtatttttttcttaacagaagcatccatgtaaataagtgtttaaacgctggaagatatggttacctttgtgttaggaatagtgtcttcaattctgaatccatttgtagtatgcaaaaattacatatgaaagttggacaatgcctcagacggtcagacctggtcacatagatatagtgatgaatcagaaggcatcatcctgctattggcgtgctccttcagctctgaataatcggataatcggcaagttgagcaattttgcccagtgccagcgacctccttctgttctgtatttgggctgcaaaattgacgatgatggtgcttaccttcatggattagaaaggcggtggtggtgcttacctccatggcgctgggcacagcaagggccacccttgataaaaaaaagtgcgttctttagcccgaagaggagtaggcgatgtgcagctggactcaacctggtgccccgacatacatacatgtgagggagatgaaagtggaggggaagtttgagaagatgggcgacgatttgatagtcggaggaaacggattcgatggcttttatgcttattgccaatgatatacagatgtgagaggaaggagatcgaagtgtaaacgaagggatctgggtgaatggggagcgaaccacaggaggtcgtgatccctcaactactacgcacaacagcgctgggaggaggagagtcgccataaaatcagcaaagcaagcggcgcggtgaatggaagaggcacgacgtttgcgcggtggtcgcgcttcctggctgcccgccacgatcgaggaggagagcgatgcgggagaggggagtcgatgcgcgtggggccggcgaagcagcgagatgcgagagaggagaggtggggagcgatgcgcgtggggctggcgccgtagcaagatgcgggagatgagaggagaggagcgatgcgggaggaacggccgatgcggatccaacggtgaggacaaaaagggtgacatggaagcaccaggaagcggagaattctaacagtgaggatgatttgtataggtatataggatatcatttattttactgtgacatattttattattaaagaaaccttaaatgtgacttatatactttaggctaatttatcctaccgagagcgagagagaaagctgagagaaagagagagaggagatggagacttatacgtgatttatctcttctattcaattgtaaataaatattctaataagtgtggtgtccagcagtaaattttttatgatttctctcttctattaaattagaaataaatattttaatagatacggtgtccagcagcgaatttttgtattttgtatacaatgattaatgcgctaaccacagcacaagtaattgaagccccatttcatcaaactttcgtttgtggatttgcatcggagttgccccatgttcgttgggggtacttcagaaatgggctcaggcccattacatggccataaccattagcatcgcactcaggggcgggcccactattgattcaagggtattcagacgtatacccaagatttttggataaaaaataagtatatgtactctatacctcgtatatgtattaagaaattaaagaaaaaggctaaaactactcattttgggccctgtttcatcgtttcttctctattgggcctaaatttcccacttccctcccctttcatctcagcccacaatcagtttgggccacaactagttcatttcccctcctcgcctaggcacagcaaaccaaagccctaattcccaaatcggccaaatcctaaccagaggaccgaggacgtgcgcggtgtggcggcgaggacgtgcggcagtgcggcggcggcgacttccggctgcgtcggcggaaggcggcgccaaggcgggtaggagcctaggcggcgcgtcgggcggcggcgactgcagtctagtctgcagcgtgctcgtcggcggctgcggcggaggcttccggctgcggcgtgcgcggctgcgtcggcggcaggaggcgccgaggcgtgcaggcggcgcgtcgacggctgcggccgtgcggcgttggggctcggccaggcgtgcaggccgccagtccgccaggccaccacacaggtacgcgatgcggcggccgaacgaccacggctcgccggcctggcatggattgcgtgaggggcttgattcattgattcattgcattgatttgttctaggtagttcaatagtagttatgttttctggtggcgacggcttgtttcattgatttgttctatagtagttcaatagttcactagcaccgaaggattcaacttcctcagttcctgtcttctttatttttcagagtgttaactgttaagtgtatatttattgatagattgatagtataaagctgtaaatattaggaatttagataacttagaaccataatatttaattttcagtgtgttaaatttatatatatgatgatagtatgaggctatatatgagctgttgttaggaacttagagaatttagagagggtgttttcttcgatgaactatataaaaacaagaagcaagatgagcaacaatctgcatttattggaagagaattttttgtacaagttaaaggatgaggacatcatcactcatttttaaaatatcaagcattgaaaagttctcctctaaattgtaagttttttttatcattttaccattttctatcctttacatgttatatatgttgccactttcatatgtcgaacaattagtacttatatatgttaaagaatttggacttatgatcaattctatcaatttataaagttatggccaattttgtgttctatatgctataatattatacaattagtaatgtgtaatattataccaattaattattggacttctggaagtaaaaagaattttgttttacccctacctatttcgaatacctaacctctaaatcctgggcccgccactgatcgcactttctctctgtttgctctcatctcgttccttttccttctttccagagcgaggctgtttgccgctgcagcgccggcggctcactaaaccccagaacccccttctctcgccgccgcgccgccgccccaatggcggtggacaaatccggcggcggcggaggcgaagccggcgcctcttcctcctcgtcgggcgtcgccgcctccaccatggaccgcttccacaagatcgtcctcagctgggactacgtccgcctcgtcgcggactccaaggtacgcccctccccgccccgccccgagcgctcgctttgcaatcaccggcaccacctttgaattttttttctatatggcggcttgggaggacagggcgggcagcagcaggcgaaggggctggggcgcgtgaagaacacgtacgcctcggtggccgagtacctcgctgtgttcgagccactgctgttcgaggaggtgaaggcgcagatcgtccaggggcgcagcgacgagaagaaaggtgggtgggtgggtggcgcgcccgatttcgtgttgcccccccaatttgctgtcggtttatttaacagtgtgtgtgtgtgtgtgtgtgtgttgtttttctctcccttgcgtttctgtgtgggcagaggctgggcaggactggcagaaggggattgtggcgtcgtgcaccgagtcggaggggttccacaaggtgtccatggccgtgcttgatgatttccgggagatggtgtcggagaacgatctcctgctgctgtccaaagagaaagtaagtgctttagcaccttagtggtgtgataggaaatgtttcaaaaggtatagatggctacagaatttagtggaacatatagcgtgtcaagaactcaagacaatgttagttacttatctgcgctcctacatttggaagggctatggggaacttgagacataatttcaccagaaaaagtgctttccatggttttagataatatgccaggctagcaaaatgctccatcgattctatgcgatatctcttcaagaaagaagttatgattgaaaattcatcacattgatatatatctgcacttttgtagtttgaagagggagtgacccccagtgcatatgcctttgccttagtggaacagcggggtggcagagaaacgatttctctaaggacatttgtggcaggtgaaataaaaaatcttaatgtagcaaagcctgtgagctgttctaggctgcagcgtattgcttccattttttcaactacagagagcttcctctggattttaaaggtgagtttcaactgctaataaagaatgcctgagttttcatgcttgcataattcattgacaacacatatgaatatgctattttcttttatggttaaaattgtcagatttgcagcttgtctaccataatgcgagaattctcgggcatgcactctgtagcatcacttccttttaaggatctgattctttcagctagtgagaagaacagtggtgggaatgatcaaaaccgtgcttggaatgtccctgagccacttatggattatcttaaaacaaaccttaatgattcacaactagatgcagtcaacgtgagcattattcttaatatccttttttgttgctcaatttagttctaagaaaaatcagatgtctgattgatcaatgcattatctcttgcaggcaggtctttctcgcagatcctttgttcttatccaggtttgtttgcttatttccagttatatttgtttatttttctgtattatttatcattaacctattttagagaaatgctagtgccttgagaactagagtatatgcagctacatgtgctctacttgttgtcacatgccattcatatagaactccaatgtatatttgtaggggcccccaggaacaggaaaaacacaaactatccttggacaaactatatatatatatatatatatacacatatatacatacatactatatgctgcaagacatgttgcgtgacgttgagaacctaacttatgctgtgttctcatgttcaggttgggaacatagtgcctccgcacggtaaacggagcggttcattagcgcgtgattaattaagtattagctattttttttttcaaaaatggattaatttgatttttaagcaactttcgtatagaaactttttttgtaaaaatacacaccttttagcaatttgaaaagcgtacgcgcggaaaacgagggggaggggttgtgaacaaggggttgcaaacacaggcttaccacgagagagatttcatgaagttcaccagttgatcagtgatcggagacacctctatacgtctgatgccaggaaaaatcaaccaaatgtccgctacctggacttaatgaacttgacgccagtttggacgtcagaccaaagtacaaacctttgtgatttttaaa

SEQ ID NO: 68432 - DNA, 11196 bp, Oryza sativa
cggtatgcaccatgttaacagggaaaggattaccatcaaccttcatcggctttttggaatcatcaaacttaatcttccctccttcaatggctacttgaatttgctgtctaaaaaccttgcaatcattagtagaatgagatctagaattatgccatttgcaatacctccttttgcctagttcctcagccgatggaattacatgaccagcggggagttgaatttgcttctcccggagtagcagatcaaaaatcttgtcagctttggtaatatcaaaatcatatttctcctcttttccagaattctttacccactgacaggtataacatttttactccttacccattcggctgcagctatttcggagtcatcgtcgtcatcatccgatccatacatgtaagggcagacatgattaaccctcttagagcttctcctggcctctgcaaacctctgttcatgcaatgttaccttctacacgagatgcgacaggctatcaaaatctccagatgagaatttcttcctaatcggaggaatcatgccttgaaaagccaaatcggctaactgggcatcagtcaaactcaagctaaaacacttgttcctcatctccctgattctctgaatatactcatgtacaggttcatcatgcctttgtttgattgctgtcaaatcagataacttcatctcatgaactccactatagaaatagctatgaaactgcttctccaaatcggcccaactattgacgcacccatacggcaaagaagaaaaccatataaaagccgacccagacaaggacaaccggaacaatctaactctgagagcgtctacagccgatgcttcgccgcactgagctaaaaatcggctaatgtgttcataagttgacacaccatcttgtcctgaaaatttggagaagtctgggattttaaatcaattttaaaccactcagggtaaggttgccgatacaattttccagtatctttcggcttaagcccaaattattctctcatcacatcggcaattacatcagcccatggtcgttgttgagctgctccttgcgactgttgccgtattggttcaaactgattatattgagaagcaaactgaggttgagttagccctccttgctgatactgaacttgtggggaaggaggctgatattgataatttatattgcctccttggtaattctggtaatttggctgaatactttgtaccaagtgctccggcacaatctgaggcatcgtcgtaccatctggctgtatatggtgaactaaatgttctggaacaacctgattcagggcatgtccagcctattgcccagccgattgattcatcaaggcttgctgcggaatcggttgtatagtttgttgtcccggaggtgttggctgaactggctgcacaacctgctgccttggtggagtctgttgaatcggctgcacaacctgttgccttggtggcgtctgctgaatcgaattgacagtagattggaggggtagaaacatagcagccacctgatcctatgctggccgatttaccgtctgcccgctatgctgtggctgctccctcatcaatagccgaggattaatcggctggcctggtgtcgacgatgatggagcaagcaaagaagtcaagtgcgcgggataagaaaggatggcataatatagtctcatttgcataaatagcatttaataaacatttcagaatttcataaaacagtaaagtatttcattaaacagtattaatccaacgctatacaacaaaccctgttgcataggcccaaccattctgaacaaccaatcccggctgcacagttctatctccaaaccaggaatatatcattccaaaccaggagctaaacaaattattaacatcatcatttattatggtgtgaaatatgagactaatcacgaaagacattgttagacctgcccattaccgcgggcacagctattcgaatagtttaaactctggccagaggtgtaccactgtacccacaagacacaacctcaacatcatgtcaaccatgcgtcgcgatacttaacaagtacccgaatagagattgtgacaataccctctatataacacaattcaaagcagtgcaccattcccggatcataatcacccccttgcaaacaaggcatggactccccagcgacccccgtgggcttatctccgccacttcacagtctggtgctctacaatgaaccatactatacagaaagtaaagccgttgcccacgctggcttgtggttggcacggtaaatgtttcacaaccaaaaatcgtgaaccggtccttaattgtcatgagcacgaccatcaataccatgtgctcacatcccaccattatcaggttttagttggcaaattaattaattaaccaatcatgattaaccatcatgagctatcattaagccatcattcaataatagtgaatcataagttatcccatttatatgagctagtgtctctaagcatggctaagcatcctattcactttagctaaaaccatataatgttctagctaatcaaattattaacaaagtgacaaagaatagggaaccaatagcaaaagggctataacaaggcaataggttatttccacccaatgacattcaaaaataaatgcagtagttgaatagaaacaatagctttaaacgggatcaacatgctcaaaggattgttttgggatctgtgtgacttgccttgctggccttggaactcttcaaaatcttctcctgcaaacacagactctccgggaacgtcggaatctaaacagaaaagagcaaaatcaccaaaacagcacataaacaagcatgaacagtacatgtggatatttttaacatgtagatctcaattttagaaaaatttagagacttgaaccaactaaatccgaacaaagatgacttagttatgaattttcaaagattaaatcggattaaatcctttatatagattttaattgaattatgacgcaataaagaattatttttgaaaaggaaaagaggattattgcatcagcgggctcggctcacggaacgaacggccgagatctatcctatccacaacggacggccgggatctatgggcccacgaccggtccacgggacacagtgacgatgacgtcggcgatgacgtcaccaccggcagcgactcgggcgcacatgctcgccggtgaacgacggcgcggcggctcaaacggaggacaccaacgggttgcgggcatcacggtgaactcactggtgacctaaacgacggcggacgatgaccggacggcgacggcgtcgaggaagaagcggcggcgaccttcggcttgacgacgacggcggtgttccggcggtcttcggcaaaacggaggacgggacgaggacggcgacgacttggcgaacccgacggtggccttcccaagcaacgacgacgaccggagcggtggcggcgcatggctggacaagtggcggtgacggcggcgcacgggctcacgaggctagggcgctacaggcggcggcgagctaaggtgagggtggcgacggatagaggaggtcccggggttctttttatagcggctaggggcggcgatggaggcccacagcgaccggtgacggaaaggaaaggttagggttcgagtgagagagaggaatccgattcgagatcgaatccaccgctttccaaacgattttagccgacgattccaaaagagaaaagatagaggggatcccggggatcatttcccctctattgatttcatcggagaaggaaaggcgcagccgaatttggaaggagacggcggcgtggctcggctagggttcggccacgcgacagcgcgaggaagacgacggccttgacaggtgggccccacctgtcagcgggtggacgcgcacgcgcgagcggcggctcggctgtgggccgacttgggccggggaggagagagagaaggttttggccgactttcggcccaaagccaaaagagaatttttaaaacctttttcaatttaaattattcatgaaatgcaattccatttattaaaaatacttccttggctcaaataaatcccagaaaaatctaggaactatagaatcaagtaaagtatttaataaaattttatctggcccacttttatattggaatttattatttaaaaattagatcttttcttctagacttttaaaatcatttctaataattccaattaaacaacaatttatatatttaggatttttagggtgtgacaaacctaccccccttaaacagaatcttgccctcgagattcggaagaattggcgaacagatgcggataagctgactttaattcatcttctcgttgccaagtagcttcttcttccgagtgattactccattggaccttacacaaaaggataactcgattcctggttcttctctcatctgtctccaaaatacggattggtttctcaacatatgacagatcctcttggatttctatctgttcaagattagcttcctcagtgggtacccttaaacactttttcaactgtgacacatggaacacattatggactcctgccaacgattgaggtaactccaactgataagcagcctcacctcttcgactgacaatcttataaggtcccacgaaacgcggtgccaattttcctttggtatgaaaacgatgaacccctcgaagaggcgtgacacgaaggtacacatgatctccttcttcaaaactcaaatctctgcggcgattgtcggcataactcttttgacgagactaagccacacgcaatctttcttgaatgatctttaccttctcttctgcttcccttagaatatcagtcccgaaaacctgacgttctctcgtttgatcccacaaaagcggggtgcggcacttccgaccatacagtgctttgtaaggagccatttgaagactagcttgataactgttgttgtacgagaattccgcgtaaggcagattcttatcccaacttccaccgaagtctaaagcacaagctctcaacatgtcttccaaaatctgatttaccctttcggtttgtcggtctatctgcggatgataagcagtactaaagttcaacttggaactcatctcttcctgaagtttcttccaaaattttgaagtaaactggctacctcgatctgacactattttcttaggaacaccatgcaaacacacaatccttgccatatacaattccgccaaacgacttccggaataggtggtccttaccgggatgaaatgagccaccttggtaagcctgtcgactatcacccaaatagagtcatgacctgatgacgttcttggtagaccagtgatgaaatccataccgatttcctcccacttccattctggtatcttcaagggctgcagcaaacctgcgggtttctgatgttctgccttgactcgctgacatacatcacatactgctacatattccgctatctcacgcttcatacttgcccaccaaaatctttccttgagatcctggtacatcttagtactaccagggtgaacggagtataaagtttcttgggcttcctttagaattgcatatttcaaatctttgttgtctgggacacagattctctcacccaaccatacagttccttgctcatcttccaagaaaccgatagcttttcctcttctcatattcttcttgacctcatgaatatcaggatcattaatttgagcttctctaacttgatcaatgaagtgggcctcgcttttaaggatcattaatttgagcttctctaacttgatcaatgagagtgggcctcgcctttaaggctgcaacgaaacctctactgacaattcccaaatttaatttttcaaattccttgcacaattccaatggcaactgttgcccttccatagcattacaatagcctttcctgctgagggcatctgctacaacattagcctttcccgggtgataatgaattcccaggtcataatccttaatcagttccaaccatctccgctgtctcatgttcagatccggctgggtaaagatatatttcaaacttttgtgatccgtatacacctccgtacgagtaccgaaaagatagtgacgccaaatcatcaacgcatgaaccactacagctaactcgagatcatgagtagggtagttcttctcatgcggacgtaactgacgagatgcataggcgaccaccttcccatcttgcatcagtacacaacctaactcaagcttggatgcatcgcaatacacttggaaacccttctttggatcaggcaaaatcaaaatgggagctgatattaagcgtcttttcaactcttgaaaactctgctcacattcttctgaccacttgtacttcacatctttctgaagcagtcgtgtcatgggcttggcaatcttggagaaattctctatgaacctccggtaataacctgcgagacctaggaaactgcgaatctctgaaactgtcttcggttgtttccagttggttacggattccacattactaggatcaacgacaactcctcctgctgagatgacgtgaccaaggaacttcacttcagacaaccagaattcacatttgctaaacttggcatacaactgatgttctcgcagcttctctagtgcaagacgaagatattcttcatgctcttctttagttcaggagtagatgagaatgtcatcaatcaagacaaccacgaacttgtctaggtattccataaacaccttgttcatcaagttcatgaagaaagcgggggcattgataagtccaaaagacataagagtacattcaaacaacccataccgagaggtaaaagcccgtcttaggtatgtcttcctctttaatcctcaactggtgataccctaatcgaagatctatcttggagaaaacggtggcacctttaagccgatcaaacaaatcatcaattctgggcagcgggtacttattcttgatagtcacatcatttagtaaatgatagtccacacacatcctctgggtatgatctttcttttccacaaaaatagctggagctccccatggagatgaacttggtctgatgtatcctttctgaagcaaatcatctacttgcctcttgacttctctaattcattggctgccattctataaagtctcttatggatcggagttgttcctggtaccagatctattctgaattctatatcccttttaggcggcataccaggtaaatcatcagggaacacatcggggtactctcgtactataagaatctcttccaaagttatttggttcagacttgactctaaagtctcagaaggcagtgcatgaacagttacgacttgaccgtcattgctggtgagagttactttcctattggcacaatctatcacacctttatatctggctaaccagtccatccctaggatgacatcaagatctttggattctaacagaataaggttggccagaaagggtacaccttggatctctattctgacagaggggctacgttgtggtgagagtgcttggttactcggggtactacccatcaaaggacgtctaagctcttctacctccatcccatgatttcccgcaaaactcatagataaaaatgaatgcgtagcaccagaattgaagagcactgttgcaggaactgagttaacggggaacgtacccaaaatgacatctagagcaccttgaggttctgcagcagcaacatggttgacacgagccttggctgctggtacggaggacttgttctgagcagggacaacctttacgcggcgggacttcggacacttgtcagagtaatggcctggttcgccacagttgaagcacactccgggcttgtttccttgttccctcttggcaggctgatgttgtgtcggagctgccacaggacgtggagcttggttgcagttgttgttgccagcattgttgttgaagaactaacgctgcggacgaacaacagacgaagaacctccctgtgacattaactggggtcccaaagtaagacgcggcctctgactattcccctgctgtgccttgaagtgaacaatccggcgtttcttctgctctatgcggttgtacttgtcctcctgacgaatagccttatccactaacttctgaaaatcatgataatccccagtcatgagtgggtacgaaagctcatcattcagcccttcaaagaacttctcttggcgctattaatcagtgcgcacatcttccggagcataacgagccaggcgattaaattcatgcagatactcggtaacagtgtgggatccctgagtgagcgacctgaactccttcttcttgagagacaccactcccgatggtatatgcgtctttcggaaagcagcggtgaactcaagccaagagataggttcagcagtagtcctgttgaggcggaaatgatcccaccactcagaggcagggccatgaagctgatgcgaagcgaaggagactttctcttgatcggtgcactgaagcaggtccaacttcttctctatggcgtgcagccaatcaccagcctcgactggattagtagtgctagaaaaagtgggcggcctcacacgaagaaattctgctaacttgttctggggaggtgcatggttatttctctggttctgctggttctggagttgctgcatcatcatgttcataagctgtgcctgttgtgccaggacatgggcaagcgttggattctctccattgttgttgttgttgttgttgttgttgttgttgttgttgttgttgttgttgttgttaccattcccaacgctgcgagtgagcaccatctggcatggacaggagcagaagaagagaaacgggggaaaaactacttaggacagagaattatttttttctactaacttaacttttattgatcttaactgagtttcattattacaaaactgaagactctcacaccactaaactcaccaactacctaacactcgaaagcaaacaaacgcatgcacttacaacccaccactgatgtaaaccacatgcaagacccacacacacaaccaaacttaaaacaagtaaaccaacacaacgatctagggcaacggcttgacaaggcattctagatcttccgggcatcggagttgattgaaggctcgtttggctcgtctccatcatcttgagtagctccccactcgacctttgaatgggtgcgcttcgattcttctccttcatcatcacttacgttgacgaccggaggatccactagggctggggtagcttctttttccaccacacgaacctttggcgccaactggtagcgagggacaaatagagctctcttccttgcggtaagacgaaccctggccttttgtggtggtgcttctcccttcaatgcggctagctccttctccaaccgatccaccttgtcctccagcttgcaaatcttaccacggttccggtcttcacgatcttgagctgctaacacaatctccgcgcgggtctcatccatggcccacagcatcttgaccaaatgccttgtggtagcatcattctcaatccccgcaggttcaaggtagctaccacggtcacttccctggggttggcgaggatggtagcgatactcggtgtcggccaaccgatcattatagctttcgcggagctctcctatagcgatccttgccacctcttgacaagcatgaatgtagcttccccctccagcctcgaacatcaccgatgggatatcttcacgattactattcaaggtgactttgacacggcacttctcttcatcacgatcatgaggaatctgggcatacaaaggggcaatcccaaatcctatgaggaaggacattgtacgcaactcctggacaaatccttcggtaccgaacaagtactcaggcttgtagcgcggcatctaagacaagtgaaaggagggaattaagtcatttatcccgttaatagcacaagtttttgggttaatttgaataaagttagaaaatcaaagtaaaaggtaaataaataaagtaaaccaagcttgcaagataagttgaaacagttggaaacaggatcacaaattttgcacttttgaacaacaggtttcaaaaaaaaaaaaagagggttataaaatcaacatgctaaatttatttcattgcagcaagattaaataaaacaatgttgtaaaacgctttgctggtaaatgggccattagtacagtaatagatgtacggtactgataacacaggaataataaataaattttaaatgagaacaattaaaggaattataaactgcatgtgccattagtttggtttaattaaaagagaaagggaggagaacagttctacttttccaatatttttagagggcttgtatgggtaaccatttggcataacctagggtcaaggaggctctgataccaacttgtcacgcccggaatttctatccaaaattccaaacgcttacatgtgtgaaccctcgtccaggaatcagccgaggcacacaataacaaattgataatagagtacaattattactctaattaataagcgaataaaatgtcattacagatgtagatagttcctctcaatcaataaagatctaagcagcggaaaaataagataaacggcgcagacgactccactccacaggcagcttgaccagggctacacctaatcctccacaccatcagcatcactgtagaactcctcctctgatgaatgattgcaaggtgagtatatgacatactcagcaagccacgcagcaaatatgcaagtgcacgggataacaaaggatggcataatatagtctcatttgcataaatagcatttaataaacatttcagaatttcataaaacagtaaagtatttaattaaacagtattaatccaacgctatacaacagaccctgttgcataggcccaaccattgtgaacaaccaatcccggctgcacagttctatctccaaaccaggaatatatcattccaaaccaggagctaaacaaattattaacatcatcatttattatggtgtgaaatatgagactaatcacgaaagacattgttagacccgcccattaccgcgggcacggtattcgaatagtttaactctggccaaaggtgtaccactgtacccacaagacacaacctcaacatcatgtcaaccatgcgtcgcgatacttaacaagtaccgaaatagagattgtgacaataccttctaataacacaattcaaagcagtgcaccgttcctggatcataatcacccccttgcaaacaacgcatggact

SEQ ID NO: 68433 - DNA, 3675 bp, Oryza sativa
taaattattcatgaaatgcaattccatttattaaaaatacttccttggctcaaataaatcccagaaaaatctaggaactatagaatcaagtgaagtatttaataaaattttatctggcccacttttatattggaatttattatttaaaaattagatcttttcttctagacttttaaaatcatttataataattccaattaaacaacaatttatatatttaggattttttgggtgtgaaaattctagaccaagggtcacggtccgtctagcatttagcatctaggtgaacattgcccactaactattgtggtagtcagatttaccctctccccaaaactatacaatgctagacatttcctgtcaactcttcaaacctgacgagtattccccgaactcaatccaaaatgtttttgatctttggtgatacatacagggtagtccaggcagccaaaaacggcggggctcacctatcagtgcttcctttcctttcacctcctttcctttccctcgatccccattccccaatcgtacggaggtgggcaacagcctccatgagctgccgaagaagggcaacagcctgcatgagctatcggaaaaaggtacccacctgattcaccgttttcttcatccatgcttcccttcccttccctccccatatccccccttctcccatggagggtagcagccaacgagcatgtggaggacactagtggtgtgggcttgggggatcgctaatgggcgagtgatcgctgtaggcgatcacccccattccctccgctaacacgctcctctccccttcctcccccttcttctcttcctactacaccataaattttaaaaataaaaaacacaagttagaaaaaaaataaaaataaatctaatactcttatttatgtgtatagactttgcacgtataaactttatgtatagaaatacaatatatgaaaatatttgaattcaaattcaaatttgacttgggtatataaacttttaacttataaactttgggcacgtataagctttatatctagaaatactatatataaaaaatatttgaattcaaatttaaatttgacttgggtatataaacttttaacttataaactttgggcacgtataaactttatatctagaaatactatatataaaaaatatttgaattcaaatacaaatttgaatcgggtatataaacttttgacttataaactttgggtctataaactttaggtgtataaactttagatgtataaactttagatgtgtaaacttgaggtgtacaaactttaggtgcataaatttactaaaatatgaaagtaatgcggtcccaaaaaaaggataccacgtgaggagggctgatcgtgcggggggacgatcgcccattaggatttctggtgggcttgtggaggtagaggttggtggaggtgatggccggcgtgggaggcaaatcttacgttcgagctgagaacatggtggatctctataggaagaggcggtggaagacctcgaggacacgatgggggtcaggctcgtgggagccagcatcaaggccaacacacaactgggagaacctgacctcctcctcccacctcccaatgagctgcttgtaggatcgaaacacaagaactaagccaaccagaggggggaggtgaatggttggtatgcccaaaaaccaaattttcagcggaattaaaagttaccctcaactttgatgtagatcagtgatgcgaacccgctagggtttgtggcccgatctttcgatgagaggtaagggataactcgattggatgaagacgacgttcacggcccgactacaaccgtccaaagacgctgcgccttagcaaccgatacaccgtctccaatggtcgacgcgaacttgtggtgcgcgtcaacccggccacgagggcactcgtcctgcaagcaattgaagaacaagcaagaacaagtagaacaagcactgaaattgctatataaagatgaaagtttcactatcaaatacaatatggtggggttccgattacaggcagacgagcggtttagccaacacgcgcgctgtgagccggtagcaagtagctatctctatcatcaaaacccgaatgttcttggcggcgactagaggtataagaagaggggaagaacgaccatagggtcgtgctccaaccctaggacgtgcccctaatgggcccaacttggatacacagcccattgggccaaaagaggtgacgcaacaccatggacagaaaacagtcgggagtaaaatgacaattgcggccgctccagaatagatatggacatgtggctggatccatttgaaagtagacttgataagctttccatgaaatacttgcacgcccaaatcggagttcgcttgaagtcgtggcggccgtcagaagttggcgctgccctgcagtccgaatccaccccgcgcgaatcctcttccctttggatcctctccatcgttcctgagtaaaacacaagtgcacgcgtctccggggtataaagaagaggaatatgaactcaagaaagaactcacctgataatttagttgacgtgcacgagcgcgggtaatagaaccatcatgttgtacatggggggacgtggatgtatcgatggtgttgatgtcctcatcatcctccccttcttgcatttgagtcgtcctcgactcatgctcatcttcttctcccaaatacggcttcaaatctgcaacgttaaatgtgggactaaccccgaaatctgcaggcaaatcaagcttatacgcattctcattaatctttgctaacactttaaatggtccatcagctctaggcatcaatttagactttcttaaatcaggaaatcgttcttttcgcaaatgcaaccaaaccaaatctctaggttcaaaattcaattcccttctacctttgtcaccagcaaacttatacttagcattcatgcgctctatgttttctttagttgtctcatgcagttttaacatcaactcagcacattgcttagcatcaaaattcagtttttcagaagatggtaaaggcatcaaatcaattggagcacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggatgacaagtagtagaaaacaaaagtttagtccccaatttagcccacaaagttctccaaaaatggctaagaaattttgtgtcacgatcagaaacaattgtgtttggcacaccatgcaagcgaacaatttctcgaaagaacaaatcagcgatatgagaagcatcatcagttttatgacatggtatgaaatgtgccattttagaaaatctatcaacaaccacaaaagtgctatcacgtcccctcttggtcctaggcaatcctaacacaaaatccattgaaatatcttcccaaggaacagtaggaacaggaagaggcatatacaaaccatgtggatgtaagcgtgacttagccttttgacatgtagtgcagcgagcaacgaacctgccaacatctcttcgcatctgtggccaaaagaaatgactagcaaggatgtcatgtgtcttcttgg

SEQ ID NO: 68434 - DNA, 3410 bp, Oryza sativa
aagtgcaagcttctccaccatctcgctgctagccaagttgttgcagctacctccatcaatgatcatgcggcaacaacgctctttgacgacacactttgtttggaacaacgtgtgttgctgattttgctccgccttctccatttgtgcgccaaggacacgctgcacaatgaggctctcatagtgatccgcaaatgcagccccaatgtgctcttccggtggctcattatctgcatggtcagccgcaagcaaagcaagtgtatcatcatcgaaatcactagcagaggagtactcaccatcttttttgactaccaaaactcgcttgctagggcagtcacgctgcacatgcccaaagcccttgcaacggtggcactgaacatctctcgttcggcctgtggatgccattgaagaagcactcagtgctggctgagcagcctttgtcgctgacttgtcactagatggaggaggtgctgctcgactgattgtgggtgtggaagatggagaagcagtacggccggccggaggagtggtgcgtgtctgccatgatgaagttttacctgcagaaaaattagccttggcactagcacgtcgtccctgcacttccctttcagccttacaagtaagatgaaacaatcgggtcatattagtgtaatctttatagtctacgatgtcaaaaatctcgcggtttaacccacccaaaaatctagccatggcagcgtcctcagtttcctctaaattacaacgaagcaagcccatttgtaactcctgataatattcctctacactttttgcaccttgtctcaattgttgtaacctattcagcaagtcacgtgtatagtaagaaggaacaaatctagcccgcatgacccgtttcaaagcatcccaagtttgtggcatgttattaggatttttcttgccatgttctatccaccaaaccaaagcaaaatcgatgaactcactagtagcagctctaactctagtgttctcaggaaactcatggcatgcaaatttttggtcaacagcaatctcccaagagaggtacgcatcaggatcatattttccatcaaaagtaggaatcttaaatttaattttagaaaaagcatcatcattgttgcgtacctcgcgtcagcagcgaccacccatacctcgtcgattgttgtgtagccgtcgacgatctcgagcatctcgatcatcttgttcagtgtcagcaatatattcatcctccaaattatctcgacgtactttccgtcaatgtcatcgtcattacccccaccattgcctccagcattgagagcatcaaaatgcctcacaagagcagcaaggcaagtgtcaatgcgggcgaccgctgtctccagcactgtaagcttagtgttggtggagatctgcgtggacttcaattgtccaatcttctcatttgtcacctgcaaatctgtatcaagtccttctgtgtgctacttcacttgccttgtaaagtattggatgatgcctttggtgcgtggggaatgagatgcaccctcctcatctttattctctggacctgccatgggttagaaatgaaggacaacaaaacaatggaggatgtaatgtaagccctacacaactattgggatgtagcttttgcaagacgctcactctcacttcactcgcagcttgtctcacaagctcttaccagttcttaccttgcccacaggagggggacagcaacccacaagttagcaaccgtggaacaaggtgtatcggtgctgtagcaacaagacctgtcaagctgtagtcgggtttgtggtggagctgttggtggctgaaagcaatgctcaagagaaaactagaaaccacattagccaaagcaaattgaataatcgctcaagggtatagtgtacagtgctggtcctaggctagtcgaagtagagacacgagtctaaccacaaaggacgccacaaaacacaaacccaaacagcaacgaaaacaagaaacggtggtgcaaggtggtgacaaagggggaatggtggggtgtgctcgctggatcctcttcttccttttttttttgcttgctctctctagtgctgaggagagacaacttttttttttattatttttattttattttattgatatttttttcacaaccaggagcacactggaaccaaccacagaaaatcttgtctcaaacggacaaagtatgaagcttatagaattttttcaaagttctatgcgaataggtcccgaagcttctcgccacaaaaacagaattttgcaagtggaatttggcgattttaaatttgccgaacccggcaaagcgggggagaatcggatgtaactttttttgtagatgtccgtggatatattataagcctaatttcgagtccgtatgagaaaaatatgactgttttaaggaaggtcactcgaatcagggttctatttcctttctagtggcggcaggatacaaggcaactcacaaaagctatcggcaacagatcaaacacaaatagaaagtgatttggtgggtgactgcgacggcggtgacggtggtgatgatggcaaaattgatgaaggtggcgatgtgcggtggtggcaagaactcgaaactctaatcgcctaacactaagaccagcaaattaacacaaccgatgcaatcaaaaactcaacaagccttaactaagcagtactagtaaaaaggcacaatggtctataggatcacgggaaaactaatctactattttttttgttggtcttttctggactataggaaaaaaaattaatgacgaagggaagggtaaattctctcaccgaagaaccacgctctaataccacatgatgcgaacccgctagggtttgtggcccgatctttcgatgagaggtaagggataactcgattggatgaagatgacattcacggcccgactacaaccgtccaaagacgctgcgccttagcaaccgatacaccgtctccaatggtcaccgcgaacttgtggtgcgcgtcaacctggccacaagggcactcgtcctgcaagcaatcgaagaacaagcaagaacaagtagaaaaagcactgaaattgctagataaagatgaaagtttcactatcaaacacaatatggtggggttccgattacaggcagacgggcggtttagccaacacgcgcgctgcgagccggtagcaagtagctatctctatcatcaaaacccgaatgttcttggcggcgactagaggtataagaagaggggaagaacgaccatagggtcgtgctccaaccctaggacgcgcccctaatgtgcccaacttggatacacagcccattgggccaaaagaggtgacgcagcaccatggacagaaaacagtcgggaataaaatgacaattgcggccgctccagaacagatatggacatgtggctggatccatttgaaagtagacttgat

SEQ ID NO: 68435 - DNA, 1359 bp, Oryza sativa
aaaaagaaaggaaaggagaaatgtgggcccacactattttctctcacttacatgtgggccccacatatttatttaaatttttttgctgactaggatgcacgtcagcgaaacagggtggctatactgcctcgggaccttttttgacggttttacatagtttagggtacacatttctggttttgtgggtaagggacctgaaaaattctcggtgttaagtcgggggacctccagtgaacttattcttaagtttgaagaggtaattgggtctttttgtttaggttgagcacggagctctcgttccctcaacgtaaaaggaaaggttcgatttgagtccctcaattataggtcggatctaattcatatccctcaatgtaaagcataggtatgtcgtctctcccaaatttaaaacaggtgtaaaatgatttccttgaccattttgagagtggtttttgttaacatgcatccatgttacaaacacagtcataaaatatattaaaaaaaagtgggcttacatgttatcctctctctttcggtaccctttctctctccccccagtcttcttctcagctcgccgtcactaagccttgtacatctaagagggtcttaggtaaattggtaaaatttgctataggatatttaaagtttgtaatctttgctagtagacaccgcagaaacatggcatggtcaaggatactctaaagactttgtaattggctggaagacaccttaatgattattttattatttccaggctaaatggagagataaattatgttaaaaagacaaaaatgcccttaagtgctactagcatgtcaactggctctcccaatctttctcattgatcattgtaaaattttgcatggactttctttcctacgcggttggtggcggtgacactcgtcagaggtggagcagcgaatcgaaggatggagtcttcttcttgtgttggtgccgggtactttggtctgcgccaagcataggcggtggtggccagtggcgaacccagaacaaaaattaccgaaggtccaatacatactaattatctaattattgactaatatattaattaatatagtgtaatttagataggacaccgggtagtataacgtaggcacgcccctggtggtggccttgccgccttggagccctaggtggtgttccatgcagcgtcgtcggtggccttggttctccgggcgccgatgcgctttgcggtggcggctgttttggaattttgggcgatggccttggagctccgagcgctgctactccgtgtggtacccctgaagctccgagtgccggtgtttcgtgtgatggccttggagctctcggtgcacctgctctgtgcggcggcggtggccc

SEQ ID NO: 68436 - DNA, 7356 bp, Oryza sativa
tagtagaaagaaagaaaaaagagtcaggactcgagactagtcagttcattttttccgtaccctttttctgaaacaaatctgccttttgatttgaaatgactaataacatgtaggtttggaacgtgtgattctcgtgtgaagttctagagcggttcatatatccagtagatttactgatgcatctctggttacgcttgggatctatgtgtggggaaggactcttcgttgatagatttctgaatttgggataatgcgataaatatcatcagattgtaaaaagtgtaaaaggaatttcggggcgtataattaactttgtgcaccaccaaatgctcatctcatgtagttgtattagtattatgtaccttgggagcaatgataaatctactacaaaaggtgtgtagcaccagttgcttgaggcatgtgaggtagccatttagcttcctagcaagctagaactagtgaaatgttactttttggcatgaggcatgtgcaattgcaatagcctcttctactagtggatctataggaagggaaacttcgatgaagaaaaacgatgttaggtttatttggtttgattgaaggagatgcagaaacacgatgatttactgctatggcagtttagatatttttcttatcacaggatttctgcaatactctgacatgatatctctaatctcatctccaggttaggtcttgtggctacaatcaaggtaaacattctgactgttactttccatgatatattgggtgaactacccctattttttcaaagttgcgcttgcttggcagtgtacatacttgatagtataatgcctgcatgcacacaacagacttgaaagtttatataaaattcatcaggctgcttccatgctgcacgattccatgttatgtggcatgacttgtttactctatagtcagcttttggaaatattaaccgctgcttctttggacatatttcatttgctacgaacagtaacacgatgctggttgcttgtagctgtataatgactgtgttgtcttttctttctgaaggaccgagccaatgaaatatataagaaggtggaagatctcaagtctatcaggggaagaaatcaagatgccatattagctgcctgtttgtatattgcttgtagacaagaggatcggcctagaactgtaaaaggtacagtttgttctttgctgaatgcatttatctgaatgcgttctgaatgcatttatctgatgcgttcttgtttgatgtgatggcttattgcagaaatatgttcggtcgctaatggagcaacaaagaaagagataggccgagcaaaggaatttatcgtgaagcaactggaagttgaaatgggtcaatctatggagatgggaaccatccatgctggagatttcctggtctgtagtttgccatgtattctaatgagtccttgtctgaattgattgagtgaactcttgaataaactgataaaacctgcagaggcgtttctgttcaactcttgggatgaacaatcaagctgttaaagcagcccaggaagcagttcagcgttcagaggaacttgatataaggtttgacattttggattcattatgaaccattctgatgatcaatagatcctttgtcatggaagttattttatccgttttagcttcagtgtttatcacctctaaatcactgatgcttagatcaatgcattgactagaggaactaatcagataaacgagttgcaaatacagctatcagcaaatctatattcttaaagcaagtagcatacatatcctgtacagtccatacatacaacctcattatccccatttatgtattgggaaggggcagggctgcaggagagctagtttttgactattagacacaaactttccttattagtcaaattccaagtgtgcatcatgacttattatattcacacctccgtgcaaacctatgctgtgcaggaggagtcctatttccattgcggctgctgtcatttacatgataacccaactctcagatgataagaagcctctgaaaggtttggaacacagacccgttctatgtttaacttgcaactgtttaactcgttaataacaccgtgaaaatgttgcagacatatccttggctactggtgtggcagaaggtaccatcagaaattcatacaaggatctgtatccctatgcttcaaggctcatcccaaacacctatgccaaggaggaagacctgaagaatctgtgcacaccataggaaatttttttcttttcttttttgtcacataacatggaaattagatttgccagagaggagtaatgttgtccttggatgtgagttttactggcccatgtatcactgcacctaattttatgtgcatggacctgttagaacaaagttatctcgaatcgaagctaagttatatgcaaagcttatttaggaatggcaaaatttcatgcattaccttgtgagcaactttttaaattgttgattgataacgaccaaaacctacggaggagcgataagtttcacaaactaaaatgatctgcacgccacatatataaaattttgcaagtggtatcatgttcatgaattgccaggtagtggtgtattcgtatatatttttttatcggaactgcagatcttgtagggaaaaacaaaagggaagtgaatcttgaaagagctttgcagttcatgccatactgccaaggctcgttgcatactgccgaggatcgtgccgcatgatcgatgcatacaagggaaaaaaggagatcccttccctctgcgttggcacttggtagctcctgtgctgaagcagcggagcctttttcttgtcttgtcagccaccaattctccaaatgcagaaatgctgcgaggtgcggaggacgcgctcgttgtgccagccgcccagcggcgcgcgcgcgcggcgatcgaccagctgcgacgcacagagtgcagtggcgcaccacggccgccgtcgagcgcgggcggtgggatttggcaatgccgcccatggcgcgggcgtccacccgtttgacgccgacgcggtcgccgtatctttccttccctcccaacttgctgacttgcaccttgtttagattttgatacatggtgtcgagttgtcgaccggagagggtggagtattgacaaatgttgatgtacagtgatggttcgtttgaaaatatcattcgagactcaaatgaatgaataaaatattgaatggttgataagttctttttagataaaaaaagctttctaagaaataccgataatttttttaccgtgataatatatataatctgtagaaaaagaagggccctaagagcggtcaacagttaacacctctaaaaaaacagttgatacacaccaaacacgcaattgcccccaattcaaacgggtgtcttgtgcctacgcttagaaatcaatcatctaaaacttagctgactggatctggtttttccaccataagtagtttagttactgggttgtttttattgtgtaaatattgaaaactggtattttgttgtgtgaacactgttcaggctttcttgcagggccagtaaggtgtggaggatcaacgatcctacggcaacatcgattattatgctcaacaccacaacattccttgccttccacagatgtcgggtaacaccacatatagcagcaatttttcacgtgttattggtcactcactcactaacaaataataggctctcgtaacgccagccaggtctatgagaaaaaacaacacagtggcatcttgcattattccctcgtgtgccaaaacaagcacggtgattgaacacgaagtatctctatcaagcaatatggtgtggtagccgtctcgctgcctctgggtcatttatttctacagaagggttacatcaggctgcaactttcttggaagtcaccgagttgataatagtggcaaaatccggaccctgcaaaacggaatgttgcgtaatgaaatacaatacacaattacacaatagcgggttcattggtttaagaacacggcaatcaacaggctgtatttcaggatatgatgttaatttatcataccttcaaagaggcaccaccaacaaggaagccgtcaatatcttctttctttgctagctcggcacaattggctgcatttacagaacctgtaccagaacgaatcataaaatcagtgaggcatattgccacatcctagctggcatcaaattaataatggtgcaaatattctctgaagtcacaagccttagcaggtactgataccactagatcgggcttctagatatttaccacaaacaacatatttcaaggaataaccaggctttcaattgcttatataagagaaaaatagaaaaatccattttgttagatgctgttgttaaggacattcataacagagtgtttcataatatatcaatgttcctaaattctgccttccaataatcaatttcatggggtgaagagaggagaaacacagtgaaactcatccaagtgataagaaaccgacctccatatataattcgaatgccggaagcaacctcaggtgacacgttggttttcaaccaatcacgaacagcagcatgaacttcctgagcttgctcaggagtagcaactttcccggttccaatagcccaaacaggctcatatgcaattactacatccgcccagtttgtaatactgtctgaaagcaacatgttgatacatgaatcttgtcttcagatgatgtaggctcatcaaccattattaatttaactcaagatgaagaattgtcacctgcaaaagccttcatctgcttaaaacagacgtcaaaagttttccctgcttctctctcttccaacagctcccctatgcaggcaataacctttacattttgactcaaggcatatgcagccttcttcccaataaactgcatttataaacatggtatgtcacaatcccaatcagaactactgcatgtcaacagcaatcatgcatctcaaaggtgccttcagaatgttacaggctaacagcatggacaagtggacaagtgagagaactaccaatccagtagcatctgtgtatatagcgcttacctgatcatcttcaccaatgacatgtctacgctctgaatgcccaagaataacccattggcagccaatgtccaccaattgctccgcactatagacattttaggtgaaacatataaaaactccagtgtgaaaacaagaaacaaaaaattatctttttgcgcttgcttaaaattcaaagctaccataatcccgtaaaaaacatcgaacagaccgccaccatttatcatcaatttacacatggttctgacgccatgtaatgcattatactaaagaaaagaaaattgcaacatgtttttagctttacctgatctctccagtgtatgctcctccttttccaatccaaacattctgagcagatacctcaatacgatcagttagtgagttcttaacctgatcaatataaatgaatggtggtgcaaccacaacatctgcagtattgccacagcaagttaattgaaggtagaaaaagatagacagtggaagctaaaaagaattccggaggatggatttggatgaaaaagaaggcatgaaagaaccaatcaaatacacacatctaacacagtgtgtatagagaggaagagaatcatgcatagatgaataaaacgtgcttaccaacatcaggttcaagtgtagcagcattcaattcagtcacaagcttgctgacagagtccttcgttccattctaaattgagggacaagaaattatatcatcagaaccaatcatactgatagtaacatatctgaccaaaaagtcgggaaacatgtcttgatatagttagcataagctctcgataaaaagtgaagcaacatataataccgagatgattctccaaaaggaaaaatgagcaactgaatcagctcgtcctaaggatggcctaaagaagatgctactatctttatttttggacaagatactgatgcacactttcttaccctcggaccactagaactaatttattttggacaagatactgatgcacacactttcttatccttggagcactagaaccaatccctgtctacgtaacagtagttgctcgactccatgaaatttgggcaaatgagaaagccagggactgagaagatgaagtctgaaaaaaattatacatttttgcatataagatgcatattccccaagagaactgcttaagccaaaaacgactacatcttgtggcaccaaaagcgactccatatctagcaaacacgaccaggtgtggtgtagatcacgatgtattgatgacgacaaaaaatcccattcattccgctcatctttggaatgtcctaggcggcaaccacaaggcgccaacgactcaagatcacgaaggtgcagcagcagcagaatctccatccatcatcgctctgctcataggtaccccgtgcgtctgcaaaagttgattgatgaggaggagcggatacttacgcacttccagttgcctccaacgaagaactgcaaggacagcagcagcagcagaaagaaagaagcagcaagtcgtcagccacgagcacaaaagggcaacgaagggaagtgtaattaaacgatagcaggaaggaggatggatggcaaccttgccggatccggccatggcgacgacgcgctgggcgcggcggcgggagcacccgaggcggagctgctgcggatgcgccggggcggcggcggcgacgcctgcgcggcggaggtcggcgaggcgggagaggtgggaggacgcgagggacgacggcgccgccattctctctctccaatccaacccaacccaatccaatccccttcgtcgcgcgctgcggttggtgagagcggagctcgcgagctgaggtgaggtgaggtggtgatgatgcgggcagcggcgcagccaccaccaaccgcggaggaagggggaagagaggggagagcgacccgtgcggaggtggagggccacgcggctttgtatggccgcgcgcccacgcgcgccttatcggcccacggatagggcgcccagggccgtggcctccgccacgtcgcctggtatttcctgggccggcccgaccgcgacagcccaagcaacactccacaaggaatgttccagaatctctcttatgctttgtttagttcctggtccaaaatattttttaaagtatacggacacatattaaatcgaacgtagattaataataaaataaattatagattttgtctgtaaactgcaaaacaaatttattaaatctaattaattcattattagcaaatatttactgtagcaccacattgtcaaatcatgatgtaattaggctcaaaagattcttctcgtgatttacatgtaaactgtataattggtttttttccga

SEQ ID NO: 68437 - DNA, 629 bp, Oryza sativa
  unsure (1)..(629): unsure at all n locations
tctttcggggatcgctacgtatataaactctcacaactcatgtacactaatcacgacgcccaatgcgcagtatccttgaactcaggtatgtggacatgacgttccttcttcgtaaataaacaagaccattgtcctggcgaacggtgaccttaacaagtcattgacagctatcctcacagcttgatgacgggatcacgttgttatgcattacaccgactgtctcaaacagcatggagacagatttgactgttacaggactttactattggccagttgcgatagagtctgtaaagggaaattcgggtgtttcaaagcaacaggctgccagcaagcaaagccctccatcatgaaaaatggctctactcatagcagccttagctcgcgctattcggccaacaagagccataacatggctatatgttgcacttttggattgtattcagatgaaatcaaaatcccggtttatttttctcgaggtcgcttcgctcgggtatgaaactatgctaaaattcatgtcaaacttattctcacaaggtatatcgttctcgggtgtttgcactgcatatgtataaatagcatgaatntacgatgctgtctatggcaaaattttataatgccccttatctctg

SEQ ID NO: 68438 - DNA, 686 bp, Oryza sativa
aaatgtgttccaaaataatgcaactcatatcttcttacctatcatcgatgaataaatcgggggagggctttcaatatcccatcaccgtacctactaatataactttcctattaatttggggcattttggctctttgtctcctttcttaactccaccataggaagctaaaatttgagtttttttggggagtatgttttttttccctagatctaaaagatgcacttgtactcatgatcatgattttcatgaccaaatacgtactttggcagtttgcagcatatggatcgattccttcagacgacgctatcaagtattacggattagaggccaccatggacatttatggctttaatctagagcatggacaacaaaccggaggttttatttggatttacaatacggatgaagcatctgccgtgaataaagttatagctggatggaatgctagttaaacttatctgcttgatttggaattgtaatttcaagcctacattagcttagctggttgatgctcaacaggttcatgagcttctcactgtcaatcgaagatgtgtcactaaacaagatactttgattaatcatttgcttcatgtcttttagatttaacatttaagtgtattgtacctcatacaaggtgaaccctgaatcgtacaatgattcacagacgcacttcagtacttgggttg

SEQ ID NO: 68439 - DNA, 8256 bp, Oryza sativa
atacaccaaaaggcacttatgagacactcttcaaaatatctctataacactgtaaaggcattttaaaaatgcctctatagtattaggaaaatgtctctaccaggtatatttcaggtatatttgtgctcttaaaaattttgggcctacatatataaagtttatacattaaagctttcggagatacatcttaggtcatatacacggcaacgaccaaaagaattcacgcttgagccgcataccggatgctttctttttgatcattccacaaaactgaaatagcacaaaactgttcggtttatgccaatgtggggttaaggatttcataaagaaatcatgggggagcatgaccaagagatacttaaaaatctcttccctaaaactttttgttgggattctccatttaggattaaaaataaattaccatccaatagataggataaatttaacttcctaaggtacttctttcccttcccttgtttcaaatacttcatatagtatccttgaacccggaattagtttgatggatggagtaaataattatttcttgttacaatataggaccatctttcctgaaggcccaaagtgcatcattcagtccggatcaacgtactaccctctgaaccatacgagagatgaatttctgcctcgtacagctcgggccaaagaccagggaagctgaagacctgttatcattttctattggaggattctaaatggatagatctaaagacttcaaacctccccccggctgctcgcccctctgatttttgcgcgggcgttgctgctgctgggtcgcggcatgtcagcgcgcgcctgagggcaggttgatttcgcgagcctatcgtgcgtccgcgtcatcgctggttcttttgcagggaggtcctcttctttatggctatcttgttatgcgtccccgccgtgcttttttgggctcaggaatatttgcgtttagtgtgatgcggaggagacagagatgggaaaaaggcccacgccacgccctggattgttgacagggaaaacgactcaaaaaccaacttaacttaaattcgtctctagtcagacggaagccactaacaagattcctatcgatagtagggacatgctgtacgttcttcagctgcacgatctttcccgaagtaaacttcagatctaccgtgccaacaccatgaacagaagcatgtgacccattctccattaggacggtggaaccctgtgcgacctgataagaagaaaataatgagatgtcagcacaaacatgtatattggccccagtattaacccaccagttaatagactgattaactgaaaaaacagtaggtaaataccatacccgctttcatctacagtgttgccaatagtcatatttgtagacttagaagtctgccctgcaggtgccttcatccccttgcgttgtggacacttcttcgccagatgaccaggtaggccacacacaaagcaagtcatcttatcctggttaggattgttgtttatattcttcttcttgaagttggtggtctgctgagctttgtattttcctttgctcttgttttgggccttgtgcacaacattggcactggactgcccaccatcgcccttagacgcggcatccttttcccgagctttctcctcaacatcaagagacgctatcaacccctcaacggagtattccagtatcttgtgtttgagtgcagtaccgaaacctctccaagatggaggtagtttcacaataatgcacccggctacaaatttgtcgggtaagacacacttaaggagttcgagttccttagccatagtctgtatctcatgagcctgctcaactacaaaaaggttgtcagccatcctttagtcatgaaactgatccatgatgtacagatcattgctagcatcagtagcaccgaatttagtattcagtgcatcctacaactccttagcgtcggtcatatgcatatacaccttgaccagacgatcgccaaggacgctaagaatgcatcccacaaagagagtagtagcctcatcgaattctttctactggtcagcagcaagaactaccataggtttgctagcactcatccataagcatttcatagttgtcagccacagagtgaccctgatctgccatctcttaaagtgcacaccggcgaatttatccgacctcaatgcatcggcaaaaccagccatagtaaaaccacagtgcctataataagatttttggattgttgaaattataagcacataatgatttaatttatcccataaataaatcacgacatcgcatatgtgttggacaaaaaaatcgaacacactggcctgggagatctgcttagctcctgtgcaggtctaaatcttgatgagatgcgggcgtgccagtcagtttgatcctgcaactgacaagatatgcaaatagtagatcaaaacagccgatcggatgacaagccgatggagtagttcccgccgatagccgataatagccgatgccgataccagccgatagcgatagggtttaagcaatcggctatatgtccaatgtagataatgatataaaggcaattggctgatgatgatgtaataaaataacaatataatccagtataaaccaatcggcaaataatgatatgataaataagcatagatccgaaggttaaagcacacatcggctggaggtctgatgtcatgaaatccacaagattagattaaacagtgaaacctttgttgtcatcggctaaatccaacttatatgtatatgcaatccttataagccgatgcaacgtccagataactcaccggctgaaaccccgatgaaacccttattggcaatcaagaattaggctagagattatggttctaagcacgacttagtagatcaaacttaactgatgcaacattaagtatgaaaagaaacataatatctagacaatcaagctgttgactgaattttcagggtggtagatgtcgaagctaatctaatctagcaacgcgatttagccgataccggcagaaaccctaaaacgagaagcagccgatagagctaaattgatatgctaagactagattaacagagacatatgataaataggtaggcaaatatatcatccaaaccagagcaatccaacatgtcgaatgtactgatgcagccttgaacgacgccgacgtaaacgatacaattgcctaggccggtggaatattggacttaccccttagccggagatcgaacaccgatgcaagaatccgacaactgacgacttgacaactctcatcggctaatctcaggacttcgaagccgatgctgactctaagccgatgactactccgagcttaccaaatttcactgttaacaagatgtaaactagcatgaacgcatcaatagatctacacttgtaaacaacacaatataacatgaatagatcaaatatgcgtaacatattgagcacttactgaggttgctgaaagaccggttgctcagcaggaattactcgccgttccgggcgttgacgaaagcacgcagcacgcgagcgaacaggaatacaagctgtcgtggacgaacagggagcagtcgcacgaagcgcttcctaaaaaccttattgccgccttctcccggtgcaggacgtcgaaggtagaggttccggagacctgctctcccgatcgccggtgcacgccgacaagcgggatggagtagtctacgagtgacagcgcagcacagagtaggaggcaaaccctagattgattttgtgtgtgttgcgtgaaggcggcggcttggtttatatagagataggtcgcttgatcaaggcgcccgcacgatctccactccgcgtaaccaaaccggataagtcgcgtgtaacttatccggactccacgccgttttcacgcaccggatttttcggaatgtttccaaaacaaaacaaatccgaatttccgcagcaaaacaaaactgcaatttctgcagcaaaacaaaactgcatctgcgcaagggtgaggaaccaattttttagaccattcgacgcgtacgtcgtgcatgcccaccgcctgccaggcgaggcaagcgagcgcgcgtatgttcccccacttctctccacctcacatgcttcaattggctagaaggacaccctcccttttaaggaggtccctctctcctagaataagcaaggtggtactaaactccccatgcatgtcatcccatgagatgtacttttgtgatttttcaaagaattaatctttgaatgggctaaggcccatctattaattccaacaatataaacttgtacgcgaataaaactgggtcgtacgtaggattatcatagaagtagtcttggtataatctcaaatgacgtgcttatctgttgtgatcaattacttcatgtcccgtgaaagacccgccatgttttgatgcattggcaatgtgaatagctatgcatgatttgtgctgcggcaaaaaaaaaatcgtcatcatcgttggatgatgattcatccagaagctgttgaaataaggagcgaggataactcattacagatcggatcaactgccaaaccattattcatcacaatataataattttttccctaacgacattgtcagatcaaattaaaaagtagaacgtgattgatatgagaaatttctaacatgacggtcacctagcatattacctgatttatgacattttcgtgtagaggatcagctaggccttctgtttctccacatattagagccttagaggcgaggtcttccaataccaccgtgcttcggcgagggtttctctggcggtaacagaagccggttagtaaaaatattttttttttggaacgaatgaatgattccaatccgtaggttttaggaactaacttttgaagttttgagtctctctcgaagatgctaataaaacttcagtattgagaaaggtatgagagaactgttgtccacaaggaggttagggttatgattttgtgaaatttcataatattagacttatggatcccctccaacaaataagttttagcggttcgggctctgccactgttcacactcattcccgcttggacactcggccaccttgcaagaaaccactctacacgcacacgcgtgccatggccgccgccgccgcctcctcctcctcctcctccgccacgctctgcaagcaccacggaccacccaccgcgtcccgccgccgcctccgcgtctgcgtagccatctccgtcacggcgctcctcctcgccgccgtcgtcgccgctgccgtgctggccgtcgccgcggcccgcccgcgcccggccgacgcgacagtcaccgcgctccgcctcgcctcgctgtccgtctcgcccggaggctccgtcaacgccaccctcgacgccgtcctcgccatccgcaaccccagccccgtcgccgcgttcgcgcacgacgccggccgcgccgaggtctactaccgcggcgcgctcgccgcggacgccgacgtgccgcccgggcgcgtcgcgccgcgcggctcggaggcgctggccgtcaggctcaccgtgctcgccgaccgcctcgccgggcgcgcgccggagctgtacggcgacgtggtcggcgccgccggggacgtgtcgctcaccgtgcggacgaccgtgccgggcacggtcaccgtccttggcgtgttcaggcgccacgcggtggtgatcacggcgtgcgacgtcgcgctcagcgtgcgccggccgggcgcgcacagctcgtcctgtcgggttctcaccaaactctagccatatgttggatttttttaccattttcagtagagttgcaaaatttaaatgtctagtgttatctgaatccattcaagtttttaaggttcttaatgtgtgttaatcgctgctagtaacttgaaattcagaagaatatgtccaaatcaattcattcacctccaagttaatgagcacatcaagcatgagcaacacacaagtgaagtatgtgcattgatcacagaacaagcatgcaacagtcagttatcaacagaaaggaccaaaatgaattaatctgctaattagtatggtcttcagcattcagaatacctcaaataatacatgcaaataataatcatagtaaattgtgtgtcatatgtatcttgtgaccaaacagaagctcaaaaatatgaactgaaagttactggaacataagcaactactccatgtgaccgtctacagtgttctccgtactagtgctccaaaaaaaaacccggttttcggatgctcgagaatcaaaaccatttctatctgatgtcatcccaaatattgctataagatgacagaggaaacccaaatagactactttggtgatgtgctgagctgaagatgaaacatgcaaattaaggggctttggtcttcaaagcatcagtttagtgctgtttcttctcagctaacattgggatctttgagagaagcttgtgatcaagcactgcatattgcttcttgagctcgattagggccttctcgcccacgacatcgacttcatcttcgtatttctcatacagcattggcagtgtgtatgccatcaggaaaactgcaaacatgcatcaaattgagtgtctcaaacgacgatgagcgatagagatacaaattgttatctattgatctgcatttctgatcataattttcagattcaggcttttcagtttccaggtcatccaaagagaagagatagaagtgtaagatcatagcttttcaacattacctagtactaacaggttaaataattcaatatcctaccgtaatgaatttttttatcgaaattactatttgactgacctgcgtggagacactttccctaaacgtgcatggaagaaacaaaactcagagtagtaattttctatcatgtaacaaattcaaaagtgagaaggtattgttatatattcgatctgatgcgaatgcgagtagacatcagaacacaatattgtgcattcccatgtgtttgttttttccccaaacagtaaccaatgcaaattcagatattcgtgaataaatccatcaattttgttttgcaatcaacataattttcataatttggtaagggtgagtaaaattatagaaattaatgtacatactttatcacacagtttttctatatgcaaaggggaaacctttgagttttacttcaattttttgtcaatagatatgggagcatatttcacaattctttcagaacacacctcaaaaaactactactccctccgtttcacaatgtaagtcattctagcattttctacattcatattgatgttaatgaatctagacatatatatctatttagattcattatgtggggaatgctagaatgacttacattgtgaaacggaggaagtagtaatttgcagtgaaatctgagaaagtaaacaatgtgcttactggtgtaagacaaagtcaagaagctgaagcagctcccaattatagaaacgaaccagaggcctgcaactgtctggaagaagaagaagatgctccagtatcacattgcgcgtcaattacatgaaaagggaattaataaaattaaaaaaaaattaccataagatatgttgtgaggtcttttccggaggcgacatggcgtaatgttaagaaggcctcattgatttctttcctcagaatatgagcaatcttcaggcattggacttcagacagaattgcatctgggaactttggaggacccctgaaatttctaatatgttatatcagcctccacaaagcatgaatttgttgttctactcctctccatccattacttggtaacaagggccgaaatctctttcaaaattgttctcttttaaaactgtacatgtataggttttgttcgaagaaataaaaagagttcaacgtatacagttgagcagtgcagttgtacattgaatatatagaaaactatatactgtaatagaaatgaattcttcagaataaacagctagctaggcaaaagcaactagagccaacaaagattagaccaacatgaatagcaccaagatgacagagaaatgacatgagtaaactgatcaaatccagatatatattcgtgcttttattttttttcagttacttctaagatagctccgaaattaaccattctattaaatcaatattcatctatcaagccacaaatagatttttgtaggaggaccagttttcgattcttctgacaagaacaaaacgaagctaaattgttagtagaagaagcgagaatgaactaatcatgggggtgacctgttgatgaaggaggcggcattggcccagacgaagcagacggtgaggaagaccatgagcgag

SEQ ID NO: 68440 - DNA, 725 bp, Oryza sativa
atgaattagtttagagttagaaaaaacaatgctgcaaccagaaaaatgggttgaattaaaaatgatgcgaaaattacctctcgttcaacttgtcccttcttactttttccctgcatgctttggagcttggtcgagtgccactttctgatctcggactaatgttttgtggtgccaagttagaaatgatcaaaagaaaacaggaaaggaaatgtagattggataatggatgtgaacaaaccgtttatttgttggctgttctttgccatgttcacagtccacagagccattgatttcagcactggtgaaaaaaataaacttgtacttcagtatgccatatgtcacgataatatacagcaataagtacataaaaaactatacaatgacaacaaaagaatcaagcaaatttaacacaacagaacaatacatcagttaagatgcactgtgtggttcataacaccacaacctatggcaccagaaggtggaagcacaagtcaaaaaccaggacagatttaaaaacacatgagatgacttcctggtgcataaagaaaatgtactagcaccacaagactacaaggtatcataaataaaagaatactcttaaatcaaagagttgcagtaaacaatatcctaacatgaacacgttcttcaataaatttccattccacagtaagcttcgtgctggaacccaagtgatacagattaaccacttctctcaccccgtttct

SEQ ID NO: 68441 - DNA, 7261 bp, Oryza sativa
tcagaatgcgaaacaacaactacttatagataaatacttaatgagccaataactacaacaaaatcaaagtgccagttagtttggtaaactcaccacataactcacatatcagaaatcctgagaaatagagctatcattatctagaaaaagcaaaaacgaaatggtgatctagaaacttatgagaagtttcgtattagtctgtcaaactacaatataattttgtaagaccatcaccccggccagattatgcttatcaacctaaacatgtatgttatatgtaatagaagttcagtggttcttaccacatagtacaatgcaaaattgtccttgtccaccatataagttggtctcaatttgaaccggatcatgtagattacaaaaagtgtagctgcaagtgtagcagtatctagcacagtatggatgtcatactccataacgaagctgcagtatagtctaacagctagaaacaacgcagttaaatcctgagacttgagggatagtcctgcaagagatacgatcataaccgagcttttaatattcttagttatccgtgcattaatacagaaaaaataaatcacataatcatggaatgaaatcataaagaagctataacaaacatatgcttctctgtatcgtcgagcatacagtggcatgcaactcattagtcacttctcttgttcaaaacaaaactatgaaacagtactttgggttgcaacctattgcaaccaagaaatgaatggaaacattctgctccagaaaccttgcccaaatatagaaatagctggtttctctaataaaagaatggtgacatactactccctccatttccaaatgtttgatgttggttagttcaattttgagctccaacgtcaaacaaaaagaaaaggaggaagtactattctattccagccaaagcacaaaatattgctccaaacaaaccaactcaatcttacagtaatcaaaacaaaactatacatctatctctaaatgactttacccacaaccagtttctaaaacaggacaggacagggcatcaatgttatctgatcgctgatcgatcctgatcgccaagggactgatcaggatgattaatcgtcgatcagcctcgattaatcgacctgatcagtactatgtataccagtactaataaaacaatcatagtactaataattgatggcaagatagtcacttacttgccctagtataaagcaatcacaatataaagcaaccagcagtagtagcacatattcacatgtactaaaccctaagacgttttcaaaaagtgatcaataggtgctctgatcggacgattaatcgtgcctgatcaacgattaattggacaatcagatttctgatcgaactgatcgaatgaatgtccctgatcggagtcaggggaccgatcaggatgattaatcatgattaatcggatgatcagatagcactgagggcataatcatggaatgaaatcataaagaaatttaaaaaaaaatatgcttatatgtatcggtaatgattcacacattcagtggcatatgctactcattgcaaaatggtacctgggtttgcaacccgttgcaaccagaaatgaatgtaaaaattctgttccagaaaccttgcacaaatataggaataggtatagctggtttctctaaatgactatacctacattctgtttctaaaacaggacagggtaaacaatacaccgggttccttggttaattctcaacaaactgcaccatcctccgcaagaggactatatagcttattacccagccatgtgaaagcatcgtgcagccaaatctcctaatgaattaatcaactatcactgcttcataagatggcacaacctgcagatcagcaattaactatttctcccgtacccaaaaccctataacatcacagtgatacgtgtatctcccgctccatacaaatctgctcgcggaaaatcacaactaagcgtgaactgtcagaaacattttccgacaaaaacaggaaggagcctcagaaatcaaacagatcgagtgaatttcagaacatgcagagcccatcgcctcctagatgttcgccttagcaaaaccgccaattctcccagaaacgacttcacggtcgacgagacgaaacacaaaaatccacaaacagatcctactccggagctacgcggttgcggatccggcgatctcgacggatcgacgcgcgcgcgcacgcgcgcgcgacggaactggcaacaccgtacacgtgagccgagaggggggggcgaaccggcgcaggtcttctccttggtgagcttgtagatgagcacggcgatgccgagcgcgtgcgcggcctccgcggcgacgaagaggttgtcgtggtcgtggacgatgaaccggatgaagacgagcgcggccatgccggtgacgacggccaggaaggccttcaccttgggcggctgccgccgcacccacgccatcaccgcgccgagcggccgcttcgcccccctcatctccgccgccctcgcctcgcctcgccgccgatcggagaacacggggagggtttttttctccccttgttttttttcttttttttttcctctctcgtttttttccccctcgatgcggtggcccggatagtgtgcgggcgcgtgtgcgttgttttgtttttgggatagatccggatggctggctggctgcccggctgtttgccgttttggagtgcgggggttgcaattaatgggaggcccgtgccaacggggggaaattcttggcagaattctgcacaaatcttggcactctacttctagcagtcacatgttccatcgttttgtggtgcaacttaaagaaaccttatctataattttattagtagcattttctctacacgtcttccgttttttctatcggttctggtgatactaaatttagatacataaataaaaaaaattatatccatgcaaaatgcatattaaccatgtgttagttttgtgccttttttcatagataaatagcttgtctttttttaagtagggaaagatagacaacacgagaagtgtgtattgtgagtaacatttatattgttataaacgaacaatttaaattgtgttatggtcttgtctagcttgtgtagaagatataataattgtttgttgactaaatactcgtctatatgcttttgtagtgctgggtgctggagttggtcggtctttgtagtggtgtttgaattctcgtaactactacaaaattccaagacatgtaagtagtgtctctgttttattgtttgatagattttgtattctaccttgttttgagaaaaaaaacctacatataacgatgtttgcaggcatttctatttatgtagtgtcatcattactaaagttcacatattaatgaattgttgcagtttagactttagagttgtgtcgtgttctttttatcacgatgctcgtaatattcataaaacggttaaatgacacaaggaaaaaagttagtatctataacatgttcatcaactcatcttgtatatggcatgccttttatatttgcaaattagtaaatggctaattttgtatagggcatacctcctccctctataaactctcatgtaattaaacctctcatgttaatatatttacagtatgagcctcttctactattttcccgtaaaagaaaataataaatgactatttacttgcatcccaaccagatgttacatatgaaagtcattgctgcaaagctaattgaagcagatattactaccatcggaatagtggttaggctcctcagacttcgaagtcacaatcttattattaacatgtggatccatattttgttgagcccacatatattaaataaaaatatcacgtcacttcaagtgcacatgatcatggaccgtaagtgcttattcacttcaccatcatttttatatttaccaggttttactgttatcaaattttaagaaagtagcaatctaaacatgtcttaaatattataccaaaccataataggttaatttttgttgtatttaatgaacacaccctaagaacccacggtcctcaattggctacttcctccgtttcacaataagtcattctagcatttctcatatttatattgatgttaattaatctagacattcattaatatcaatataaatgtggaaaatgctagaataacttacagtgtgaaagaaacggagggagtagttggcttcatcgcacaaggcgtccaggcgatgaagcccgctaacgtcgtttgcaatattgggccaggcccaaaacgcaacaagcacggagtggacgggctccttgtgtagtaggccaacaccttgggctccttacacgaggaacggctggcccagcgaaggtacgggttgcgttagcgtggcaacaaacacaacaccggacgtggccacgtgggaggattcatggatcatcacgaataacccccctccatcctcccgaaaattacagatagcaccatgcggttgaatttcgtccaaaaattcctgtcttgttatactacctgaagaaatagatgctaagaacaagggtgtaactgaaaaataccccgcccatcgtctctctcttctcccaccgttcacaattcctcttccccttcccacggaatcctcttcctccccatgctccgacgacgaccatccctccgattccccggccatggaagcagacgagccggccgccgccgccgcctccacctccctcgactccgacgactccttcttcgacgccctcgactccctcccttccccaccctctcctcctcacaccccttcctcctccaccctccgccgccgccgcccgcgccgcggatggagtctgaagcagcacgaggacgacaccgccgcatcacctacgttctctgattcatccaccatcaccgtcgtcgacgaggccgtcaagcccgactccgaggagacaagctcacaccgtcctcccccgcctcccgaggaggaagacgaggaggatgcggcggaggcggcggtggagggggaggtggagggggaggtggaggcgagggacgcgaagctaaatccggcaccggcaccggcaccgacgccgacgcctccgccgccgggcattctcgagtccctcgccatgctcgtcatcaaggcggggtgttccaagtcagcgcgctcatcagctgcctcacgttcccgattcggctgctgcaatggtggttcctcctcgtgacggaccctctcggattggtgcggcgagcgagggggtgggcgctcgaggtggctgggcacgccacgggcgccgcggccgcgcgtctcggcggcggggaaggggtggggcgcatggtggcgaggctggcgtgggggtcgctctgggcggtgtacgtctgcgttgttctgtgctcgattctggttatggcgttcctcggaggagggctcttggtggggaaagttgtggaggagcccattcaggttactgagaccctgaattttgattacaccaaaccgagccccgtggcatttgttcctgtacagcggttggtgccgccgaatcagcggatgcagctcgaggtgttcctgacgctgcctgaatcggattacaaccggaggcttggagttttccaggtacattttgctgtttgtccttgtcagattgattttgcattggtcattcctttgataaaagggaaaatgatattcgattgaagcagtgtcgagtaaatgttgttagaaacccatattaacattctaaactgtaaaaatttatgacatagtccctgagcatacttcacaaatgagaagataccaactgttaactcagttgtgcactgagatgttatataatttgaagatttgaaatgtttagtgaaaagttagcaggattaaaaggcttatgtgttgttctgtagaatcggttctcaacaggggacattatgttttgagttttcactatttcactcagccgtagttttcttatgacaacctaaatatttttaggaacacaaaaggacatctataaagcatgatagttatactgttttttccctcaacttattactgtatcaatttaagacatgccaatagaaatttttttttgagagaccaatagcaaaacaaattatacactagaaaagatacaatcttacttctaatataatatgggtctcaaaggaatctggtggacatgtgacacctactctaaaatgttgatatctaacacaaaaaaaactttgccatacagatgaatcttgagcatgataggtgtggtgcatgtggtgtcactgcgttatgctgcaaatgctaattgttgggtaattgagtgagctttatgcagacatgtgttacactagcaacatggctaataaggcattgatagaggaaacttttctgtccataaggttgcgtagcgggacaatatggttatcaatgagagagttatgttaactttcattctgtagctcaaaggtccaatatcatgacggaacatataatttccctgctgtagcgtgtcaagggagcatatacccagtttaagttttctttaattattttgagttgagatattataaatgtttcatacgcatactttttggtctttcatattagataccctttttttagtaacatcgtgtttagcatgtctctattttcaatctgatttcccttctttcattgagtttaggtaagagcagaatttctatcagcagacggcaaagtgatctctacctcaagtcaaccatgcatgctaaagtttaagagtgcccatatgcacttcatagaaacttttctgcgaagcgtgtctcttttgtctggctattcctcagaatctcaggtcataagactaaaaatgaggggcattacagaggcttcagaaccagtaatgggaataaggataattcttgaacaacgagctgaatttagtcctggtgcaggcatcccagagatctatgccgcatcactaaagcttgaggcagaactacctctgctcaagagaatactctggaactggagatggaccctttttgtctggagtagcatggggttctttgtttttgaattattgctggcccttatttgctgtagaccctgtatatttcccaggagtggacataacgctgcaactccttaggctagctcatgtaatgtacacttcaaaataaatgcaaaagggatgttaatgttgcacggtatacagctatcgcagtgatgcttctttatttgattttgacatctggtggttgcataacaaaaggtgcatgttaggcttgatgactaacgctttactccacacttattatcaggtacgctg

SEQ ID NO: 68442 - DNA, 838 bp, Oryza sativa
tgggatttgaaaaccgagttgcagatctccatcagcttattgccaatgatatacagatgtgagaggaaggagatcgaagtgtaaacgaagggatctgggtgaatggggagcgaaccacaggaggtcgtgatccctcaactactacgcacaacagcgctgggaggaggagagtcaccataaaatcagcaaagcaagcggcgcggtgaatggaagaggcacgacgtttgcgcggaggtcgcgcttactggctgcccgccacgatcgaagaggagagcgatgcgggagaggggagtcgatgcgcgtggggccggcgaagcagcgagatgccagagaggagaggtggggagcgatgcccgtggggctggcgccgtatcaagatgctggagatgagaggagaggagcgatgcgggaggaacggctgatgcggatccaacggtgaggacaaaaagggtgacatggaagcaccaggaagcggacttatttattagttattaaaaggtcttttatgtaccatatgtggtttcataggaatataacatatttggttattactatcagaatacatatgctaaaaaaataaataagtattaattttttatgtcatatctaaaagtatatttatcgcaaataatatggtgcatagctatctcataaacataatagtctcatataacacacttttatgctccaacaatatactgtattaatgtatatgcttctttataccaaagcgcaaaatggactttgtcataagaatttaacggtcaactaacggtcaactagttgaaatggcatggaagagaccacactaaaattcaggggtatccaagagattgac

SEQ ID NO: 68443 - DNA, 2115 bp, Oryza sativa
tgtagcatggtttactggcttatacgtgttactttgaaaaatgttactttttgccactctgtttttccagaaaaaatatactgttctctttttttgcaactgttaatacaagttagtacaaattaaattatatgttatatttgtaattttctaaatttttgtttatgtaagggtgtagcagcattttgagggaaaattaatgcttgactcactactacaaaatcagttttttttctggctaaaatcaactttggcaagcaggcggccagccgcctgcaacaaaaggctagagaaaattgtgattttggctggcgggcctcatccgcttgcgaaaataaaatttcgcaggtggcatcctagaaatccaccggaaaaatggatttccgctgatggcacatttaggtcaactgccagtgaagagattttccaaaaaaaaatccacatattccataggattttcaaaacaaatttacatcaatatattcatcaacagatcagcagattcacattaatagttctattacagtgaagcaaatcgattttcaaacatcaacatccaaacatcaacatgaaaacatcaatttctcacagtatccaaaagtccaaacatctacatcaacttctcacagcattttcaatatgcaaatatcaacacatacacatcggtcgccggcgaccttagaggttgctatcactgccaccgaagccacccccttggctactgctgccaccatctgggagcaggggcggatccaggattttcagtcaccggtgtcattaggtaaaacatattttattatagccttgcttgatatagttctagatccttaatccacgctggatttgaagtgtatatgttaaactataatggtttaaatttttatagtatttcataaaagattgggaacaaaataattcatcccaatattatcaacataattataaatctaaatcacatattcatgaagcttagttatctataatgtcctacacgtgttctaacattagtgaattactagtacaacatagaaatagatatcactgattgataacaattcgagcaacttaccatgtcttctaagtattaaaaaacatttttgcaaaatttaatgcatgcatgtaagcttttatctgttgcgcactatttctataccttattattctacattgttatctattaaacctaaaaagaagtaatgacacatttcaccgggttaaattattaattgtttaacaatcagaacaaagtaaagaaaccaagcaagttagttctaataatcacttagcaaaactatgagaagttgattaattaactaaaggaaaacagggtgtttgcacgtgtaatgctaacaatagcataactgttttgctttcataaaacaatgcatgtttttattacctgctaattgcatgagctgtagtgaattggtcaatctaccggtgtcagtgaactttcaccgatggtgtcattggttaaaaacaaatagtatcgtgtaagatttgcagaagggcgtcggtgttagctgacaccggtaggaacaccgtagatctgcccctgtcggggagagggaggagagggatgcgagggaatgcagggcgttgccgatctccaaccatcaccatcagtaccggatctacccctcatcgccatcgttatcgacacctcaaggctggaggcagctcgatccagagcttgcgcccctcccgtggccaaaaccgctgcccatggccctgtggcagtcgcatcgtcgtcgtagcggcctcccccgttgtcgtggcgatggatctggccacccctgtcatcacggtggcagacccggcctccctcatcatcacggcggcatatctggtcgcccccatcgtcgcggcaaaggatccggccccgagctcgtggcggccagcggccgagaagaggaggccacgccccgccgcggcggagaggtggtagaagcgatggcagctagcagcggtggtggcgacggaagccgacgacagtggtggcattggcagtgatcgcaacggtagctggtgacagtgaagaagggacgaagaagcagagaccgtgggagaagggagcgaggcggcggagagacggaggtagaagggagctgtggg

SEQ ID NO: 68444 - DNA, 595 bp, Oryza sativa
  unsure (1)..(595): unsure at all n locations
tggcattgttatgatgtgatgctttgtacagataagcgtccgccctgtagtattggatttggtttcttgctgcgcggcataaacgaggattttgaccaagagtattatatttgaactgtattagatttggtttcttgctgtgcggcatcacgaggattttgatcaagagtagttagcacttaccaggctgatatattgttgtctatggaattatcaatggttcttggatttattttctttctgtgcaacaacaacaaggttgccaaagaatatttatctagtatgaaattctgaactagtggtacttatgcttgtcatgccaataactgtgaggctaccgttattctttcttactgcgcaattgaccatttgttcatgtcatgtttccatccctaatgatggccttttctggactgtttgatctacaggtcataattgacttcactgcttcctggtgtggcccttgccgcttcatcgccccagtgttcgctgaatacgccaaaaagttccctggtgctgtcttcctgaaggttgatgttgatgagctgaaggtgcgcagagtngcccacaatcttccaaaaacattttgtcaccc

SEQ ID NO: 68445 - DNA, 4847 bp, Oryza sativa
  unsure (1)..(4847): unsure at all n locations
cattcactgcagattagtgctggtgccaaaacgtgaggttactgcgagtgcagcaaaaggatgtaccgtggatttctcgtacattttgcttgaatgattttttactgaattacagggcctgaaaaaggtgaaaggtactgaaataacagcccagcggcaaaatcattgcacatgggtaaagaagcaaatcttccagtgagctgcctggatctcatcgacctgagtaggtcagatcctttatttatgtagtctagtgtcgtatgagattggcaagacaatgttttcacacggtgttgaacgagtgtacgtatgttggagacaaccagatgatgagttgatgatggaaaagaacggacgaatttggtatagtataccacaatttgaagatgcatctgggttgtcaccgaaacttgatagaaaatttattgagacggttcatttagttatggttcttgggcgaagaatggagccaaacagttcggattctttaatgattaaaactcaggtccacacattaaggcgataatttcaataattaaccccatacatcaaatttttttagctcggctattgcatttctagaagacatcacggtaaatttaacctggcacataattcacctccataaaactgaaaaaaggttcattattcccataactatttcatcaaacaacaaccttcatgctttcttcatactagcaggacggatcacacaatgcagcctcctcgattaggacttgtcggttaatttttcatgagggtattggatagaatcgaggggaatcaattccacaactattaaggtgtgaaatcaattccttctaatcacgctgaatccatgcataggaattagccgaacatgccagtttatatttcctttgtctaatatagaaggaacattattaacaactcaaactatttgtcaacttcaggtaggagtggaggtagattttatactgcaatattaggaatatataaatacatgactaccattatgccacctatacaatgcgaactacggaaaagggtgaaagaaagaatgtcaagtaaagaaagaaagacggaaagaaagaacggcaagtaaaccgctgagagaagttttacagaggaacgtttggattggatgtttgcatcaaacacgtgtataaagtttcacgcatagattttgactgtaacgagcctcaccactactctgttaagaagggtgaacctaattaaagcagcgaagatttgcacaggtaatgaacgcctgaaggaacatggactcgctgctctccaacttgcataaaatttttccaaggggtgtagctttcttcccacttcgtttaaacatctaggcaaaacagctgatactagcatctcaaatgtacagttgtgattcaaaagaatgacagaatctcatctaattattgacactactgaaactgcttgttgattcatcatacttccacctgtcaaataaattgcagagagcagattatgtaaagtttgttgagcacaacaaataaactgaaccagtcggaatgaacaaaaattataagcaattactctgaacagaaaccactgggttctgaaaatggattccaacagacattaatcaaagtttgcaaagttggaagttgccttctcactactaaaatatgaggaaatattcaaccacaaatatattcaactactaaaagatattatgacaagttgccaacagatactcttgtatgcacaaagatttcaaccatgcagcttactgctgcttgagcgcaagctatgtggaaaggggtacaaaaattttgtgcgcagtagtatacataagttgcacctgactagggctgtcaaaaatgctcgagactcgtgagctactcgagcttgattcgttatgagcttgattcgagctcggctcgtctaagaatcaaatcgagctcgagcttgactttaagctcgcgagcctaccgagccgagctcgaataactcggcgagcctcaacgtctggctcatgttctttctcctaggcatttcctccccctctctctctcttactcttcaaattctctagtaggagtagtactggagtagcacaactgcacatgtactagcagtggcagggcaggagggagcactatgcatttgttgtcccatttcccaacaagagagtaggagtactagtgtgtactagtaggagtactagtgtgcggcttgcacagttgcactagtatacataggagcactagtatattatttttagccatctaatcatgcatcacagtgttagctttttctttgaatgggatgaattgttccagtattctaccgcacgaagcaggcttgagagaagctcgaagctcgaacgagccgagcacgagctcaacttcaagctcgtgacaaacctaggctcggctcgagctcgactcgagtctatagcgagctcgagcctacacatggaagctcgctcgagctcggctcgttgacagccctacacctgaccacatcacaggcccatgtactggaaagcagcagaacgtacatgtggaatggtcgaacgcgtacattacactatgatcttacaaacctagttttcctggaacctacgagtcaagattttgattcagacggtagattttaccatttggatcacaatccaaacaatcttagctggcagaatgaatcctaatcaagcagagtagacaagatcactatgtgctccgatcaatccttgacttggatcccaaataatttgttagctgcaactatttcttactataatttgtgttactaattcatttaaaaaaagatatgctagtaacactcctgcgtgttactaactcgccttctaaccttacaatagtcttatatgactaggttgtatgaagggaaaaatttggacaactattacaaatctcttttgccctttgtcacattttgagaaaaaaatattttgacaattgaatgaccctggaggaagtgtattacaaatatcttttgccctttgtcacattttgagaaaaaaatattttgacaattgaatgaccctggaggaagtggcctttatgtttggtagttcggtactgtattcaatatatgcattgacatgaattaaggccaagtaggatgatgtattagataatacaagtttcaaatgtttgttacataaaaaagatcatgatacacaatttctattttaatagtgtgactcctgcaagccaagtctactattttctccaagtaaggcagggctgtggctgcccaatgggttggttgcacagccaggttccaacaaatgtatattagttaacattaacttttttaaaggatttgatttcaaattttaactcatcattcacccactaatttaagacaaagcatcaaaaagacaaacctgcagaggaaaattggatgtagcctactactgacaacctgacttcccttagtttcttctctaaacttgtcaacatgaagaacctcacattggccacaaatcgcggaaactgttacagttctttgattacaggaagcaaatacctggaagaacataacaccatcaaagaaatgtagtaagttattctcatttatgatttatcacaacaagaacaatcagttcctcaccgtgaaaatttggcaatatattgccacacaagagaagcataaaaaatgtctaatctaatttatcgatacacgagatttccagcactgcagattaaaaatctactatttaacaatcagctatttaaaagccaaatgtgaattacatagatttttcatgctatttaaaagaactattgataatgcaaattacatacttcccctagccaaaagcaatcctcctaaacagattatatattcttcacaatggttagttggctcacctcattctcttctgcagtgcatggtttactgatcaattctggaatatctgaagcaaagaaatatggactaaccaaagccatcttagacctagaatcatgctcttcccacagtgactgcaaaaggtaacaataacttgactattttagagataatacacttacaaagtctaccacaagatgatctgacaggtgcatagggggcggttactcaaacaccccagtacgcagaggggtttgcgccccatatcatacaagagtatgtagggtatattaagaggaaagatacctgcagcttggatggagcagactccttatctttggaggcaaccaaaatatgatcatcaagattgtatgctataccatcaatgttacaagagtaatagtaagtcttgttctcgactactctgagaggatcaccaacccaacccacaatactgtgatctgtgctgcaaacaatagttttatccttagcatcgcctataacaatttcattctttgtagataaatccccattcgatgtcaactcatgaacattgccacgttctgaaatggcattattttccattgttcccacaccttgaggttttcctcttcccttatcaacagctgcagaagcagagcctgattgtgattgttcttttgaactctccaaagccaacttatcactattatgtacaatcctgttagcttcactggagtttttatcgataactgttccatctgctgcaagttcttgattattatcctttgtagttcgattttcagaaactccctgcgaaggaactccactaataagattaacctttggtgcaacaacagttcttgtaaccttgccatatttcggaggcaggggttttcccttgctacgagctacacatgttggacaataccactcagctttaggtggtagaacattgaccccgtcatgctgaaggcattttaagtgtattgatgagctnctgtaccantgtatgtgcattcagtggccag

SEQ ID NO: 68446 - DNA, 554 bp, Oryza sativa
actgaccactaggagattccaaggataatcagaagaataccaacctggacggactactggcggttggggaaccacgatatcttcttactggtgagcgtgcaccgtaggacatttcttccatacctgcacatgatggcatccaaacattaaattaatcatcatttttttttaaaaaaatgtggtaaataatctaactgcagtacctattaaaatgattccacctatcatttcttccatcattgtagcgagaccgaacaggggaacgctctggagatggtgtcctgtatcgacgtgcaaatgcatattgttgagtaaaaccacgccccttcctgacacgttgaggctgtccgttgtctgtagagcccattgctaaatctttaccattggttggcacaggttcagctctagatataccagcctctgcagtatcagcaccattgttgccatccacttttgttaaacttgcatcagccctaataggactgctcctagctctcgcaccaggatcatcccttgaaatacaaacaaacatctcaattgtgtactcaaaggat

SEQ ID NO: 68447 - DNA, 19329 bp, Oryza sativa
  unsure (1)..(19329): unsure at all n locations
gaggaggaggaggaagagaaggaaggaaggggaatgcgagaggtggaggtgggcgattttatgttgggttgggtttgccctttttttttttcggtttcggttcgggtcggctcggtcgcgtcgcggcaaggcgagagggggtccgtccgactgggctgactggtccgggtcgcctaccgcgtctggttttttcagctacggtttggatggctgaagaaacgtgcgggtaggctctccctgtcgcgtctcgcttcgttgtcgtaggtgatctcgatacggtgtttgcagtggtgatatggtcgacgtattcatgttgttctgcaggagatggacgtgtcgagttaaacgattagtattaccgaaatacccctatttcataaatcttaatgtaattgtttttcactttatcaattctcaatgtaattattttatactagtacttttataaattttgatataatgattacttaaaaatggatttattttaggacaaatagaagaagctaaaaatgaacttactgtgagatgagatgaagaaggttgtgatttctgctttagcaagagattctaagaaaccgctatttattctcataaattagatgagaatttagattatttggggatcagatattataaaagttgtttataacagtagtgtaactccacaagcttctaaaatagatcctcgttacctcaacagagcattcttgctgcagcaaagaaggcaaagtttaacaatggggaccaaacctgttcaagtaagagggtggccgttcgaaaaaacaatggggaccaaacaatgcaagcgtgtttgatgaattttaatctcagtcagcttttccaaaccaactgacaacgcaagcagggagtcatcgtcaacttttcctttcgctagttccctgggccgggctttattctggttggtcaacaaacccaaacatttgcacacgagactgatgtgagatgcaagctacatggcatgagacaaccgctaacctccctacaattcaaccagataatgtagattatgcgcataaccagtcagtaaaccagcgcgaacagtatgttaaatggactagcacctggcatttgacgacccccaaatgcccaatgttacgagaacacgactagccgatcttcatgacacttccctgcaacaaaaataaataatgtaattcctgcaaaattgttgtactcacttcttccctaaatgtttgacaccgtagatttttttaaacatatttgaccattcgttttattcaaaaacttttgtgaaatatgtaaaactatatatatatatatacacataaaagtatatttaggaatggagggagtatttcataatgaggcctgaagatataggcacattttatcatgactggaatatcacatcgcaaccgcaaacataatcaaaagacagcatcatcagttcaccgccaactttccattgtaaaatcacgaccaccatatactcagaaactaaattgaaacaaagtatcagcacattcgcaactataaacagtcacatcaacgacctggtctatgtttaagaagactctagtgcatttttgtcattaatagttatacctcaaaatatcaagtaaaaagagctccgtcgagacgccgaaaggaattcttattcagagtatataaaaatggtgaagctgataaagttcactatcaaattacatatctacactagtgaccctaaatgtaatagcagaaatcagcaaggatgaatgtatgaacgatttcgtaatgtgcagtgtgctcccagtaaattaaagtgtaaacaaagagaactaaaaagaatagtcactccaaaggacatagatgattctacgtcagtgggacgtcgttcaactcacgatctccgtcgaccgtcgcttgcacatcggacggactttgtcgatcttgccatggccggaggccgatagtcccagtgagctcagtaaggctcctgcttgcttactctcacccaacacctcctgattccagtgaatccacagcatatgcagttgacggcggctacgtacttctttgaatgaaagattgtctccagtgggtggtactctccgacgaaatgcatccatgtcagtcaaacgaccgacgacgaaccgtcaagagagagatggactcggattcaaggtacgtagaactgtacttcgtttctttttagttgtaactattccgaattggatatggcagcacttagtttttaatttgcctggaagggaaggaaagaagacaactgatcgatacaagcagtcaccagatatcatcatccattcatcatctctgcaattcagttcagcggcatcgatcaccatgagcagcagcatcaaggatgagatcgacgctgcgttcgcggcgggagcaatgccgccggagtggcggccgaggctgctggcgtcgccgcggctgggcgagcgcgacgtcgacaggatcgcggcgtccatcgccgagatccattggaacctgcagctcgacgggtcgacccagctgtccgtcgcttgtgtggcgttctggttcgtcgtcggcgtgctggtcttatgcgtggctggccttttcttcctcgaaaacgactacatgagtggaccgttcgccgtggttggggccgtgccctgcgtagtgatcactcctatagtaaccgtggcttatgagcgccgtcgacggagggccaagatgctcatggtgcgaacgcgaactgtcctcgagcactttctgcttccacctatttaatctgtactggtctagcttactattgtattgatgatgatgtcttttcatgtaaaagaaaaaagaaactatatacgagcttgtttggattgaagctaatttttatatcaataaatgtttagtatgctactagtttttgcctataataattaaaactagtcacatagtcacactttgctcgacttttgatcccacgaaaaaacttctatatataatttattagtttagttagcttttaagaaggttttgacgtaagttcatttatctagtaagtataaattgtctaaccaattatagatttagctaaattatactagagtacactccctccgtaaagaaaaacaacatagtatgtgagaatttgataccacttaggaaaatgaatctaggcatgatgaatcactagaaggctcctgttttttcatcgtaattgcccctctctttctttgttcatgagtttaagaggtggcactataaacctccagaaattttcatatatttagctcatttgtgtttttctttaaatgcatatacttttttatctaatggccattgtttattcaaactttttatccgacggtcaatacgtttttgatgatgtgccgtattcttgtgtaggaaaacttgttgcttttacttggtagcgccaacaattgcaaggttttagtactaccaaaattttgttaggccaaaatttagctttgaacctaacaaacccttacctcttttttacctctcttacgtatcgccattagacttcctccatgattgctcgtcttgagtccaacatgcattcgaggatgcactggtcttggcctgtttgacccaataatatttagccatggaagcctcgttaattagtacgaaaatgcaagaggtaaaacaccgattggcatcactagatgtctagatgtaaggggaaggggacgtatggtggattggtggtacgcatggatgtaggactgtggataaaccaaagtagtgcggcggcctcgacattcagaatctggaattatagaacaaggagaaaacggttatttaggttatgtaaatagagtagtatggcaagattttcttatgaaaaagtactcacacttctgataagggttgatgggtgttaaggctgatatcttaaagtttgggacttttgatatatagaacaacactcagctgagattttgataacaacactcagttgagaggatcgtaggatagataactcctcttttgttaagttgtctgtagaataccgctacagagcgttcctgctgatggggaccaaatcatgcaagcgtgtttgatgaaccttaatcccagtcagcttttcaaaatgaaatggcaacaaacaaaaggatttgcacaccaaactgatgcgagatgcaagctactaggcatgaggcaactgataacctccctaaattcaaccagataatgtagagtatgcacataaccagtcagtaaaccagtgcgtacaatatgttgagtggactagcacggggcggctttgacgattcaatgtaacacgactaggcgatctttatgacacttctctgcaaacagaaattcgtaccacaagaatctctccgtagctttgcccggtaaacaatataactagccgtgccccccgcgcgatgcgccgacatcatccaagataatcttaatcataaaaaaaaatcataatagtaaaaaataagcatgattgaaaacaacatagcacataacagagctacacaacaataataataataataactcgatcagaaagagaatatcacgatgttctcaattttgagtgatttaattggaccataatattttttatataatcaatgttacacgaacaacgggtatctcggtgcataatacaattacatcaacaaaagtaaaataaacaacattagtatttcaatacctagcagagtagcagttcccaggaagaccaatcagtgggcgatgattaatttggaaggatagtcaaacaaaactatgtccacagcacatcacagttgtgtcccctgcgcattgcgcgggcatatgaggcaacctataataactcaagatcagaattgggcatatcacaagataacatgcaacactgttccacagtaatagcgcaatatcaaaaagggcatataatctaacaatgttctcagttttgaagtgatgtaatcaaaccaaaagtttttttaagagcaatcttacactaacaaacatggatctcggtacatagtagacaacattcttaattcgataccagcagatcctaggaaaaacgaatccttgggcgatgattaatttggaaggacaacggacatcacatcatatatatggcagtggcaactcatattgtatatgttttacaatctatacaaattggccattagcaataacaaatagaaattaaggtttactgctccatgacccagaaccagtgattttatagccaattctggagatatgagagttcagtattctcgccagcttgtcattaattagcatcgatctattttagccaccaataagaaaaggaaaatacatccacattttaaccttgatgaagagcatgcatatcccacactgtacaaacaacaaagcataatttcaacagaataaaacagtttctaatttcctaaatgtcacgcccagaaattcccgaatagaattccaagcagaatgtgtattaaaatccccgtccaggaccagccggggtacacaaacgacaatgttgacattcagatccacgtcttacaaacatcataaaagtcttacataaatgcagcggaaaaacgaaagataacaggagctaagccttgacttgatctgcagcgggaacaccactccacaggcatcctcgacggcacggacgaagcctactcctcggagaaaccaccatctgacacatactcgtactctggggttggggaaaatggagcaagactgagtactacccactgtactcagcaagtcataccggaataggggtatgatgcagggaattatcataggagagctagagtggttcatttgcataaagcgagcatttataaacagaagtttaaagaaaaaaacagtcgcaataattaatcaatattaatcatctgctgtccaacgctatcccacgttgcaacaagcccaaccatccacctaaactatccaatttcattagactaaactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagagaaaagctacactacaagcccagccgttgcccacgctggcttgtggtaagtacgataagttcttccagggcatcccgcgaaccggtccttaactgccatgggtgcgaccaacaaaaccatgcacccacagcccaccatgtgatttattttaattaaccaacaccgaagcggtgtcactactccaacattaccattagaacctacagtctaaacattaataggattttccccattgtgtattagttgaactaagcatggctaagcaattcctagtccaaagtctattcatgttataacccaagctaacaaaggagcatggtatcaaaatagcatggctgtaacaataggtaaacatcccatactaacattataaaacaatgcagtatttgaagaaaaacaatagagcatttgcaatataggatcaacatgttcaagtaacaggcatgacttgccttgctctgctgctgaaggaacctcggcgactatttcgaagtacaccggagcgtcggaagaaccggaatctaagcgacatacaaagcaaacaatgcaaacaggctataagactactgaaacagagaacaaaaccatttttaatggattctacacattttccttgatttactgagacttgaatgggcttaaacggagcacggatgaattagttatgaattttagaagattcactgtgtttattactataacaaaaagtccttaaataatttattgcgcagttaattcccagggctgacgtcatcaagggggcggcggggcccgcatgtcagcggctcaagggaagagaggggcgccggcaagtggggtccccgggtcagcggcccaaggctgccggtccaccgtggaccgagaccacgagggtggtccacgcccggggccgatcggacgggcggcggcgacccggctcagttcggctcaaggccggccaaccggccacggcgatggcgacggcccgcgcgcgcgcacgcgttgctggcgacggcaaccggcggcggaggcggcggcgcaaaggcgacgcgaaggcggcggcgctaagcggcggctaggaaggagagggaggggaatagaggggagaggacgcctcaccaagggtggccggcgcggaggaagacgacggcgaacggcgacggcgaacggcgacggcgaccacgggcaaacggcgacgacgggcggacgaggtccggaatgccctaagggaggaaaagagaggttagagggagggagacgaaccacggcgaccggcatccatggccgaaggggatgagctcaccggagcgcgaggggatgcgggttccggcgacgaatctcgacggaggaagggcggacggggtggatctcggccacgcgaacccgacggcggcgacggcgcggcgcggcggcgagtctagcggcggctagaggcggccggagtggcgggaaaggcggcggcaggcgggtgcacggcgcgggagcgatggagagctcgggagagttcggcgaaaaggggaaaaagagagagggggtggcggcggagcttaaatagggagagaaggggccggacgtggccgggagaggcgggaatcgccggccgacgtgggggagtgggagaggagagagaggcgggattcgaaaattgaatcccggtcatctcagacgcgggcgcgagcgggagagagggggaagcgggtgcgggagacgcggcgcacgaccggggcggccaacgtggcccggagggggcgggacgtgggcgcggcggcggtttcggcggtggtggcgacgtggggtcaggcggccggagaaaggggacgaccccgacaggtggggcccacctgtcggcgtcccggggagagagggaggcgggcggccggcccgcgcggcttagctgggcctcagccttcggccggcccagcgggaggagggggagaaaaaggaggaatgggccgacggcccattcaaaggaaagagagaaaagaaaagaaagaaaaaggaaaaagaaggaaaaaggatttttcctgggattaaaattgcatgtgctcaattttaattggttaaaattatttcgagagctctgaaaattccactaaaaatcttgttagcgtatttcggcatgtaaaactcaagaaaaattccacatgccaattccgattattatttgcattaatttattaaggtttactcttgcttgacacaggtattttcttgagaccatttataacttcaatttaggcttgggaaagaacttcggggtgtgacactaaagcatgctaagtaatatagcatcagtatataatagcatgagaaagttgaaattacccggactggcggtcacaaaagcatcagtgaaagcctgtaggaagccataaacccatgagctatataaaatacgcaacaaaccactaaaatgccatcacaatattcagttatcgtgttagctaaggtccaatgtttgcctcatattgtggtctctgccatgcgcccatgcctgaaaacgaaaatggatgaaagtggtcagtgagatgctgccaaatataaatattgacccatgcaaaaatatatgctacagtttagccgaatactggtttatatgataaaaaatagagtagggaaggtcgtttatcaaaacaactaattaaataatgatcatgcatagggatataacaattggacaacaaataagacttcccaaggaactacccaaaaaactgaaataataccaggcaataacaggtagagaaaccctaaagagcaattgccaagtagctggaagccttgaacctgaaatatgaaaaacataggaattagcaaacgaagccactcaaagaagcaagtacactattagaaaataaaaaaagataaatgaaacgaaatatgcccatgtgttgttgtggatgattgaaaaatcgtatagatatatttgagataggatgatggcacataaatatgtagctaggtatttaaacaaaaggagagggaaactgtgttgcatatatctgttttagtagtaactgagctactcatcatatagtattgggatcacatgtaccaaaacaaaataaagttaaatacctgaggcaaggaaaatagaatatgcatttaagtgtatggcaggatgatatgaaaaatagcttttaagcaatactacactacaacaggaagcaagtggatttgacaaactttggtagagataggacagtactcttcatcaactttacattgaaatcatccatgcatttcttgggcatagaacaatggccatgtaaattatcaattgtagagtaaaggatggtgaaataaattaattggacaacataatgataaaaggggatcagggagctgacgaaccactgtcctggattaaaatgaagatatgcaaggaaaataaataaaatattcattagatattgatgccagacattaatattgttttggcagtgagaagtggccaaacggcaacaatcggaggacttctttttattgaaaaatcgtatgacttctggctggatgggcctagcccaaacctgaatcaagattagggcctaatccagatagaaaataatggggagatcatacctcactatcccaaggaaggtgacggcagcacaatggctagaagaacacttgctccactccatagcttgtacccaaaccctaactgactcacaagataggtcatccaaattgacgctgcaaaggatagaagcaaggatgctgaagatggagaagcagattgagttagggcttggcttgctctgctctactccatacccataccctaactacagatagattcatcacaaaataagtcatccaaattgatcgctgcaaaggataaaagcaaggttgctgaagataagaagcagatcaggctagggcttggcttaccagactgcacatgttgtcaacaccgtgcgaagaggtggacgaaggcaactatggcagcgggcgtgcacccttcgtccaccttgagaaattggccggtcgagcaagcgaatcaggcggaacggtggcggcgcttgcaggtggctcgcaagaaggcgacgaccccggccgctagctccgcaagaaggtggcggcggcgggcttcgcgactcgcaaggggaagatgaagatttgagtattttgggaagggaggcgcagaggatgtcgaggatcgaggggattggggaagctatgccgggcgcagcgatgtgcatgtgaggcgtggacggttggatcaaatcaacgcgtggacatcggacggtgcatgctgggtgatgactgtagtactgtagcatcttttcctgggctgaggttgatcaaatcactgctagtagtgggttgtaaaaactaaggatttaatatgatatgatatgatatgatatgatatgattcctactacaaaattgttgtatttcaaaatggggcctgaagaccaaggctcattttaccaggactggaatatcacattgcaaacacgaacataatcaaaagacaccatcatcagttcacgcgccaacttcccattgtaaaatcacgaccaccatgtacccagaagctaaattgaaccaaagtatcagcacattcgcaactataaacagtaattcaaggacctatgtttaagaagactctagtgcacttctgtcattaatagttatacctcaaaatatcaagtaaaaaaaaggctccggtctcggtcttggtaagagatacagaaggtcgaacactagaacataactgaatgagtacataaaaaatgggtgaagctggaagttttgtatccttctacaactcttacaccaccccagatggaagtcgtagaaccagctgcccaccaaccaaactcagcacaaccggcggctcaggtgggtaggccggcggccggcaaagaggtgagctctctccacagccttgtccagagacggtgtcgacttgtgtccaccaggcactagccgactcacgcggcagagaagttttgcagggtaagcaacctgaagctgctttcatgcagccttgcagatgtaatgacagaaacatacataatacatgcaaaatcatgatatgtaatgctacaggagaatcgaataaggttggcgcttggaaagaacaacatttttaattgttggtaaactccggttacatttttacagcaagtgtatttggggaagaaaaaaaaaagggggaacaaatgtctgtcctgcagtcctggactaccgcaaactcagaacatcataatgtccattaccatcaaaaagaacctgtattgcattccgtccatactcctttccgtatttggtgaataccctcaaacctccagttttttccaccacgaacacggtgatgggcatcctagcatagtaaaagtgaatccatcaagcccaatgtacatgcataagcattccaataggataggatactgaactaatatgtactgcatctgaaatatggataatttaaaaagtatcaaaaatcatggctagtactcactttaaaacatgtgacgccatagagatttctatctcacctccccacacatgaggtttcctcatctctttgatataggaatggcagtcacctcaacaagcctgcaaattgatgtctcataaagaagcataagaatgcataactcaacaatatttcaatatttagaagcagagaaaccaaggacaggtagaactaaccagggtttgtcagcacattccttctccaacgcatcacaaacctaacaatggcaccatttaaacagatcttttaaatgataaattgacagagaaatggctgtgttgcttccagtatttaagaaacagtatagattcacattgcaagtaaatctgaacattacaagcataccttttttcttaagtcatcagccatatctttctcaagattatcatcaggtggaatcatcattagtttaatataagcaccatgtactatagatcggaataggcatcttccatctccacagattcctgtaggttattatgtcagcaaaacacgaatgatcagacgatgcatgcttcatattgtaatttttttattaaaaaaaatcctctcaccggtaacagaaaatttagtattaacttctctctcttcactgctttggagcctgatagcattctccttcacaggaaggatatcaaccttttgctttggggcacatttgttcacttgggatttgttaggtagctcgtccatgatggcattctccttcatgatcctctccatgttagcaacccagctgtactcgccagtgactggacagcaggaagagtccaccacacggtcagaaaaaacatccctctccactgtgtcaacgagcacctccttcatcactatgctcaaattgtcaaacttctcatcaagcttcagtcctttggtggcagagatgagcttcttgccctcaaactccatgaactgaccgacagcgtactcatcaatggcatcaaccatgtacaggacctcatagtccttcagcttctcaaggaagggggagttctcaacagccttcttgctctcaccagtgatttaatagatatcacgctggccctctttcatccgggctacatagtccttgaggctggtcaactcatcaccactcttggtggagtggtacctcaggagctcagcaatcttcgtcctgttggtagagtcctcatggatgccaagcttgagatttttggagaaggccttgtagaatttgttgtagtcttccttgttctcagcaatctcaaagaacagctcgacgcatttcttcacaaggttcttgcggatcaccttcaggatcttgttctgctgcagcagctcaaatgagatatttaggggaaggtcttcataatcaacaacgccctcgacaaagctgagccactcagggatcaactcctcacagttgtccatgataaacacccggcgtacgtacagcttgatgttgttaagcttctttctggtgtcaaagatgtcaaatggtgctcccttgggtacaaacaggatggccttgaactcaagctgaccctccacagagaagtgcttgacagccagatgttcctcccagtcgtttgtcaagctcttttagaaggctgcttccttggtgatcacctctgatttcctcatccagatggcttcctgcttgttgatcaagttgcactcatgacagacttccttgatcttcttcccttgttttttcttctcttccttctcctcatcaacatcctcaacctttccctctttagcttcctcgttctcactagtaatctcctttgaatctgagagaggtttctgcttgttcgaggaatgccactcatgagagacttcattgatcttctcccctttcttttccttctcctcatcaacatcctcaacctttccctcttcagcatcgacttcctcatcatcacagatttccttctcaatctttttctcattcagggagatagggtagctgatgaactcagagttcttcaccagatccttgaggcgatgctcctcaacatattcaggctgtaagtaaatagcagttgtgaacaaacagcatagggtgcaaataccaacaacatacatcgcagcaaataaaatcatataatacatcactaatagctggaacatggttcacacaagtaaaagtaaaaacgtgttgtttcatttcagtgttgacggaaatcacaatatatttacacaacaacaacacaacattaataattggaacaagaccttaagcaaataatttcacttatatatgcacattgaataatactttaatcctaattgcagaaaaccacaaataaagaaaactatatgctcactcatatagataaatcgaatggtgttcaaaggaaaaactagtgaaccaaggttttacctcataactgtcttcagatagtgaatccatttggagttgcaaggtcctagtggggggagatcctcttttgatagatcttgaataaatatgacttctcatcctctttgaaaaatgaatttccttgtcctagagaaaagtggagtaaggtcagaaagcaggaagaacaatattgtaaaacaaaatagaatgggaaataccctcagctctatccatcgtcgctttctttgtaagattgttattcttcttcttttggttgaagcagtatcctacggaaaagtgcacagtgagcaagaaaatacaaacaaaacatgtaaaacagaatgcaggtgaactatacgttgtcgctgtgttttctttttccttggccaaagagcccaggcggcgcaggaagcaaataaacttccgtgaaggtcgttttcttctctgccctgtcctcttgacgctcattgtgatgtttcttttgcccatcaatctttacaattgcttgattctcgatatcgattgcttcattgtcagaatctggattatctgcaaattattgtgttcaataagtgcaaaccacaaggagaaaaaacaagtgaagagttttaatagagccctgtatacttgagattgagagttacttgtaatcattgcgcgaatcatgacagggagctcaatcacatagaagattgtgttcaaaatgtatgagagctaaaaggagaaaaaaaaacaaattaacaacatgactggtatcacagactgttaaagatgatggttatcctgtcatggcctcaggtcgtgacacttacctggacataaattttcatgctgtactgcttgtagacaatcaaaaccaattcactggcagcaaatagtatatttggtacatagaacagtatgaaaacgtgaatttctagtgacagagttgagtaccactgcaaattcaaatgagacaataattaggaaactagtatactctttgattgaaagaattcaataagtcacttaccaagttattgatctgaactagatggcacaaaacaatcataacatttcccagtgatccaaataaatgctccagcagtctcaatatgtcgtctcccacatttgtttccagcaaaaccaggattaccagaaaactgatgcatataaaacttacaagacaaattgtcttgtagaacaaaataggttagaacgtgaatgctctaataacaaagggaaaaaatatttgaaaagatacttacttttttcctttccttgttgtgtctataaatagacagcaagtggtagatgttcagtccacaagcgactgaattagtcattaacattgacagctcaactcccttattgacggcagaatagatcatccacgtcgtgtttcccaccaagttaatgatcgtaatgctagcattccaaagctctagtgtcagcaagtatctacccttcaaggcaccgtaaattattgggattgctgcctgaaatattgatatggttcctccaaagattgaaccatattgttggataaaagtggccgtggccttaaacaacaaaatagagacaaattaactttcatatgttatattgtcatcataactagtaatatggagcatttgataatacaaatcaaacaaataatttacaatttcttttaccaaattttacaatttgtcctgtgacaataatttaacaaataaaagttgtggtgacgttttacaactcaaactacttatctgtaataaatgttgaaatatgagtgaattgtgcggtaggacgacaaagggcatgttcagtgtgctagcattttctttttccagagaaaagtttggtaccattcaagttcaaccataccaggaacaaaagtaatcctaagataactatgaaaacaaaagcaatcctaagaaaactaacaaaagccctgccgactgccacggtagctgctaccacacacacgttctcaggcgtcgccctgcgccctcccctccgaacgtacctggtgggctggtggcccggctgctggccgcgctgccgtcggccgcacctccaccgtcaagcgccatgctcccctcggcgaccagttgcgcctccccgccggccaccgccgccgctcgatccgcaccaccgcggctccggctccggctccgccgctcaatccgcaccaccgcggctccgctcgcctccgccgccgcaacctgctcgtagtggtaggccgcgctcggttttccagtctgggccatgtccaaattgggccggccggcccatcaacccttcctcctcttgcctcgtgactagctttttctcgccatccatggcgacgaagacgacgcagtgcagttctacgactagggagtacccactcatcagccggacgaagaggagagcagctaacctagcacaagcacgaggagtccccattccttatcgaatcaccatttctgatccccttcctcatctggagtgcggaacaagcacgatgtacgactacgagtcccccattccaacgcgaatcaccatttcctcgatcgatcgcctccctcatccggaggccagaacaagcaccctcatccggaggccagagcaagcacgactagtcccgagtcctacgcgaatcaccattcctctcgacccccttccgcatctggaggccggactggtcaccgagctagcttagcgcccaacgcgtcctcaccgagttttcgcctaggcccgccgcttccgcaagtatgtcgtaacgcacgccgtccccttcacctacacgcacctactccgtcgatcacctgcgctctactccgtcgatcacctacggcccggccgactcatcagtccatctatcacccttgcgtgaacgtacctcattcatgactgcgtacatccttagcgacgaaggtgacggcaaaggtgctcccgggacgccgggtgatggcccagtcctcggcatgccgccgaaaatccgacgagacgcccgagctggagtaggcgatgaagcgatccagggggacgaagaagcgaatgtcgtagagaacgccggtgtagtagaaggcgacgccaccgccgtccatggtgaggaggaggacgccgccaccgccgccgccaccgaccgcatcgccttcctcgccgtcctcgccgccgatgcagagagagatgagaatattttgagtcgaaccattctggaggaggagggggcgaggggcgaactagttgtgagttgtaactgggagatctatctggtttagcttttatacccacagcctctccctccacgccggccgggtccggacccctccacgcaattgtctccaaatttcaaattttgaaattgcgtccaccgtgtaagaatttcatcgacgcctggctgcattatgtgtactcctgtaaaaagttatttttttgaaaccttagccagcttagctggttttatatttcagaagataagcacggtacaaatgccaccaatggtgacaagggggaaagacagggggaggagagcagaaaaaaaggaaaattacaacaaaggatgagaggttaaggcgctattctcgcaagattttttgcnnnnnnnnnnnnnnnnnnnnntatttcgtccattattcttgccgttagttgagggatttgaagttctttatctttgaaaactcgtctgttcctctcgcaccagatttcccaactcaagagcatgtgcagtgactgcatccccttactttgacatttgctttgttgctttgttcttgattcccaccagtcaactaggctctcgtccggattgtgcaccgggaagggttggttgtggttcattctagccattattttgtcccaaatttctcgcgtgaatggacaatccttgaataaatgttgcgccgtctctaagttcctgtagcagagttggcaaaagtagttattgggccattgtcggagttgcaagcggtcggatgtccatatcctgttttgcaggacaagccatgcaaagtttttgcatttggatggcgcccatgtcttccaaatcaaagtggcggcctttgagtcttctctaccggcgaattgggctaaataagccgattttgctttgtatttaccggtatttgtccatctccaggtgatggtgtcttcaactccttcctccaggtttgtctcattatcccagataaggtggaacactgcgaagaattctcggatcagtggcatggacagctcatgcctaatatcctcaatccatttgtcattggttaacgcatcctaaaccaagcgttgctttcctttagagtggttgaaaagcgttggcgctaggtatttcagcggctggtgtccaatccatttggatgtccaaaattttgccttccgcacattaccgattgttacctttgttgtggccgcgaagatttgctcatctaactcatcgcaggtggggtgttgtcccaacccgaggtttgtcagggcactcccactcaaaccatagccaacggagtctcaaagctctcgcgaatttatcaaggtccaacacgcctagtcctcccatctttattggggagcatacttttttccaattcactttgcacttcccnccgctaatctcttgatcgccggcccagaggatttcttcctaatcttgtccatgtctgtgaggaactgtttaggcggctttaaggcggtaaggaagtaggttggtatggagctgagaacagacgtgactagcgtcttccgccctgattgctggattaacttccctttccatcccgctaaccttgattgcaacttgtccatcaccggttgcaggtgtattctcttgatgcggcctggggtgagcggcaatcccaaatatgttatgggaaaattgccccgctgtccattgaaattttccaacacctcagacaggttctgctctgcgcatttgatggacacgactgagctcttgtgcagattcacttgaaggcctatggcctcgccgaagaacttgagaatgctaatcaagttgttgacatcattcctgatcgggtttataaagatcgctgcatcatcagcatataaggatattctgaaccgcgctgctcggtttgataacggagatagaagcccctcttgcatggccttattgagtagtcgttgaatcgggtcaattgctaggatgaagaggtagggcgagaggggatcaccctgctggaggcctcgcctgtgtgtagttggttctcccgctatcccattgagtaaaattctggatgatgcagtcgataggagaagcacaatccaatttctccagcgctgactaaagcctct

SEQ ID NO: 68448 - DNA, 4478 bp, Oryza sativa
  unsure (1)..(4478): unsure at all n locations
caaagcaatgtgggggtcttgggatacagaacctagaactacaaaacaaatgcatgttaagcaaatggttatataacttttgaaatgaagagagagtttggcaaaacttgttaagaaggaaatacctatctaagaaaactttgactcatgtagagaaaaaccaagggattctcatttctggtcaggactcatgatggttaagaacatctccctttcttgtggatcattaaaagtgcacaatgggactcaggtcagattctaggaggataaatggaacgggaatactccctttgctgctcgttacctggccttatacaaccttgtgataaacaagaatgaatcagtggcagtggttatgagtaaaagacctctaaaagtgtcctttaggagggctattgtgggtcatatttaaaagcttggttggaagtggtctcaaaggttatatcaataaaattgaccgagcagaatggtacctttttgtgggagatacaaaagaatgggcgtttctcagttaactcaatgtacaaagcaatcatgtacagggaagtcgttcctaaaaaggacatgatttggaaactcagaataccactaaaaattaaaattttcttgtggtacttaaagaatggagtaattttaacaaaggataatttagccaaaaggaagtggaaaggtaatgttaagtgttgtttttgtgattctaacgaatcaattcaacaccttttcttagattgtattttagcaagattcatgtggaatgcagtctatatatcttttggaattcacccgtctaggaatgttgctagtatgttcggcaattggctaaagggggtttaacccaagctaagagctcaaatccttgtggggatttcagctttgtgttgggcggtttggttatgccggaataatgtagtctttaatggctccaatactaattttctgttgcaggtgattttcagggggactttttgggcaagacaatggtctttgctacttaagcaagaacatggccaaaaagtgacacaaggttgcttgattctagagaagagagtttctggctttttcgcaatgaagggatggaacttaacgaaaagattgggagattaatgctctctggttttcttgtgtggtatggttgaaactttgtattaactttttaagaatttctgttgctagagcctaagtactcgggtctagttgcttgtgatggtgttaaaccttgtgtaagggtgtgagtttatgtactcttgtaagtttcgttggggctgtgtacatccttttttgggtgtagaggccggtttaatccattatctaaaaaaatgtaaaggatgcactatatggcactctgaagtaaggtttcctgagtatggtcttttggtgaacaaaagatgggagatggatttttatcgctcgaggagatatcctctcgttttcttattttgtacatggcattgaaaaaatcatcagaaaattttgagaaaaaaaatggaaagacagaccagtatgtgatgtgtcattccacaaccatgtaagcttaaattcaacttgtacaattagaaacaaatatagcaaatttgactgtgaattacgtgttttattcaaagtcgaatttgttgtatgagttgaatttaaacatgcatgtttgtagagtggcatatcacatattgatctagcttgctttttttcaatttttttagtgattttttgagtgatattaaaacaagaagacatcctgtcaaggtataaatagtttcctaaaaggtgtatattttgtaagactacaatctagggatagagagagagagagaagagaagagaaaatctaagaaaaaaagttcaatccacatccagaaatgaaccagtggttatggttttgcactcactaaaaaccagactagctacaccgtaatacactttgaacagctacataatacagagtagcagcagcgcttatatacacagtttggggacaactgcacaaataaacccaacaatttagctatttagacgaccctctcatccttctgcattcttctctaatttttggatcgaaacacaaatttatgcttgtgtgttatgagccactactatttggagcccccactatcctctgcacataaagatcagagcttagtggaggcacgacgaagctcatcccgagcttacacagccatccaaagctgtatccttaaaatgcgcaagctgctaaatgattgtcagtctctagcctgaaaatgccggtgccttccaacccacgttttagttcatcccaaggaagaatggtaaatagagagcaaattaaatggtagaggctatttaacctccatggtcatccaagttaagaggaataattggcacgggtgctctctgtttatatatttattatatacagtgcatgctagagattctagttatatttgtctttctaaaagaattgatggagacaatgatatacacatgcacatagaggtacttggaatctgaaactcatataggtattgacaattagaagcctcaaatcagcactatgatttttgggattatttttccttgtactgaacaacctgcgtacatagctagatgcatacatatgatctgaaaaaataaagatcttaagaaatcttcgtagacgaagatttcatgatgtaacatcccgtctctcccaggccgggcccgcttacatatggtagctttcataggtcatagactgccctcacagatcaactttgtccttactagtgagtgtgaactcaggaagaacttgaagaacttacatatcttttctgcacacttgaagaacttacatatcttttctgcacactttatccgtccttactagagccctcacagaccaactttgtccttactagtgagtgtgaactcaggaagaacttgaagaacttacatatcttttctgcacactttgtctgtccttactagtgtgaactcaggaagaacttacatatcttcttcccgatcggtcacccgtccctaaattgctccaagccaagcacgattaacctcagagttccttagtgatcggcttccgaaaaaaaagttgcaacttgttgatatgagtattttattaatcctattaagtactaggctgggatgttacatatgattaacatcttttttacggcatgacaaagatgatagatttgctgcacgttaactctctcgtggttcttactacccatgcctccatagctacttatggtctgccatacacaccctctgcaataccactggcgatgtatgagccactcacgtgggaccagacccgcttgtcagtgacttctagttctagccgcagtgcaaaggatctatgcgcattttatcacaactgttgcatggcctaaagtcccagtgcctcccagtcctatagttcgagctactaaaaaagaatatatatatatatatatatatatatatatatatatatatatatatatataggacactcatatggggcaccatggtgcccgggcaccatggtatgaaatacacaaattcgtccaaatttttcaaaattttcaaattgtgagtatatacctagttataagtattcgattcatacctatacctagcaacaaaacaactcaaatttaactttatttcacaatccattattacatacctaactaattatatgtttggatgctatatacctagaatcaaaatctaacaaaagcaagtttgaattcagttcaaacttgctttgaactagttagtaaagtagttaacgttaatacctaaatatttgaaaaagtttcatactcatttgaattgggtatatagtaaatttcaatcatggtgcccgggcaccatggagcaccaaacaaatttactatatatatatatatatatatatatatatatatatatatatatatatatataaagggcttcatttcgttagaaaatcacatattcatttccttcgtatgaacagagaaaaatatgatgactcaaagaaccctaccacgaactttgtacagcgtgcattacttagaacgactaggaaagtaagataagataagcaagaataaaaaaatatttgtcggaatagcggaatagaaaattaagaaatgcaaaaatgcagaaaaagaagtgcctctatttagagatttatctacttagatgaaaaaaatcatactctatctatattattaacgaatatgtatcccaacccatctcgaggtatttgtatcaatacctattcggaagatcccttttttctgtgccaggaactaaatttgaactggtgacacgaggattttcagtgtatgtatgtatgtatgtatgtatgtatgtatgtatgtatatatatatatatatatatatatatatatatatatatatatatatatatataactaggtatatactcacaatttaaaaattttgaaaaatttgagtaattttgtgcatttgaaaccatggttgntgngctcatgtgatcgcattcagaggtacag

SEQ ID NO: 68449 - DNA, 650 bp, Oryza sativa
tgataagcggaaacagtttataaaacaaagcttcctaggctttgcaacacccagtgcaaatttccaactctactgacagtggcggatctaacatgggacattgggggttcagttgaaccccccaaaccttcttaggaaccatcaaacagttactagtattaaggttaaggcaaatttctagagcagaagctagggttaacgcaaattcgagaaaaaaagtgcgtgggtagagagagagagatgggaaagaggatgtgcgtaacggatgcggcggaagcagcaggacgagcgacggcgacccagctcgctcgctcgctcgcacgcgcgattggatggggatcggcggtggcggaggatgtgctcaccaggatgcagcaggatgaatgacggcgccctgctcgctcgcgggatggatggggatcgccggagccggagccggaggcggcagcggtgggcaagagcaaactaaagaggaggggtcgtcaggataagggttaaggcagtgttcttccccataaattgcacccacggtgcaacaacttgtcaggtgggtacaaataatttttaaaagttactttaaaaatcatatcaatctatgttttaatttttttaattaatacttaattaatcacgtgttaataggcaacacc

SEQ ID NO: 68450 - DNA, 1500 bp, Oryza sativa
  unsure (1)..(1500): unsure at all n locations
ttcgtgaaattgttattctcttcccctttttacgacttaaatcaacctaacgctcttaattcggacatgagctctgccagctacctcatgtgctagagctctgcaattcagccctaagcctaagccagaaagatcattttggtttttaagcatagtaagttagtaacacaaaagtcacacatacaagtcgacttcctttaaacaggaagcaataagcaaacttaacatttcgcatactgcatgctaatttcttttagtaagacacaaggaaaaagatggatcgaatcctttcagatcttctacgtagcaacgtgaaaatcacaaggcaatattcatacccaggcaaacaatcagaagacaaagcaacctcaaaagaaactgacgattgctttacttccaggctacagctgacgaaaatttccgtcctgattgctactggtggagaaggcaccgatctgatggtgattgtgctttcaattctcttcgcctgcgcaaaatccaaggtagcaggcatacttgaattcctgatacatcccaagccccagaattcttgccagaattatattgagaaccaaactcatgcctgattccatggccttgtgtatgcatcatgtaggcatccaacttccttctgcatcaattcctctcggtgtgtgtgtgtgtgtgtgtgtgtgtgtatggtgttcctttaatggctcatcacttaacaaggctatggagaattttaacactgactgaatcatgtaaattgtaaaaaaaaatgcttatataggatgacacaccgatttcggatgactgaaatctcaagccaatcctctgcatacattagcacctttgaaaatcgtaatatatgtcaaacataccaagtggtcacttaagactggtacaggagaggaatgtgacatattacgatgttaattagctgagagagtgaaacattcatggtcattttattcggatctaccttggctcgcatgcaagtgaaaatgaaccacccgtcttctcggggcatacatcgcaacgtgctgcagctatatcctaatcagaatcggcgctaacaagagctgggtttggagagaagttgagtatagtgcattgggatcgtctggtagtcacactgagttgatgctacggttagcttcggttcccggtgcatcccaatcctatggctcatgagcacagcttctttctttctttctttcttatccctgcacatctcgtgaaagctgagtcttcatcacatattgtgcagcatttaaggtagtatttggttggtgcgatggaatgggttgggatgggacgaacctgtttttcgtagcgtttggttgggggatagatgggatgggttggtccctttagaagaatattcccctcagatccaagaccaaatcatccagcaaaaacgagtggatgagttcgtcccacctgggtcggatgcacggcgtgagaaaagctgatgaactncttgcagacgaagaanntgcaaattcaatggcgcgc

SEQ ID NO: 68451 - DNA, 1204 bp, Oryza sativa
tcggttaatcatagataactaatcaaattcatgcgtgcaagcagcgatcaaaggagtggatgatgaataaggccgataagctaaaacaagctgtccgtacactgtttaggacctgtaatgacatggtggacaagatgcacttagtagacgctgtccaacgtcttggaattgatcacctttttcaagaagagataagcagcacactaagcgatatcaatggaagtcaatttgctagcaatagcctccatgaggttgctcttcgctttcgtttgcttagggagaatggcttttgggtatcaccaggtatatatcaatctctctctctctctctatatgtgtgtgtatatatagatattacatatatatatatatatatatatatatatatatatatatatatatatatatatatatatatatatatatatatatatatatatatatatatacgtaatatatatatatatatatatatacatatatgtatatacatatacatatataggacactcatatggggcaccatggtgcccgggcaccatggtttcaaatgcacaaaatcactcaaatttttcaaaattttcaaattgtgagtatatacctagttataagaattcgattcatacctatacctatcaacaaaacaactcaaatttaactttatttcacaatccatgattacatacctaactaattatatgtatgaatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaaatttactacatatatatgtatatatatatatatagcttaaatagaaatgacaagacatgcataaatactagattgatgcagagttcgtaagtagattgattaatgaatactaggatatatagtctcattttttctgggtgtatcattctgaaacggaacagcacagttaatacaaagaaatggtatgtcctgcagatgtgttcaaaatatttaaaggtgaggatggaaggttcaccgatgcaatatctaatgaaccaaggggattactaagtttatacaatggcgcacacctcctcgtccatgatgagacaga

SEQ ID NO: 68452 - DNA, 2342 bp, Oryza sativa
ttgtagtaacacttatacttttatacagtaacaactatatggttagcatgtgaggctttaacccatatatttttgctttaattcctagtttaacaagtgagatatagtctagtggttgttcttatgttgatttagttgaaggtcttgtgttcaaatcctattgattgcaaatttttattttattttttcactctaaaagaatagtcttatatatatatatatatatatatatatatatatatatatatatatatatatatattaaaaaatgccctgtctaacaatttaggaagcgtgcacgcaggacctttcgacgacaaagagacagcgtgagtgcaattcggagagacggcggcagtggcgcttgcgtgagtgcaattcggagagacggcggcagtggcgcttcaggcagccgcacgttgctggaggggcaaggcggagggatggcagcgtgatctctttgaaacaaggggcgcttccggttgtgtgcgtgcttcaaacaactttgtcttctccatattaccacatctatagagtctaattttctatgaggaactactgagttcaaatgcgaagacggtataataatacgctatgatgacaatgcaacggatatcattagtaaaaaggaaatccaaatggaacttgcgtttttggcgcgatcgtcgagtaattgagagaattgaattttactaaaatagtttctagcttatgaagtattaactgtcaaaagggaaatttgagccttctttgttgtacttgctaattcaatgtatacacatataagctgtaacagatggtttcatatttgagccttttttttgctgtacaagctcattgcctgtaacaaatgctcattgttggaaaataagagagatcaatctagaaatcagctcctctagttgccaagctgcaaacgcatgtgaatggaaaaaacaacacagtgggtaagttaggagaaggtgactttttctctttttctgaagtaaaggttggagctttgctcattatattaagaagttggtttcagactataattcgaggatattacatagaacaaaaagcaactgaactttcaccataaactccattgcatagcgaatatagtaagatgcacggccagtttttttttttgttaaatttcctgcagatagaaccttgtgtacaaaaaccgatccaaagaacatctgcctgggttcatctggtgcccaacataatgcttttgaaattgttacaggtcattgaatgatgacatgagcactgattgcagctatcaatgcctccaaaaatcctaagctattattagaggggcatcaagcttacaaagttatcttgaaaggagaggctaagtggctatggagaagagaaattccaatgaccgcttcttcatcgtcaatctccagccgccgctggccttcgtgaggcattttgccgcttcacccacagttgtccagcaggaactcaatggctgggtgctagcagccaggaggatggaggtgggcacaacgtgagccccaatcagaaaatcgaagatgaatgtttttattgaaatggcattgcaactttaacactgcacttcatttgtcacctgttaggatctggcatgggcacagatcacttttcagtttgtcccatacattaagaacttggaaattaagacaactgtaacaccacgatgtgcatcagaaaccttttgggacagcaatagaatgcaaacccatcattgatctgctcaatctctgtagttgaaagtaagctacctatgcccatatacacagaaaaaaactcacaatgtaattgcttatataaccaggaatgagaaattagtaaagaaataaatgaattttaatcagatggtcgttattacaaatatcggaaatctccaatatgcacagttctgcaagatgcacataattatcactgtaaacaggttaacaaggattcatgattatggaagaatgactacaaagtttgattgcaacagcatggaaaataagtttattttttttatcaagctgatggagagaaacaatggctatatggacaggtaatcacataattaattatgagtacaacatatatgcgtgcaccacaacattgtttcaggaaaaatgaatttgcatcctaactaaagaagaatgcgatcagttataagccaatatggaagtaggagtgcccacaatcccacatgggggaaaaattccaatggtcaatatatgattcattcaggaaatcaactgattttttttccaatgatccatatatttatatatatatgatttatcataactttccaagatgatcatacctatattgtttctgaatataatccaaaatcatca

SEQ ID NO: 68453 - DNA, 2230 bp, Oryza sativa
  unsure (1)..(2230): unsure at all n locations
atgaactgcctatcgtttgacagnngctncataaatggagagttttgcatcctagtgaagtgtgtacaaagcaaggagcatctctctcatacagtactgctcagcatgctagttcaaggtggctgctgcaatttttgttctgtcatgtgaggttttatcttacgttcataatgtaaagtccctttctgagattggtgagctgtgcaatatgtaactttcttggattccatccattgcacaggggctagtaaaagtaaatcatagactggatatctggtcaatcagttgtttctggctatatcactatttgcttatgtagttaactttgttggtttagttatcaatccaaataatacttgtcataccacaggttgtaggttctgcttcaacattgaaggaagataaacactggaacaaccttgttgagagtgcaaaagagcggggtcgctatttccaggtttgattgctgccaccttttccttttgttcaaagcataggaagtaaacacttgaatgaatctaactatgagcaccttgtaggttccgaagccattcaccgcattctttgtggatgataagctgaaaaccatgaaagtggagagagctcctccggagctgaggactgtgcaagcattggaagcaataaacgaagcagttgtagggcaagaactcatggatgtcgacgatgctggcgaccaagaggatgaagggtatgatgatgatcccgtggaggctgatgatggtggcggcgatgactaaccattcactaccacatagaggtatgtagaagagcaacatttgtttaggtggacttggatgctggaccccagccacagccagggcctttagttgagccttcgaattacaaattcagtgccgtgattctttgctatttcgggtgcgagaggtggctgaatgcctgagttcatagttgcaggcatagctacatcttatgttttaagttatgtatgtatacaaagccccttgcaccaaaagagctgaaaactgctcaactggctttaatttgtctgcggctataattttgcacggcagttgtgcatattgttccaaaaaaagaaggttgctctaggctgtggcagtctgatggcattttctttggtgttcgtaggtaagtgtgtaaccagtgatttatctcatctttcttttacatggggtacttgcagttgtcgaagaaaaccattgtttgcttttctatatgaaagccaagtgcattaaccgcagcatacatgcactgcctgagcggcagaacacacatgggctgccatcatgagtttgcagctgctgcctgcgtgtagatgagctgcacaacagatggcattggcctttaaaaggcagagtaaaagagcaatatatgcagtgacatgtacacagagacaccgagaaaccaagtcgagagaggcgtgtatgcacgacaggaggggtttctagtgcaattctttggtttttgtttttctcctttttcatgctcaaggtaaagtgagctggatgggcgcattctaagccaagaagtctctctctctctctctctatatatatatatatatatatatatatatatatatatatatatatatatatatatatatatatatatatatatatatatatagatacacacatactgcgagggagacataaggggggcactggggcgccggggcagcgcgggcgcgagcgcgcgcgagagcgcgcgtgcgcgagagggagctagatggggcgctatacctagacatacatatatatatacatatacatatacacatatatacatacagatacagacacacacacacacacacacacacacacacacacacatacgcggagggcgcgcgccccaccgatggacagggggacccacgcacagaaaagcgggccccccgggcgggtaccgacacccacgcctggggggcggccgggacacacacgccttaatgacacagggagggcgcgccggttacacgcaacgagatcgcggtcaagacggcggcgcctccctgtgccgggtgtgggcggcccaccaccggcgcccccgggagaccgaccgacggggccggcatttggcggacgccagctccctccgccacaagggctgccggccgcgcgccgggccagcgaacgggcgggggttccgggagccatcatggtcgcccggcgctcgcgcgcgggcgagagatgtggcgctcctcgacacccctggagcccgtctc

SEQ ID NO: 68454 - DNA, 691 bp, Oryza sativa
tcctcccgggccaagtggcccgcagccgagccgccgctcgcgcgtggggtccgcccgctgacaggtggggcccacctgtcaaggcagtcgtcttccttgcgccgtcgcctggccgaaccctagcggagccgcgccgccgtctccttccaaaatcggccgcgcctttccttttccggtgaaatcaatagaggggaaatgatccccgggatcccctctatcttttctcttttggaatcgtcggctaaaatcgtttggaaagcggtggattcgatctcgaatcggattcctctctctctctcgaaccctaacctttcctttccgtcgccggttgccttgggcctccatcgctgcccctagccactataaaaagacccccgggacctcctctatccgtcgccaccctcgccttagctcgccgccgcctgtagcgccctagcctcgtgagccgtgcgccgccgttgccgccgcttgtctagccgtgatccgccgccgctccggtcgtcgtcgtcactcgggaaggccaccgtcgggttcgccaagtcatcgccatcctcgtcccatcctccgttttgccgaagaccaccggaacaccgctgttgtcgtcaagccgaaggtcgccgccgctttttcctcgacgccgtcgccgtccggtcatcgtccgccgtcgtttaggtcccggtgagttcccgca

SEQ ID NO: 68455 - DNA, 3379 bp, Oryza sativa
atatatatatatatatatagtatgcaatattatatattagataagatcagctgaaactccgatactatccctaattatgattaattacaggttagtttttagggttctagacaagactagggttgatgcatctcaaagtatgtaaagaaacctaaagtccaaacaatcaagtaattaactaattttcaggatggtagattccttagctaacctaatctagcgaggtaatttagccaataccagtataaacctaaagcgagtctcagccgatactaaatcgagatactagactagattaagtaagatatatgataaactatgctacaaaaatgagactaatacatctaaagcgacgcaatagccccgataatgaaaaccatcaagacaagttacctcttgtcgagagatcacaaccgatgccccgactcaaagcaaaaactcatctaaaagttaaagaaaaaggtggcgatgcaccgaaagttgtattggttggatgtacgtcctgttttacaatgatcttggatttatatttatacctagagtacaaaacttgtctattatggacatgactcaaactttccaaaagataaaaacaacaaacaagttcacatggaggactcataccatatctttaatttaaaacgacattaaaatcctaattaataaatacaattgacttaaatatgccatatctctatatggcaatgtcagttatctcaatcgaggcccaaaccgagcccaagtcaagctatatcggccactttcaatatcgactgaattggttcccgactgaattgatacgctgtctgtttttggtaagatttaatctccttcaaatccatttcgatatatgtctccaaatccgagtatatcttgccaaatttcgttgttaacacagtgaaaccagagagagtgcgatgcaagacatcagtgtgaactgactcccacggaaccgcgatgccggtactagtcctaggaaacaattcctggtacccacagtcaaccgagatacatcattgcaactaaacatagtatagttaggttatacatttagaagttacatgttcagagcaactcctgaagtgaaaccgtcaagcaaagaagcaataatggaacctagcgcaactaaacccaatccacaagcaatgacttgggtttagtacagaaatgcggaccttcaacttcacttcactttgctctccctggggaaatcaataacaattgagtacatacgtacttagcaagccatgggaaatgtgagtatgcaagcttcaaagaagggttggtttggtttcgcagacttttgaaaacatttttcaaaaggacaattgcttatttgaccccgttttgaaccgtaactaccaatttgaccctactttttgaagtttgcttatttgaccctccattttagaaacaaagctcccgtctgaccccctttcgatgactccgttagggttgaatttaaaaagaaaaaagaaaatgcttctaatattcctaatgtccaaaataccctccaaaccctatcctttcactcttctctggtttagggcgctctctctcgtgcaaactgcaaagtgtgcggcagcggcgagctgagggggcacagggcgacggcgactgagggggcgacggcggcgatttgctggggcggcggcggcgatttgagggggcggggcggcgacgatctgaggggcgacggtggcggcgtgaagcagagccccgccgaggcccccttgtgaaggtggagggcggcggcgatctgagggggcggcacgcgcgcggaggaagtggtggcggtggctgctgcagggtggagaaggagcggcggcgagcagaaggagcaacgtcaagtggcggctgcccgagcggaaggagtggcggctgctcgacgacgacaaggaggagctaccgcggtgggtcggctatggctgagcggcagcggtctccgcgactgcgggttgacaacgacgcgctatcctgcgccggctagttctccggcactggatgccgctcgccgccgtcctccgcatctctctcccgcgtgctggcgagctccgtcaccgcacatcctttgtgcgccggcctccttcctccgtgcgcgtgatgccaccgcccacccaccgcacgccggcgacctccggcgccgcaaagggcagcgctccctcccttcccacgtgccggcctccgtcttcctccgtgcgagcgccgccgccacaaaaatgacgctgccatgcccaagtgtcaaataagcaagggcatattggacattttttgctccagttaacactgttacatgcccttaacagaatagggtcagattgtatcttcaattttgaaaaagagggtcaaatgagtaaagttgaaaaaagagggtcaaattggcaatttgctcctaaaacagggtcagatgcgcaattgcccctttttcaaaacactaagtgtgtaattgtcccatttggtcgaaaagaaactctccccttgatcctgtctacaagttgctttgcaacaactcaagtagatgagacaaattttagttgattaataactatcctcccgcgcgacctaccatgataccgacacacaaacttcttccaataggcagtttccaactatttctcgtttattagtttcttttcattttccatatccatcaaccatcagctcaactcatgtctcatatctttggttcccacagctgtccaaaatctctagcccacaccgtgttctgttgggaagcctcaactatgatgtcattcgacatcccagttcacataggactgtttcagaccatgtaatggtcatccagtagacatcatgaccgattttggtaacgatttccaatcccacaaaatgtttgtcacaacactttgcaagcaaacctatgctagaggaatcaccttccattcgcccataaccatatgcatggttgttcgaacagtttggtaacctttgcagagggtgtgcactttactcacaagatgtgatcttaccttatcactggccaagtagggggttcgcgacaaggcctttccaaagctaaccgaggatacatcatgccacacaaaagggttctctctgaatcgagtatcagacaaatctcgaccatcttctatctaggaatctaggatgtcaccaatcaaccgtgcccaacatgttaaaatttagggaaattttgctacaggacacttgttatgtgtggttttagccctagaacactgcccaaacccacttttgggggaaaacactccataaacgtggtaatttgccagtggacaccgcgctgattaaaataatacttttccgttgggaaggagagagaaatccgtgaaatgtcaaaaatgccctgggccccacatgtcagctctatctgctatctctg

SEQ ID NO: 68456 - DNA, 10233 bp, Oryza sativa
ggaggtacaggcgtaccgtgtgggcgcgaaacgggttggcctgggggtggcagctgtgttccccgaaggcggcgtaaagtcggccgacgagcgcgtcaaggctgccccacgcctcgcggagcaggcacgggcacggtgccggcagtgaggggtggctccgccggccgcacgcttgtccaccgccgccgccgcccactccactccgccggccgccgtcctcgccatctccgccgcgaccaatgccaccccgtgcgagcacgctctgagagagaaaagagagagagataggagagaaataggatatagagatgacatgtgggcccaagggcatttttgacatttcacgcgatttctctctcctccccaaccggaaagtattattttaatcggcgcggtgtccattggtaaattaccacgtatatggagtgttttcccctaaaagtgagtttgggcagtgtcctagtgctaaaaccacacataacaagtgtcctgtagcaaaatttccctaaaatttaatgtgtgcctagtgcatcatatcaactcacatcttctcatcccaacatttatcaactattggcacacaaggtagagcatcaccaccatggcgtccactttgcatcgtggatttttgaaaacaaattgtgatttgcaaacacgctgacaccaccaatcgagttttcaaaggtttataaacccattttcctatatcaacaagcaagtgtgaagtgtgtggtattgtcgacacctatgctcggggcatggttgccgaggtaccattagggggagcgacaaaggataaccctaatcaacatcctataggtatagtgcaactattaggtaggtttgttagtttgtttcgtgaactagggccagtcatatttatcatgcacactaggaatgcatttttttatttttttttaaaaattataggctaggagcaatatgatcaaataatgacttgcctctgtcttcattttcaaaatcttcgaacttgcttgtctagactaattttcgtcgacgtggactacacaggaaacaaataaaaccaagcaaaactaaacataaaataccattattaataactaatcatgccattatcaatatctcatttttaaaaaaattagagacttgaacgaggttgatcggagttaccaatagggagatatgaagtttgaaagattacaaggtttttctagaattagaaacaaaattaaaggttttctgtgaaagaaaaagaaaaggataggtggggttggttggattgggtagagggaggatgtaaagtagactttgtttgagtgggaggagattgttgggccgggggagagagaggaagaggggcaaggaccttttaggcttagcaggccacacaagccagctaaagccatggcgttgcctataagcgaggacacgcgggggcgcggtgtggtttgctgcctatgggccatgacctagccacgtaagcgccaccacatgggctgtagaccgggccagcgttgacccttaccagcatcaacagttggtggaagttggtggcgcatcaacgaatagcgtcttgccagactaggattagccaagaactattcgacgacatgtaatcaacggctagccattgacttcctcccgcctgtttctcaatgtggcgggtggctagggcttgtgattcaatgtcctaccctcttgtggggctttgtatatatactactagacaactttctcttcgaatagaactcagatactctaagtagggcacaaatagatataaacttgcctttcacgaatcggagtccaacaacgtactactctactatgttcttaattatccattgtattttcataattgcgtatacgtttccgcacaatattaggtatgtggtatttcagggcgttatgattccaattatagatgtgataccttatctaatacttactcacaggtttaactgtggcatataggaccatgacgctcatcaataatgccaatgttttctagattgataaaagtgccaatgtgcaccatataatctattttatatctattatattatgaaaacaaccttgaaaaaaggcaccacgttcgctgtggaggttagaaattttcacattaatcggagaaaaagaaaagaagagttcaagttgaacacaatttagaaatatctgaaattcggaattaaaaataactaatattggaagaagagtccatatagaaccgaatacgacattaattaaaattcggaattaaaaataaaataaattctgaaattagaaaaaaagagtctaactaggaatacaatttagaattatctgaaatcggaattaaaaataactaatatctaaataagggtccatatagaacaaatatgatattaattaaaacccgaaattaaaaataaaataaattctgaaattagaaaagagaaggatagttcaaataggaatacaatatagaaataactgaaatttgaaattaaaaataagcaatattagaagaagagtccatgtaagaacccgatacaagattaattaaaattctaaataaaaataaagttaattacaaaatttttagaataataaaaaatagagttcaactaggaatacgattttgaaacaactaaaattgagaataaaaaataaggaatattgaaataatagtccatatagaacacaatacgagattaattaaaatttaaattaaaaaataaaataaattcagaaattagaaaaaaaataaaagtttaacaaggaatacaatttataagtaactgaaattcgtaataaaaaataaagactattgaaaaagagaccatatagaacacatgacaagattaattaaaattcgaaataaaaaataaaataaattccaaaaatagaaaaataactataagagtccaagtaggaatacaattttttaaaaatatcatggtgaaagatgtggaattttttttttaaaaaagtccatctcgaacacaacaatgacaaatgaggggagaagcaatagggctgtaaaggagtagagtggtggcggttgatgggacatctaaagttataagaaaaaccccaaatagaatctcaacgacgattaagaggagggataattggtaggccattaacagcacagtcacagtggttgacgggtcttatagaaagtaaaaaataaaccttaatgataatcataaatctcaatgacaatagatagggggaggttgtgggcccgcccgtaaaaggagtacagtgggtaaagtcgctgacagtttgacgggacttttagaaaataaaaaatgaacccaaatgatagttatagttatgttcgatttttaaaaccccggtgacaataaagagaggacgcaacgggcgggccgtagaggagtactgttatggtgtttgacggaatttttaataattataaaaatgacaaccaatgagacaatgaactctaaaaactacaaggtccaatttttaaaggtttcaaggaggatgaataaaaacagtggtagatcgacaaataaataaaggggtgacaatggaacaagcggtagcgattggcgtgagttataaaaatataaaattagaaacaattggatgataaagttcagtctttcaaagtactaagataacgagttatctatttaacaaaatttaagtaaaatcatatatagaaagtagataattttgtatgggttgctagccgcgcaattgcgcgggccacccaactagctatattattaagctagcatgaaaagtaagcatcacattctctctagaggctagaagttcacacattaattggatataaaaagagaaacgagagtttaagtagtaagacaatttactaacaaaaattagttcatatagaacacaatacgaggttaattacaattaaaattttatgctagaataatttaataattctgcatcgtaacataattttgcttcgatgctagccatacatttgcacggaccaccttgctatgctagttgaatgaagcctgtagcaaaactctagtaattatgtatgtgcgccatttgggaaacaaaaagaggttaagtgttgtcaacgtctcaacgacaaagaagagatcatgcgcctagctacaggacatgcatggacagacacaccgtccagaggttagcgatggcgcgaggaaatgcaaacgctaaaattggcgcgccttaacatagcagttggcggcaccatatattctcctactcctcccagatcatcccaccagtggctaagagaggaagaaggagagaaacatctagagtgaataagaaagatggggttcgtccgtgccctgttcctgctggcgatggtgtgcgtggcggcgcacgcgaaggactaccccaaggaggagggcgcgaaggcggaggggccggccgccgcctcggggggcggcggcggtagcacccacgacgtggtgaagctgggcggcaagggcgacggcaagacggacagcaccaaggcggtcaacgaggcgtggacggcggcgtgcgctggcaccggcaagcagacgatcgtcgtccccaagggcgacttcttgacgggtcccctcaacttcaccgggccatgcaagggcgacatcgtcatccagctcgacggaaacctgctcggctccaccgacctcgccttattcaagtcgaactggatcgagatcatgcgcctcgaaagcctcgaaatcagcggcaagggcaagctcgacggccagggcgccgccgtctggagcaagaactcctgcgccaagaaatacgactgcaagatcctccccaacgtatgcatgcatgctttcctgtgatcgatccatcgagacatacacattaattatttatttgatcgaccatttggtatgatccatggatataaatatatgtgcagactttggtgctggacttcgtgaacaacggtctcatcagcggcatctctctggtgaaccccaagttcttccacatgaacgtgttcaagagtaagaacatcaccatcaaggacgtgaccatcaccgcgccgggggacagcccgaacacggacggcatccacatgggcgactcctccaagatcagcatcattgacacggtcatcggcaccggcgatgattgcatctccatcggccccggcaccgagggcgtcaacatctccggcgtcacctgcggtcctggccacggcatcagcgtcggtagcctgggcaggtacaaggacgagaaggatgtgacggatgttaccgtcaagaactgcgtgctcaagaagtccaccaatggcgtccggatcaagtcctatgaggacgccgcctcggtgctcaccgcctccaagtttacctacgagaacatcaagatggaggacgttgctaaccccatcatcatcgacatgaagtactgccccaacaagatctgcactgccaacggcaactccaaggtcaccatcaaggacatcaccttcaagaacatcaccggcacctcctccacgcccgaggccgttagcctcctctgctccgacaagctgccgtgcaccggcgtcaccttgaatgacatcaaggtcgagtactctggcacaaacaacaagaccatggccgtctgcaagaatgccaagggcactgccaccggctgcctcaaggagctttcgtgcttctaaacgatcaacccacgctacatcctgccaccaccaccattattttttcatttctatttctattttccaggtcacttatagtttttctctggcgatgctctgattggattgttctgatgcagtcggactatccgactgctctatagtcagattgtctgcagtggtaccggactatccagttagttctaagctgtttgtaagtttaagaaatttttggaaatacctattcatccctctaggtgacatatacaatcctcaagactctttcaatcacattatctcaaactagatggagcatacatcacataatagcaactattagcaatgtataccggtggttgcgatggtggatttggttgcttcgccggtgcattcagtcatgctcttacgggaggagactcaggagaaatggccgaacggggcagcgacactttgaggtggctgaagggggcggcggggcagggaggttcatttacaaggcgaaggaagatggagctagggctaggtaccaatctccggtgcagcttgctctaccaaatcaacctcctagcaaccaactcatatccattcaccaggtattccatttccttttaaatgtggagtaacttactcacaaacttttgtgggctatgcaaaagagaaatagcttgagggtgacgcctagtcagtgaggaggagaaccttgaagagtaacaagctgacagatgaaggtcaaatggcgatccagaagtgctcaagatgcaatacctagctctgagtagctcaaatccccaaatcccactccaaactcacaagagatgctcaagatagaaggtggatttcgtgttaatcctaatggaggctaaggaagtaggtctgataggtcaaacaacaagccatccaaagaggggtggtaactattaaatacttgacctacactaaaattagtcgttactgacaataaatttgaatgtcaaagggtctaatcaggcatattagaacttctaatccgtggcatccattgaatcgttcgatcaaccctctctgtcttgatgaggagcaccaatccagactttgtatgatgtccatcgaggaacttctgatcgcccttcctcaacatatagagagctttgattggaggtcctgattgcaattgatggaactttggatctggaagctatactaagcctattttcccatgcgggcgttgcgcaatgtcaccttctctctaaagactgaaggaatattgagcgtatggagacacaaatgttgatattgacttgaaaccctcataatatgcagcttttcctatgactcaatttgaaataaaaaataaatttaaacttctttagtcatttagccttgtttgcatttgtaggggtcgtcatacattcatgttaggcccttatttggtcgggttatgaatcatccaaaatagactaacacactaggggcctagatgcactttcagaagtaactatagtgttagaggagggggggagggggtgttggtatttcttaacaacattgctagaaatattcattccagcaatgtcgttagaaatgggcctgatatatttatggttacagaattaatccgcaagcgcacggatataccattgtagcatttcactcggaagtatttcaaggtatcgtatttttaatcccaagggaagacaataagagtgaactttactaatgcactttatacatatattacttataattgtcagagcctaagtaggggttaaatataatataaggtagagtgacatgaagcaaagctattcaatactcataacaaaataattctaactaagtggacgaagaaatagaaagcactcaattcctatacttctagtatacactcaaatcctaacttacatctgctaatgtataattgtgtggccaataaccctaacagtgtcctcctggtacttcgagagaccaccacgggttgccgagtttcttacaacaacttgtcatggccgtccaaccgaggctaaatacggaggagtacactccccaggaatttatcttaggaatatatactaacgtggaggaatacccaaactgagctgtcaccatcaacggcccacctctactatcccgcaacatatatgcccaattaatgatacttaataatctaagcatcatgcttatattgttaaatactactctatacccgcatgaccgacatagagtaactgatacagacattaaacccgcaccattacacctctctggtaggctacccacacaattatcataatgcagatataaaataagaccagtactcaaactaaataaagtaccgaagatatataaagaagagtacttcattaattcggaaatttggaaagtattacataagagattacaagagctgctagagccataccgaaaacttttccaaagactccgaggacttctgaacactattctattgtactccacttagcactatactactaatactaaagtatgaagaggaatttagcatgcttgagtgtgttgagagagtgaatgagctcctccttttatagggcccgtatgacggttttagctatgcgcaatttcggttttgcccttgtaaccgtcattgaggagtgatcctggacgtccatgtggagggccagccggagccgacgccactaggtttcagccgaaccaggggttcagtcgaacctgggccagcccagcagacaactagtttcggcaggtcgctaacaaatgggtcccttaggcggttttggcagttaaagtcggtttctgacggttgcacctgacttgtgggcccatcttatccatttgcttgtttaggagtgaggttttctccactttctctttattttatttgataaattcttgcaacatgttattctccaagtacaagtggaaatatattatttagaaataagcatgcattgtaagcatagctagttctccattattttagctatattgatggtcgaaattttgtcggtaacaaccgtcaacaaagggtaaatctaacacaccccgccctggcaccaccatcaacgtgttgatgcgaaacacagcggcctaggagatttgcttcactccagtgcaggaccaaggcttgcctcgagtgtcaagagcgtgtcagctggtttgatcctggaactaacaaggaaaatagaaaatatagttagctgcacgatagctgatcggctaataagccgatgacgtatcgctatgacctagccgttacagtcagaccagattggttgtgtgtttatgatacaatagataaagcaaaaccctaaatatgtcccattggctgtaatattacccttttggtttttgtcaatttgatttaggtaatattataaaatagctgattatccaatatttagagcagaatagatagaatacgggctattactctagtacaaacttatataggcaaatcgatctagataaatataccgaataatgaccaatcttagatacaatgatctaaccgtgattgactaagacttgatatataaagtgatctacctctataaatggcaaatatatatatataacaaactaaaagcatgcaacattatatattagataagatcagctgaaactctgatactatccctaattatgattaattccaagttagttttttagggttctagacaagactagggttgatgcaactcgaagtatgtaaagaaacctaaagtctaaacaatcaagtaattaaccaattttcaggatggtagataccttagctaatgtaatctagcaaggcaatttagccaataccagtacaaacctaaagcgagtctcagccgatactaaatcgagataatagactagattaagtaagatatatgataaacgatagctataaaaatgagaccaatacatctaaagcgatgcaatagccccgataatgcaaaccattgggacaagttacctcttgtcgagagatcacaaccgatgccccgactcgaagcaaaaacttgtctaaaacttaaagaaaaaggtggcgatgcgccgaaagttgtatttattggaagtttgtcctgttttataatgatcttgggtttatatttatacctagagtacaaaacttgtctattatggatatgactcaaactttcctaaagataaaaacaacaaacaagtccacatggaggactcataccatgtctttaatttaaaccgacattaaaatcctaattaataaatacaattgccataaataagcgaatgcaaaagactcggagacgaggttggccccgacagttggactgtagagaataccgacgccgttcccttccaaatgcgcgtcaaaaaagtttaattttcaagtagctttttttttcttgaactgaatttgaagctagctaggccttttagttaagtttttttatacactagctaggtagcttggctagatgtaattagatacatgtagatgtaagtatataaatctagttgggtatatgcctatctatttatagatgtaggtatataagcctcgtgtgctatgtatattctaccgatgtagattaagttggtgctgatatttatgaaatagtaggatggtaggtatatacatagtaccaaaatattctgtattaatttgcatgattacaacgtgcaaattt

SEQ ID NO: 68457 - DNA, 9390 bp, Oryza sativa
ccacccgtcgacagggtggtaactattaaatatttgacctacactaaaattagtccttactgacaataaatttaaatgtcaaagggtctaatcaggcatattagaacttctaatccatggcctccattgttcgatcaaccctctctgtcttgacgaggagcaccaatcgagactttgtatgatgtccatcgaggaacttctgatcgccctccctcaatatatacagaactttgattggaggtcctgattgcaattgatggaactttggatctggaagctatactaagcctattttcccatgcaggtgttgtgcaatgtcgccttctatctaaaaaccaaaggaatattgagcgtgtggagacacaaatgttgatattgacttcaaaccctcataatatgcagcttttcctatgactcaatttgaaataaaaaataaatttaaacttcttgagtcttttagccttgcttgcatttgtaggggtcatcatacattcacgttagtcccttatttggtcgtcttatgaatcaaacaaaatatacttacacactaggggcctagatgcactttcagaagtaactatagtattaggggaggggggagggggtgttggtatttcttaacaacattactagaaaatattcattccaccaatggcgtcatagatggtcatggtatatttatggttacagaattaatccgcaagcgcacggatataccattgtagtatttcacccggaagtattcccagatatcgtatttttaatcccaagggaagataataagagtgaactttactaatgcactttatacatatattaactataattgtcagagcctaagcaggggttaaatctaatacaagggtagagtgacacgaagcaaagctattcaatcctcataacaaaataattctaactaagtggacgaagaaatagaaagcactcaattcctatacttctagtatacactcaaatcctaacttacatctgctaatgtacaattgtgtggccaataacccctaacagtgtcctcctggtacttcgagagaccaccccggattgtcgagtttctgacaacaacttgtcatggccgtccaaccggggctaaatacggaggagtaccctccccaggaatttgtcttatatactaacgtggaggaatacccatactgagctgtcaccatcagcggcccacctctactatcctgcagcatatatgcccaattaatgatacttaataatctaagtaccatgcttacattattaaatactactatatacccgcatacccgacatagagtaactgataaatcagacattaaacccacaccattacacctctctggtaggctacccacacaattatcgtaatgcagatataaaataagacatgtactcaaactaaataaagtaccgaagatatataaagaagagtacttcattaattcggaaattcgtaaagtattacataagagattacaagagtggctagagccgtaccgaaaacacttccgaagacttcgaggacttctgaacactattctatttttactgcacttaggactatactactaatactaaagtatgaagagatatttagcttgcttgagtgtgttgagagagtgaataagctcctccttttattgggctggtatgacggttgtagttatgcgcactgtcggtttcgcccttgtaaccgtcattgaggagtgatcctagacgtccacgtggagggctcagccgaacccctggttcggcccttggttcggccgaacctgggccagcccagcaggcctccagtttcggcaggtcgctaacaagtgggtcccttaggcagttgtggcagttaaagtcggtttctgacggttgcacctgacttgtggacccatcttatccatttgcttgtttaggagtgaggttttctccactttctctttattttatttgataaattcctgcaacatgttattctccaagtacaagtggaaatatattatttggaaataagcatgcattgttagcatagctagttctccattattttagctatattgatggtcgaaattttgtcggtaacaaccgtcaacaggggataagtctgtcacaccccgccctggcaccaccatcaatgtgttgatgcgaaacacggcggcctaggagatttacttcactccagtgcaggtccaaggcttgtctcgagtgtcaagagcgtgtcagctggtttgatcctgcaactagcaaggaaaatagaaaatatagttagctgcacgatagccgatcggctaataagccgatgacgtatcgctaagacctagtcgatacagtcagactagatcggttgtgtgtttatgatacaatagataaagcaaaaccctaaatatgtcccatcggctgtaatattaccattttggtttttgtcaattagatttaggtaatattatagaaatagctgattatccaatatttagatcataatagatagaatactggctattactctattacaaacttatataggcaaatcgatctagataaatataccaaataaagaccaatctcaattacaatgatctacctgtataagtggcgaatacatacatacatacatacatacatacatacatacatacatacatacatacatacatatatatatatatatatatatatatatatatatatatatatatatacacgcatggatggggctccatggagtatgggctccaacgttaggagccgtaggatgcttactgatcgattttgatcatttgggtacatagcttaatgggtatacaccccgtttagtgtatagtatttaataatgaatggaatccatatatttgaatagacagtaacaaaaggaataaatgcatttatatgcatgcatgcaatgcggatgagagaatatccataattgcgtgtacatttcaaaaatggaaacattaaatacccatgaaattggaaataatatctttaaatatggaaacttacttgcttcacgatggggtctgaataaatggaaactaagtatatggaaaaacaaattattttttttggaaaaatggaaagtaagtatatgtgaaaatggaaactaagtatgtaacactaaatactgatcattggtttttggaaacatggaaactaattagttggaaatttattatatatatcgcagcaaattcattatattcaaatgtatttggaaacatgaataatatcgcaacaaatttatatggtaatgtatccgtaccaaattattacattcatgactccattaatttagcaatttgagtgacaaaatatgcaacaaccggtcactttccatttttaggtacggatgggtcgtatactcaaaaatttggtatgaaacggaaaaagaatcccatgcaatgaacaaatttcgattttagtctatgttaagtttatggcaaaaaaaactgggtattagaagtacatttttttttgtaattatatgatgtacagagatgatatattctcaaaaattaatcgtagtatgtgaaaaaaaaacttaggtacagttgtgcatcacgccgcctagccgtttgatttaatatatgttggatacttgaaaaatctagtatatactatctaaaatatcagtatataccggagaaaaattaagtacaatataacccataaacagaattgatttaggtatatacccattaaaaattgcatattttggacacccatttttagttaggtatatacctatctaaatgggcgtgaaaaaaatttgattttcaagtagcttacattttttttcttgaactgaatttgaaactagccaggccttttagttaagttttttttatactctcgctaggtagctgaccagatgtaattcggtacatgtagatgtatgtatataagtctcgtgtgttgtgttttctaactttttgggtatgtgacgtgcatacgtttcaaacgtactacaagctaggtatttacatgaatgcatttgagatgtacatttaattgggtataatactatttaggatacacatttttaggtatttaaacacgtatattgggtatgtgtgacataccatattctatttgggtatatactggtctaaacacacattctaggtatatacccattaaaaattgcatattttggacacccatttttagattgtagtttggtatatacctatccaaatgcgcgtcaaaaaagtttaattttcaagtagcttattttttcttgaactaaatttgaagctagctaggccttttagttaagtttttttatactctagctaggtagcttggccagatgtaattagatacatgtagatgtaagtagatgtaagtatataaatctagttgggtatatgcctatctatttatagatgtaggtatataagcctcgtgtgctatgtatattctaccgatgtagattaagttggtgctgatatttatgaaatagtaggatggtaggtatatacatagtaccaaaatattctgtattaatttgcatgattacaacgtgcaaatttcatgttaatacactgaaaagaacatcagtttaaaaaaacttgtgttaatacactagctcttagcgcgtgcatccaactggtgtttcttctgcccacgaccatcttctccgcatgatcccagggcaacatacgtatgtacagtctttggctcactaggaagacaaaccaaaaacttattagtaggatgcattcccatcttaaggtcttgacaacgaaatgaaattgttacagtactcaatctgcgaaaacggtagaacagggacttgtcaaaatacaagaataaattgaaatgaattacacacgaaccacgcgtggcgaccgtcggtgatagtagcgatgaacctcctcacgggcgacctgcggcggcgacaacgaaccttgcgaacgaccggcgcgcggcgcgtaacggcgtggttacgaagctaacggatgactgacaacggcaacgaaaccttgcagacaaccggcagtgatgaaaagctcgccgacgtccggccggcagggtaatagcgtggactggacagtggagtgtgtaaaaaatgaaatgtcgtaccattttatatgtacacaaaaagtagaaaatattaatcggtatttatggaaataaatcaattacaacctaattagtggaattactcaaaatttgtggatttgattcagtgtcatctcagatatggaaataaattcacacaatcatagggaaacgatgtgagcatgtgcaaaaaaaaaaaggaaagtatgcatcatatatggaaataaattatcatgcaatcggaaggaaattattacgtacatgtttgcttatatggaaacgatgtgagtacgtttatatggaaaggcaatcacgtcctgcaatacatgcacgcatgcaaatcatgcgggtactctaaaaatggaaagatctaatcgggtttacccgttaatatgtctaatactccggtttgagcagcacaaatctcaaagcacatatacggtggatattgttggagcccatactccatgtagcaccagttaatttactctagcatgcaatattatatattagataagatcagctgaaactctgatactatccctaattatgattaattacaggttagtttttagggttctagacaagactagggttgatgcatctcaaagtatgtaaagaaacctaaagtctaaacaatcaagtaattaactaattttcaggatggtagataccttagctaatctaatctagcgaggtaatttagccaataccagtataaacctaaagcgagtctcagccgatactaaatcgagatactagactagattaagtaagatatatgataaacgatagctagaaaaatgagaccattacatctaaagcgacgcaatagccccattaatgcaaaccatcgagacaagttacctcttgtcgagagatcacaaccgatgccccgactcgaagcaaaaacttgtctaaaacttaaagaaaaaggtggcgatgcgccgaaagttgtatttattggaagttcgtcctgttttataatgatcttgggtttatatttatacctagagtacaaaacttgtctattatggacatgactcaaactttcctaaagataaaaacaacaaacaagaccacatggaggactcataccatgtctttaatttaaaccaacattaaaatcctaattaataaatacaattgccataaataagctaatgcaaaagactcggagacgagattggccccgatagttggactgtagagaatactgacgtcgttcccttccagatggcatatccgaattacttcggataaaagctctgcctcccttagccattcgtcactcattatggatgttaactctgaacagtttcccttaggaagcccaattccataggatcgggaggtggcaaaggaacaagtgatttcttcttgctaaaatagttcagggtattgccatagtcttcgttaaaatcgtccctgaacagaattgcggcacgatccggagtctgaatttcttcattctcgacggacggctgcttagcaaccttctcatcaatcgagctagcagaagtggatggttcagtgagcggctcgatcgttagaggttcctctattttggacacgtatgcctccggttggggttcatcagattgcgtcatgaaggaagtattttctagaatatgatccaaaattgttcttccttccgacggcgttttgtgcatcaacgatcctccgacggttatgtccagatagaatgcagactccttatccaaacctatatggaaatgttgcagtagcacatattcgggtaaggatagggttggtccggactgcactaaattagtgaatctggacaggctgcaccgattgaaactgagaatttctactcgaagggcagtaatacgagtaactgggaagaaggaaagacagaatctgtctcgcaacttctcccaactacagcttacacatccaacagtagaggtgtaccattgctttgctctctcttgaaggaggtggctcatagaattcgccccgaggagcagacagctcaaaaagaagtttcaacaattactgtataacaattacctaaacactacgtctaagcaattaatatctactttagtgtttataactcactaaagcaatcactatattttagttgattatagtgaacaataatcccgtatgctatttaggaactaaccaagagataattctcacaagataaatctaaattacttaggaataatattatattgaattcagagtaataaacagaataaaagaaataggagaagattactgacaactccggaattcttccgacttcttctactctactctcttcctattctagtatacaatatagtacaatagagcctcttataattcagctcaagcttggaagtgtgtaagtgaagtgagggagtgatgtctttatatagcggtaggtatgacggttggcgaaggggaaatgtccaaagtgccctccaaccgccatcagggagtgatctggagcatccatgccaaaacctgggatcaacggtgatcaccagggttcggccgaaccagggctaagcccatctggcctagcctttggcccatgtcctcccccgatcctcctatgtttatttctcaggatttttgtttgattctcgggtattttgacaaagttcacaacccatccttgcatggatacatatttctcctcactttagtctagatttcctcccaacatcgggttttatccctgcatacaaatatacaccaacacttgtagaaaacgtgagattaagcacctattactatgttggatgttttattatctgaaatttatgcagatgttggcggtataaaatcgacatttaacagccgccaacaaaaccccccacacttagccctttgcttgtccctgagtaaaggttagtgtagaatgaattccttcaagatatgaaccaagcatataaaccattcacaaccatatccgtacttatgaactttatcagtggctatcttaccatcttgagtaattgatagatggaacaatctcgattccagtcctttttgcttctctgtcagactcatgagatttttataaattttcgcaaacaagctcttttcctcatattgactttctctcaaggatatatattttctttttggatccttaccaaggcaaagtgttccagaatttacccctattctaaggctgaaatgtggagcttggtagggataaatggtgacatacctacatcatatatattgcaaagccaaaaatattgactcaagaagatcatcagtcatactcctagatcaagggtctttatttgtggtagaaaatgggaaaggaaaaaaaatattttgtggaatggtggaataaagaaatgattctccccttttcctatactttctcctctattttgttctcttggcatgaatatggaagaggcatggctatattttctttccaactttgctcaatgttttgggcgcaagctttatttccctctctcttttttttatagccatgcctttcctcctttttttttatttctctttttgccaagaatttttttctaggagaagaaagcatagtctaatgtaggagttatttgaatggaacttttgtggaaagccaactttcagtgtagaagcttagcttaattatatatgtggaaaaaaattaaaatggaaatgaccccttgatcatgtgagtatgaaagatatctaacacgagtcatataaatttgacaaagctcaatataatgttaagcagttatatgcataataaggtttatcaaaggtacacttgcatatggccttggtgggtataaaatgaaatcaattggaggattgagcttttaaaacaattttattttgaaaacaaattcccaagagtcataacaaaagttgcgaaaattcctttcatcttgaatcatctcacatgaagctgggcggcaagggcgacggaaagacggacagcaccaaggcggtcgacgaggcgtggaaggcggcgtgcgctggcaccggcaagcagacgatcgtcttccccaagggcgacttcgtgacgggtcccttcaacttcaccgggccatgtaagggtgacatcgtcatccagctcgacggcaacctgctcggctccaccgacctcgccttgttcaaggtgaactggatggagatcaagcgcgtcgataacctcgaattcagcggcaagggcaagatcgacggccagggcgccgccgtctggagcaagaacacctgtgccaagaaatacatctgcaagatcctccccaacgtatgcatgcatctacacaacatgtattgatgatagagacatgcatcgatctcatttggtatgatccatggacataaatatatatg

SEQ ID NO: 68458 - DNA, 19149 bp, Oryza sativa
atgctaatcaagttgttgacatcattcctgatcgggtttataaagatcgctgcatcatcagcatataaggatattctgaaccgcgctgctcggtttgataacggagatagaagcccctcttgcatggccttattgagtagtcgttgaatcgggtcaattgctaggatgaagaggtagggcgagaggggatcaccctgctggaggcctcgcctgtgtgtagttggttctcccgctatcccattgagtaaaattctggatgatgcagtcgataggagaagcacaatccaatttctccagcgctgactaaagcctctccactgcagcatttcgacaaggtattcccaagatactgaatcaaatgcctttgttatgtccaacttgaagaagagggatggtttccgttgcatgtgcaaggaccggaccatattgcgcacatagaggaagttatcttgtatgcatctcttcttgatgaaagcactttgggcatgcgagaccaaatcaccaagccgtgctgccagtctcattgccaaagttttggatataagcttcgccacagagtggatcagactaatgggtctgaagtcattcaccgagcgtggcaagtctttcttcggcagcagtgttatcatggccttgttgatgcttccaaagttccctcctgtgaggttgtgaaagcttgcaaaagcgtccacaatttccttttttattatgtgccagcagctcttgtagaaagctccagtgaaaccatctgggcccggcgctttttcctttggagagtttttaattgcttcccagatttcatcctctgtgaacggctcatccatgctatcatcttgtattgtactcagtcctaatgcttcccaatttaatgtgcagccacgctgtcttcttgtccctaagattgagttgaagtgggcatgaaggtgagctgctttgtcctcatgtgtgtgcagggtatttccatcttgctgcaagcaatgaatgaatttttttctccttcgagcattcatctttatgtggaagaaccttgtgttagcatcaccttcttttagccattttaccctagatgcttgcttcttcctcgccttttccaccgctgctagccctaaaattcttatcttgaggtctttcctgaattggtgttcctctgctgtcagagttcttgtttccagggctacatccagcctatagataagttcttgtaccatagcgaattgtaattttgattgcccaaacttttgcttgctccatttcctcaaggttgcttcggtgtttctgagcttttgacttagccgccaagtggggtgaccttcctggataggctcgttccaagcctgggttacgacgcctaggaaaccttacactctaatccagaaattttcaaatcggaacctcagtttcctctttggttcttgcattggtgctagcagcaactggcagtggtctgagcaagatgtggataatgctagcaaggaatgcccagagaaaagaatatctccctcactattgctcagaatcctatctaatttgcttagaatcgggtttccctgctcattactccaagtgaactgcctgttttgcaatctaatatcttttagctccaaagtatttaaggttgacctgaagctcctcattagacgcctgttcaaattctggttattcttatccctagcctcgtataagatgttgaagtcccccatgaccaaccatggcgtgtctgttggtggcttggctgcgactaattcagcgaggaaattttccttgtcacagtcttctgagggtccataaactactgtgacgatgaagctgaggttatcagttatggtcgttgccatcgccgaaagatggtgtgttccttgggagaaattcgccatgttaacaattgtgtcatcccagaagatggcaattcctccacgagttccattggcaggaaggaaattgaagttcgacaacctgtttccccgatccattggtctatactacttaattttgtttcttgcaagcacaggatgcctgctctggccagctcggctgcttcgaggactgcctctcttcgtgctgggttatttagtccgcgaacattccaactgagaattctcagatgctgtaacatttgggcgaagtataacacacaatttttttccaaaaggatcgatcccatagtgttttccaaatgaattagttcataagcagatagagggctatatattttcttccatgacctacaactacaaaccaaacatgaccatgtagaagcaatttcactatcttctagcctgtctactctgctactaaccagctgaaggccggtgtctaccgggagcgctattcgtatcaaccgactaaggagctccggcttaaggccgttgctgcatgggagcgctagtcgcatcgaccatacagcgagcagcagcttaagaccgcagagaaatgtaaaggatacatgcagatgatgatggaagaccatttctgcagctctaacactgatgcggacaatcatgacagctgacgacttctctcagggcgcggcagcgcgtgcctcagaccaccgccgttgtggtggttccttcctctcctggcaccgggatgtcgtgcactccatccaggcgtgtgagcacccgcagaccggcaatgacatgcgacggaagcggtgtgtcgaaggactttgcataagcctccaccgccgcatccccgaccggttcacccggggtgagaagccccatctcctccatgaggcgcacttctgcgcacttagacaccggcaccgacgagaagcgcgccttacggccgctccgccgtgacggcatctgcaccaccttgcgtccgcaccccttcgtcttggccgcgtcgggcggcgccagctcgagcagcgcctgcaggatgatcggcggctgcagctgcgagaacagaggagataagacgaccttttcacgttcaccttctcctccgtggatgggctgagtctagaccgtggcctggtgttgctcctcgcaatcggcctgctgcaccagggtgggctggtctcctgtggaagcttgggcctcgtcatcttgagtggactgagcgaggaggtccatcttgggggcctgctgcgcatctgggccgagatggcccatcttctcctggcccaactcagctgccgactccaccttatcctctcccagtatcggttcttccccacccgtcctcttcgtcttgttctccgcctcccgtgaagacttgggaacgatctctgccaggagcggcagcatcgggtcgtggtccccctgttcgtctgagaaggggaggagaggtgaggagcataggatctggatcagagggtcggggagactcacgagagcgtcgactggctactggtcgccatcagcctggccactgacagcgaccaccttggttgttgcgtcgcctgcatcgcccgtgccgtcctgaccgcgaggagtcaaggagcttggggagcgcgtgcgacgggatctacagcggcaggagcatcgggagttgtgcctggtccgtgagcggccttggcgcccatcaccgtgcgctcgctggcggccggaaggatgcggcgtgcggctccggtgtcgcgccccttccgccgcccgcgactcaaccgactggccccttccaatgatgacatcgcgcagcgagcggcggcgtggtggaatatcctcagcgtggcgccgccgcccgtcgtcatcctcatcatcctccgggtcttctcttctctgcggcggtgccctgcatccccgcctcgctgccgcccgtcgccgaggaggctgggttccgtcggcgcagcccaggtaccactggaaggtgcgcaccgtgggtatcgggcctcccaaatcagacaagtccgaggagggcagtccgctcaccccggaagaaggcgagcagggcggtcctggagtccagtcctccatctcgtccagatggactatgacatgcggcagcctccccctcggcggcggcgcgatctcgtccggaagcggcggtgtgatgccggaggtgacacgcctagctcccggcgggaagaaggtggagagcactgttcatggcaggagatcaggattctgcatccacatccagcatgagaagatggccgtgttctgccgctgaaccgactcatgctcgatgcaatcgaagaggtagatgggacccatgacgccctccaatcctgccctgttccatgcgtactgcggcaatccctccaggcagagccgcacgcgaaaccaccaattcgggtggtgcacatgcctgtcggcgctccatggcgtgatggtgaaccttcctccatccagagtgatgaagcctctccgcgctgccgcggcctacccctctgggaaatcgaagaagacgaagaaatcttaggggtgatggcgcgtgactcgcaagtctgagatggggatcccaacctgctgggtcagtgcacgcaccacctccctgggggatgtctcctgtccctcgacctcggccgagatgagtgcgccatgatagcgaaggcgctccaactcgtgctacatgagctccgtcatcggcaccattgcatagccgactgccggccgttgattcggcagaccaggtatgtgatccatggtcaccgctggtttgtgcaaacgatggaaaaccaaaccagggcgggtcgttgttggttgctgttggttcttgctgggaagtggtgggaagatgagtcgggattgaatggagggggcttgcttggggaaggtgaggcgggagtgaatgggttgctttgatttgtttgggcagcggaaggagatgtgtccactgcgtctacaagtatagcagcggatgggatccctgcaagctgctgcctggtgatctgaagcgtcagcaagtatctacccttcaaggcaccgtaaattattgggattgctgcctgaaatattgatatggttcctccaaagattgaaccatattgttggataaaagtggccgtggccttaaacaacaaaatagagacaaattaactttcacatgttatattgtcatcataactagtaatatggaacatttgataatacaaatcagcggaagcacttgccgtgcaagatctccttgaacttttctctgagatttagtggattgaaggaggcagctgggcgattgaagacggcctgaaggttgatgaagaaggatttttgcgcttccgccaccaaaactttggttttaccgcttgccattttgatgaaagatcttgttcttctgcctcgatttgagacttgcttgtagctcttgccggggctacgattatcgactttaatgttgcttttcctttggccttcttctctgcatcttcctcttgtgccttttcgggagggggcgtaatggcgctccgtccctctcctctctctgcagtaatgtcgagctcctcttcctggcttcgggcattgatttcctgatggaaagccttggacgccggagatggagaagctgctttgcgtgctttggcggtctgcggattgaatgtctccgctgaatgttggtgtagctccagagcaatgacgtcatcctcatcctcctcggcatccgttccccaatcaaggggctcggatagcagtggcgaggcctgacttgcttggggcgaaggcgtgactgggggaggtgagcgcggttgtgcggtggccgcctggtcggagtgaccagaggcgcagggctgtgggcgccggtgacggttgccccgccggcgctcaggttgacgagctccctaggctctcgctctctcatcatttctctccatgccaaatacctaacagaagttggtttaagagccgttctacaaatcctgtaaaaaagttatgatggtgattaatggtaaataacactcccaccacaactctatactttttttttaaaaaaaaagagagaataatatataacacataaattagagggtccacatgtcaaccacctcatcaccaactcctacattttataaaaaagaaaaaagaactgtgaggccaatatataaatatatatatatatatatatatatattagtaacaactatattatatataaattaagcgtagaaaatgagggtaataataggttaatttttatttttgtaaattgaaataccgttgtaccgcatggacaataataagttttctagttaattagatggagtaattaatataatgttgttggcattcgggcagcaagccgattgcgccgtgcagaacgtgtccctcgacacgctgttcctcctcgtcatccaggccgccgctgtgtcatcgtgctccgcaagttcatctacctcacgctcctgcgccacgcagcccacgccatcttcttctcggaatctgtccgtactccatctgattagaaatgggcgggcgagattaacttggtcgttcttgcggcaggcggggatatcatgcatggggggtatagctagcctccctcctgcacgagacatgatttgttcatgtcgacgtcgacgtccagagcgtagagggtgcggatggtacgtctccgagccgatcgaggcgcgcgcatctcttctacatgttccagatcgatctggaacgacatgcaccggtgcaccacggtcacgtacgcgtgatcgatcgagcgtcgccacctgccttgatctcgttgcgggccacggatatcggccggctcggtcgccgtacgtctccacggcgatcgcgaccaacatcatcggggacgggctttcttgcgctgacgtgggtccccaccttcttctggtcgccttgcattggttcctcgggttcaaggtggggcgggttgtgccgctaacccgcttggttggcccgccccactagcccactacccacatccgctaacccgcttccaaaatccaaagaggcggattgatacatgcaggcgacccgctttgcccaggagcgccattgcatcctccttctgttcctcttcctcgtagctaccgtgccagtggtgccacccgtcctcgttggcttttactcgctccgttttaaaatatttgacaccattgactttttatacgtgtttgaccattcgtcttattcaaaaaatttaagtaattatttattctttttatattatttgattcattgttaaatatactttcatgtacacatatagttttacatatttcacaatttttttaataagacgaacggtcaaacatgtgctaaaaaatcaacggtgtcaaatattttgaaacggagggagtacagcatacttacatcgctataagctttgagatctgtggcgctgtgcagtttgaaacgacagccgcatcaacctagctatggccatggcggccagccatatagcagcttaagaagaaacgacgcgacatcgacattatatatgtatttttgctcgattcagtctgggattgagggattttgatctcttgatcatgggacacgatatgacgcgaagactgtttggctagacacgcatatatcaagccgattgcgaagagaacataaatccctaactggagcatgtcaccacggaaagcaagaagatgataccagcggatcggcaaagtttgcacagcattcatcagcaataccaggcacaaaaatatggaatgtatggacagcatgaaatgcgttccagcacatgtcgtggatggaatctcactgaggtgatgatcaagaactacatcgaacacttgacagcactctccggttccagcggacggagtgacggtagagctattgacctcttgtgcattcacggacggcatacagagaaacaagttgcaattgacgcagtgacgcagcggatttcgttttaagtggtatcgtgctgtgtgtggcacagtgtcgatagtgcggctgctccgctactgggtgttctgcaatacgcatgccaactaatgctgtgatatttagttggtaaaatttactacgggacacttaaaagttcatggtctttgctgcagtatatccaaaaaacacatatttgctataggtcaccgtaaaaacatgcatggtgattagctgttgaacactagacgcattattttattatatttagtacaaacgtagagagaaacagtgtggaatgcaccaatttgcccccgtgtccataggttgtaaggtgattggatccgatgcaaacctgacccagaccattctcactcctctgacccggtccatttttactcccctagtatgggttcagttagaactagacctgaatgggtttaaaacaaacatgccccatagacaaaattgtcttttcttaaagtttctctctccatttgcaccggataaaataaaataatttgttcggtgttcaacagctaatttacatgtttttacacgttctttgagtgtcttgtagcatagaccataaactatgagtgtcatgtagcaaattttgccaatttagacatatcaccacatgcgcaattagcatgtcacacccaatgccaccgccttgccgccgtcgctgttgccagaaccctaggccaccactgtcaccggagtcagagctcccgtcgttggcggggaggaggatgcagctacggatctccccgagcatgtgcagcatcaacatcccgagtagcaacggcgtcatcgactcgatgaaggtgtgggtggcaccgtagccataaccgccctcgccgctcgcggggggtgtcagggccgccgtggtggtggtggatggggggcggggtggtaccggcgcgctgtggggctcggctacatccttccctttgtcttcatcctcgccgccatctcggcgctcgaggctgacgcaacaagtgctcctcgagcacctcgcggtcggcaaagatgccgatggtccatggggcacgctcgagcacctcgcggttcagctagctggccatcttgcgctgcgctctttgtggtatggcaccagcagtagggccggcggggacgtcctccatgcaacggtatacgtggatgttcttcgcgttcaaggcgcggcgccgcgtggtcgatcggcgatgtgtcgacctggcagatggaggtgaacacgttgacgcccccagttcacctgcgtgcaggcgtcgtcgatgcggcgatcgatgtcctttgtcgctgtcctggacccgctagtggtaccgcttcgagcagtaaaatcgatttgtttggtgtcagaacttatctaatggtgttatagtatactaactatacttagatcatgatgttatagcatatggataaacagtttcgctataggttttatcgtcggtgtcagacccgccggcttttttactgtagatctgcgcccctggcttcgagccgatcgacgtgcttgcattcggccggtatcgaacaggtttaggacctggatggtggcttatgcgcggggcgtcgtcgcctggagctcgaggaggctgagcattgccagcgtgtaattagtagtagggatgcggggcggccggacgggcaagcgggtttttttagcccgtttatctcacttctagtttattttttcttctaaattttatactattatgtagaaaataaactagcaagcgggtttttatgcgggttacgggactacccattatctctacgtattagctatccagcacccacaacacgattcaatagaacacgagatcaagatagtttgatggagatccaactgaattcgccgtcaccaatcacagcaagtaacatatgtattttcatttatccaaggagacattccctcgttaatttattgcatgttacttaaatataaaaaaattatatcactatatgaacatgcaagtttaaatttcacttctaccaggtctaagaaaaggaacaaattaaattgaatatattcactgttatatctcttctttttatataacttgtaactcgaatttaaatctatatgattgtgaagtaatatacctcaagttaatcaatcttgtcattggagtacgtctcgctcgttttggctccaggcccattgcaaataggacacgtatgagcctcgctcgcgactcggctaccaagcccgtctcggctcataggctcagatctcttgatcataatgctgctgctttcttgcactcaaattatcaataagcattttcattaagacatacataaatgatcaagctaattgtctcttgctgattgcatttgcaaatggccaaatgctatgtactagtattatatatgcatggttaattatatgttcaccagttgcagggtgtgcagataggcatcgatgcctccatggcgatcgagctgcgagatacgccaccccaacctgctgccgctgagggcctattacctcgcgcgggtcctcggccagtcggtcccaatagcggcaattaagctgctcgtcttacgatatgtagagtcagttttatctaaaataggaatggagctgagtgaaactctcttacaaaataaactgtagggtggagctgggtttagtagttggagctttactaaatataaccttagacttcctgcacaacggcagcttctcccaatttctccacggcttgcttcttcctagcattgtgcgggattacatgattgatcaagattgatttgattagctagttcaatttgggcttctacatcccaactattatactccatccgtcctaaaaaaacaaaccctggatctacgtgtccaacgtttgactgtccgtcttatatgaaatttttttataattagtattttcattgttgttagatgataaaacatgattaatactttatgcgtgacttatccttttaatttttttcataattttttcaaataagacggacggtcaaacgttggacacggaaacccagggtttgtcttttttttgggacggagggagtagttgttaactgctacatttcagaagatgcgtagtctgaacatttgcagattctaacaatgctaatattgatttaacctttcatcatgtagatttgatacatctaaaaatttaggagactggtatattttatttagccataagaataaacatatcccatagcaattactaaattgagcatttcatttcttcatggttacttggtcagtgcacacatttcagtaatagagtttcatgctcagttaaaggaattaacgcagtttttaattagatcaacacatgtgaaaaaatggtaaattaaatggcagacttttgtttaacagcagtgctttgctggcattattatgctttctggctctaaacaaatttgctccgcactcaaagtacatctcttggggttcatgcatctatatgaactgaaaatatgatgaatagatgatggattgctgatcgtctactccgttgggggctcccccaccccatccgctgtgttctatgcgaccagcatgaagagaatagatcacatcttggtcgcttgcccggaatcccgacacctctgatggtgggttcttagggtgattaatcagtcggcctgcctccttccatcagtggctttgcaccagtaggaaagtaggaagaaagtcgcgaaggatctctgatggggatttcatactattgcaacgctggtcacctggatgatctggaaggaaataaagagttgggtgttcaatctccagcagcggccctaggcggaagtagcgaaagctatggctgtagaagcagagttatggcgcctggccagggtggcagtgctggcgcttggtctctagtttcaggagtccctaggccgtcaccatcgtttgtgagattatagcttcaagtcctttgttgtacctctcaggtatcccgtcccgcttcaagttttcgtttgttcagtttataaataacatttatttctcttaatacaaagatgtgtttcttgcatattcccaaaaaaaattctgcatacttggtcatgttcttttttgataaatatgtaaattctatctcggttttcgttagcacgcttttcaaattactaaaaggcacatttagtacgaaaactttctatatagaagttgctttaaaataccaaataaatccacattcttgtaataattaaaactcaattaattatacgctaatggtttatctcgttttgcatgcacccaaaaatctaatgccactaacattttcggatggcaatgatagtgccactaacattttcggatggcatgacgtgcagtctcaagaaggcgagtgtgccaagactgacgtttacagtacagcatgggcatcatcatcctcaagctctgaactggcaaatctcccgctggcaatagcatgggtggtgacctgctgcagtatagtgggtggtgtccattgtcaacaaggtgtgaacctgaaccaacgagaggtgttcgcgctcgccatcgccgccaagcggatgacggacgagagaagagaaaggctgcagcggcggacgagacacagtagacgttgacaagagaggcggcggctgcggctacagaggagagatgccgatcagcgatggatttgagctcgtgagccgagtcaagcgaggctcatacacaccgaggtttacaaaaccagtggtacccacacgataatcacgcctacaaaaaataatcacgcctaccgtcggggcacaacaaaataaaaccgtgataacccattaacatcaaataaatttataaactaatttaattttgtgataaattctatacggtttgccacggttaccgtggttaccatacggtaactatgctaatcgccagagtgcggtaactccacctccgacagtaagagaaaccctacagatccatactatttgtattgcaccggaagacgtaacgagcgagacgtccgatcctgcgggagtccacatggcaatcatcggggggtggggctgcacaggagctgtttgcagccggtctccaccaaatatttttccccatcgaacacctgctagcgagggagaaggtatcaatcagacgctagcatggagcgacggcctggctctcgcttcgcgtactcgaccgtgtgtaaatggagaggaggataaaattgcgctacgctgtccttcacctcgatattgaaaactctctttctttttcgaaacgaacagtataagacaggacaagtttcaagtattgatatagcaagagaaaaatacaagtttatagtctggaagactatagtcaggaaaaaagaaaaaaaaacaaccgcactacgcgtctacaacaatacccgctgcaagagcgaaacaggagatcttcaagacgatgcctctaagaagggaacgacaacaagagcgcctccgctgcttgtcccggggagccaggacaaggttctcacctgaagaaagtaattgggagagacaagaaaatgcagcaacaccccaaaaggaaagcggcacccgcatgcgtcgttgttgccagcccgaaggcagagctttcgcccaaattttcacccctcccaagaactaaactactgcacactccgctaccaccaccatcgaaagccttcgacacacactgtgccggtgtcacgctgtcggccaatcatcacaggggagctcgaccctcgacactcgctggatccatccacgtagttgggttgggtttgatcccccgtgacagagtaactgctgactctaccacgatcccgttgcccgtgtcacctcgggccactagaccgtttcgccatcaccttgccaccctctcatgcgccaacttcctccctctttgccatggtggccaccatcccgctccacctccgctggcgtatcgacctcgtccactgcctttgtggctttgtgcccacaaccagctctggtaccgtcactgcccacgccatcatcgccctggaatctcctacacctcctccgtcggcgctccagccccgctccctgctccccaccccccgtagacggactaaggggaagagaaaggggagagaaagagagagggaaaggggagagagagagagagggaggaggaagaagggaaggagaaacagatgatgacatgtggatctcacatgacgtcacgttagcaaaaaccacccctcaaaaacgtctaaaaattaaattgcaccgtttaatagttgggggggtcgtgagtattgtgcggttcaaagatacgattcagactcagcaactagtcaaggagaacgatgggcccattgcgtaaacggcaatcgggctcggattcacggtagtacgtactgtaaccttttttagttgcaacaactattccgagttggatttttttttgcacgaatattccgagttgaatatggcagcacgcgttataaatttgccctaggcggaggtatcgcaacaaaatctgcctggaaggaaggaatagtacgcagggacgcagaaagaagacaatcgattgatacatgcaaaaccatcatatccattcatcagcaattcagttcagaggcatcgatcaccatgagcaacagcggcagcggcactagcaacatcaaggatgagatcgacgcggcgttcgcggcgggagcaatgccgccggagtggcggccgaggctgctggcgtcgcagcgactgggcgagggcgacgtcgacaggatcgcggcggccatcgccgaggttcacgcgacctaccaatacgtcgggtcgaccaaggggaacatcggttatgtggcgtttttgttcgtcctcggtgtgctgttcttatgcgtggctggccttttcttccgcgaaaacaactacttgaatggagcgttagccgtgcttgtggccgtggccttcatagtgatcattcctatgataatcttgctttatgagttccatcgatggagggccaatatgctaatggcgcaaacacgaactgtcctcgagcgctttctgcttccacctgtttaactgaactccatccgtcctataaaaaacgaatatagaaccaaatatgacattgcagtactataaatttaagatgtgtcatatcggtactaggttgttttctatggggacagagagagtactgctctagcttactctattatatgatgatgatggtctttttccatcttttcatgtaaaagaaaaaataaactgtgagattatttggattgaagctaatttttatatcgacaaatgtttggtatgctactagtttttttcctatagtaattggaaattctatgctaccaaaacttggtagcgccaacagttgcaaggtaattttgttaggccaaaaattttgaacctaacaaacccttacctcttttttacctctcttaccattagactttctccatgattgctcgtcttaagtccaacatgcattcgaggatgcactggtttgggcctatttgacctaatatttagccatggaagcctcgataattagtacgaaaatgcaagaggtaaagcgctgattgccatcactagaggagaggggaaggggacatatggtggtacgcatggatgtgggacctgtgggtacggggcaaggggtaaacaccaatggagtgttccatgcaagctaaaggagtgcggcggccttgacattcagaatctagaattacagagcaagtgtttgctaagaaaacggttatttaggttatgtcatgaaggaggagtatggcaagatcttctactgaaaaaattatgcccacgggctcacttgtcaatctctctttctctggctcgccggcatctctctttctctggctcgccggctggaacacgccgtcctcgccgagccaccgctccggcctgtactccaagcagtcctcgctcgatggcgtatgcgctgtacgtcacggaccaaccggcgcggacgagcgtgccgtcggggagtgtgtcgtccgccgcgcacgactgacgccggcgggtacaaccgcatcgactccgtgagtgcggcatggaggtagtgcatctcccagagcgcatcgaaccgaaacggctcgccgaggcgtgtgtcggtcggcttcctcaccgcgcggacctcgtcggcgatgcgcgccacgacgtccggccgggacgacaagagacagaagaaccagctcagccccgacgccgtcgtgtcacggccgacgatgaggaagctgaggacgatgtcgcggaggacctcgtcactgtgctcgtcactcgccacaaacctcgacaggacgtcgtctctgtcttgcacggacgcgctctggcgccgggcgcggacgatgtccatggcgaaggtgtggacgtcggcgatggccttcctcagacggcgtatggtgccgacgttgagccacttcttgatcttccaggagacctcgatgagatcaaagaagcgtccgacgacaaggttctgcgcctcgccgaaggagtgcatgaaatccgacctggcatcctccatgaccccgccgtcggcgaggcagggcaggtcgtgcccgaacgccaccatacagatggtatgaaacccgaatcgctggagcacgtcctgcaagtcgaggacgtcaacatcatcgctatcgctcgtcgacggcgactttgacatcaccatcaactggtccggcggcattcaccacccctccgcggcaccctcgatttgaggcacgcgccaccgtatccctgccgggccagtcgccattgcgccgccgccgagctccctgagagctcggtgccaccgtgcatcgccatgccgtgcgccgggatgccgccgtgcgtcgtcgccgtcggcggtgaaccccggcgatgcgccgccgccccgccgtggccgagccgtcccggctcgagccggcagcgttggctgcgcgcgtcacgcgtctgctcggctcagtactaagcgcgaggaagaaaaaggggaaaagagaagagagagagcaggtgcattttggtacttacataactctttctctctccattttgactggaaataataaaataataggaggagtgtccacttttttacagtgtccacgaaaagattcacgatcttcggatgtctcatagcaaaaaccgtaattttttggtgccctatagtaaattttgccttgttggatagataactccttttctgataagttgtctgtagaataccgctacagagcgttcctgcggaagcaaagaaggtaaacctttaacaatggggaccaaataatgcaagcgtgtttgatgaaacttaatcccagtcagcttttcaaaatgaactggcaagacacaagcagggtcgtcgtcaacttttcttttcgctagttctcaggcccggccgtattctggtttggtcaacaaacaaaaggatttgcacacgaaactgatgtgagatgcaagctactaagcatgaggcaactgataaactccctaaattcaaccagataacgtagcgtatgcacataaccagtcagtaaaccagtgcgtacaatatgttgagtggactagcacggggcggctttgacgatccccacatgttcaatgtaacacgactaggcgatctttatgaaacttctctgcaaacaaaaattcgtaccacaagaatcgctctgtagctttgcccggtaagcaatatagttcctactacaaaattgttgtaattaaaaatggggcctgaagaccatggctcattttaccaggactggaataccacattgcaaacacgaacataatcaaaagacaccatcatcagttcacacgccaacttcccattgtaaaatcacgacaaccatgtacccagaagctaaattgaaccaaagtatcagcacattcgcaactataaacagtcattcaacgacctatgtttaagaagactctagtgcacttgtcattaatagttatacctcaaaatatcaagtaaaaaaaaggctccggtctcggtcttggtaagagacacagaaggtcggacactagaacataactgttattcagagtacataaaaatgggtgaagctggaagctttgtatccttctacagttcttacaccaccccagatggaagccgtagcaccagctgcccaccgaccaaactgcacccagcaaacatgcattagatgaagttcacaatcaaattaaatagttaaactagtgaccctaaatgtacctcttcacatagtagtagcagaaatcagcaaggatgaatgtctgcacgatttccgacagaagcaccatagatggccacaagccatagcccagagcagtcaacaatcgaccacgagtatccaatacctgcaggatgaatttgttgtctttaaattaacataaattccatgcatatataaagtgtcaaattcaacattgtggatagttttttgtttctgaaaacccatgagtaacaactattgaatgaacaagtacagaaatttccccaagatgtccttaaccattaaaaaaagagcttttaagatgatgcaattatactagaaaaaacaaatcaaggtaaacaaggaagcatcatgaccaggttgttcattgatgatacctctaaagtacatgagttgagaaaactaacataataaggtcatttatcaaagtagaacggctaccataaaacagacaagaaatgccaaacctcaaaaaaaaaacattattgtaaattaagtgttgggattctgtgcgctgggtatggtacagaagaaacaaagaaagtaatgacaaaatcaataaacaggggaacacatataaaagtaagcttggggtttgtttagaagacgaacctgaagaacccagtgtgcacagctaagaaaccttgcaactcccaatgcaaacacatagtgtgctgtgaacggctcaacaatctgcaaaagatggaaaacatgttcaggaaacttcgcccctgcagtcaaggaaaatgcatgctatttacctttgtgttttgcatcaaacgcagctgtggtagaactgagacagcttccaagtaaacacaaaatgcccagctgatacggttcacaatgttatgagatgttgaaggatgaataagcagtgctagcacagcacaaggtaccaccttcaaaaaagtaataaataaaagaacccgataagtaagcatccattttaactaagagatttatgagcattacagctgacttcacaagcaaaacagtttggcacacattatgggttcagcattttcagtgagtaataaataaagtgataacacttctacagacccattactgactgatatctacaaggtttcacataagtacatcacgtcttcagcagtttatgcggcacaagacaaccagagtgatacttcctcttaacgtttgtattttgttgagtcgtcagaatgcgaaacaacaactacttatagataaatacttaatgagccaataactacaacaaaatc

SEQ ID NO: 68459 - DNA, 1694 bp, Oryza sativa
  unsure (1)..(1694): unsure at all n locations
ttttcaccaagactggattagccaaccatccaggatgcatcacctctcttataacttttgctttgagcaacttctcgagctccacttttgctgcttgctgcctgtctgttgacattcttcttaacttttgcttttttggcttgtagccttgcttgattgccaagttatgttcgatcaggcttctatctacccccttccagttcttctggtgaccaagcaaagacatccatattgcttttcactactttcaagatttcctcctcaacatgcttttccagattctctcctagcaaaatgtattttctaggatcatcatcatctaactatactttcctagttttcccttcaggaactggttcctgcaacttagagtattctccatgtttttgatcaacggcatggactcctttgacatttggcgttccctgaagctcaaactttctcgccgccaactggccacctcggacagatatcactcctcgtggtccaggaagtttcatacatatataattgtgatgtattattgcctcgaagatattaattgctgatctccgagtattgcattatattgacacggggtacctaccacatcaaaccctattttctcttttcttgcattgtggcatattccaaaaaccacttgcaaaggtattttcccaattgcatgtacttgtgtccgcaaaaccttgtagaggcactcatgcatttgtcaatctgtcttcgggtatntgcatctttttgaaagcatcgtagaatagcacatccgntgagcttcntccatcaccnaagactctttgactttcgcattgtactatttccactgagatcaccaaagggtcctggtgggggaaaagtattccttccgcatcttcaggcccaaaggaaattactgtcttcgaatgaactggtggatttgactgatagcttgtccatacatgatttacttgtctcacatatgcttttctttgtctttttgactcaattcccaaagaagagcctcctgttatggcatttatcactctttttggagcttcttcaattgcttctattttcatgacttgtggtgcttctatggcatttttccctcgctgatctcaagccccctaatgcttgttctcatatcgaccgacatgcttttccactaagtaagccatgtgcttacattcttcagtggaatggcctcatagaccatggatttggcaaaacttgctatagcattcttccgtagaatgaccacctagaccatgtgcttgacaaaacttgctatgattaggctgatactcttttcctccgcttctatcattattcaaccatcatcctctacctctgccagaattccaccattgtcctcggcctcttccagattgcccccagttatttcttcctccacgagtgttttctcattgtcttttcccttttccttctccattatttgagccatctccaatgaagttcacttgttttttctgatcttacttataatcgaatttttccatggttttgcagtgttttctgctttttgttcttctcctaaagaaacttgcttgttcttcgtctgctactttcccaacaatgcagcttcttctgcttgcaccctcaactcatcttcttctcctcttacaaaactttcctattccttgcaggtccttcactgtctttggcctattccttgcaagatcgaaacagagagggcc

SEQ ID NO: 68460 - DNA, 2586 bp, Oryza sativa
aggcgggcgggcccgcccgtcagcggcacgcgcgcggggaggaggccggatgggccgcgggggagagcagagagagggagagagatgggccgagccggcccaagagggggagggggggagaaaagactttttagagcttttctttttataaaaccattttaactttgtttatttcttcttaattattatttgtgctctgaaaattccactaaaatttatttacgcattttaggcttttaggaaataaacaaaaatcctccaagccttatttgacttttaactttgcacattttaattgttggaggctttcacatggattttacttattctatgcataatttagaggatgtattttagagtcgttttgggacgcgacaatgatgacgatgacgatgggtcgcttggttccggcgtatgattacggggacgtcggccgggttctcgagaatcatgtcgtcgtctcccgctgttgtctcggcgccgatctccatcatcgtcgtcattattgcgacgtcctcgaccagtatcgcccagcaaccgccgttcgcgatcgtcgtgatcgtggcggttgtggcggttatcacggtctcggtcttcgcttgaacggcctccttgatgttcgttatcgtgacgccgtgaagagatatgacgccgggaatggttctcgttgtctcgtgtgcgtcgtgcctctcggcggccattcaagtgatcgcggagatcaccggtgccgcgaggtggcagggtcgctcgatgaggcgattcccgccgttcagggttttcaccatttgcatcgccagttggtggctgttccgggtgcgctgcagcagcggcctcttcgaacgcgttgctgaggttggtcactgattcccgtagtcgttctgtccaatgtgcgagatcgtcgttcagaacgggatcgtagggggtttcccttagtattgcgttgacggctctgatgtgctgggccggagtagtcacttgattctccgcttccgcattggtgcgcgctgacgtgccgacatcgtcgatagccaatacctcacgcggcgtactcgttgtcgatgatccatagtcttcgagtaggtgcaagactgatggttcatggggatcgatgtcgattaccccaacaaattgatctgaaatcggcgtcactccttgttccttgtcctcatctctgatggggatgtgtgactgctggaccttaggaggtggcgtcttcatggcggtgagaaagaccttgcagctcgagaggtcgtgattctttgtcttgtgaataggacaatagacatcacgagttggagaggtacgctgaattccacgctctttgtaggcacgaatttcagcatggacgttgagaaagacccagcaggcttgcagggtgtgtttcttggttttgtggataggacaccaggaccttgtcacctcggaagttatcctcgtcggctcgtgattcctgtcggaaagacaaggcttggccgcactaggatccttctcgggttcggatgtcgtcgacgttccgatctctgcttcggcgggaggatccttcgacatggagtcgccccgggttgtagccactgcgttctcgtttccggccattggcggaccagttgagatcggcattgtggtgtaaaccggaaagacgatttcactgacttgagtccacaccagtgttgttgaagtaggaactccttggttgaggttggtgttgacgctgttgtcaacgaagctggatgtcatagtagtagaaccttgagcaccaagtcccccacctggcgcgccactgtcgacggtggatacccgtagaccggatatagagggtattgggatacgctggtacgaggatctacgtagtacgacatcaagcaaacaggaaacagggattatactggttcaggccccttggtaggtaatagccctaatccagttgatgtgggattatatgatggaaaccacagattataaagggaataataaagctcgacgataccgacaagatcgtagtcgagttgatccgactagatctcccggcgacttggtttcgataagctccggcttcgtaggctgtggtggatgtgttggctctgagattcgatgccttaggtcctcccgggggtcccttttatactgtaggtcaactggtctccaagtaagactcggagacatcgaacccgacacgatataatgacgacccagttctatccgagtaggactctttccatctgtagactccatgatggacttccttaacctatgctgagaacatccatatacacgcaaacataccatatcgatacgtgacgtatatcgaatggtcgagggtatactttacccgtaaccctgacaaaaacattggtggagatcagtggcgccgaacgtaggtttacacatggggctggttcaagcaaggagctagccctagccagctgctggctaggacaatgatgtatggctctggcaccgcacatagtaagccacagtcactggctcatatcactagcacaacggcaaacattgagcgagttaacaactgctccctccgtcccaaaaaaaaccaacctactattagatggaacatttcctagtacaatg

SEQ ID NO: 68461 - DNA, 10903 bp, Oryza sativa
cttaaccctcaccgagtctagcaacttaggttagttttgattaagtgtcatttagtttttatatcgcctattcacccccctctagtcgacatctcgatcctacagccgccacggcccaagacgttcttccgctccctctccgccggcggcagcaagaacatgacgccgtggctactcttgacctcgccgtcgtcgtcgctgcatcaggcatcgaggtagtcatcgacggcgaggtgaggcggacagatctgggacgtcgttgttggtgtggagctccacgtagaaggaggttggcggcggcgcgaggtagagggagacccggcgtcccgggtgaaggagtgctgaaaaggaagaaggtggcgactgctttggtcatgtccatctccggccacacttgtcaccgccgtcgccgaattatcgccggtctctcatgctgtggaagataggaggaaggagaaatgggaagaaggaagaaggggaaaaatgggtagtttggtccaattttttctggaaatgcatctaagagggtaagtagtggtatcttttgaatatgtataaaagtataatggcatatttccaaatacataaatactggtgacatattttgaaacgggcaaatttttaatggcatgtatccaattaacccctcctgaaatggttccatctgctattcctccggacgccccctcatgaggtcccagtgccgccaccgtcgccacacgccgaagcaacagcatcgcagctgggtgtagtggaagatcgcgcgcgccaatgccaggcggaggccgtatggccgccgtcgccgctgccaccccacacaacgcctccgccggtggcaccacgggagcacgagcattcttttcgttctcctgggagccaaatctccttgtctagctaagttcccgcgcttgatctgggtggtggccggtcggtaggtgctggggtccttacttgtctagtcggcacttcagttgatattgtaagcacgacgcatcaatttgcatccatgatttgccatcatcttgttaaaaagtctactagcagaaattttgaatagtgaaaagatgattgttttgttcatcttaatgcagattggagaataaaggatctgagaattgaagatattaatggcaattctattgagccttcctatggaacctatcaccaggactaggatcctctaattttagctgcattaatgtcaggggtgaacattgttgtcacttttgaagttttacacgtttaattagaggacagcaatagaaactaaaattagaggattaacttggtatgttacctgatgagtggtgaatcattcatgtatcttatatatcactatttatgtatgcaaaaggcaactcagtgtattgagagttccgaagcttttaagtgattactttcagcacttaacactaaatgattgtccataaatttactcattcatttatgtctttaactaatggactgtatttgatcatataaattcagtttctatccttgatttaaaaaagtaacattcagttgtaatctctcgagataattttcactcaatgattatttaacatcttttcatccggtgtaatatgaaattaatgcatagcatttcccatcgcaacgcgcgggcatgtaactagtatcatataaaatcgtactacctccatcctaaaatatagctatttttagctataaatctgaacacacaagtaagattcatagctatttttagctatgaatctgcagaagtatccagattcataactaagaatgcttatattttgggacggagggagtataaacttgccgatgggtattgtacacagtgtacagtacattgtacactgaattcgataagtttttatagtgtgaacgcgagtttaaaaattttggatccgagttttacccacatgtaataagagtagccgatccatttggatatctatggataacctattaatataatagacttatagtagatcgaccctattaaaccatggatcaacgaactcacttaaaacggtttaggttcaatccatatcctaaccattccaatcctgatgtacactgttcattcgtccacgcggccacgtcgccccaaaatcagtcgcgtccaatctctttcccagccacgtgtttgcattgtatcgggccaggccaattgagcccaccacccaatcgctcacgacaggcagaggaggaaaaaaatggggcgctgtgaacccgctgattccccattctctccgggaaatttaagtatttgtcactcttgtgacatagtaattaacgatttgccacatcgtatctataacatgtggattctcatgtgttataacatatggaactagtggcaaatcatacgagtggcttacgagtggcaaatagttaaaatcccccattctctccaccgcgtcatggcctgcgacggcgccgccgttcccctttcatctcgacctcgggcacgcagctcgcgtcactcgccgtcgtcgcttcccagcgaggccatccacggccaccgtcgcttcttcccggagaccgccgccatctccccacccccgcgtgacaccacttcttgccctctccatctagggttttctcgggcctcgaatcgctgtaagcccctcgacgacttctttggttgttttgcttggatctccagctcaggggagcgctgctttgatttggggattgtgcctctcttgcctctctggtgtggagcgatcagtgtggcgttgttttctcttaagctagggttagtgcttagtactgtaggtgggaaagcaatttcttttttttttggggggggtggggggatgaactctcggcttcttctttagatggtacctttgattgggtgtgccgtggaattgcctgccatgcttgataattttggtatcccctgtgtagaaagcatgttccgctgccacggaggacagggatgcccctgtgcttctattatctccaccaaggaggctgttgcattccagatctccctgtcgggcaagctcgggaggacgctacattgagccatgatgactgcaatacttttaggccttgagaagaggatttggaccactggtggttctgaccaagatttaacggtatgtgtttttctgtatgttttcttccttgtagtgtctattcccttccccacgtcctgatgattacttgctcaagctgtttgattattgttgcagcagttacaccttcagttgaccactcaaccaaggtatcgatcagttttggtccaaaacatatgtttattctcatgcatcgatttgcaatgaccaaatctatgcttcgatcttttaatttgctacagttttccctgcttctctaatcagtaccattacagatttgtctctgtgactgcttactgtactttcaaattgctttacagtgcatgcacaagtctgttgcctattttagtactagccaatatatagatgttcccaacgaacatggtaaaaatattctctgcaattctttgcttctatagattctcatgcatacgatatctgatcgatatccatgaatccatccttcttttgcatggttttcattttcagaacatttcagctttcggtatatgaagctcaagaatgaagtgaccgttgtctggcttgcaacctttccagggtacaaatcaatcagtttggatatggaacacgcattgtacgggttgctgcttataggttgtttggatatcacttaatggatcaaacaagcttgtcatgtttgtttatatgcaggtgctatttggaattaagtgcagtggttgtacgggttaattcaaacatatgtatgtctagattcgtagtactagaatgtatcacatccggtagtagattatttttttataggacagaaggagtagagttcagagaaagtggctagcaagtaggccccacattttttatattttttcctaggcacttaaatgtgggctttacctgtatttgtgactgggttgctccatcatcacaaagttgactaagtcaaaaggtcacgttaacaaaaccatccaaaacactatcgagagaatcaaaatttatcggttttagtaattaaagggttgagatatctggcatggtatcgtggttaaagggatacgatttagattcgacgacaagttaaggcagtcaaaacggacttaatctgatttttgttagcaaattttagccatctagttgtcatgtattaacattaggaaaccgaggacggagagagaggagtgaacgggggcacggttaacgaccaaaggcaggaaagaaaattattattaattcaaatcctgatattttaaattaacaacgttgctttcaatgcactgaatattctgctataaatcatgttaacgattttaaaacaaagagaattcgaaaaaaattatccctgacctttctgattattaaatatattgttaattagggttttctactggttaaccaaagtaatttctatagacaatttacagtaaattgcgctcatggtatctgaacttctatgaacttatatggtaggtgcaaataggtacaataacttgcaggtcgctcattcacacatgggctaaaacaagccacgcaagaaaattgatctgaatctacccgcaaccttgatgatatgtacgcatcaaaaccggattgaactaatccattccaggaaaattaaataattttgaacggaaactattgagatcacatcgtgaaaagccaaactgccaattgaaatgtatcagtaataattagaagtcaaaatggatcagtgcagtcaatcgtgacagtgtagtcaatcgtgatggaaggaaataacaatctcatcttaaccggagcctgtgcgcctaaaggtcttagaattggtgacattatgtttatcggctaccaggatcacggttaggtcgatgtcatagtgcagcctttgcacctatccctaattccctatacacacttccagccaaggatcactgtgtgtaccaaaccgatgatatcctagcacgctcaaagccaacccagttctagccgaggatcatgataaattggtttgcccagcctaggacaagccgatcaaatcggtgagagtgataggagaggcaaacatcaggtgttttctgtaaattatatccccaaacaaccatacggcgtgcaagatggtatgtcatccgtgcgccacgccgtatcattttgctagcatagatcgttttggattaaattagcacggattagccaagttattatattaaaacaagcaatttacaaaatgttgtacctacttgcacccaccacacaagtttatgtaccgtgattgtagtttactcagacaatttttaatgaattagaaattacggaaaagatgaaactccggatgtgacaaccatcctgaaaaataatcaaaagcttgattgtttagactttatgcttctctgcatactttgcgatgcatcatccctagcggtgcttataatcataaaaactaacaaacatgcttttggtcataataaagggtaaaatctcgttgcagtcatctaacataatcatgctttacactatattctcctcttatatgagtagattattatatataaatatatttagtccttaattgaatatatttatataaattggcctacaggtataagatcatatcggagtagtagccaatacgttatcatttcctttattttattctattttctactccctccgtcccacaatacaaatgattttaagtttttgatggcaacgtttaaccactcgtcttatttaatttttttttgcaaatataaaaaactaaaagttgtgcttaaagtactgtagataataaagtaagtcaaaaataaaataaataataatttcaaaaaattttgaataagacgagttgtcaaacgttgcaagtaaaaactcaaaatcccttatattatgggacggagggagtacctaacagcccattttcctcaacggtatcggcatgtaaagactatatgtcatcggcccaccagccgatcggctatcgtttacaagattaattattttattttccttgttggttgcaatatcaaaccaactagtacgcccttgaagaaagcgagattttggacttgcactagagttatgtagatctcttaggccactgtgtgttcttttgcatcaacagtagttaagtgtcgagatacgtggttaaagagatgagtacgatttagattcgacgacgagttaagacagtcaaagcggacttaatccgatttttaataaagatggactgggctggccaaaaacaaaaccagtcttcggctcacatcgcaataccaacacaccgcatcgcatatttttcctcacctttgctcaaaactccggaaagaaaccagacgaaaccctaagaaagagagacgtcttcggctcttcgcccgccgccatggcagctattctccgatccctgggtcgctcggcaaccaccgccggcctcttcggccgccgctgccgcctccttagcgaggcagcttcagatcatcaggtcagttccgtcgctcgccatcttcttctctttctcgcgacacagacccgaaatattttcgacgaaaattttctccatctcccccttatcttcgatctcccgcgcgttggggctccttcaatttcatatgggaaggaacaaatgggaaggaatagatttgtaggatcttgtttggttaatcaatttcatcatatgggaactagattggaggggatttgggaggtgtgcaatgtcacagaccaacacaatcacaccaaatctctcacacacagtgccaccgatatattgcaaatcgtgttgggcgacacacaattgcaatggtgacctttggaggcggaatttgagccatggaggggttggtgctggtggtgcccgccaggtgttcggtgaaatgctggctgggagatgacgcgggcgctgttcttcatgtccaagtgagccaagtcctttatccggtgaccggcgaggtactgcatcaagtttacaacacctatggagccgtggctgtgcaggtcctcaccacgagcccttggggtgttgaggcttccgtgtggttccgatcaacctgcgatgcggagagggctcgttctatcactaatggacgcaatatctatgatgggtgttgcctgcttgatgtccagcacgtgcagcccactatctgacccatagtgtatacgaccattgggtatatgacatgcaattaatccccctaatcctctccaatccaatccccatagggataatttgattaagcgaacaagccctcactgatcgattataatcaaatctaacttgccgtcctctaatttgtgccgttcccgtggaggcagccgaagaggattatcggtttgtcaagcggtgtgcacgttaaaagaggctcaaggatgcagtcgtcgcggcaatgccgcagtaccccgtcgatctgctcctcccttgctgcttggtttccttaggaagtctggttcctattatcagttagcatatttgtggttaaggatggttcagtgccacagaacatctgttcggcgatgtactgtgattcattcccttgaactctgtctttattaataaaagtttgagttttcaaaaggaaaatctaacttgcttacttatttatgcctgattttgatttgcataagaagatcgcaaagaacagcggccacatgaagaagggatctgcttcggcgatgatgcagcaggaaagggatgctgcggaatcgggggtgcaaagcattgggggagatgatcttgctcctagtcctcgcttgcttttctggtgcaataccgattcccttccgtctgtttctacgactttcttgctgctaccttaaatttaactcttggtcttgatgatgatttattgagtttcaggagtagaacttaaatttgagtcttggtcatgctttattgaatttcaggggtagaataatccgtttatccatcatcacctacgcaagcttcaaacttggacaaaactctgctagaaacgcatacaagagaaccaaggcagagcttccatgcttagaagctgttgacagcacaactgcgtagctctccctccatcttttcatacccaccttgccttgagctgcccctttaattatgcatggatcagacctatgtatgtttgttttccaagtaatctatatctccattgggcatgtcacctttagttatgcatggatgtctcctttatagatccacctgttgatgttttctgctaatcgatgtctccagtgagcatgcatgtcaaagttggaagtttgtgtgtgctttgatgtaatggaaaagttggaagtttgaagaaaaaatttggaaccaaacttgtaggctgtgtttagttccttccaaagttgaaagtttgggttgaaattggtacgatgtgactgaaaaattgtgtgtatgacaggttgatgtgatggaaaaagttagaaatttggatctaaacacaaccttgatgtgatggaaagttgtaagtttgaaaaaaaactttggaactaaacaacagggctaggagttctgagggatgtccggatgtgataaaacagatgtgacgccaggtatgaaaacgaagatattacaaagtgtttgcgcccccccccccccccacgcccccgcccccaaaatcctctttgattcacttccattaatctgtggttttcttccattaatttgtggttctctcgggtgccacatctgagcttcacacatcctccaagcaaagagaactttgcttggctgcttaatgtgatcttctgttgattcacacaatcacccattcttcaaggtacagctgcaaaaaatcctaacttgtttgacacgaatattggcactatttgatgaatgattttgttgactaaaacacactataccccccccccccccaaaaaaaaaggtttttgctatgcatcactagcgtgttttttctttgttcggactcaaattttcatctgtcagatcatagcttcaagatctgtgttgttcttttttttgggtgcgcagccaaactagctcgagcctgtttgctctactgatcctatcgactatcgagtgaggtcgcacgcactagcactagctagcgacagcgatgtgatcaatggaaaaaaaaatgaaaatatacattttttttcatattttgcgtttatatacatagttggcgaagtttagcgaaaatatacctctcctgcgcgttgggagtgcgggagcagaacaaatgcacggcgtgatggcgcgggagcgatttgccaaacagtgctgcggactgggggtgcgggactggcttggcgcgcagaccgtgggggtgcggaactggcttggtcacgcagaccgagagtgcggaaccgagtcggtctcgcgcggtggctgtgctcatgcgtgtggagtgcgggaccgcaccgatggctgctcagtcgcgcagaatggtggcacgggaccaaagtggtaccgcagtctgaaggcgcggaaccgagccagtcccgtggggctacagttccacgtttccgacgtgcgggagcgtgtcaaagtaaaagcaaatcattgaacgcttttctaccctatatatcttcaccaactcactcttacacctacattactcattagtaatatgcccgtgctaaatgctacggtgcaattccattgtctttaataacttttaaaatttcatgttaggaaaaaaaaatctatgatatgtgcaccgtatcggctcacctttctacatttttcccctccctatttatattttcctctctatctgtccgacttccattttttccccggtataatcaggctgtgttctccaaaaagaaatatctccttccacatgtaaatagaacaatgaattagcacatgattaattgagtattagctaaaaaaatttaaaaataaattaatatgattttaaagcaacatatatatatatatgtatatatatatagaaaaactattctacacccggatatagaatagttattctataccccctccctccaacccacctcccctcccttcaagagggcaaaacacacccccccacattggtcaaaggtcccccacctcggtcaaaccagtctgtggctttccccaccaccttcactcttctcagttctcgtctcagaaccgcgtagtaatgtgatgttcatcatgcagtaacgctatgtcttacgtgcagtaacaacactcaaatttagttaaaatatagccatgacggatctacttttgataagcactttttttctaacatcatagtgcaaacggtttaaaaaaaatcatacatcacgtgagagatattgttgttcgaagcttgggttttttggatcttgactatccacaagtagtaatacttagtattagttactactatctattgtgcgttactacaatcccatcgtgacgttattgtaacgttattgtaagtgtgcagtaaagaccataagttttgtagtaacaatgcgtcttactgcaattctcgaatagtgttactgcataaacatgcggtaacatatacctgccatgcagtaacaattccactttgtgcggtaacaattatatttagcatgtgatacttttaacctatattttttctgattccaagtttaccgcaatctcaccacaatgttactgctaaacgtgcagtaacgctctatatgttctacagtaaaaaggtgttttactgcaattcttgtatagtgttattgcataaacatgctgtaatgtgtaactgtcaggtggtaacgtgtatctgtcgtgcaataacacttttacttttgtgcaggaacaagtatatggttatcatctaaaactttgaacccatatatttttgtttcaattcctgatttactgccattcaccataatactactgtcaaaagtgcagtaacgtcatatacatgcatgcagtaacacta

SEQ ID NO: 68462 - DNA, 6578 bp, Oryza sativa
ttcaaactgttaaacggtgcattttttgcaaaaagtttatatacgaaagttgcttaaaaaatcatattgatccatttttgaaaaaaaaattaataaatacttaattaatcacatgctaatggaccgcttcgttttctgtgagcactgtgcgtgttgggatccagtgatggcgaacccagcctgcctgctttagttcccaaattttttcccctaaacatcgcatcgaatctttggacacatgcacagagtattgaatctttacctattataaaattttaagatgtttttgccgtagtctcggtacgtcgtccgattcgctcgctgccattatcctattgcaattccactgcacaccacgtctgggccgtgcgacagccctggcggatgtacgtttgcccttccagttcacgtgttgtgtttccgttcaatttggctgttccagacggacagaaaacaagaccgttttgattcttctattcatacacaactttaattccatagatatacacaattttttcaagcgaaacggactctgaaacaggaaaatttagggttcggttgtgtaggataagactcgatttcatgcgcgatatgatacggttttgctccgattcttgggaaaacggaaaaaggaggagataagaatcaaaacccctcgatcaattttgaattacctccaaggattcggttggatttcacggaggagggagcttcaggcgttctctgtcagcgatgggagtccggccggaggtagatgacgacactgcagcgctgggacccacgcgacagtgagagggggagcaggggatgatcattagacatgttgcttgatgggcctgatgcgcgattgtggggcggaagtggaggggaggaggagggaggttaacaggccggctcggctgcggataatgggctcaaaatagcccagggagaaaggaagctttttaataaatacgaaaatgatgtttatattattaaaattagcaatgaagatctgaaaattctaaaaacatttcacatagtgtaatttatcatgtagaatttaataaaaattaaatccaatcatattttatttggaaaattttatttcccacatttaccttgattttcatgagcctttcttttattcaacatcgtatacatgtgtaattgtgattttatattttaattaattacataatgtaaatctttcttaattttttcttaaatttctcatgttttcttcccgttgcaacgcacgcgtattttttctagtatagataaaaacaaaaactaattatacagtttgcatggaaatcgcgagacgtatcttttgagcctaattagtccatgattagccataagtgctacagtaacacacatgtgctaatgacggcttaattaggctcaaaagattcgtctcgcggtttccaggtgagttataaaattagttttttcatttgtgtgcgaaaaccacttccgacatctggtcaaacatccgatgtgacacccaaaaattttcatttcgcgaactaaacagggcctaaaatagacttttgaacaaatatcaataaacatttgaatgaatatcagcgtctgatgtgtaaggtggtgagcgtggtcacgcagacaagacgactatggatgccttatgcttggattagggatgaaaatggcaaaaaacaacattgtttattaaagacaacttacgtcggttgggaattttcatatttaacagtctaactatttagtgagaactacaatatgatgctaaaagaaaacataaaaaaattcaaatttttatatagccaaatcggaaatggtaaaaaatggcactatttatagagaaataatatatattcagttggtcgggaatttcagtcaccattttcattcctacttgaaatgcttgattgatttaataggttgatggtggattgctggctaatgggttagacctaggactaagtgggaggtctaggggtttggttgtggcgtgaactatagctgggttagttgacccaccctgcataatggagggtcaaggattcctatttggtgtagttgcaatcccagtcaacagagccgctcgtcatcagccatcgatcttcacctgtctctggccacaatcctcgtccctgtccttcgttcccgtccgtcctctatcttccccatcttcctctccatctctggctcaactcctcgggccatgccacgcccccatgccctagctcttaaactctagccaccgagggcagcggtgtggccaccagccatcgcgcggggattccgccgtcaccaatccaccacgtgcaggagtagcaacactaggcacaactacatggtcatacctgtggtcatgaccgggaaaatgatggccattgcgaaagaagaagatagattttgagtattatgaaggatcgaatcataataactaagccatccagagaggggtgaatggttggtatacccaaaaaccgaaaacttttagcggaaataaaagttatcctcgaattcaacggatcgcggtctgaccgaagtgaatgcgccggtctgaccgcctggaatacgtcggtctgaccgagatcgaacttcggtcgaaccgccgagatcgccagccgcgcctgttgtcgacgccggtctgaccgcctcgctcccgccggtctgaccgccaccttgccgccggtctgaccgccggtgagtcgtcggttagaccgccgaaacccagtgaaacacaaatcgatgaactcttaaagtggatgatgactttattgattctctctgtgtttacaaacagcaccaacatcacttcttacaaaaatttcgactaaattcgaaaccctaactcaaaactcaactcaattgctttcaaaagcgataccgggaagcctcacactccccctctatttatacccgaggtaggcaacctaaagccacgaaccaaactcatactaggagtcttaaacaccttaggaaaccctctagtataagaaacaaactttacataaccaatcatactaaatttggactccttccaaattcgactccgcatcccatacgcatacaatacctccatcgtatgccatatggaatctccatcaaccacgtgcatcaactctagcctaagtatcccgtatgatctctgaccaccacagacgttatcttatccccaagccgactcccggtccatcaccgcaaatactctcccgaggcatcgagtcacctacatatgaaataaacaaagaaaccatattccgagaccaagctatctccaacttgactcattagtagtaaacaacagtattacatatgtatagtatccatctagaagccataacaatgaaacaatcacggatatccaaacaaacaacctgaaaccgaaaccgacacagcgttagccagtcagaccgcgggctgcgccggtctgaccgcgcatataccgctggtctgatcggcaacacctgcccggtctgaccggacccaatccagcagtacctgtagattcacctgtgaaatccaatcatctccaaaactacttcgtgaataaattccaaatatcaaaaccaataatctccgatgccaattgttcgttacagaataataatcaaaaacctttattttacatattacatgaaagtttttggatttttcaatcgtaagtttttgtgattttgagatgaaagttttagatttgaattgaaagtttttgcgattattgagatgaaaatttcagatttaaattgaaaattttgtgattaattttgagataaatgttttcttatattttaaatgaaagttttgtgattttttaaaataccacgtgaagctgaaccaaaaccggcaagggatgcatggtggtgtgcgacttgcttcgctagtgtagctgcaccaactagtaacccttgggatggtcctccaatggtggagaaggtcatgggaaataaactaaaataggatctttcgtgccacaaaatttcaaattttacatatgaacctatccactaatccacagcaagaaggaaaaaggacgcgattatatttactaaccaggtgttatcagtaaaaataatgtttatgatagcttaaacaacacatgcttacataaacataagcttacataaattgatatgatttaaatttaaatagtatataaaatgatgatttaaatgtaaaagtaagatgatgtggctttacgagagaacaaaagaaggaatataatttagatcatacatataaggtctaaaaaaattgagatgatatggcttagtgaaagaataaaataagagagataatttgaaccatagattaatcatgtaaagactaaaaaacaatcgatgtgatatgactgaacgagataaaagagaaataacattaactaagtgaagatggactatataagtatataggatattataaaaaaaaagatggagagatatattcaaatattatgtgggataatttaacatgtttgcattttgaatatctaaaatttaataaattataaaattgtagataatatagtgtgcttgcatgatgcttaaatgtaataattgtttgtgaataatgatgtgatatcttttgcatgttaaactctagaattgagttataactttattatagtaagagaggataggattgttcattttcattcttctcccatgtggagaatgaattcagttctgaaacttgttttctgtttgcaaaatttcataaagataaacatggctgcacttgcgtcgtccatagacttgttttcaagacaaattttgcaaaacctagttagtttaagaaaaaaaagtctaacaacttgacatttagatcttagcaatgttcacatatttgagcacaaatgtttgcaggccatcctcattccattaccttaataagttaataggccagccttgtatagaaatgtaactgggccttttctggcagagagttgagtttaatcagcccagttgacataaggccctagtgttaatctcgagttgttgtttcctacccattttgagggaaaaaaaaaaaaactagcagaacacttggagtggtctagtggattcctccaacggcgttcatcagtgtaatgaaatatcgtgtggttcaagcgcgccacatttgagattctccttcacctcggtgtcgatcatggcccctcgaggccattcgtccctccgcgaggaaccgagaacctcatcagaaattgtcaggtcgtagggtgaagaactagaatattagcaacttttctatagaccgtttagtagttcgcatgtggaaagaaagtaagggagtagaagttggaaaagtatatataaacaacgtagcctaattcaagaacatttttgcatggcatactcacgtgagcgaaccactctttcttttttttacaccacatttttttttcttttctgacaaattatacaccaaaactttacttgttcaattgagatttgaatatttgtatattaaaaattgagtgaattacatattgggccagtttttattaccatggttgcatattggactaggattaaactataatttttactttagactagttatctttgcataacgtttcagtttaggcccgttctactccaactctcatgtctttcgtctccaagagccaacagacgatctgggcagggtgactgtgacacagagcaaatcgagctcattactagctggaaacaaaaatagaaaaggagatgtctctgtctttgcttgttcactgtaggctggaagcaaaaattggaaaaggagagatctttgtgctttgctcattaacctgggggcttttgctcattcacctggggaatttggatggtctcaccaatgccaggagaacataagctcattggccaatggagaagctgcaggagcagccttgaatcaggtacaaggactagaggaggatgaagatgcaaggactaaattattggggtgtggacctactagtccaaggtgcaaagcttggtaacaagatatggtctaaaatgaaaagatttgatatcacctagtccaatatacaaattaggtaataaatgtaggtccaaagtgcaaatcgccactataacaaaaaccttatatagaggctctcttgaacagacaattttcaaaatgactctaagttttaaagctctatagtctagagatattttttagaggcactttcaaaatcgcctaaaatatttttactctagagacactttagagacattttcagcatattttattaaatttatcttgtagagacatcttttcggcactttaaaatttgcctcatatgtaaaggtattttcttaaggcattttaaacaatataaagatatttttccaaatattaatatatatcaagtaactagatataagtaacacaaatcacatatttacatgtaattaaatgaggttgagatggttagtgcattgaagataaaaaatgtcaactcaagatgtctcaagttcaaggattggtaagagataatgtttttctttttttttcatattgatttgctatagttgtcataacatattaatgtctctacgaagtgtctttatttgcatagagacatctttataaatgcctcttagttcgtagagaca

SEQ ID NO: 68463 - DNA, 59976 bp, Oryza sativa
tttcctgaaccatgttatataaaaatatgttcagtcctatcttttgaatttcaaaccatattacgttcatgctctcaattgtcaggggtttaatccctacaactctagaaggttctgccagtcaatgtatatgctcatatggataacatagcagcaactactatctagtgcttatgtacttaccaacaagagtaataagattaaaatacaatatcgagcagctaagtacagcaatttcctaaagcttcaggttaatatcggaccaaacggattcagttcatgatcagttagaaaaattcaacaaatataattgaaacaggtccgacatttccaatcagctaaatccactgaataacaacctggattatcaactttgcagctggaaaacgcgtaatccaatctgagtttgattatagcgtaatggattaggtaggaaaaggtcaagtttcatctagttctccactcctagcttcttgcatcttgaatacaggttccctcagtaagacatccctataaaggcacagacttagtgacttatcgcaagttcacgtaaaggcacagactgcagcaatcaactggaatattgaactgccaggaaaatgtaacttctagtgcctactaaattattcatgagtatttttctttgacagacagagtgtattctattggaacaattcaattcatttgtctctgcaggaatcatacagaagttggcgcactactcctatgccttcatggggtttgattctgaaatatgaccatgaatggtgagaagttatatccagaaaggttctaatctaactaggctaactctttcaaaacaacaagctacgatgatgagacaatggaataatttaccacgagttctaactacccctgcaagttgtacgatgatacagtagaaatatatatatgtatgtatatatgaccaattaatttcactgccacaggatattgggatctaggaaatcattggtagctagcaagaccgagtggattcatatcttccttttcaatcaagcatcgtatgtcattccacgacgcttagaccataagatcttaaactaatgtccaggattttggggccgagtaagttcgatttctcaagcaatgactacataccgtgggtccaaaattagccaatcgccgttatcatctgaacttgttagtttgcttattagtagttcctatatgctgctacatcacgcctttgttgttgcctgttgggcgttcgaactaaaagaggatgatctaaacccagccaggtcagatctcactcataaaacacccaaaaccttacttggccctgtcctaaccaataatttggcttaaatgggacaccactatggctatcatccatgtcagtcaaattgtcaagttaattctacacgagccaattaatcgggttggtccagcttgctccgcctacaagagaccagactgcgtcaggcaggttgcaagcttgcaaccacagtagaggacgcaacaacactgacacaatctgaaagaagtcaagaacagcaaggccagagaagatgtaccttggtgaggaacagaactgaccagcagcggatgtctccatgacgacgacctcgcatcaggggattcccccgtggccaccagcgagcgaccttccacgcggctgctgcgcctgaaggggggaacagcatggggatggacgcgacagtgaacccaaaatgctgccccgcgcacgagcgccccccgattgcaacctgtgattccaaccgcgaacgtgaggtgagatgcatccttccagatcgcgaaatcgcgaggcaacgcgagggatcgagtgcgggggaagggttcttcaggttacctcaacctgtgacctgtcccctccccgatgcgtccctcccggatgagaattttgctctcgtcttggcgctgtgatcaccgaccccgtgggggcaagggacgcgaggtgagtgaggaggaagacgggagggcactgttgctcacgtctccaccgtgccttccacggcgccgccgccacgcgtttggtctggtcgtctggaggagaggcactgccgcgagtccccccgcgtcggcggcgctatggcacgccgtagaagcgggaatggtgagtgcggaggcgaaggggctgtcgccggagcggcggcgatggctggaaggcgagacggcgagccggcgagcggtgagaccggcggcggtggctcggtggcgctggcccatgggtccaactgcagtttgtacttttgtggaatctggaccgtacgatgggcaaggattcgatggtctggataaatgatttgaaatttgttttgtttggctatgcactccaaactagagttactcataattcaaacttatctggaaatacaactacttttccactcatctcttaatcctattttctcatctcaatcaatcacaacaattcttatcgtaactttaatctcttaaataaaatgaatataaatagttgtactttgggacgggaaagtatttgtctataatcaacgctgacataaactccctcgaggcatgtttggtttgttgttcttcttagctataaaaacagaggcaataccaatgtgttaagttttcatctaatttggtacccaaaatttggcatgtttaaaatgttagtgagaaaaacaaataagatatatacataactaaaacgttataacaatgtgcaaaacaactattctttgccaaagttttggtatgttagatcttgtcgttgccaaataatttggtaacgtttggattggcaatgatccaaacaagcacataatacttgagtttaacccatatcttctttgcgccttcatttttaagttttgcaaaagctgcaattaatttgtgtggtcaatatctatatctggataattaaagtaggatgagttgagatagttcggttcagttcaatggatgaccggccttatgtttagttgaacggatgtgacaagagaattcacgaccgtgcgacacaaataatgttgtaagatcatgtactatcaccttcagcctaatccactaatcatgttgtacgatcttgtactatcaaccaaatgaatgcatgcatctttctatacacctaagtaaatgaattgacatgataacctttgtgatttgattttgttcttgacattttgaaacggtaagaaataaaatatgtcatatgctcttagtgacaaactattattgttccatcagtgcaaagtgcaagctaaaatgttcataatctgactataccctttcaactagagaatcataaatggattgttcctcgctcgtatcaatggtccgacattgctcttttgcacaggaatgtttttctaaaccatagacttcatttctcggaggcaatggattaaaatttaatctttggtcttgggggtcactgaaaagaaataatatagctatgtttaagggggcttgagattataaaaagcagttggtgaaaatttagaaaaagttgtgattctcaacttttggcaatctagctttccattcactatttagattccacaactaccaaacctcaaaagttgggtgagaagttagataatttcagtctcagagggttaaagatttgtagagaaactgtaattgtcaaagttctccaaaagctcaaaatttgggtgaaaagatatattgtataggagaggtaggccctgtttctttcagcttgatattattataatccagattattgagagtaagctgaaataaacagacaaattattaaagtagcttattataatctgaagcccagcttattataatctgataagctcatttaggtaacaatctagcttatagtaatctggcttaataatctaaattataataatcttaagctgaaagaaatagggcgttaaagattttgagaaaaggggtaactgtcataatctcttcaaagaagatcagatatctataaaaaaaatcttgatttataacattcaaacgttatagaaattagttgatttctagcctcttacttactcttgggttacaagtcgtgaaaatttatccatttagtatcacttattcatcacgtaacaatactatttttctattaataagaatcacattgttctttttttaccaccgataaattttattagaaacctagaatgaatagggatcaagtggattgaaatactatgcagtcgactgcatcatgcttttatcactgacatatgggtccaatgatatccgagcacacatattagtgataaaggcgcggtacaattgactacaggggatcctggtctggatcaagtctttgtgggacttacgagcaattacaagctcaatgcttacacgtattcagatcttacgggatcaggagaggagaatatttacgatccacatgaaacgagaaaagctcattagcatatgattaattagatattaattattgtaaacatgaaaaattgatttatttaattcttttaaacaacttctatatacaaattttctgtaaaaaattgtagaaacgtagtaacggaaaacaacaaaattgaattttagatttggagtatagaactgaaccttagactttgactacacagtgagcaaccactgcagtcggggcccacctgatacactaaaggccaaaaaggtcaaaatttgacttttccacccatcgtctccaggctccagccgttcagcgagagaggagaggcaccgaaagagagagaaaaaaatcccaacctcccaaaaggccaaaaccataagccacaaatcccctcatcggctcatccccgccgcccacccaccccccgggatcgagctccatccgcccaacgattccgccgcgcgcgccaccggattccgattttgttctcgcgtttttggcgcttttcgatctcccccgaggcggtagccgcctagccgcccgccaccatcaccacgcgcgcggtcgcggcggcagaggcgcgggcaggtgggcggttggtggcggctccaccgcattcacttgaccgaaaatggcggccaacaataatagcgacccgatcctggacgagggagggggagggggcgtgaagcacgaggcggtgggggaggcgggagaggggaagggtggtggtggtggtgcggcggcgacgcaggcgcccgcggcgatgctgccccgatcgggctcgcggccgcagctggacctcagcggcgcggcgatccacggcaacctggaggaccgcaacccgaccatcctgctgcctaaccagtccgacgacatctcccacctcgccctcgacatcggtggtacgtacgttcgtggcggagctagctcacactccccccgtttccgactgatttcgggttggcaccttccgttcctcgttcgaatcagctcagtagcatcaagtcatctggcggaagtagttagtgtagagtgcacgggagatagttaagtgcatggaagcttagaatcaaatgcttgatggattctctctctaatatcagtgtgaacaagctagcagttggtcgtaatgctgttgtacttgcatttgcatgctgtgtgtgctcgctactaaacgttatggacaccttatgtgtgctgttgctagttgatctcaccaataactttggattattaagtaaactctggatttgtgacgttggtttctgaactagtaatgacgaatgtggtgattagttttattgttcagaagctccatttttggctagcaatccaaaatgagagctacaatctcttattctcttcttggttcccaaatttcatgcaaatttgtttactaagtactgaactgtatattttctctaggttctcttataaaactggtatatttttctcggcatgcggagcactccagtgaggacaagcgtaagctatctacgaagaggagacttgggatgttaaatggtggcaggaggagctatcctgttcttggagggaggctccactttgtcaagtttgagactgggaagctaaatgaatgtttagacttcatttcttccaaacaactacatcgtggcggtatgcaaccatttctttgtattgttaaaaatcgaaatcatttatgttttggggtttggattgtccacaaattttgtgtactaatgttattttaatactgcaaattgctttggtggtcatagattgatgtttaccacattatgaacagggatttgagaatatgtagatagttgctagagttactaatttacttttatcacatgcatttatattagcaatttcaagttggccattatcttctgtgtttggctgaattgtgccctgaatatctttattatgatggcatacttgagtttgttcatttcatgttttttcacattcttcattgtcctgtccattctggaagtttaccagctgtctaatttgctagagtttggctgaatttgatacttaaactgtgatcatcacatttttgtccacatggtttcctaaggttttgttagtctaggccgttggcctgcactttcttagcattgagtagaacttttttgctgcaggggttgattcaccttcgtggcgctcaggagctcagcctgacaacattgtaatcaaggtgacaaataatgagacagcaccctttaggtttatgaaagtttgtttggtcaatgtttcgattaatgtttgttattgttcattagcacttgaatatttggatagcaatccattattctcaatctaccttgtgttgttggtgtagatgatttcaacctatggttttggtgaataacaatcataacgctgtagaacaacttgtagtaaaccatgacaagaataccttccttcccatttccccaagattagctcttgtatagcacttgaatatttggctagcaatccattattctcaatcctaccttgtaggtgttgttgtagatggtttccacctatgattttggtgaataacagtcattacactatagaccaacctgtagtaaacagacaagaatgtcttccttcccatttcccaagattaactcttgtgtcataatgactgtatctcatagaagcaaagtctttttcccccacttatcaggaacagactgcgtactgatgttttcatgtacaaaatactgactgagttatcattatcttgatggcattaaagttatatattttagttgactatgatattttgtggaaaggcaacaggtggtggagcattcaaatatgctgatctcttcaaggagagattgggagtcagtcttgaaaaggaagatgaaatggactgccttgtagctggagcaaattttttgctgaaggtttctatctctgagttaccctaccctatttaggttgagactattcagttttatattctatatgatctatgtaatggactaaggcagtaagtcatatttcaaatttatctgaagattgttcacattcaaaaaattaaattacattagtaagacttatgtgttttcagtctatacgccatgaagcctttacgcacatggatggccaaaaggaatacgtgcagattgaccagaatgatctgtttccattccttcttgttaatgtggggtctggtgttagcataatcaaggtaccttgcagtttttttttttaaatatcttttttggattggacttctttttttggtttgctggattttgttggtcgtcgtttttgaaggttgatgggcatggaaagtttcaacgagtaagtggaacaaatgttggtggtggtacatactggggtttggggaggttaatgacaaagtgcaagaggtatttcttcttctgctcatggacatcatacatttctgttgagatctgagaagtttgagaactcctaaaagtatgattttctttcagtttcgatgagttactagagctgagccagcgtggagacaacagcacaatcgacatgcttgttggagatatatatggtggtctggactactccaaggtaatagcaccgatgatggaaaccgtcttgttaacatttcatgttccataaagttatcacacaatgtagacctatgtttgaaactataaattgttaaaatctgctagtcagacttggtacttgcacaactcacgatgtgtcagaaacttcagaatagaggtccttcaagtgcccaattcttctttcttactaattgctgcgtgcttcttctttatggcagattggcctttcagcatcaacaattgcctctagttttgggaagacaatttcagatgacaaggaactgtcagattatagaccagaggatatttcactctctctgctgcggatgatttcttataacattggtcaggtatgacaaataatgataactatttgatacaagtggcccaatcttcatcagaatttttccatagagatgcacatttaccatttcttttataaatttggaagtttgaaaaagtggtccaaatattgtagcggtgagtctaattccacacaaacaacagtaatcttatctgaaaaagaaaatcaatagaagaacataatttttttacttgtattttgttatgttgtgttctttaatggaaaaaaaaggtggtataggtgtcagtagggttggaaaaaatgagtctgggtagtaatactgccaaagatgatattagatgacaattctaaacaatgggttttggtgttaagggtctattatcacttcctatggctcaaggtagtgatttaggataatgtgtgttgttacctattgtaggatgtaggctaatagcataatgtgctcaaagctggtgttaatttgtcttccatgttccgggttgagtttatggtgtactgatttttcaaaaatatatttagccaaaggatttacaggcccattgaattttatcagtggctgtatcaattgtgatgttaattctctcgtttattttactgctttttccaacttttttgcctctttccattgaagctaattcaattgttttggtttgtagatttcctatcttaacgcactccgatatggacttaagaggatattttttggtggattcttcattcgtggtcatgcctacactatggacacaatttctttcgctgtaaatttttggtaaaacttccatataggttcttgtttttatgttgctcgacagtagcttagcttattttgaaaacagtttcctccacaagttctgttcaagaaaccaacgtatgctatatatttgtaaaggtcaaaaggagaggcaaaagccatgtttctgcgtcacgagggttttctaggagcacttggtgcatttatgagttatgagaagcatggtcttgatgacttgagaatacatcacttggttgaacgcttcccaatgggtgctccatatgttggtggaaaaattcatgggcctcctcttggggatctcaatgagaaggcaagtacatctactcttgatcatggtaaccttaatggttttgttggtcattggggttttagttgttttagaacaaatttattgcttgaaagaagtccacattgaaatggaaaccacactcatccaactaaaatgaacacatgaactgaaacgcacactcttggacttctttttcccccctataaacagctgctgggatgagttgaaatcttttccacctgttgttactcttggctcgtggttaacattctctggctccctgttattctgtttgatctattcatcatgtatggctgctagattaataatcatgtggaactgtacttcttcccagatatcatggatggagaagtttgtgcagaagggtactcagattacagcacccgtacctgttggatttcctgtgacaacaggtatgggaggttttgagaggcctaccgccaagggagacattttgcggtcagatgcaagtgcagctctgaatgttggtgttctccatcttgtacccacattggatgtatttccgctgttagaagatccaaagatgtaagccacagtcatccagttctctataacaattattgcaattttgaaatataagggtacctgcagtaaattcattatggaagctggaggcacacttttggtactgtaaaaggtccaaaaggttgggtgaataatgggtaatttgcctcaaaaagctaaagaaagcatcaaagtcatcacttctcaaaacatttttaggcagaagtaattgagatactttagcatattatctaaatatttgaaattgcagtctccattttttttaatataaagagctgcactgcaccccagccaaacagaggtcttgatttgaacttaagaatcatcttgtgttagctcagggttaagaaatatgagctctttcaccgaatcacctaagcagctcttactgtatttaccaattaaaacaatagtagtctatctatagttctataccttttttctgacattgtggatcaacttatttaaagcatttttatcctacatatacatgccaaaattgcttgaggacaagtggttttattgtgcataagcttgctgatggtctgatggaacaattgccatgtgcagctcaattttagatcatgcgtaagttgtaatatattatctgtattgcaggtatgaaccaaacacgattgatctcgacctgaatgagtacaagtattatttctgcttcccctatttctagatatcttgtaggaattgaatcatttgatgatatctgagatgtacaatgccaggtactggttcaagattttgtcagaccatttgcctgaccttgtggacaaggtatggtgtacttcttgcaataaccttgtataacttacgagataagacaccagagttttctttgacaatatggcttagtgataattatttttttcatgctcccctccctccatatgagtgtgcatgtgtgctgctacctatctcatcctgttcctaaaacaatgtcccattgggtcctcataagttatagctaaatacaagccccaataacatgccaccagtttgcagtattttttttattgcttttgttggtttacacctaagaatgattatactcactcaaatgttcccacaaactcaacatttcttattaagaaaatttggcattataactagtaacaggtcaatcaatattatacgttataatttatttgttagcaatttatgaatacacaagtaactgtttatgttggaatctccacctcaattcctcttgtgaatgtgtgaaaaatgttcttttttgtactaatgtgcgcatgttattgttggtaggcggttgctagtgaaggtgggactgatgatgccaaaaggaggggtgacgcattcgcacatgctttttctgctcatttggcaaggtacgcagttgccattacatgacattagttagtacggagtatatttcagttttcttcattcaaaatcgagcattgataatctgttagtctgtaaagattgatattgtaaaactcattacactatgtcacttagcttcctaactcttttggttaagtttaggttgatggaggagcctgctgcttatgggaagtttggtttagccaacctgttggagctgagagaagaatgcctgagagaattccagtttgtcgatgcatatgttagcattaagcaaaggttagttcctgtctttctcgctctttatgtgtgtacgttcatgtgttcatgtgcttttatctaatcttacggttttaattgtgtgtgaagggaaaatgaagcttcactggctgttttacctgatcttctgatggaacttgatagtatgaatgaggtaggagatagcagggcttgtcattcaggcgtcattctgcttagctcagcacccaacagaattgatctgaatatttgttgttgtgcaactatgttttcaggaagctagattgcttgcactaatcgagggtgtccttgctgcaaacatatttgattggggctctcgagcttgtgtggacctttatcacaagggaactataatagaaatttatcgcatgagccgcaagaagatgcaacgtccttggcgggcaagtattccaattctgaccttttaaatgttatatttgtactgcaagatttacccaaagtttcaaattacttgcaaacttcttttttataattgctttgctgtgtttatatttttgtctcttatttcagattgatgactttgatatgtttaaaaagagaatgcttgctgataagaagggccaaccatacaaaagagcactgctttttgttgataactcgggtgctgatgtggtccttggaatgattcctttagcacgggaattattacgcaatggaactgaggtataagttaagaaaaacaataagctaaagacaagtcgcccttttgttatctttatgcacatttgtgttcaaattataggtaacagacatgatgctgtttcaagagatttaatcatggaaacaggaaagtttggatattaacaatgtatttaattaacattcctgtgttcctgcacatcaaagtacagtgaatgatagattgggagattgtcctttataacctagaattgagatgacttataaattttaccggccctgtgaaatattccttccgtttataaacatgtcgttttagacattgacatggtttccaagatgcaaagttgaccactaatttctattttagtatatttgtataacccaataaaattgtaatattatgaaagtggttttcgagacaaatgtacatatcattttcacgcatccaactattaaatgtaaaaaaaaaatcacacacctttattatagtccattttaatattatttgagtttaattgtatcagatctgatatccatacagttgacttgagctggtaacaaaatgttgattttgtaggtggttttggttgcaaattcattgcctgctttgaatgatgttaccgctaatgagcttccaggaattgtggctgaagctgcgaaggtacaaatgaatataaattctattttcttgtccatcctattgttatcttaagttctgttgttgcttgtaatgtactacagcattgtggtatacttcggaaagctgcagaggcaggtggattgatctttgatgccatggctggcatccaagatgatctgaaagatgaaccagtatcagttccccttatggttgttgagaatggatgtggcagtccgtgtattgatttccggcaggttagctcagaacttgctgctgcagcgaaagatgcagatttggtaagatagactgtagctctttgaactgaatgcattttctcatgtaaaataaattggaaagttatgtggtttgatatatcggttgttgttttaaatgttgtgcagttaatcttagagggcatggggcgatctctgcataccaacctcaatgcccgttttaagtgcgatactctgaaggtacttgtttctgcaaacagctgatttattgatgcgcacaattacaaacttgtcattcccttggctaaataccagtacaaagtaactctgctgtaattattgtactgaatatcttggaaaaaaatgttgaatcaacagtgtgaccagtatcggatctagaattattttagagcccgggcaaacttcactatagctagtatttattaccgaaattatatctcaatttttcctaattacatggaattttagtggattatccgctgacgagcctgggcagctgcctggggtcgccaggtggtacatccaccactgagtgtgaccatggtagggatgtacttacgatagagacaattctcaaatgcaaccatcagaggaaaaatacaataaccttgaatgaaatatgcaccatttggtcaacagccactgcgttgctgaatgctgacactttgctagcgaccactgcactgccagagccctgcttgcacgcctcagtcctcaatcgacctcccagcatgccagcaccaatctctgcccagatttgggtagagagtggtggtggtggagcaacaccaatggtgtgggagtggaggtataagagtaagaaagtccggaagtggacaatatgggggaaggggagtgcttagtaggaggaaaaggaaaaatattttaaaacagaacttttaaggtctaacagcgtagttgctttttgaagtaatggttctggcatctatgggttgaacccaactggaaatttattgccttacttgtcagtatgttcgggattgataagaaggctacattaaatctttgaataattgaattgtggtgtcatacttaaatcttgtgtgtttttacaaggttaacaaaatgactttatttgcagctggcgatggtcaagaatcagagattggcagaaaaacttttcaatggaaatatatatgactgcatctgtaaatttgaacctgttccttgaacaatgcggaagaatgtgccgtggatttggtttgctctagcacagaagcagctaataacaggtactgtgacactgtcagcacatcactttatcttatatggcactaaaattgtttgctgaaatgacgacttcgatttgtgcagaacctagataataatttgttcttaccagttttatcattttactgtaatttgcaggtacatctcacttaatctgtaaccagtggggtcatggtattagcagtgtcacatatccaagcaaaaagccataagaacaaatttcttatataagaactaaaagatcctctcaatgtactaaatgctcctttagatggtaaagaatcaaagaagtgttgttgacttgttgtgaatattgttatcaaaacaatttttctgaacatggagtagcgacataataaaggtttttaaagaatttgtagaaagcatacaagaggattcagcatttggaagaacatggattcaatatgcttgcaagttgcatcctcgaagtttgagaaataacaatcaacagatgcaatattgaagtttcatatgttgaggaataacagagagaaacacaaggggcaaaaaaaatgtaatgggggcaatatatagcaagttgattcgcaaatcaacaccattacaaatacaggcaagttctaagcaaagttgatgttataagccttgctcccgtccgccctgaagatgccgaagtgcctctcgaactcggcgccgggcttgccgtcctcgtcgtacaggtcgaacaggaacacctccacgggcacgcctggccgccgcggcgtgccggcgccgcgcgccacccgctccacgatcttggcgttgtaggcggcggcgttctgcggtgtcgccgccgggtgccccgccgtcggccacccggtctccgtcaccgcgatcggcacggcgccgaacccctccctgtcgagcgcggccgccagcgcgtccaccgtcgcgtcgaacatgttggtgtagacgagcgcgccgtcgctcaccgccggcgcgcccgcgccgaacagcgcgtagccgagctgcacgttgacggggtcgttgacgtagctgatgaacgggtaggtgttcaccatgaagggcgcgccggtgtcggcgaggaagcgcagcatggggcggaggacgtcgagggaggcggcgtcgaacgcgccggcggatggcgggtacgacgaggcgagcaccgacgaggcgtgcgcggacgagaccttgaccttgtcgccgaggccgagggagacgagcgcggcgtgcaggttgtgcatggcgggcaccaggtgcggcgcgtagaactggttgttgtacagcacctcgttgccgacggcgaggtagcggacgcggtcagcgggggcgtgggcgagcacggcggactgcagccaccggagcgcgccgtcgggccccgcggcggagaggaaggtgaggttctcgttgggcacgccgaccatgaggtcgatcccggcggcggcgaacgccgggagcaccgccgggtcggggaggaagagccgcgccttggtgatcccgttctgcctcagcaacgccgccgcggccgccggaggtggaaggttgctgccgacgcggccgtggcaaatgccgatcttgcccgggtcgccggccaccaccacggccgccgccgcgagcagcgcggcagcgaacacggcgacgtggcgccaacacaacgctgctcttgtcgccatcggaattgacgttgccaaggcaagacgcaagactgcgttattgttgctgtttttatttttatttatttatggtgcgttagatttggttgtcgctgtcgctgtttatatagatgttgctaagaataggagaggaggaggagacgttgagattgttggtgagaatctaaaagagagtgtggatctgttgctttatggttgccgaggctggacgacaggacgggtaaccgttggcatagccgttggttttcgaacaatgtcgtggtgcatttggagggagtatgaccatgagtatacacggccacgggtgggtcacacagccttgttgctctaatcatgtcgaataatccttgtgtcgttcaagaatcggtagaaaaaatccttgggtcattcgttagtaacgtcgcgtcttgtgagtgattaaagcgagcgtttttgtgcctgcgtcgcgtttactactgctgctactactaggacgttcctttttcgagttttcatcccacacggcaggactggttggtcggttggcagccgggacgagcgactgcgcgtcgtgcgccgcgcgagcacgttagcacgcacgcacgcacgcgaaccacgcctcccatccacccgatcaggtagacgcagggcatcagcgcgtgcgcgtcactgctcacatgcactgcagcattgtcgctggcttgctcctgctcccgatcagcccacggcgcacggggcctagcccaacccgtgcagctcctcggccaggcagagaggccgcggcccagccaggccgatgcgggtagtggactggtccaccgcggcgtccgcagcttccttgcacgacgaccatctcacgttggatttttccaccggtttcgcactttcgctcgcgctctgcctctctcgttgaaaacggtggcagcatcatcgtttttcacgtttccatcttactgtataaaattcttaatttttctaatttctttcggaattatagtgcaatcatcactacctagttaaattgataaatatataaagagctccgatcgatccacaatcattttcgtagaaataatatcgttttcatcatttaaggccccgttcttttcttgttttgctgttgcaagattattatttcctatcagcatgcttctcagattattaaatgtggtgttatttgaaaaactttttatataagagtttctttagataatctaaataaatctatttttttagtttgtaataattaatactcaattaatcatactctaatggcttgtctcgttttatggactaccgagcacatttgaactaagtctaagtcattaacttgcaatcaaggggtcaaacctattgagaacagggaacactctacttcgcatcggggaatccgagccgtccaaagcccagttatactataaacaaagtcgcatccacctcaccagtgattcctggattcctcctcactccactcaacgcccatcaacatggcctcggcgcctcgctcgccctccaacatatcctcttcctgctgctgttgctcatcgccgtggcagcatcttgtttttacttgcatgcttatagggacagcaaaaataaccacaaataaaatatcgaaccgaactgatcgagactgaaacagcttcaaacatagggttgttttggtttgaagccctacaaaaattttggtaatgccaaatcttgagcaagtttggcactaccaaaattttggtaaagttgtgttatttctaactctattgaattagtaagatttggccttaatccaaatagctaacaaatactattcaaaactaccaaataattggtagggtaataattggcttcaatccaaacatgcctataatcctaactcattcaattcaccccttcttcctggctttccttcctcctcgtcacaccgcatgccacccctccttccttgtgtggttgaaccacgccactccatgccccctttacttcaatggcaataggcgcccacatgtttctggcggcgacgctgcctccactccaatagcgacgggcgacaacggataccaacttggagcagaagcgtctacatacaataggattggggcctgcaaatccaacgccgccataaagaccactagcccaggtgccttcgacgagccgggtcggtctgccgctcttatggatcaacgtgccatgaattcttttagtttttttgaatggggataactaaagatttctatgatttgtttgtgattttttagtgaccagtgtgattatttccatctcagattttagttatgaccgaagatcaaaccaaaacggccgaaaccgaatagctcagtatttattactccctccatctacttttgatagtcatatttctaaatctgaaaaatttatttttgataggcatatttcaatccaacaacctattctcttaataactttcttagatttaatgcgtgattatccattcttccacacatgattggctacatgggcattgagaaatataaatattaataaattgtttgtttacgaggaatgactagtagcatgtttaaatggatgataaatagaattacttatcattggtctgtgtgccaagatgaagaaattttcaaaaaccacccctactcgcgcccacggctttcactcgctccgtcggttaaaaagtcgttagttaacctgcaattatcccattgtttctttaggagaagagataatggcgtcggtacataatacatatggattttccggtttcaaacccaccgaaaacaaggagcaccctgcatcgcatcgggaaatctgagccgtccaaaatccctcctcctataaacaaaaccgcatccacaccaccgtccattccggaattcctcccgagtccagtccactccgcgaccgcgccaacatgggcctcgcccaccggcgcctcctcctcctcctcctccacctgctgctgctcgtcgccgcggcggcggaggcggccgccgccggagcagggaggaaggagaagggtatcggcggcggtggggggctgcggttccggggcgggagcgggacgttcaaggtggtgcaggtggcggacatgcactacgcggacgggcggcggacggggtgcctcgacgtgctcccctccgaggccgccggctgctccgacctcaacaccaccgccttcctctaccgcctcttccgcgacgaggaccccgacctcgtcgtcttcaccggttggattcctctgccccgcccacccaatctcctcctcctccacccattccttgttagtgcttcgattaattaattaattattcaactatgagtagtttattctgatcaattttcgtatatcccacctaacttctttgtcgccttttcctacgaatcttggttaacaaatccatttctgataccgattactcagcagtttgtttgccactctagcaaagtaacccgcgtgacccaacgatcttacgagttttttttttttgcagcagtaattttaggtacgtaatattgcatgtaacataggtttaatgattctcgaacagtaaatgattggtgaaccggcgaatccgtttgcaacttctctgaaaatattacccgagtagtactttttctctgaaaatattctcgtaatggtttattgacagtacaataaattcgtattatatgtgctagtgaggtcattagcgagctgaatttgctgtacactggttcatacctcctctgacatttttgcagaggaagtgtagtttctgtgaacttgatacgtactcgtactagtagtactaaagtacaacaagaatgtcacgggtttccctttccgaagtgataaagatgtgtgggccgggccactgaagctcattcttggattggatttcaagaattctcatctgtagggtgggggttgccattcccaatcatgcagtgaggtctaggtctagattgttgattggtccattagatcactaccacgatgggatgaactggtctcgtgatggctacatccatgatacacttggacaattactgcacacctccatctgatcgagctagcagccgtactccctccatcctaaaaaaaactcaattcctgagttttcgcgtctaacatttgaccgttcgtcttatttgaaaaaaatatgaaaaaatttaaaaagataaatcatgcataaagtattgttcatgttttatcatctaacaataatgaaaatagtaatcataaaaaaaatttatataagacggacgatcaaacgttagacacgaaaatcgaagaattcggtctttttgggacagagggagtagagaagaacaacagtacaaatgttgcagcccttgtgatctgatcagctcttgatcactgtcctgttttcgtcgctttgtttcacgggtaaccttggttgatgttccaaagctgctacttttgcagcgtttggatgcagccactgctagctgttttttttttgtctgtttttccctttttgggtgcagacaatacatcaatttagtagcatttacataattacgtttttttcatataaaaatggcttgttcagttactcgtattcagaacgatgatggccatagttcatatacttcactgattattgttactttatttccctgttttaaagactatgtattgtttggtgatgctatttggcaggtgataatatctatggctttgatgcaaccgatgcggccaagtctatggatgcagcaatcgccccagccattaacatgaaccttccttgggctgcggtgatcggaaaccatgaccaagaaggtacgctgtcacgcgagggtgtgatgcgtcaccttgtgggcatgaagaacaccctttctcgcttcaacccagaaggaatagaaattgatggttacggaaattacaatttggaagttggtggggttgaaggaacattgctggctaacaaatcagtgctcaacctctattttcttgacagtggtgactattctacggtgccttccatcggtggatatggttggatcaaagcttcacagcaattctggttccagcaaacctcttcgaatctccaggtgaactttaagttgcacattgtacacacacaaaaaaagaatcaccaggtggaataagttgacataatgacaatgttgtgaaatgcagacaaaatacatgaaggaggaaccgaagcagaaggcggcagcgcctggtcttgtgtacttccacatcccattgccagagttcagcagcttcacatcatccaatttcacaggagtgaagcaggagggtatcagctcgccatcgatcaactctgggttcttcgccagcatggtggaggctggggatgtgaaggccgccttcatagggcatgatcatgtgaacgacttctgtggaaagctcaatggcattcagctgtgctatgctggtggatttgggtaccatgcgtatgggaaggccgggtggtcgaggagagcgagggtggtgtccgtgcagcttgagaagtcggacggcggcgagtggcgaggtgtgaagtccatcaagacatggaagaggcttgatgatccacatctcaccacaattgactcagaagtcctctggaacagaggctccaatggtatgacattctcctgtagagtctgcatgactgtgaatccatgatggtttttccaagctagataattatatctgattaaaaatgagtaaattttggtggatgtggtctttcatagtagtgtaccatcattgtttgttaaactactttttgaacaggactacaacagtttttagacttcaatggtatggcattcttctacatgactataaatctatgatgcttattcaagcttatgattatatctgattaaaaaatgagtaatcatagtgaattgtaatatttcatagtagtgtaccatcaatttttattgacctacttttcgttttcggcactactacaattaatcttaaagagttaccaattgacattttgaatatttggcaggaaggcgcaagaagaatcctgatggaaagatgagatagtgatatagatgggaagacggggatagtgaaatgttgcaacgtactacacgttatgatgtgctgtttgccaatttgttttacaaaattttcgatttatgtaaatgaacaaaaacatggtacacgacacggcatgcacccttttcgcggttgtaattctcaccgagaaaacagtgaattttagtaaaaacagttactgtagttttagtaaaaatgtcgcaatttgccaatgggatcaaataaacggcagctggaataaaaagagagccaaactggtggacacaatacactgaaaacaaaacatttattcaactataatcttattcgtgagccagtgggacaagataggtcaacgacattttgaggaacagcctcgagggctctttgatgattccttcttgtggtatgatatgacatattgatttttccctaaatagattacatatacagccaaatcaacaacagatgcgtgtacatcagacagtatccctctataaatatatgcagttgggaacgcaggcacaaacagaagtgcagaactcacatctgttttgtataactcgtatacagattccgaatgttgctcaaccgagatggattggcagcagcgctgcaagcctgcgtttggcgtgagattctacctcgtggaatagttgctctttcatggaaatctgaaccttgttttatggatgaatctccaaaataggtacataaccagcaggaaagtataccagatcaaacgccatcttcagattggttgatgctatagcttggagtgtggtctcagagggcatccaccttcaaaagcatggtcaagtacttcctcgatgcgcttcacaagcagaatctacagtagcaggtcgaagtaaagtcagcaatagacattttttagacagctacattgcacccaaaagggaaaactctatttactggtcatctacgattcaaaacatacgtctactatatggtatcggaaatttcttccaatgctactttatctatgatatattttttaactccgaaacaatttgtgcaccatacatatcaactatatgctcagggccttagagcatctctgactgtcgaaatacatagagcaaagctctcaatacatacctccaagccagagagaatgggtgctggaacctcagccaagtccttcatgtttctttctggcaatattactctcttgatgccatatctatgtgctgcaagtacctgaattccagaaaaaaacatttcaagttagtcaaagagcagagcagagaaaatggttaagctttcatccttctgaagtcaattaaataacatgtcaggaacctatagggcagtaccttatccttaacaccgccaactggcaacacaaggcccctaagagtcatctctcccgtcatagcagtgtcagctctgacttttcggtggctaaatagtgacactaatgatgttaccaatgtcactccagcagaaggaccatcctttggcaccgcgccagcaggaaaatgtatgtgaatatcacgactctccaataagttaatatcagaagtaggtgacagattaaggtcagcagctcttgctctcacctgtcaaaaccaaggaaatgatgagtaccactatgcaaaactaggcaccaaaacattgtgttttcttcttatgtaatattggagtttcattccagtaacaataattggagaaaaataacttcaaagggcgatatcagagaaccagcagaaaataaacaaagcagcatgatgcaaccaatgcatagataggtgaaagttaaagaagatgcttacccatgtcagagctaactgtgctgactccttaattacgtcaccaagttgccctgtcagatgcaaatcacccttacccaccatcgctgtagcctcgacaaattgtacctccccaccaaatgaagtccaaacaagcccaactgacactcctgggctcgccacacgatctgcagcttcgctatcatcaaatcttggaggctgtagcacaaatatagcatattaccataagtaagacaaacaaaaagaaagaactctgtagcttctcataaggctatactcaatactcaaatgtttaatagcataccccaagcactttttctagcatagcctcatcaacaatcatgggtgatggattctcataagtatttgatatgtcctggcccataggaataacttccatttcaacttcaccaccatcagcaagcctagaatccagtagagttgtagtaattggttgtatttccttgccaagtctaagcgcactatcttgctccgcaaccttgactgcagctgcacgggccaatgcagctaggttccgctcaagattacgtacaccagcttctcgcgtgtatctctcaatgatgagtctgaccatagcctggagaaatggcaagcatgacgaaatactcaggagtcaagaacttaacccaaaaatgtagcagttcatcaaagtactgctgttagcaaaatatcggaatgatgagatcaactctattatttagcagagcacaatcaggcagtgcctactgtttcatcaaaggtgcaaaagcatggtaaatagtatgcatctccagctctccacattcactaatcttgcattgattctagatcaaactaaactatttttaatcaaacaatatgccgaatttctttataggcaacaaaggatgcagcagaaaactgcatatcttacctcaggaatctgaagatatgtggagctcaagccatgctgttccagtacccttggtatgagatgtttcatggctatttttagcttctcttcaggtgtgtaacctggtagctcaataacttccatcctatctaacagaggaggggggatgggttgcatcctgttggcagttgcaacaaatatgaccttcgacaggtcaaatggaacattcaaatagctggtgaaaacatgttaaggaattctaaatgtatgataatatagatcatatatcaagtaaagaaatctcttctctaagcattgtgtagtgtacgcaagttataggcaacccagaacatagcattgcagataatgggggaaataaactgtaactatccaactaaatatgaaaattgagcggtacatgaaaaacacaatagaaagatgtccacaggtagtgatcccccccaactccattaagaaagtaaccaattaatcagaaaatgctgttcattatctgaataatttgaaaggatactgatcgttgaacgttttattctgctcagggtcaagaacttctagcagcgctgatgctgggtccccacgtacatcagaaccagttttgtcaatttcatcaagaagcatcactgggttgctgaccgatactctctgcatttttttaatgggcagaatatgaatatagcacaagagatttcactattaatccaagacttaagtatattagaaacacaaaatggtttgtcaggtggaaatacgacattaataagcaaaagtaaaacaagattggtctggtcaaagaaattgtaaggtcataagttactcctgaaataagaaaaacaagtgattaaacctttagtccatcaatgagacgtcctggcatgcttccaatgtatgttcttcggtgacccctaatatcagcctcatcctttacaccaccaagagagattcttatgaacttcctatttagtgcctttgctatcgacgatgctaatgatgtctttccaacaccaggtggtcccacaaaacacaggactggacctctggcatcaggcttaagctgccagtattaacgtgcacccatgagagagaaaatacatgatatcataagcacataaatttatgcatgtgtaccaaccttacgacagccaaatattcaataatccgttgcttaaccttggtcagcccataatgatcacggtcaagactctcctttgcagctctaaggtcaagctccctctcctcactgactttttgccaaggaagttcagcaagaagttccaagtaggttcgagagctgctatatccaggttgctgaggttgcatctttcttagacgcctgcaagaaaaaacaactagatataggaaccggcggtaccacatgcctgtacaattgtacattgagaatgagatgataagttaccttaactccctttgagcatgcttccaaatattagcaggcattccagcattctgcatcttcctttccaatgccgctacatcatcctcatcatcatcattatcgccaagttcctctttgatagcccgcatctgtgcattaaaagggttgatatcatattggaaacaaaacaatgtggcacaaaagaagcaatggaaacaaagcaaataaactccaacaagatgtgaatcgtaaaaaaagggttgtgctcatcatgtatactttcaaactttcaaaaaacatgtaagtatgatgaaatgtaacttatactgacataattgttgagagcaaaaacatcagcagcccgaaaatcctgaatcttcaagaacagaaaataacatgatgggcaaacaaacctgctggcgaagcaaaaactctttctgagactttgatagctgaccctcaaccttttgagttattttctcagctacaagaattgactgttcatcacaaggaaaggaaataagttaaaaactacccaatgtttaaacctttgatgatgaagttattaaaattaaggaaaactaattcactaatcataaatgtcttcacctgcaggtgcctgtcaacaagttcggttgccttggaaagtctaacttttaagtcaactgaatccagcattgacaactgctcctcaaaacctatttcaaagctagccacaaaaatatcagctagtctgtacacaggaactgtctcaagaagcaccttagtcctaccaactgtcttctgcttctgcaattagaaacaacatcattgccgtaagtcatacataaccttgaaagaaaaatgtcatggataacagaaagatgagactgcagatctgatagtcacattgggaatatctatttagggtatagcgctctgttaaatttcttcacctgttcaagaacggaaattagttccattgcagtagctttgaactgcctagaaagagcaatgagatctgggtcctgctctgcgtgctccaactctagcaaattgcacaaacattaataatgtaagtgttagaatttgatattaggtgaattcaaaaggcacttaacaaagaaggtacaagaataaactaatataccaccaaactatcggcataactacaatggaaagtggaagaaaagggtggagctgtacaaaataacagctacaacagacttatgacaatgtagtgcaggaaaatagcaacaaaaataaactaatatttttaacaaacaagatcttacccgtttttgtcatatcaagacgtgagacacgagcgacatgatatgaacctcttgcactgagctcttgaacactgaacctacataaaccttcaaggacgacaatatatgtaacccttccacttggtttctccacacctctggaaaggtgcaaagccctagcagctactcccctatagatggacggaatgaaaaagtgttacacacctttttttggagaaagggagacaggtaggaaaacacaacaaaattgactaatttccaacagttctcaatcaaataattgtgtcaaagaagagttgaccactatcaaccaatcttaaccctcttgctttatctaagcccactgcaagttaatgcaatgtcacaccaacgcatagtgcgcccaacagaaagaaaattatttgcttctatcaacttatcaagtgttcatagaatgtaataagagcatgtgcccacactaacactagtttgtttacctttagtaatcgtatgctattgttttcccactattcccgacatattcaaaggaatttcttctttaaatcttgttcagagatatgaccatatggaaaaacacatattagcaaagatggcaatgttacacaccggctgtgccagtgaatggtctccttcccattcttagtatcctgcttcgttgattctcctgcagaaccaccaggcgccttgctcccaccctcacctgaatcgctgcctacacctatatgcgagcaacagcaataacagtaagaaaccaccatacaacaatgcccacaaatggctcacagaaccaaattaaaaaaaaaacagcagcagcagcagcctttatctcaccaggagacagcaatgagccagcagcttcggagtcatgcacagggagcaccccgatcagacccttctcctcccgttgccagagttcctgctccacaagcttcacactgcaggagaaacaagtacattgatgaagtcaaaatccaaaccaaaaggcagaattttcccttcccaccaagtcaacacacactagcaaagccatcgtacgcatacacagaggaaaaatctcaatactaatctgaaccacaagtaagtacaacacgcctagaaggtttgaacaccaaacagatataattaggagctgaattagtcaaccataaagcaaccaaagccgctctaaaccactttggattcagcgagttcatcaaactgcgctggaaactttttaactgttcacatcacagacgagatcatcccatcgagaaaacaacaagtgacgactacaatacaaaaaagcagaaaaagaaaaagaagaaaaagcaatttctacttgctccacacaaattcacaaaaccacagacgaaatcgaagaaaaaggcctcacgaatcatgagctaagctgactaagccaatacaatagcatcaaacaaagctaagctactgcgattttaccaaccacacgctgattaaacctaacttggactaataatccatccaccacccaaacccccgcgcgcccaatcagcccatcggccaccacccaaaattccaccctagaaaacccacacaacccgagaccgtgaaaccccccaatctcgcggtgcgcggaatccgctcgaggggcgccgacgacgacgccgcccccactacttacctgctggggttggtgcagcggatccgcacgatggcccccgggaggagcaccttgttgcggaacggcagtatcgcgagccgtccaggcagctccaccgccgcgtccgccatggccacgcacctcgcccaccccaccgcgctggaatcgtacggaagtggaggggattacggctcccgcgctggaattgaaatcggaggttggagacgatgacgaagacgacgaaggggatatttatggggtggaggtggaggagagcacacacgagccggagccaaactgaacacagagagagagagagcgggggaagtcaaggaaggttgctgcaggtggggcccgcatgtcagtgagtggtgtgtgggtgggtgtggacgtggcgctctggtgggataagggaaagggggggaaaggtgggatgggatccggtgcgggggcaaggaggaaagctgattctgattggctgcggggttcgggttgttgtgccacgctggcggtcagggggtgggcgggtttcggtgtccgctgtttcggatttcggagctcaggctgcgggatggggggatgtcgaccgtccgagatgggatggcggacggtgtggatggtgatcttccgcgagtccatgctgccatgccggccgtaagatcgggatccaacggatgggagtggtttagcgagtcatctaggccctatcttggagagtttttagtcactacagtttcttgaaaaatctttagcttccctgcacctaggttttgattttcgtgaaaccgttaaatgtcggtttgtaaaaaccggtcgtgattagctggttttcgtacagcgttaaccaaaagtcatcggttttggaaaatgaaaaggcaaaccctacctacatcgtcacatttttactcagatcctaataaattgtaatataaaaatcagaagttgaaaaacttgtttattagattctcatctatttacaagttactactacctccgtctcaaaataagtgcagccatgagtttccacgcccaactttgatcgtccgtcttatttgaaatttttttataattagtatttttgttgttataagatgataaaacatgaataatactttactcgcgacttatgtttttaatttttttcaaaaaattttcaaataagacgaatgatcaaaattagacgtggaaaactatagctgtacttattttgggacggagggagtagtacatattcctcgaaatcttgagctctaatcttagcttccaaacaagacattatccaatccccataaaatcatgtgaaaggaaaaaccattcctaatcagatttgcacatcggaattcataaaattttttattagggttccgaaggagttgaccccataaacttgacctgtgaggtggagaattcttgcaatctcacgcgtattaaactagtgttaatttggatacgaagtactcgtacttaagttagcagagacgcttattaatcaattaagtccgtgcagaagaagcaattcttctactacgattatattgcaatttctgttgctaccaactgctatgatatgttcaataaaaaaaaaggaatcagccttccgccattaccggtataatgggtgtgtttagttcacgtcaaaattaaaagtttggttgaaattgaaacgatataatacaaaagttgaaagtctgtgtgtagaaaaattttgatgtgatgaaaaaattaaaagtttaaagaaaaagtatcaaactaaactcggtctaaatgaaagctcggattagtggagccatgtcggcagccgtttttatttattcgtctgttggcaaacctagatttgataacctaaaattcttgctgagcttttcccaaaagctgagctaggcacgtggaaatattagcatgtgaaatccatggctcattctaccgtacatgacgaatttatgaggcttccagtcaacttcagagcttactccaatagtactatatactacagtaggtaggcttgtccaatagtactctcttcgtcataatataaggtctcgttgagttgacgaaaaaaaaattttggatattacatcggacgtttgattagatattggaagggttttcggacacgaatgaaaaaactaatttcataaatcatctgaaaaccacaagatgatttattaagtctaattaattcatcattagcacatatgagttactgtagcatttatggctaactcaaaagatttgtctcactattttcatgcaaactgtgtaattagtttttcattttatctatatttaatgctccatgtatttgtcaaaaattcgatgtgacgtttttgggaaaaaaaatttgaaactaatcaaggcctaagtagtactccctccgtcccaaaatataaaggattttggagggatatgatttctagtacgcaggtactttgtccagatttacagtactaggaagtgtcacatccctctaaaaatccttatattatgagagagaggaagtataatttagggtagttgtccatattcgtaattttaggatatattgcatctatactatttatattgggatggagagagtactattgatcagtctaggattgattgctcacgtaactgtctaagagtttgaattgaaatataaaattcaaagtaatggaattacataatgcacaagatactatttagcaatgcgattaaacaccgcgtgaagcaacttcagttattacattcaggatatgatgtagacagggcaactagcatttctttatttctctcatttagtgattatgatttatgtgtgggatactgggattcgtggaaggaaagcagcaacctcccaaatatatagtagagttgcctcgtaacaaaatgatcagagtttgatactggcaccaacaatttatatatatgctacagtaactaaagtgataactgagtcatacggaccctgacgaattaattatacttcatcggtcccaaattataggacgtccttttttaaaaaaaaatatcaaaatcgataattttttaattaataattatattaaccatatagtatatgctaagtactatacacgttatatcactatatttatatttaaagtactttgatatgatgttaattttatatttgttggaagcataacataaaataaattaacagcaaaagtatattatagaagatcatataaaaaatatagtgcttataatttgagatagcacaaagcaaagtcgttagatcatactgtgttcccacgtgcaaggccggataactagacttggtcacgttcttttaagtttttccctagatttttaccgtggattacttgctccacattttcaaaaaaaaaagaagatttgttaaaaaaaaatcgtcttctgctctagagtttaagtcacttgttataagctacttcctccattttatattataagacttttttagcattgtccacattcatatatatgttaatcaatctaaatatatatgtgtgaatagattcattaccatctatatgaatgtgagcaatgctagaaagttttataacctgaaactgaaacagaggtagtatttcaaagttttttcttaaaatattacaattaatcgtgttaatcaggtaaacaatcagccacgataaaaagaagcaactagcaggagacttgggagtctacgagatactcacaggtcaccgccggcatgtgtcaaacaaacagtgcaccagattgcacgccgaggtaagcaaacggcaaggaaatttggcgacggttcagacctggattgcattaagatactcgatgtttagatggcaacacatgggtaactacctgtacgtcgaaggctttacctgacaggcagctctaaaatatacagcacgagctccatggctccacggcagcatctccaagacctgagcccaagtccacggctgatggagatgcatcccattgcttatccagaaaccctgaaagaattcacatatagttaaagatcagaatgcaaacaaatgcagatccaaaaatgatagatagatgtgaagtcatcgttctggatgtcgccgtcgtcatcacgacgacggtgtgggaaatttcacccaaatttcaggaatgggattaaaaaaaatagacaagtttgtttgaaatgctgaatatgatgcacgcacgccgtggctgtttattcacgtttctgaaacgctggatccaaatgggcaagtgaaggcgatggctggcttcaaccacttgccaaatcggaaagcgaggttcatcaaccagtacagcgaagtgactagtagagcaacaattattttgataaagacgctgaacaaaaaaaaatcatttttggaggcatggcactagtgttcatactatctttgtctctaataggggtaggccctttgatggttgattggcagcattgatcatctcatcatggtctcttgtcctgattcctgatcagtttcttgccttcacgggcttagggtgtgtttagttgacgtcaaaattgaaagtttggtcaaaattgaaaagttgtaagtttatgtgtgtaggaaagttttgatgtgatggaaaagttgaaagtttgaagaaaaaatttggaactaaacacgacaggtagttttgaaacttttcctgcaaacaatagtccctttatgagaagaatcgttatgagaaggtgaaaaatacagaactgtaactgattttctgaagcaagaaaataccaaaagatttttactatgcatcaaaatgagaaggaacttgtatatgagtatctgagattgttaggctttctaatctacaatttgtgaattaagtctagctaaatggtccttgcattcataaatgataaaggatgcatttatatgttgtaacaggaatgaggccttttgagtaccttcagcatcaagttggagtaagttaccagcctatgtgcactaggccataagggtagtggccctaagcctaggcccaaatttccatcgcagatttcacatttgcatctgctactcgaaatagaatttttttttccctgaagttgtggactgaaatttcaaggggtgcgaatcacatagcaagatcatcaaagcaaaaaactacatcgcccacgaaattcgaatcaggtcgtctttgccaaatcgtcagtgaaccgtaacacttggaagcacgctagtaagatcaccagtccataacgaattcaccggaagaaacatcatcacctcggattagagaattagaatagaacgaggcgacacgatgtatcgggtatattgtgaaatgaggaagatcatgtaaggttagagcaaggcgacggagatgggaggccacaccttaccgccggagaggacggaggccggagatcccggcggcggcgccccagatgaccgccgtcgtcgtcgacgacagcagcgaccagccgcggtagattggtaggcctcatagtctttcggcccactgatcaaccctatgagaagagacacaagttggccctctggtgcatgtgggcccaaatcacagcggttacgctccgtatcgcgttccggcccaagtcagctcagcaggattcttcctcggtttaatgtcctcgatttggaataagttcactttgactctcttaactactgacagaatcttattcgtcgtgcccttcaaccgcaatatcggatatctcgacccctaattattaaaaccggtacaatttgactcccttgctgcatgtttggttggagggagtttttaggagggattgggagtttagagggatgaggctatagacggccatatggcccgaggcccacggcccggcacgaagcccgcaattttggcccggcccaaccacagcccggcccgactagggtcgtgcccgtgtcggcccggcccgacagccgggccgtgcctgggctgcaccctcggcacggtgggccggcccggcacggcccgatcaaataaaaaaatacagggatgaaaaatagacttatataatcgtataaggcatggcccaagacaataggtatacaaaatagacttattatccagccatttaaacacagcccacagagttgagggaccaaaaatagacttatttccagccatttaaacacagccacagagttgagggaccaaatatagactttttctgtgaggcagcacaatagcccatcataccttcgggccagcccggcacggcccgagtagtattgggccgtgcctgggccgtgtatgccgcccgtgggctggcacggcacagcccggtgcgtcggtcgagccatgccggcccgacaagcctcggcccaggcacggccgggcttgggccgtgccgtgccaggcggcccagatggccatctatagatgaggctattaagtgttttgtttggttgggagacatgggaattttggtgggatggggatggggaattgagcaaggaactccctccttttcaatacctgggtaggggtaggtaattgggagggaattcctcctttactttttctaagcaaatctcagccatccgtttttattaatgacctaatctccaactaaactccctgtcaatttccatcacctctaccaaacaagatattgggattaaaaattaaattcccatcctaatctcatcatcaattccctcgtgtaaactcccaatccccttccctcgagttaccaaacaagccgatgattttggtcttttcgagagcagtttcgctaatgtgacatctacgtgatagtgttgacctgatctgtggcgttgacgtggcgcttagatagcattagaattaaaaacatatatgtgggcgccattcgtcattcacaaaaaaaattatgggaccgttcatgtgtctccccctctctgtccttccttctctctttctcttcctctctggtctctactttgacacgggatctggagcggtagggcgagggcggagcggcggcggcgccgaccaccttggtccccaatcccgactactacggcgcgctactctagcaccgcctgatgggccctgtggtcctcaaggtggcgaccaccgccggtagcggcatcggcgtcggctgcggaagccaccgatttgatcaaatcatcctcacccaccccacacaaagaagtgaggggagatggcgctcgcggtgttaacccgcattgctgcgttgtggaagccgtggttctcgccggcggctcccgttccacgactctcacggcggatggtggtgccgtccccggctcccgcggcgtggatgttgtcggctccgtcctctgctcctgcagttgcggcaccttctccacgtacgatttcctcgccgcgcgctgccgggtccagctaaggccccctcgtcgttgctgtctccctcgctacgctgtcgattttgaaatgtgagggtgatcatggaggatagcggttcgtgatcgatgatagaagagcgatgggtgaaggtgattagtgattcggaggagagtgttcgtgatcgacgcataaactagaagagcgcgctgcgtgggatgggtgagggtgatcacggaggatagcagggttcgtgatcaacgcatagattagtggtgggtgaaggtgattagcgattacggaggagagctttcgtgatcgacgcatagaacatataactagaagagcacgctgtgtggtggatgagggttatcacggaggagagcgggatgcgaaaagcggtgggtgatcaaggagaagagcagcggttagtgcgagcagaagctagacgcggtgaaggaccattatcttccttctgctcctcctcctcctcaatagaagtagaatcggcagtagctgcggccgccatggatgcttcgctgacctccgatattagttactccatccatttcaaattgatctacatatttcataggtacaccaagaccaaaaaaagctaataactctctcatactatatttactctagcaacaaactcgatgcatgcaccatccctactatttcctagccaatagcaaatcaatatattgcatgtgggttataaatacttgtgtgcatggatgcatgtatcaatgctaatttactccaatgcacaaataacgaatagacttaatgaatgaacagaaatatgtagatcatttaggaataatcttaaaaaaactatatgtagatcaatttggaatggagggagtagttcgttagagagagaggatcggagaaagaaggtagtgggtagtcatggactcggcccaatgacagtacacttttgtttttggcccattcaggccgtaggtgttctgtctcgttgataacagctatgtggcgtgtctagaaattggatttgtgtctcttttttttcttttcttttaactattttttcttatgtaaaattttctcaagacgacccagttttagaaaaatatacattagtctctagatttatctttctagacacgaagttaattaacctttgcggcgccatcatcccgtgcaacaccatctccttcctccacctccacttgtaacgccatcgcctcctccccttcctctacctccacgttgatgcgatgagagcgtggctggcaagtagggaatttgcaagcgtcaatgactacgtgtgggcagggaagagatgggaaagaggatgtgtgcatgggagcttgccgagggtgtggcggaagcagcaagacaaacgtcgacgacgccgttgttgtcgggacggagactaccagcggcgtggtgggtgaagtcacagggagtcgaggccgacaggacagggagatcgacgggctaagggccaacctctaggtggccgtgcagacaaaggagaagagcaggaaggcgtcggacgacctcaccgccgcactctccggctacgatactttaggggagaaggtaatgctcatgcgcgtccaggcagtcgaggacgaggcccacgcggcagggcaagagaaatgtcaaaatagagagagaagaagaagtttgtgtcgctgacacgtggggtccaccaatttttaatcttattttaaagctgaaatgccgtgacatgtggctcccacgttaacttagccgccacgtcagctaaaaccgggaacaatattaccttgcgaccaaatgtgatccggttttataagttgagggtcggatcatacctgctatgcaggggcgaattttaaactcgacgacaaattgaccgagtcccatcattctaagcccactaactctcctgaatctcccttgcggacttgcggttcgaacagaccaaagcttgggccctcgacttctagctttcgcagcctgcagtattggtaagccctatgggcttacagcccacgtgtcggcccaactcatggctgctggtgcccgtgggcttcatgctgcatcgagttcaaaagaaagggggaaaaaaaggaaaggaaatcgtaacactgccctaagcacgcctactttcaatgaaatctaatccctccgtcctataatataaggaattttgagtttttgtttgtatcgtttgatcactcgtcttatttaatttttttataaatataaaaaataaaaagttatgcttaaagtactgtatataataaaaaataaataataattttaaaaaaatttaaataagacgagtggtcaaatgttgcaagtaaaaactcaaaatcccttatattatgggacggagggagtagttatctaccaatcaaatcaaatgtattctcatactactatcctcatcctaaataagcctaaaaaatagaaaggaaaacaaaaaacaaaaacgccaagaatccaccaactcgtctctgtgtctctctttctgtacttttctttcttcattcatgccgtgatcgatgatagcagcagagtgcaacctcacctcctcctcgccggctgcggcgcgacgtcgaccctcttccccttgccggaggcggcggcggcggcggcggggggaggaggagggtcgggctgcgactggacggcgcggcggaggacgtcgacgacctcggacatggtggggcgctccttggcgttcttgaggaggcaggactcggcgagcttggcgatgtcgcgggcggccttgacggagtactcgccgcggagcctgggatccatgatcatgcggaagttgcggctgtcgggggcgaactgggcgacccactccagcagcttctgctccccctgcggccggtggcggtccagcgtccgccgccccgtcaggatctcgtacagcaccaccccgaagctccacacgtcgctcttcaccgtcaggtgccccgtctctatgtagtccggcgccgcgtacccgtgcgtcccaaccacctgccacacatcatcatcatcatcatcatacaccatcttgagctcagctatgtatgtatcatatagtaagaacatgaaaaagaaaaattcaaacctctgatcgattggactacgacaagaaaaataaacgaagcaactaagaccgatttatggataagacatgtttttagcgaaccgttcaaaagccaaaatgacatcaaatagggtacatgaaggtaaaaacaaaaaaaaaacaatttaaaactaagcaactacaaatagtttatagataaaacctttatatatgtgtgtgttattagtggtttaaagctaaggctattaagggggtgtttggataccctgactaaactttagtccctggtacatcggatgtttggacactaatttagagtattaaatataaactaattataaaactaattacacggtggaggttaatttgcgagacgaatatattaagcctaattagtccatgatttgataatatagtgctacagtaaatatgtgctaatcatggattaattaggcttaaatagatttgtctcgcgaattagcctctatttgtgtaattagttttataagtagtctatgtttaatactccaaattagtgtccaaatatccgatgtaacagggactaaagtttagtcagtgtatccaaacaacccctaaatagactatgatgaaaagacccaaaatcaactttagaattatgttttagaattcaaattttttgttgtggctaataagccaataagcagacaattatagcattgatccatttcctaaggataataacatagctcaaagctccttcgcaatgcaggaatttcatggaaatcttctaaaattcctatgttccaaaggtctggtatggtatgccatagagcagttctgcgtcaatgctgacacaaggtgcaaaattcagggggagaagagtgatgcatgcgtggcatgtgtgcatatgtaaggaagtggtggcaacttggtccatggcattgacttgctggattgcggtcaagattgtcaggtacacatcaaacaggtgcactggactgcttgcctacttcagtcaacgatgctttaaaggctgtagtatataagttgctttcagtgcctgatggatcagacaatgcagttgcgagaaggctatggttttgtttgtaattctaatagcaggttcagatggagacataccgctgttgagacgtgagtgtttgctcctgttggtccctcccttgctagcccgaagtccgacagctttgctctgaagtctttgtccaacaaaatgttagatgctttgaagtcccggtagattacctatcaaaattgagcaaatcagatgaggatcttcccttttgtacaaaatggaaatgtcgtaaccaaagaagaagaaaagctgaagtaactttgtatactaagcagcagtacgcaattagcactgtaaattatgacgatgacctgaaaaaatgtgataggtttagccttccctaacagcctgtatatcttgatgctcaccagctatagagccttcttgcctaagtccttaattgttttctagattggaatacttggttctacagctaaactagaacatagagaggacaaatcgtatacgttggttgcaactaggagtagttagtactgattatgctttcagaaagtgtcaatgaaatttggtgcctggaatcttacaggaaagtaatggagatggagatggaattgaacaaaccacttttgcctctttttcatctagctcatcaattcgtggtccttattttctcattgactttacactggaatactggattcactgcacctctattgcactacctctagttactatggatgcacggtcaaaagaacctattaaaacgttggtgctgtctctcatcatatatttttattgccaaactttctcccacaaaaaacgaaatcacctatttgataaagatatatcttttcagagaagttgaaagcatgtgggcaatgtatgtctgaagtatacctgaacttgcccttcatgcaggtaagctaatccttctgcagcacccaagattatttgaagccttctattccatgagagaggaggataagctcggacgaataagtgatcttccaggctcttattaggcatatactcatacaccaataatctttgtggccccctttcaccatcaacggcacaatatccaagaagctttacaaggtttgggtgctcaagaaccccaaggaactgtacttccgccaaccactgcttatgtccctgggagcaaaattaaaagaaactgcaaaatattaggaacagaagacaggattactcattagagggatagcataggagatcaaccgcatttgttttagtagcattatagcacaaagcaaatataggaaaccaacagacctaatgctgccttacaagtagtttattcataacatcactataattagcgtgcatcctaaattcctaatatacatcaactggtcaagaaaagacatcataactgagtcagtaaaatatcatctaattcgagtagagaaacttggaaaaatccttatatttttagcagacaccacttagagaaaatgaagcttatgcttgggtattctattaagttcaggacttgaaattaattatttcctgtactccactaaacgatatattcactaccggtttgtcagtctttagacatcacttgcataaattcagaatggatatagagtcgcaaagcacatggaaattgaagtttctagctgacttttgttctatatgttcacgcaccaaaatttttcctcctagtgagtgaataatagtcaaataagactagcaacatggttgtgcaggttgcccagaaacgtaatctattctatccattagtcttctttgattgagcaaattagctaacggaatattgatttagagtgaaaggttggttcgcatcattttctaggagacatatttctactgtaagcattcagagaagacatggtctactattaatattgattgccatttgttttatgatgaccatgaatgaatattcaacttccaagtttgaggaagtaaggttcctagatacttgaaaagttcattgccgttcaaattctatcctgtatttcccctccattttgctttattatgaataaacagttgccacgtgtgcccattggtcctatatttaaccacatctccacgcccagcacctcaactagtaatagtttatgcagaccagtaacttctatagtcaactgacaatggactgaagtaatccaatgcaatagattgaccccataaaatatactatcaaaattgtaaaataacagtaacaggcaatatctcatccttgaaagttctgcattttgatcctgtcttcctgtcaagattgtctacacagagagagatttttaacatactgataatagataaccaaaccaatttcaacatttagcaagccaggaatatttccaatattccggcaaactagaaaatgacttgtgtccatggacttcctatggatcagaacaacatacttgtcagtttatccagagaccaattcaagatcagctaacaccaagcacagaatccattaactttactccccataatgaatcttcccataacagtcgttaatctaatctagtggtcactactgatgattttcatcaaatttggcagaactacacattaaaaacaaaaactcgctaagttgcctgaaagcattcttctgcattctatgccaggatcttggcgaagagaagtatcaagaacaacaaaaatggcatcatttgggatctcccttaaaaaaacacttcccttatctaccagcactaatttctgacaatactgaacataagagagcaaaccttaaactaacaaaactcattccccaattctcctattcccaaattcctattcacccctagttatcaaaccggaaatcaatcgcgcagaatcacaaaggggggaatactactcctggatcggaatggaggattcgttcccgggtgacaactgacaagacatgattgatggtgtccaagaaaagtcaagaggagggggtgcagactgcaaagagagacagagacaggggaacgagaaggaggaggagagcacgcaaacaagcgagtacctggagaccccgctggttcaggcacttgacggcgacggcgaggcgatcggcggccttgccgtcggcgggggaggagcggacgaagcccttgtagacgctgccgaagccgccctcgccgagcttctgggcgcggctgaagccgttggtggcggcctggagctcgtcgtagtcgaagtcccggagctggccgtggccgcgctcctcgtacagcgacgagatgctccggtgcgacgacgtcgaccccgtcgacttgctcgccggcctcaccgccccggagtcgtccgacctgctcgtgctcaccgccgacaccgtcgtcgtcgtcgagccccgcctccccgacgattccttgctcttggacgacctccgcttcttgaaccaacccaagcagctcatttcttgcagcaagcaagcacgcacgcacgcacgcgaaccgtgtgcggtccaaaatccttttgtaggcgaagaagaggaggcagaggcagtgtgaactgtgaaccgcggaaggtagcaatagcaaagggagaatcagaaagctcgccaagatttatttcggcaggcgagagagaggagaggggaagagggcgcgtacgtgcgggggtagtactacgtttgatgaagcggccgcgtcggcccggttggctctgccaactcacccctctcgtttctaaaaaagttttatataaaaattgttttaaaagattatattaatttataaataaataacaaatatatatttttttagaattacacaatacaacgcagacattcacaacgcacgcgcactcacccctatgaacacacgcacgcaaaccctacccctatgagcatcttcgaagactgtgccggcaaattctggaagagactgatgaagtcaccacaggcgcctcgctgtcgacgggtacgtcacttaccactgaatacataattaactatatgttaataaatcactacggtttatataaggccagacccagcccaatacattaaatatagtttccataaactccacgttatcaagaaagtaagtattagacactactttttcatacttcaatttaatgaagtactacttatttcatatgatgtcttggatattgtgaaaaaactatgtcttggatatttcttttttcctctctatttccttgtcatattattttttttattttagatgatagtttatttaatgcttcgtaggagtacattattctggttattgcattgaggctggcctaagtgctgccggtggtggccgttgcacgcgcggtgcgtggtagactggtagttgattgatcagctgatcggttgctgctgctggggcgcaccgggcgcacgcggacgcggtgtggtgtgagctcggcgggcgggatggggacggctctgtttggtgttgggtttttgttgtgtggattgcccgcgtcgtcgtacgggtctcaactacgaatctgaacgcctcgtcggcttcgccaaattcgcatgcctgcgcgtctctctctggctctgcaggtggccgtgttcggttgcatcactgtatagcagtcgcagcccccttttctaatcatggaatttaaatttactttgcatgagttgcgtgcgtgatgaaaacaacagctgtgggatggtgatgcgagtgtgtaatcgagaatattttttagggaaacgaatatgttgttctagcctgtgtttagttccacgttaaaattaaaagtttaaagaaattggaacgatgtaacgaaaaaattagaagttcgtgagtataaaaaagtttaatgtgacgaaaagtttgaagtttgaagaaaaaagttagaatctaaacatggccctacttttttatgaaaaaacataggataaacgtagatgtttataacatgcacacgtaaaatctatttgtatgaataccttcagaagactaggatcaacatattttaaaattcaagaagtcaccacatacatctcactagataagtacgtcaactaccactgaaagactaattagccgtaaaggcgtcgtgttacgtttaagatttgaacttgagtgagttgacttcaccaattcaatcagttgagctacgtttattttgcatgtgtttatagtatttgggtgtacactttttctctctaatatcttcacccgcgtggattgaatcttctcgtcagatatatactgatatggaccacaacaaactttattatcactatgttttacagagtttcataatctatttagctccatccttgtatacatcgaagttgtcggccagcccaaataattttgatgatcaatagccacaagcgcgagaataattgtgacgaaagtcaagagggaacatagattatagtgatatatattattcataggctcgtagcttaattcatgttttgttcgacgatttttgatattgtttacttgcatatatgccatgtgtttgttacgttgggcccaaacaatacgacacatatatagacctagtcgcgacagtgtacatgattcttcaattgtttcttgggtaatgggttccatgcatgttccaatagtccaagttgggtgtttaaaacttggaagaaaatgtgaaagaggtgttaggtgaattcacacttcagtgcccaagacaccttcaatgtcaaatactctaatcaatgctggtcaagtgactcataaaaaaaattgttggtcaagtgaaaataataaaatacagacagtcttagaatagtgtgtttgagaggaagaaaacatataatatcccactatatacataggatttcaataaaatatcactcaatggaatgcatcgtataaaataccactcaatacgttgcctaccagatgaaatattactttgaggagttttaaccatttttatactcgaaatgcccttggctgtggctatgaagagagagagagagggagagggtgagtcaggggaggaccgggtgcatggcgccggagacctcgctgagaggcggtggcagcggaaggaggacaagacggcggtggggataaggaggcgacaacaaggatgagacaccactatggaggtggagatagacccgtcgtcccggtcacttctactcgctgcccccctcccaaaaaaaaaagcaaaaatgcaaatggtgtgtttttcataaaaaaaaatacatatgattttttaaaaaaagaatttaaatattgatcacaaaatcattcacctaggccgagtttagttccaaaatttttctttaaacttctaacttttccatcacatcaaaactttcctacacggctacacacataaacttccaactcttccgtcacatcgttccaatttcaaccaaactttcaatttttacgtgaactaaacacacccctattcagctataaaaacaaatagaacaatccatttgtgtactataatagtacaccactggaacaagaaagagggctattattgacccagttgtagagggatcacattgctcagctctaaaccatactattccaaagaacttctgcaagacacccactttgaaaaaaaaaaacacctaaacaaacaaattgccccttggaaggacaggactagttagtgctgtgtgttgacctgtgtaaacaaaatcagattttgtgtaccggctttctagtgaactgcgtacaaacggtgcagatgagaggagacaacagcagcatcatgaagagcactggaggagaagaggacggcgacgcctctgatgaagagaacccgtcgtcgtttctcctccccggtcaaacacacgggctgcaagtctggaatgatggagaaccaaacaacccgctcaatccaacgctcacgtgtgcgtctgttaggctgtgggccccggctgtcaggctgtggggccccggtcaacgtcttgaccgggacgcgactgtcgcgcagtgacgtgctgcttgatgaacaacaacacctggtctcttcacggttagcccaagtgtgaacttaaaagtacagccaatcagccatggttagactttggaacacgcaaaattaacttggtttctgcgaaaattgaattgtcatatggtctctccgtaatttttttatatatagatctttttagatggaggaaatactcacatggtttattccctccgtattagaaagttgtttttttctctagaacggaacgaaatgagtattcgggaatcatgtaaaattttgtgttctgaataatggattaggtcgtgtttagttccaaagtttttttttcaaacttccaactttttcattacatcaaaatttttctacacacacaaactttcaacttttccgtcacatcgttctaattttaaccaaacttctaattttggtgtaaactaaacacagccttaacctcgctgttcagagttgggacatttgaaagacaatactgtataattcatatgtcagggagctaactaaaagttcagaagaaagagcgagtctcaaacattcctctaccagtgtcaaagcgtacggagctatgccagcttgtcagctgcgagctcaccatctcgccatagtcgcgtgccaaaaaaaaaaaaaacaaaagtgattgatcacaagaatcgcattgctgccgggtacaccacgctgagatcataaatttacaatctaattaagaataattaatggtatactacacattgtcaggtcagcccggtgagcttcagaattcgacgatccatcattcatcgcatcgtcatcagggcttaggttgacgacgccccggtcaattcatccactccagccgttgtcatcatcatcatcatctcctcgtcttgctaaccgtcgcgtcctcatcttcttcttcctcctccggattaatcttctgtcgcttctgcaattggtcagcctgtcagcaatgcagatcaagaagttaattagcgaatgtaactattactaagcagtgaactgtgaagcaattcaatccatgagatgcaagtcgtatgaacacatctgaatgcatagaatgtgtccggacagccgtgtcaatcgattgatctagacgaacttggctggaaacagttttgctgttgcagctgacgcgaaggacgttgactccccttactggaatcgcatgctcatctgtgtactactagtactgaggaggattcaggaaaaggtagtagaaagaaagaaaaaagagtcaggactcgagactagttcagttcaatttttccgtaccctttttctgaaacaaatctgccttttgattttgaatgactaataacatgtaggtacgtacttcatatctaacggatttaatatataacagtgatccaggttagaaaacagtactgcagagagaactcatcacctaaaacactgcacggctgcacctaccttcggtcttttcttgtaccaatggttttgaatattttgatcttttcaaccactcaatgtcatgcaggttaattggcgatttaatcgccttttctgcaattcttaaatgcgacaaaagaaaccatcgtcttggccagagaattcagagtttactagttcaaacatggtatttctctttcactgtctagtgcatagtagtatttacaagtagtatccagctagctttttactttcttcatttctttacgtgatcggttaactgtcagctagagaattttggatggtccgaagatttctaccggtatctgtcagtgtccatttttgcagagctgtactactgagccttcattcaggtattgatcgttttcgttgacggatcggatcaacttccaggacaagcacggccattgccattgcatcgatcactatcgaacaaggaccatctatcaaatccggtttccgcgttgcacagatccagagctgttcctctcgtcggtttaagaatcaactccgacgcgcatttactattcctatacttaattaaggttgttgcagtcatgtctcagctacgtgaagaccgggcgtgtcgatcatggcgtcaatggtgaccaactgatgatcaacagtgacagaaaatgcaaatctattttctccattttgaaatataagtatttttatattattcaaaatttatactacaatataagtgtttctggaatactggttctaaggcactgaatacatattatgatagggaatataaacaatttaaaatttaaccaccatagtgagtttttttttacaaaaaaagcctactgtggtgactaaaaaaatctttttactctaacctttagtatttacttaaataactttaaaatacttatgttttgaattaaccaatgtcatatactaatctaactataatatttattaaagtaaaatttactctattttaaactaaccaatgtcatatatcacagatggtaagcatatatggtgtgaagtgaaaatatatgcttatttctagtctattataaaactttggctaataaagatgatcaaagtaaaatttaccctattttaaactaaccaacgtcatatatcaaaggcggaggtagtactattgtactactgcaaggtgttcttttcttctgaagatgaagatgaagattaagttttttacgcaaaacgaggtagtattaacgtatgattgattgagttttaattattataaacttgaaaaatatattaatatggtattttagagcaactttcatatagaaaattttcgcacgaaacgcaccatttagcagtttgaaacgcatcatattgttgttggagaaaagaacgggaccaagtcaagttcagctagcgagcgatgtggaaatcggtagctgcaagcgaacgcgaaagttcagagaatgtgtcgcgcgcggcgtcagtgtcactgtacctggccggcgcggccgccgccgccgctgcttctcgccgcctgcagctgcgacgagacgcggccggcgacttcggcgaagcaggcccgccccaaggacacggcggcctggaggtgcgacgccgtcgcgtccttggcgctggcgcgtagctgcagcaggccgcggtcgatgtcggcctcgtgcctcgccagcaccggctgcaggtagctctcgtagacgtgcttcgcgccctgaaaacgaacagacatggaatgggtctctgaatgttgagaacgatgtctccttgagcgtttctgaatgttcggacttcagcttcagtttgaattcagatttaattttctttttgcagtacttttatggtaggtctctactgttagtattcgatcttggggtgtgtttagttcacgccaaaattagaagtttggttaaaattgaaacgatgtgacggaaaagttggaagtttatatgtgtaggaaagttttaatgtgatagatcgaaaagttggaagtttgaagaaaaattttggaactaaactcggccctactgtgaaaataatctcaaccattaattcctgggttctactattagtagaaaaaagagcactgctacagtgtactgaaaaaaaaccatacaaacataattctcaaccgtttgaatttttttactagatgagcacacgttaattctagagttctatatgatcagatttgtaaaactgtgagtgtttataagaaaaaaaagtgattgtatagcctttttcccagaaaaaattatgcaactacaagtagttgaagtgctagtgaaataccttaatttttgcggttgtcgagtgagtgtactacaagaaactaaatctgataattgattatcggagcagacaattattcacgaatggattagtaacattacaaaacctagaccattgcatcaaagcaaatatagcacatttgagttaatcaggtgagtgcttactcgtgtctttgggtaccagaggtagagcacgagcgcaagctttgcctcgccgtacatgggcagccatgagaccgtgaaataggtgatcgtctccaacgtcgtcagaaacgcgaggagaatcctgaacagcacaagcaattgttcagattcttcagaattcaggcaggatgcagcatgattttgcaggtttgtttgtgtagggtaatgcttcatcaccagtactgacaccagaaacgcaactgatcgatctgcggtttgttcagttccagcgtcttgtagcagtcatacgccgggtaggcgtatcctaaaaccagcctgcgttgcagaaagatgcaaagaggacatgaattgggcttttctgatctcttccacgaactgttcaaacggactgaatattttttcgagattactcacgtcagaagtctagtgataagtaacaccgccatcttcagtcgtcagaacaaaagaagaacacaacaatctgcaaagggacttttcagagatttatcaagcccgtgattaaagaagcaaaattaaacaatgcaatgcaggattcagatttgcaattgcaaaaacaaacgaacttctgaagatactgggaacgtcgtcagaatttaatagggccaaacaatcataaagatcgacgagaaggaaaccaaccaacaatgaagttaatacggatcgcattgcgcaatggaaaattacctccgagaatttttcaccctgcaatcaaatggcttggatagatttgttgcgagggatgaactgaaaccgagaagagcgcgcggttaaaatatgcagggatgcggttaacattggatgggatacggaagatagcccaaccgacgcctcttttcgcgccagaaaaacggttagaggaagcggcaaaatagatgggccaacaattcatggctgaagccacgtttactgaagattgttaactgaccatggttagtggtgatgccctgccatttcacttctggactcctacccaaaataagctgcaaattgtttgtcagatcccaaaataagctgtatattgtttttttaactactcccaaaaatataagacttactttgacggtccaaaaatgagctttgactgtaaatttctgtaacactacttttacttgcagtaacaaaatcatagccataagaaagtagtctcggtctctcggacatgaatccaatattaccattttgtatgccaaaataaatatctttggattattcgcttgtcaaagcttaaaattggacagtcaaaatatatcttatatttctgaatagaggagtagcatttttagtttccagcaaaaacaatttccaggtagtacagagggaaaggcagagtagggcatagtttctggggatccaagaatgtaaatttccaagaggtcctagggtcccaaatgccaattagttatgacatttcgaccaaccatgtggtcactaacgatggccattattataccagcctccctgatccagtgtgtataattgttttgactttattattttctttaaaatttcttggttctttgggacacattcacagaagccaaaggcaaagcatgtcttctcgttacgcttcgttgtgggccatgttgctttatcacctgtaaccctataaaaccacacgccaacaatcatggattaataggccatgatgaaccatactgaaaagatgtccaatttatgtatgaacatactgaacaaactggattaatacttccctctccccatgtgatctcacatgttcagtgcaatgttcatcttgggagggattttacagatcatcaatacaagctaccagagatcattttagaatcaacaaatggaatccgtcctacaaatacaacactcgtagtatcagatagtacaccagcaaaccggatgcaactacgcagcagtatttgtataaacaatagcactatggcacaagaactactactgctaaccacccatcacccaaaagatgaacaacgaagaacaccgtgaaggcgtttcgctgatggcacattgcctttggtcacgccaaaaatctctcattgtacatggctacatgtatatcctcccggttggtcaaagccattgcccaaactctgagagagctctaggtgaacgactgcgccacagaggaagttgtgaccagaccagaaagaagaccaacgagggtgccgctgttgtaagtgcttgactctgtctgaacagcattgtcccgagagtcgacgaaagtgtcattctggaacggcccgcccacgagggctcccatggcgacgtttgggtttgggctcgtagaatgaagatactggaatcctttgcagcctgtctttgcatcagcggggatcgacgcccctctgtggtgtacctgctgtgggtagctgctcccatatccaaccaggtagctaagcttcattgggttgtctcccaagatgtaattagcctgacatgcaacagaatatatgttagaaacttactgcacaacaccttcctggtcagatgctaccaacacagcagagcagaaatagtgtgtaggtcatgagtcatgacaaccaaagttatcatagaatgtagttaagccacaaaggcaagcagtgtgtcacaatgtgccgatggctcgtgacaaaaaaaggtaggcatgtaaatacaaggaatgttttatggtgtttcttgttgaacttcaacatggcaaactggaatttcagtatcttgcaaggttttctgtagttcacctgtgatatagcaaaattgcgtatatctgtaggactgtagtactttccactgcattgcactgctgctgtttgcgatgtgagcatgtagtcactgtaaacaacagcaaggaatgctgcatttgtggcatgctggagagaattccatccacttatccacaccaatccccctgcacaaaaatcaccatcatataattaaatcacaggcaaacaaaatacagtttgcacatattctgtctaaccccagaaaatactatttaatgtaaaaaaaaagtgaacaacaaaagcctatgcataaattctccatgtattgacccataatataagatcaaacagtggaagaatttcaacataccaccagtcctactggcagtagctgatggagaatctggtaggagcccacaaatgacggcttcagcagtgtctctgtacattttgagtcccatgttttcagcattagatgtctgtttggatccaaagaaatttaatcttgacaagagcacctgcacataatagacaaaatgcattgaaagttatattctttggctgaagagtgaactaacgttattaaaggaagataaaaggcgtagcttcattcctagttcccgaataacaaagttgcttcttaaatgttcatgcaaaattgcaaacctgtgtccctgcaagtttgtcatcccaactgaaccatgttggccttccccaatcagcaaaagcttttccattctctacagtcacataactgaggtatgtttggtctcctgtagcatgatagagccaactcgctgcccacaggagttcgtcttgataaccagtagaattatagtagttttggagctttggataggtgtcactggcgaggcctttataagtatcagcaaaagtaaacaacttctgagcatgttgaagaagtgaatcagaatatgtagtgtctctggatttgaaaacaattgatgctgatgccatagctgctgctgcctcagcagcaacatctgatccaggagactttgtgttaatctgtgtgagtggtcttttctcagacatagtctccggcctttcccagcagttgtgatctagatcaggatcaccaacctacaaggtaacagttatacacgttagttgattaatatcaagacgttcaacaaggtgaggttgctgcatctattgtactgatctgttcaaagaaatatataatgtgttctttgttagatggacttaaggcaattaacatgaacaataaactagcttataagttatatctgatttcatcatcttatgtacattgtattctattcatcaggtattgaatgtgctgtacaacctacccaagtaagcatgactaaacatgtcaacgcaagcattgagtgataaaacttccacacatacagaaattcaactcataaaaacatctggcatcccctaatcttcaactttcaaaaacacccatccccctaccatcaagggctaactctacatattaagagatgtgttgaactttactcaattaagtatgggactaccatccaaatttcaaagggaaaaaaaaggactaccttggaacattgtgggtatatcatacggagaagtctatactgatagtgtgaaaagaatgcaactataaagacaaactggaaagggcatggacattgaacttgcaacaaatgtgttgatttaaaccgatttaaacgtatcaagccgaaaacgaagtacctcctaactattaggtgtccagatcacgacatctgacctggcttgcttcttaccaaccaaactttccctctactgaaagtctgaaatgccgccaggccgcaataaaccacaactaaagcaagcatagatcactcaaaatttttacatagtataaagaattatgctacagctctaacctgaatgtagaacacattgtcagatggatgcgcattgacgaggaaatcagtgatccatcggagagcatcaagcgcagggtccagctgcttcgtggcgctcatctgatctccatactcaagtatggaccacgagagcaccgttgccgtgaaggccatcgggaaactaaacttgatatgatcaccagcatcatacattcccttggaaagatccagccccgctggtttcccatcatccagcgccgagtcccccctccacgggatctggttgttctccagcttccccgctgcacaataccaacagaaattaccaacaatttagcaaataagtacttctttagagctactgaagctgaaaagggttagagattgtgctcattcagcctccaaaacactgcatcggtggctggaacaaccaaaactccaatatccatagctaaataagctaaattcacagtttggttaacagatttaagtgaaatctgcgagcacacatttgccaacgacatagtaatcaccacagaaaggaactgctcttgcagaagagcgtaaaattcacactaaaaaaaagtcaaaactataaggtcacggccactgaaatcggtgagaaatctaccgactcgtcaactttcctactgagtaacgattggtgaaattcttcaccacccagaagcagaaaccatcagatcacccgaaacaaccgtatcaacctctccaactaccaccccaaatgcggagatactaaacgaacacacacacacacacacacaagagcttccaagctgggcgccaagaaagaaaagggcattcgccgcgaaatccgccgaattgcggaagaagcattgcggtggcgaggtggtgagcagcagcgaaccagtgcgtgcggcgggggcaagaagaagaagtggagcgagtggtggtggtggtggcggtggcaactcacccttctggacctggaagaactggagcgccaccccgagcgcgtcgccgtacttggagtcgatggccccgggcgggccgggcaccggcagcggcttgagcttgcgcccgctccccccgccgaccttcttcttcatgatggccaccaccgccgccgtcgccaccagcgacgccaccagcgccacgatcagccacccgcagcaccccttcgtcttggaccccatcgcattcgcctcctgcaacccaccggagacgacgacgcctccgcggcgctgctcggctcggcgtctcgctcgctcgccgcctcctcttctactgcaggggatgggctcgcgtgggctttcggctgggttggtggtggtggcgctcgtcgcgtactcgcgtgtggtgcggccgcgggggggttggtgcacggtcggggtaggggtgaggtggaagtctgggagtcgctgtcgggtggggccgaggcgtggtgggccacggatggcagtgagaggggaggactcagcgcgtgggggtgtgtgggtgaggtgaggagtcgagagcaccgacaggacaggagatggacgggccgacgcgcgctggatggatggacggatcgtttgtgagggtgtgtgtccgacctgtatttaggtgtgctgcaccttaacgtacgtacacgagtggttgtgcaccttactgggatagggtatatttccgtatattttgttttgctagtgtctactggcaagagatcatctaaacatttcacgtcaaattggcaattctgtggaaggtgagattatatttttcggtacgacaactagctggcatttcatgacagaatgttcgtgcaattctatggttgtgtttagttcagcgcaaagtttagattttgattgaaattagagatgatgtgactgaaaagttttgtgtgtatgacaggttaatgtgatggaaaagaactgaggtttgaattcaaacttttgatctaaacacagcctatgttcattttgtggcaatggattggcaatgaattatgggcatgatcccgatccctaaactcttaaacggtacaatattataataaaagcttctatatgtgaatttcttatataagtattttatttttttcctattttacaaatacttaattcgtcatttgtatactcgtataattatcatttcatgccctagtcgccaagagtatgaggagtcgaagaatttaactctttatttgacaaattttgtttaatgtaatatctagagtacacacgtctgatagttgtgacgacgttgcttaatggcgtgaccactgagtacgataaattggtacacctggtggtgtaatcatacacgcatgggccgtccaacccaaatattgcatgctaagcaatgaactggcgataatgattgattaaaacgcagctggtgactacccaaaggaatttctggagttagaattatttgcgcaattggtgtggataacgatgtgcatgcgatttttgggtaagaccagagacgatcccaaagaatttggggatctccaggtgtcccgcagtcggaatcttttgatgacggagagctcggcccctttttaaagcgttgatataaagcatcatataacgttttactcaagcggatgccaaagataatactactaatattaagcaaaggctagtggtaactaaagtattaacaatgtcataagcactggagaaagcattattcaccatttggcgttcatgctgcatagagaagaaaaacaaattgctaaaaaacaccaaggcaagaagggcaggaatctcaatccaagcacaccttagcgtaagcatcatattgacggtcatctcgaccagaatactggtgatgagttagttagtgagtagtgacagcagttgagcacagctcacaccaggagctttgcaaaccatgattagtccatggcccatttgcctttgtaacaaatctggggactttgctcattatcttggcacggttctgaaactgataatagataatctggatccatacacaattatagtacatgcaaccaccgtatctgcttcttgttggcactgacgctggcgacaagaccatgagcaccgtcttatgatgcaatattgccgtgcccatttcccctgcacagtgcaaaacaatcattgcaatagcaatacaacttgaacagaaacagactgggatgtagtattcgttgttcttgatgacgcagataaaagggatcaataggacagtgataactgaccttgtggctgttgcacgcagagtgatgctagataaagaagaccaaaccaacaatgttgataaatgcattccgtattaacaagaaggatagcatgtcaagcttggatccagggcattatgattaatccgtacacatttatgcatcagttgctcaaatgctcagccacaatctgcaaccagaaaaccataacccagctaagaactactagtacatgaataacaatgtgagaaaataatccaaatattaacagtcggcattcaattgagaagtaggaaaataggaatattagcatgtgacatcgtatggttgatctgtagtaaaacagttcatccgatggtcaggtcgaaaggaagggtgttttagcatattactatacaaagtgtaattaaactaaaatgcatgatgtaaaatagaagctgaaagggtcagaactgcataagcacccccgataaaagcatcacctagaaatgatatcctattactggaccaattgatctgcaaaaaaataacttttacatatccacagttgtttgatctccaaaatcctgcaataaaaaacatttcagtttagatacagtacaacagagagatagatgagcacaaatatagggatatccaatcgaatggcttattttcattgagtgtgtatattataaccttctggagtcatcaacatcagagtaatagtgtgcaatgcagtaaaataacagctgcaatgtaaataaaagaaaatgttgcgccaacacattttttagggctctgcacaatgcgttaaaatgtctgtaaggtaaacaaaaaacaatgctgcattggtgccacagaaatttattaacggatgcaatgggatccacccccttctttttctcccatcctagagtcaggatatcacaacaaccaggatgtgcagaagtacatcttatctccctcgatacacggatattaagaaagtaggtctttatgtactcttcgttttcaacagaaagaaacatataaggtcttgtgtgaaaatttagtctaaccatacaatgatctcagcatgaatgaatggacacatttgattagttaacagcgtacctgat

SEQ ID NO: 68464 - DNA, 776 bp, Oryza sativa
  unsure (1)..(776): unsure at all n locations
ctagtctccagtaggcgaggcaccaaaaagcgactaggtgaacactattacttgtgtcttaggtgttctgcaatagtcatttacattttcaatgtataatttgtatggtgtacattccatttgaaaaggaagtaaaaccatttggagcttaatagcagttctatttttcctcatgttcctcccaaaggtttatgtcccactttaatcagctattcagaagtttattttatgctttaaataaaattactgaaatttgacatcttgacaacaacatgattgccagtctgggaatgttattcatccttttagttatgtacttctctgaagtcctctgtgatgattgtgaattgttgctggtcctctctttatagaatgatcccagtccaactcttagaaaaagccacaaacacttccacaaatcttcatgtgctccaggggagaaatgtggaatggacaaataaagtaacttctttattgtggaatacttacaccatgccattttgatgattttagtttcatattggtcatctttgatcccctgactgatttgcctaagtcacctgtcactgcagcaactataggtcaagcaaataaatcagctcatcttacagcaactatgtctaatccaaatatagtaccttcttccagtcatgaagggacgcctcagcatgaaaaggcacctgtaattcgacccatcaccgtaaaaaatggtatgacacatcaatctcgacctggtgatgaactactgcagagnagccatgcaactcaaggcgcgg

SEQ ID NO: 68465 - DNA, 14298 bp, Oryza sativa
ctctgtctctctctctctctctctctcccgctctgcccgtgagccgcgccaagccctccctctccgctctcgctgccgttcccgccgatgccgcccaaatcgccacgccgcccgcgcgcgcgcgccgtggtggccgaccggccagtcgccgccgccgtcagcgcctgccgcgcctgcccgcgcctgccgcccgtgtcgtcgctccgctccaaaccgccccgccgtcatcgccgtcgtcatcgacccagcccccgccactcggcgcgctagcctccaagggacggaggcagagctcctcctccctctgccgcgtcgcccccgttccctcctccttttcccaaagtggcaaggggcaagccccctttcttccttcctttttcctttttctcttcctccgccggcgtcattcccctccttcctgtcgccgatttggccgctagccggagcgccagctcgctggcttgaccatccaatgtcggttcccctctcctaaaccgacattgtcgcccatataaacccaagattcccccccctttcctttcctctcccattcgccctcgctccaccacgccattgccgtcccctctgtctcgccgatcgccgaccgccgccgtcacgtgtgccgaaggagccggcgcgcgttaggaagcggaaggggactccgggcgcgccctcttcttcctcttccccggcccgaggccggagagatcactcccgtgccgtcggcctctcgtcacagcgccccacctcgtctcagtagtgcctccctccgttctccctcctcgttccatctcctccccttagactcgggtagtagcacgagtagcctccccgtagctagctagcgccgccccgaccgttgccgccgctcgttgtgtgctcgccgccgtcgccgcccgtgctccgtagcacccgctcgtcgccggcctcgctcggcatagctccgcccaatccgacgctagcaacggatccccggagtcgcatagatgctctagctcgcccgaatcggtctcccgttgcgcccttgccgtttcccccttctctcgccgccggttgccgccgccgcaatccaccgccgtcgagcattccccggcaaatccgagccattgactcgtctcccctcgtcccgtgcaacctcccggtgtgcttgctttcgcctgtatcgtcgtggttcgctccgccgcttgccgccgccgtccgccgtccgttccggccgacgccttcgtcttcctccagccggcccgcgtggcaaccacgtaggcgccacgtcggcgccacctcggccgcgaccagatcggctgacccggccagccgctccctccgttccccccccccccccgtgcgcatggtccgcggtgagccgtgaggctgcgcgtgggccgccgcaccgcgtcctccgcgaactgcgcgcatgcgcccggccttccttcccaaaccctagcacgccccgcgtgcacctcgctcacggtgagctgagtcgccgacaagcgggtcttacccgggaccacgcgggatggacccgggggaccggctctctctctctctgctccccgcccgcgcggcgctttgggacgccttcttgggccggccggcccattaagctcggccgagccgccccttttctctcgggccgcgccgtagccgcccgaggaaagtctaatttacctccctccttcttttcttttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatctaaaggcacgcttagaggtcaataatagggctttattttcgccgtttgctgagttgtcccatttcgcgtgtagtttcggagcccgaagacccgcagtgcgaggatttcgaggaccaagatcaagatctcgagcaaggcaagccacctttgaacatcttgagcctatatttgaacttaattatgttgcttaaaaaatattatgcattgataggattgcacttaatctgtttgtcccatctgcaaggcagattggcggacctacctaacttgttgcatttgacccttgccttgtaattgttataccatgttcccttgtaaccacctagttgcgcctcggtaatcgtgcactctacacgagtatcgacgatcgccttcaaacttaaaatctgagaaacatcttgggtaaaacttgggttttacaaaagacttggaaaacccgacacctgggtcggtgcttgcgaacctaaatgaatttccaaaatcgcggaccgggtaacgtaccgggtgtacggtttcccgctcttgcacttaaggaccgtttccttggaatttcatccgaacataagacaagtacgaccacatgggtggaatgggacacccctggctgagtaactagctaatcgggggagccatgatgtcaagagacatgtggattcaacggggtggtgtcggggaggacccccgggtttcctggcacagtatggtctgggacctaatctggtgttggtctggaacccctctcattggcatatggtgaacctgtgtcggctttcgaaatgccttgtcatgaaagccttaaggtctctagtcgtggccgttctgcacgggctggatgatccgggttagtaatgacgtgtgggtaaagtgtaccccctctgcagaggttattaaactgttcgaacagccgtgcccacggtcatgggcggatgtaaggtgattcctagcatagttttgtttgactactgcttgtgaaatttgctgatgtggtttgggattgatgtttggaaaatctgcggctgatgggatcagccaggcccgggtggccgtttaaaaaccgttggccgggtgccaaccttgatcaattcaaaagactgataccttgcacatactccgaccggacgagacgcactgtctcatccgtgtcgtttgagaagcactcacttagttgtttcagaaaagagtttaaataaaatcaattgcaaaaacaacagcctttccttgaagcctgcattaaacacttattccccatggcttgctgagtactcccgtactcacccttgctctatataaataatcccccccccccagttgctgaagaaaatgaagcggatcccgctgacgaggagttcttccaggagcaagccggctacgatgagttttagggtttcggcctagttcccaagtcgcgcctgtgatgtgtggtccaagtcttggcttccgcttcccttttgtaatgcagttgtgagctcaggatctgtccgcagcccaacataactgtactcctactctataataaagagatctctgttgctgtgatattctgtcttcctgtgataccagcactgtttcctgggactggtatcaattaataggttaatttggagcgtcacgggctagttccgctcgggactagttcgggacgtgacactcatccctacacgacaacctcgatggcagcggccttcttcgcggaaattgttctactacacggtgttctagcttctattgtcagtgatcgagatccggtcttcaccagcactttctggcgggagttgttcagattgacgggagtacaactgaacttgtcgtcggcatttcatcctcagtctgacggccaatccaaggtgacgaacaagatcattgcgatgtatctccgttgtcttaccggcgatcggccacggcactggctacggtggctcccatgggcggagtactgctacaacacgtcctaccagtcatctcttcgcacgtcgccgttccgcgtggtttatggccgtgagccacctacgctgcacgcctatgaaccgggatccactcgtctaccggcagtccaacaggcgatgcaagatcgagatgaatttttgcgtgcgattcgtgatcgcctggagcaagcgcagcagacacacaagtcggcgtatgatggcaagcatcgggcactggaattcagtgtgggcgactgggtgtggcttcgtttgctccatcgcccgatggcttcgctcggggtcgccggccgtggtaagttgggtcctaaattttacgggccgtatagggttgccgagcggattggttctatggcatatcgtcttcagcttcctccgggtgctcgcttgcatgatgtgtttcacgtggggttgttgaagccatttcgtggaaccccgcctgattctgttccgccattaccgcccattcaacacggccaagtgtgtttgcagcatgccgcagttacgcagagtcgattggctcgtggagttcgtgaagttcttgttcagtggaaggataagcctgctgccgaagcttcatggatgcctttggatgaatttcggactcttcatccggattttcagctcgaggacaagctgcttttccagggggggagagatgtcatgtggggattgcaatacaaacgtcgcagcaacaggcgggcgacggcaaggcatgacgaggaatagtttttacttctgttttgattcggttcggagtttgttagatagtttgttagtttcttattccgtaagctgttaggagtctatcctttagaattgctatataatctgtaagacagtttggttttggaagcaatcaattatgtgagattaatctgtagacctattcctgcctcgccggtgcggtgccgaacacggctcctccgcgccgacgaggtccaggaccacgtcctgttacagccttcaaatactccctccgtcgtaatcctcgttccaatctcctcgcccgtgacactgttacttgtgagattgggtcatgaaatcaagattggattgggtctgttacttgtgagattgggtccttaactcaagattggattgggtctgtcacctgtgagattgggtcatgaactaaagattggattgggtctgtcacttgtgagattgggtatggcctgaatcagcaaaaagctataacaaactagtatcatgcattgtttcgtttggctgttgtcttgcctacagtttatctgctgtgagaatgttttttttttcttccagcaacaacaactgtaacatgaactagcactttttgcctgcactgaacttaaaattcatagaatgcagtcaagtcctgccaggtttttggacgccgacaattctgatgatcacagatcagctaatggttgaattcctgttgctagtgcaaacaaccaaattgcgtacaaagctttgactaatgctgtaatttagcagatggtttgggacttgggagcagtccctgctcaaggacgaggttcagagttgagaccaataatctctgttccttggagagagtgaattttaaacatggaccatggatatagcagaccatggatgtatttcttttgtgtcagtgtctgtccacctccatgaagcgcatttgcttattcaatgctcagaaaaatatgacatctctcctctatccttgattgcaaactctgctgcacttatgtactgcaaaatttgaaactattgcaaataacattcaaagtagaagtaaagttgtaataagagtttcgttcaaaaaaataagttgtaagaggaggtatttcaaagaagaatgcagtcgattgccaccacctgttcgtcgattgccctttcacaaatgcagtctggcaaatccttaagagatggatgaatgtgaactttgctactcccggtgagaaggcattgcaccttgctgactggtggctgcaggagagactatgttgtcggacgcgctacagggaaaattttgacagtttcttctttttgacctgctggtttctttggaaggagaggaatgctagaatatttgatcagcgatacaagccagcggtgtagctgaagacatcaaagaagagttcctctgcttgaaggaagcggggatcatcgctggaatcagcgagtagtcggcttactccttcgatatagagctgccctttctctggcctgctctgctctgttctgtctcctccctcctgggggataagcccttggcttgttcctgctcagctgtcttggccgatgtaaaacaaatcatgtatttgctcttttcttctgatgtgtatgccctctgatggcctctgtaattattgaccaagtgtatggagagctgagatcattagttattgattggttgaattgaacgtgcttaggttgcactaactgtaatcgtttacttatggcaataaattgtttacttgatccatttacttgtgctaaaagtgtactctgcatgagtggattagtttactttggttctcttcttcttggactgtacacgtcaagttactgtcagtctgtgacaaacttcttgctgaatgtcaggtgtatgttaaacatgcgttttagttgagattactattgattggttgaattgcatgtaatctgtactaatggcaataaattagttatttgcttcatttatttgtgccaaacgtgtagtctgcataagttggattgagttcagactcttaagtctgaatttcagacatgttcagaattgagttggttgaaatttcagagaagttcagaattgagttggttcaatttcaaagaagttcaataacttagttacttgatctattgtttatgccaaagtaataataccatggaagaaaaccatgcactgaaaacattgatctgcgaggtgttctgtgtcaggtggaatgactgaccaaaattctatggtatgtgggaagcgtgatccatcctattacaacgtgtcgccaaagatgcaatctcctggtcctcatcttaatagtttgtatgattgtcaattttttcattgtcgacgtaaataatatccaaccttttgcgaatcttattaactatagagcggatttcagccttaagctcaaggagagcacaaccgaggactactggatgttgaaataagggtacagtgcactagtcattgagttctaataagtttttgatctattaaacattcccttaaaaacggcatatattgatgactcgagagagcaactaaattaaagagactttttacaatgcttgggaggtatgttaggtaccatttgttatctccatagccaagtgcgcttgtacacctcatattataacaagattggatattgggatggtgctctatatgtgttttggggtcaaccagttgccgctattgtctacaaggctagatcactctactgttgatttgctacttagcacagcaaacttgctccccgacgtttaactgggcatcagcttcagacagagacgcagttgcttctctttgtctgaatgaatagtactagtgtttccgactgacattttttacattggtgaaatgtttgatccattgcgctggaaaatgacttatattcgctaaaaagaaccagtgaaatagaacaaattatctcaaatctgaactttctgaaaattcagacttgagatctgaactcaatccaactcatctcggcgtcgacctatataacacccccacgcaacgcgcagccgcgcagcgccccaacaacattccacactcttccttccttccttccttgtcagcgtcgctgcgccgcggcccgcggccgcgccgcgccgctcgtggtggaatccgctccactccccaatggcgcccgcggcggcgaaggcgtcggatctgtaccgtgaggagaccgaccgcgacgacgacgacgacgacgtcggcctcgccgtcatcctccccgacgcctgggagctccccaggcgccgcgtcctgcgcaacgtcttccgccgcctcccgcgcaacccggacttcgacggcgccaccttcctctccaagccatggctcgcgctcgccgtggacgggcacaacgtcgtcgccgagccgcagcggctcatgccggggctgctgcttccggaggagatggcgctcgacccggcctcccgcgccttcctcagcctcgccgacgggcgcttccacgacatcgccttcccccacgcccgcggcgcgcgctgcgtcgggagctcccgcggatggctcgtgatgctccgggagggccccgagggagtcgtcggcgccgcggccaccgcaactgtacatgtcatccacccgctgcttccgcacctcgagttccgcctccccgacgagttctccctcttcgagatccatgccgccgcggacttggaggagcacgtcgtgcggttgccactatcgaaggaggcgcgcctccgtgccggcctccccctggctgagaggctgcagcgcgtgtacaagcccgacgagaagaactacccctacatcaccatggtcgcgctctcgtgcagccccgccggctccgacgacgacgactgcgtcgcgctctgcgtctacctctgcggccgctgcctcgccatcgcgcgccccgggaacgcgtcgtgggcgcgcgtcaaggtgggctgggagtacatggagccgacagagtacaaccgcaagttcgtgagcgtggtccacctcaacggcagcttctacgcggcgtgctacgacggcacggtgctgcgcgtcaccatcccgccggcgggcagcagcagcagcagcgcgtcgacccctcctcgggtggagaagttcgcggacaggccttacagatcgaagtggtccatgtggagatcgcggtggtggctcgccgacgacggcgcaggctctctggtgttcatcgggactgagcgctgcctgaatccctcggacgacgaaaggtacctctccgtgttccggtgggacgccgagctgcggttctggcgccggcccaagagcttcggcggccgcgcgctgttcctcagcgccggcacggcgttcttcgccgacgcgaggatcctgccgtggtgcgccggcgactgcatctacttcaccgacgacgagagcgtggtcaccggggagaacgtcaccgtgagatgctacgacatgcgcagccggaagctctacttcgtggaagacgctggggccaaggtggcgctggccccacctgtctgggtcatgccgttccatgaatagtactgtacagagacattcatccaatgatccaagcaggtaaatcattgatgtgtaggactttgattagcatttgttgctaggtgatttcttcatgtgaattctatctgtgagtaaatttcatgcgaattacttcatgcaagtttccatggctaccgaggaatcttggattgacaaacttgttttgtagtcctaagcactttaggcaatatatatattgaatgctaccttttcggattgttttgtgaaaattgctggctctagctttacttcccgtgctagtgtttctgaagattttttaatattttgttttgttgcaaaaatgtatagtggtttatttgatgggttctacatttgtgatgccatttcttggcttgattcgaagtatagtctacttcgaaatcaatatttgtaacagctgagagagctacgacatatgtagccaatctattgcattgcatgctaacttttctgtttatcctttgaaaattgttagctgtctagttttacttccggtgctagtggttgttgatttttgcagtagtttgttgtgtggcaaaacggtatagtgttttgtttgattttagctacaatgttgatgttcatttcttgacttgattctagtagttggttaactgtcaaaacttcagttgccattgatgccaaatgcggtgttcatctgtatcgctagcgcttgatgctccgggggccatgggtgctgggaaagggagggccattcatgtgagggtaatatttctaggttttcagattaatcacgttattatgctagctgcaatattggtccaattttacataggctagttctctttcatgttctcgaataaagatgtaatcatgtaattatcaagagtttgatcacccaaatgtattaagccgattcgtgaaaatattttttgttgattttaaaggggattacatgtatgctgtcatggatatagaatacttgcagaattaggaatatagtgtacttgctatctcgtaccatagcaggatgctgaagctttggcaaaatttacttcaactctctgtgctggattgctggtactagtgttgaatttacttgcaatattatatgctgtgttcgaaacatacgtagtctgttcaaaccgtataatgttgtgttgattcgcatttcagatatcactaaactgtaatactctcaatttgactgtttgatcattactccgtagttgtcatcgatgccaaacgcacaggaggctgaattatcgttccaaacggaccaactctatcgaaaatccgtatgcacgtccttgcatatgcagaggcaacattttgcaaatcagatttgccttaatcaataggttacacaagagctgagtttctaatgaaattcttccgaacttggtcgtaacacatgtggcgcggctatgtacgcagcggcagcacagggctcagacgcaacaaaaatgtaaaaaggacacggcgttggtgctaatccattctggtaggagtaccagattaatgaaaattccaaaccaggattttaagaattaagaatcaacaatacgatcacgacaacgttaacaagattctcacataaacttggcaaaacagatcattgtgcacagtgctgcttagctaaacagaacaaaatgccttaggtatataacttgctcaaaaaacaagtgatactggaaggacaagccatgggcgcttaacactgaattctgattctggatggctagaagctgcatgactcatttgagagggatgaaccgagaggagtgggtggcaccaataccgggcctaccgtgcttaaccggcttgtaggagatggagaactccgcaaggtagtgaccaatcatctcaggcttaatctcaacctggttgaaggtcttgccattgtagacaccgacgatgcttccgatcatctcagggacaatgatcatgttgcggaggtgggtcctcactggctctggcttctcgccagcaggggcatcctttttctgttcaagggcatttcaaaagaaaaatattgaggaaaatacaaattataacttttagttgtttgcaaggtaatgaaatcccactaactacaaatcaatactgaatcctacaatagagaagcttttagcaaacaagaaaaaaaaatagtacagacagttgatccattcctcagtaccagtgtatttcattccaaaacagcaataagtaacaaattaaaaggacaagctaatccacacatgtagcatcgcagattaaggaatgcaaaacatcaaatgcagcaaataaaatgcatttgacattagacattctactgtgattactgctggttcagattactttacacaacacacgttttggtagttagaaatattgaagtaatcagacaatctctacttagaacatattttgagaaaatgttgcaaggatagtaacatcttttgagaaaatgttgcgatggtagttttcaaagtgtgtacagatcggtcaaaaataagatctgcaaattaagtagttaaatacaccacatcacaacatgttaaacaagaaacatatcgatttcatttaacttcattacatgaaaggcattgacctattaaatgacatggaattgcatctgcccatcaacacaagtgacatgtcaacaacaaacacagcagtcaaaattcccatcattcaattccccaaaattagcaccttacactaaatttctatcatggcaaaaaaaaaaactaaatttccacaacatcctacaacactgaattccacagatccaacaccatgacagttttatcagggaccagaagtaactactaaaaggactacgcttagtattatctgttctaaattaacatagagaatcatttctaaaacaagaacacgccaatcatccaaaatactaagcatatagcacaaattaccgactctgcaaccgtggaatcatagcagatatacgcaaacttctttcacggctatctcattagtcagaactcagaacaacacatttcaagaaaagtgagatcaagattaataattccagactcaccgccttgcgcagcttcttgatgagcgccatgggcttcctcttcagacccctctggaacctgcaagatcacagaaccaacggatcacaccagatcacacccgcaaaaaaaaagagcattcccgtaagggcaaatcaaatcactggcacgatttcatcacagatgcgagatgtgtgggcagcaacacaacaccttctgcgggcgcgcgcggggaagagctggacgaggtcatcggtggacatgtcgaggagcgcgtcgaggtcgacgccgcggtagctgtacttgcggaacgtcctcttctttggctgtgcgccggcggcgacctccgtctcgacttcgacgtccgcctgcggaaaaacgacgcggtcaccgacggagacatgcacgggggatcaccaacggaggaaagttcgagagcgaggaactcaccatgatgggctcggagcgcgcgggaggagctcggcggcggcggcggaggcggaggcggaggcggaggctggcgggtagggtttagaggggagagggcgagtgaggtgggtaggttatatagtgcgcgtggttgcgaaggccattctcgttgtactgatgggttgggctgaatgatagttgggctgtgtggagtttcggctgggactaatttgccctaggaataagttcatctgaggtatgtcaacgaatccgattatctataatctatgttacctggatacagcacaaaagtggcgtatcagtatcggatacgtgtatggatatggatacatattggatacacttcgatacgtatcccagattttcgcgattttcagttaaataaaaaaaagatacctcgccgatacgtcccaagcgttcctgaaagggttaattggatacgtgccattaaaaatttgccagtttagaaatatgccattactatttaagtatttgtaaccatacactgctgcttgtttgtaattttagtgatgccactaagctacatattttgcatgtattggacggaaataccctcatcttctacctctctctttccccatcctctcctctctcgctcatgacctctcagacccaaatccgcggtcatggcggacctccgatttccccggcgacgcttacaacctcattctccgcaactgcaaccacttctgcgacgtcgtgcgccaccgccttgtcggcgcccacctcctgcgctgggtcaacctcgccgccaagatcggggtcgtcttcacctgcgtcatcctaggcaacggcgaggcagtgcgatgtaagcggaaacccccaccgccggaggcgggaaggccagcatccacagccgctccgtgcggtggtgcgccagcccgcggacgccgctgcgacgctgaagcatctaggcccccgttgttaattttggtaattaatgacaagcgctaattgtggactaaccgttgctattaagatatattttaagttaggtccacgtcatgtgtgcgcatggatgattatcgacggattaaaatttgatggcgcgaagcgaagaaaagaaaacggtaaaactagtgctttagttttaaaattgatcgaggtgaagggcgatcaaatttgctagtttatttttagttttgccgtactatcaagggggtaatgacctagcaaatgagatgattttaattgccacattatgtcattatgcatttagacttgtgctcacttttcaccacacacacttatcacacacagtttcactgtgttcggcctgaccaggggcggtcagaccggccacatagtggcggtctgaccggcgtgccttggccagtctgaccggccacaagacggtggtctgaccggtgcataaggccggtttgaccggcggcacatgcgcagtcagaccggccctctggtggccgggatggtgttgctcggggtggccgatacaaagccgacggagccgtattcggtcagaccgagctgatggctcggtcagaccgccattagctcggtctgaccggccggggcagtggggcccaatgacagccctacaacggctagaaaactagccgttgttgagtagcacggtctgaccggccacatacctccggtcagaccggcagagcacagagttgggggatttcgccctcaacggctagttttggttggtgggagtataaatactccccctccagcagcaaggggactctcttggcacccatttcaattgcatacaccccttgcacctctctcacacccacttgagctttgtgttcatccatctagtgtgttagagggtcaattagccaagagtcaagtgcattgctt

SEQ ID NO: 68466 - DNA, 2083 bp, Oryza sativa
  unsure (1)..(2083): unsure at all n locations
cgcgcactaggatcgactcgctataaggcgactncgagctcggtacccaaaattactaacataaaactaaaaatgtgaatattttgcaatggttcaacaagtacaacagatctcaaggtcttacattgtaaggatatgatctccagcttcaattactgaaatattcgcatacttcttcacatcaggatacaactttgccaagtcctcattgacaaagtcatgaagctctgcagcaaattctacacctgttgggccaccaccaataacaacaaaatgaagattcttcttcctctcttcctcagttaggtttggaagggacgctctttcgaaacatttcaggacactcttcctaattttttgagcatcttctacttcctgacagaatgcacatgacgattcaattcaccatgcaaaatatgttgcaaaattgaacaacataatggatataacatactaaagaaaaagaagttatgacgaaagatggaacaaggatattctttgtttgacaaagaacaagtatatgtaaagatgtaaaagcaagtttgctgaaggtaattcagacattgaccaagagataagctgaaagagtcgtaactgataagatgataaaataaaaccgagttttggtacaacagttaatttctttcattaacctactgccttattagtactgacctttagaaaatggcagttttcaacaacaccaggggtattgaatgtattaggtctagctccaacactgacgaccaggtaatcataatctacaacaaattcactatttccatctgagtctgatctgcagtggatctttttggtagttggatcaatcttgtagcactctgcttcccaaaatctaaatgcgccgcctctctggaaataatgtacatgtaatatttgtgagaattcttgcattacaaaatgatgcaatatatcaataatatagctaattgattattaattcagtaaggtcttacctttctcacaatattacggataggctctacaatactacgtgcttcaactgtgccacatgtcacactaggcaacaaaggtgtgaaggtaaaatagttgcgaggtgatacgacatgaacatcgtacaaggaagtgtcaatatttctcaagaaacttgcgcctgcccaaccagttccaacgataaccaccctcttcttgccagttccatcatttatttgaagtacttgattatcctggcaagcataagtcaaagaaccaacactgcaaagatatttgaataaaaggtgtgtgagaggagagactcagagtcctgaaatatatacaatataaaatattatgaaaactaatattaagagtgcatttgccatctcagtgagttttaagttgcatttactagtttttgatttgccaatgaataccaactaatgaacttatcagagccataacagaacatgtaaataaaaatttcttccagctataatgaatagcacacctctgctgctagtcttcttcactttcaaaacagaaagaaccacaagagaagtattcactaaaattgcttgagacgcttacaagattttgctacatggcccaaaaacagaaatctggcaatacaaatgttatttcacttttgtgatcaaacaatatcatgaacagtatctgctgtgcacaattccaatatgatcccgggttacaataagaaatatgaaggacaaaccatcaccatgaatctatctgggacaaacatgtctagcatcatggattaatagctatagcacattctcttaagcaaaagggtgagaatacaatctgcttaaatgcccactcctctgtcccacaaaaccccaatttatttgaagaggtcccaggccaccgtccgggtttaaatccatttcagaatgggcctttttattggccgaattaattataattaataatttatgccgttaaataaccaaggaggccaggttttggacttttgggggacaaaacaatcctccgtttccttagaatgggaaggcgcggattcaattataccaatgtcatggaccaggatataccaacccgattaagccattggcccaggtgggacccatggttccacgcccct

SEQ ID NO: 68467 - DNA, 581 bp, Oryza sativa
caatgaaatgtgctcacgctagctttctgtttgaaagatttattaggcgcgttaatcgtatgatcttctgcagatgattgtacactacacatgtttatatgcaagtggctggttggtctgatgcaaatcatgtattcgagttttaagattttgttcaagtttacaaattatggtgtaggttattgaattccattgcagcatgctggcatttagttcaaaagaatatatggagaattggagatcacattgtgcccctgaacccgtccgttttataaaaaaatgtaaaaatggtgttacaacacttccagcaaaatctgcacatatgttttgtccaagaaaacacagtcatgcatttatactgcaagcatgctatttacattattattgttcatgaaaccttacagatgtttctttctgagagtttacaaacgtagttctgacttgcaggtaaccgactcccttaaccactgaaaaccttcgaagggttattcgctcggagcagtcggagctatagatgcatgagggtttatcatgattatcatagtgaaatctatcaagtctaattttgagttctgatggtg

SEQ ID NO: 68468 - DNA, 874 bp, Oryza sativa
tgaaaacgccgatttttgttggcggatatttaagagatccgtctaaaaaaagagtatttttttatggcggacctaaatacaaacctttttcttttttaataatttcatggcatgactctattttttctttttaatgtcatgaccctaaatagataagatccagagcagctgcattttttttcaatccaaattcaaaatcaatttaaatcggcatcagatccatactcaaatccacatacagattcatcacattttcaacaagcaaactgcaaaatatgcagatgaaattgccaacaccgccgggagctgctgccaaaaatgctggccatgcgtcgagccgccggcggcagctggatctgcagcccgtgcccggagccaccgccgcgccacccactacctgatccaccgcctcccgcgcctcgagccgcaagcatgtggatggatacgctgcccaggagcatctccgccgccggatttgtcgcccgcacgccgccaggaaatattttacagaccatgggcctgctgagcagccattgctgtggctgtggatgcacaccgcggccacagctagtagcttaggtacagccgcaacaatggctgccaagcagggcgtgtattatttgcatgtatttatatgtaggattgatgatcccttgcatgtatacactttttttaggttcgagggtaattatttttgcatttttgagcttacatatagtggaaaatttgttatgcatcagaattcggccataacatacgaagctggcaaacactatactatgctatattatcttcgaggtggagttggtatttgtaatcgtgtgatatgcatccttaccgatcctaacatatcatatatgctgatacatagaca

SEQ ID NO: 68469 - DNA, 788 bp, Oryza sativa
  unsure (1)..(788): unsure at all n locations
gtagtttagtactagtagtacatgtaattttctttatgtgtcttttcagatgtgaaaagataggagtaggattagaccctgtttagatgggattaaaacttttaagtccctatcacatcggatatttggacactaattataaatattaaacgtagactattaataaaacccatatataatcttggactaatttgtgagacgaatctattgagcctaattaatccatgattagactatgtgatgctacagtaaacattctctaattatggattaattaggcttaaaaaatttgtctcgcaaattagctttcatttatgtaattagttttataagtagcctatatttaatactctaaattaatgtttaaatacagagactaaagttaagtccctggatccaaacaccaccttactaatggctgttgtactcatcctcttgggagaagtgtcacaccctaaaaatcttaaatatataaattgttgtttaattggaatttttagaaattattttaaaagcctacaagctaaaccctaattttctaggaaaattttcaacataaaaatgagctagataaaattctattaaatactatgcttgctcctctattttctagatttttctgggaattatttgagcaagggaagtatttttaataattgaaacatcaattcacaaattgtttttgtttaaaaagttcaaaaatccccctcttaggccgttgggccgatttcggcccaactctttctttcctctctcttcccgcgcgcggnccatgccggnccaagccg

SEQ ID NO: 68470 - DNA, 2164 bp, Oryza sativa
ttttggtcccatgttaaaattcttccttggatgtcaaaaatctgcaaaacaagccacgtgcatcatccaatttgagtttgatttgggccttagaccttgtaattatgtcatgggataagtccaaggactggacaccctaggacatccctaatcatacttattcaatagccatcaaagtttagagtggtttttctatcgtcatgcagtttcaacgctagtcagtttgtagaattctaacttcaagttcttaatcattcatctacaattgagttacaatcgactttgttcttgcttgtgtttttcgattcgcatatagagattatccttctcggcgaagtcaatcaggttttaaactattgataaccaaaggagatatagaattatgattggagggtttgaaatcatgttgattggaagctggatcttgtatgtcaagtttccgcaaaaatcgataattatcttcacttgatggaagatcgaacactcccttgtcatcaatcgatcaagatttttgtcatcatcgaaactttcgatgttacataaggcagacgctaggatgtaatttatttgttgcttatgttgcaatagatttccttatatatatgtagatcataaaagggaaaaaaacaatttttactctattaagccttgtttgaccgtggtattgcatatgaggatgatgacatggaaaaatttcccattcccccttttcccccttcttttctcttcatcccccaccgttggatgcgccagtggcagcgtcatgcaagtagcagagatagggaggtagcaaaagaacggtgttggccatcagagaaagaggcacccgtagcggggttggcccgacggcagagcagatgctcaagctaaagccgaccatggtgatcccgagctcccggtcgtctcctttctctccacctcgagctccacttgacggtgaccaagagcttttcctcctcctccacctcctcatcgtgcgcactcttagtggacgccaccacctccgctccttcgcctcttcgttgttttcacatgcgtccctggttggtcgtcgccgcctcctcttatctgtctcgtctgccgcccttcgttgttgtcacgggtgcccctggtcattgtagtcacctcctcttgtttgtctcttcatctcatccgctacctcctctcctcctcttcacatgtgcccccgggtatgcgccaccttctcctcttctccatctcttcctcaccgttgcgtgcactggatctgtgcctcctccttcgacttttcgctgaatatgcgctcctcctcattaccagccggccggagcaaggacacactgccccaagggcggagtggccgatgacccgacgtggatatccgacggcgataaggttgtttgcggccatgggagggcggaggaggcatcggtggctgtagagaaaccctccctcacccctaactttccagaagcagtagcaggcgatgacaacggcggtgagggagaggaggtggtggcagcatcgaagcagcaacagcaggcagcgatgactacagcaacaacggagaagaggctgcaactggaacatcgaagcagcaacagccgacggttggatggtgagagaggaggaaaagggaagaaaggaaagagggagaggagattggttaggaagaggagctcccaaaaaataaataataaaatgagggaaaggggaaattttggcataggggatcctctagagtcgcatgacaggcatgcaagatcatggtcaaataaggctttggacccggatgatataataaacggggtttagggatttcaatacgtgctttgcaagttcatgaatctaggtaaaatttatttacatgttaaaaaaaaaaaccgctggtgcaatttactcatcaatacttaaaaggtgatgttatttctatcccttctctcataaggcacatatttgaaacggactttggaagccaccgatgataaatggaatatgtactacagatctttttctatttgtttccaatatgatatatttttttttattctaaaccttccatataatattttgatattttgtgaaagataaaatttgctacagattttttgatattttttccgaaagattacggcctttgctgtgagacacccgaagatagagaatttgctcgtggacacttaaa

SEQ ID NO: 68471 - DNA, 1691 bp, Oryza sativa
cgttgggagattgctacgtattggttcgagaccaaccgagcgagtagaatcatctctcgaacaccaaatggaagtcgccggaagatttgctacgtactggttcgagacccagcgagcaaagtagaatcatctctcgaacaccaatgaaagtttgcggtgcgagagattgctacgcactggttcgaggaccagcggacaagtagaatcatcttttggacaccaatagaggttgcggtttgagagattgctacgtactggttcgagaaccagcgaacgtgtagaatcatctctcgaacaccaatgaaggttgcggtgcgggagattgctacgtactggttcgagaaccagcgagcgagtagaatcatctctcgaacaccaatggaagcactagagttggtttattacatgtgtatctcatgtggccagcatgactcacacacccaacttgtagcatatccggatgtccgttcgcaatcatgtcgggtgatcaagccgacaacgttcacgaggaattatccgttaacaacatttttctcaaatagtccagccacggccggcgctatgagataggtcgtcggtctttgttggtaggttgggcgcgacgactctgcatttgtcgagattgttctcaataatgcggtgtacttgatcacaacctacttgagtgctcaattattcctgaaaaatattttctagaagacaagatatatagcagataatatcaagtgtgtactcaaaaaactacatggattttctagcattatcaggatataacgagcatatataaatatcaggcattatgtaaaccgtaaacaagcatgatttatatggaagaaaatagagtgaaccctgtcacgtcccaaaacgactctaaaatatatccctaaaattatgcctagaataattaaaatctgtgtgcaagccttcaacaattaaaatgtgcaaagttaaaagtcaaataaggcttggaggatttttgtatatttcctaaaagcctaaaatgcataaataaattttagtggaattttcagagcacaaataataattgttaagaaataaacaaagttaaaatgattttataaaaagaaaaactctagaaagtcccctatccctccctctccctcttgggccggctcggcccatctctctccccctcttttctctcccccgcgggccattcggcctttccccgcgcgcgccgctgaccggcgggaccgcccgccaccctcgctgaccggaggggcccaaccgtcataacctttctttcgacgctcccgacgtctaacccgagccctatctacgtccccagcgctaatcacgtcgaccccggtcatcacgcatgcaatcaagaccggggaaccatatctcgggattcccccccccctctcccccatcaaaacactctttctgtccctcggatggagttggcaacccctagcactatcttcgcggaaccaataatggccaccgagatttaccgaccccatttgcaccaattgtaaagatgctctgacacaccaacccatgtaaaagctagccgtgaaacgcacagcgtgtccgccacaaaccgactctttacacgcagagtgaactaaggccaaggtccctggataacccgaggcgaagaaattcggtctgcaacgacatggccaggaccacttctcctagagaaggctcttgggataccaaaa

SEQ ID NO: 68472 - DNA, 745 bp, Oryza sativa
agagatcaattgcagtgggctcactgtctttgtatttttcttgcttctgcaatgttgagagatggcatgagtaatggttatgttaaagtacatagataacacaaaaacatgtcctccagaacaagcattccagttgacattgagtctttttgttaaacattgacagtggttgccatgtataaacttaattgatgtcaccccaaataagtataagcatgacaagagcaatcaaaccaaattgatacagatttatggataaaacatgagcatatttttacgtggtcaaagtgtgagataatatgctactctccctactaaagctttaaatcatatagcattatgcagagccactatcaatatgcagatatatatctccactggatctgaacacctccatcaggaaacacaaaaactacatccaactagatgacatcatcattttttttcttaccacgacataggcatgtgcaatgtaagaccgagatccggtacgctgttgaaactgaactttttcacgattcagttggttttggcacatttgtcctgcacatgacacaattacatagcattagtaatagaaccactatgcatctgtcatttccatgcaacatcattttcatttgttttcgcaagtcactattacattaaaaatgcaaatagagctgatccaaacagagctataaactggactatggaataattattttgccacctgactatcaaatttatgttgatgtatcttagg

SEQ ID NO: 68473 - DNA, 672 bp, Oryza sativa
ggcccacatatcagtgagcagtactgtacatgcagtactgcaggggatctcaattgcatggttttgggtagagtgtgagtgacaaagttgctcgacttcaataggaggcggtggcatcctcatcacggctactcttgtaggtggaggcgtcggaagacggagcagcggtggacaatggtgcctccagtgcaggggtggaaccagacaggactaacagaaaggactgaacaaagtatataaaactatagctccttcttctaataaatatatgatagaaaattttagtgaaaacttaatggggcttccatggttataacgctgatagcaaaggctcgcgtccccgtcgtccccatggcagatccgccactgcctccatgttaattagaccgcagcagagactcctgcattgttgagatggagcaacagggtggagggaagggcaaggacatggttggccttgatgatggagcttgatctattatccgccgcttggatcatgtaacttcaaatgaggtactactgatatatatatatatatatatatatatatatatatatatatatatatatatatatatatatataagcaatctcaggttgtcttgataaaaatgttctgccgggctgaataattggctatatttgagcttacccaaaaaaaattatccttta

SEQ ID NO: 68474 - DNA, 531 bp, Oryza sativa
gctcggtccccctaaagatcaaagcaagattcatcaactgaacggagaaagatcgtcggcgaggagagctggtgaagggagaggatacggacgggcattaatccgtcgaactgcgtggcctggaccatcttgccgagccggagctggtccttcccgatgggggacctgcacgacttgcacgaggaccgcccggacttggcgtactccgccttccaggccttgggcggcgccgccattccgccggccggtgcggctggtgcccttttcctcccttcccctccgccgcttcttggcttgtcctagggcctagaaagaacccacacaacgagaaaggagaaagggaagggaaaggcctgatgatgatgaggtgtaaaaacgttaaaaaggaaaaaaaaaatctcccctcgaaaatttggggcgagttgagttaatttgatggtttttcttttaaaaccctgtgccatatcctccccgaatgtgtattctcatatgccatttttctggggatcctctagagtcgactgcaggcat

SEQ ID NO: 68475 - DNA, 571 bp, Oryza sativa
atcaataaaccgaatggatacaccttgggcgtcaaactcttttattaactggatcatgtcagcagtatcgcgcccaaggcggtcaagtttcttcaccaagatgacgtcaccttcctccaccttcatcctcagcaagtccagccctttccgatcgcttgaactggccgatgccttgtcagtaaagatgcgatttgctttcacgcctgcgtctttgagtgcccgaacctgaatatcgagagattgctggctggttgatacccgtgcgtaaccaaaaagtcgcataaaaatgtatcctaaatcaaatatcggacaagcagtgtctgttataacaaaaaatcgatttaatagacacattaacagcactgtttttatgtgtgcgataatttataatatttcggacggttgcaaaattgttaatgaataactgtcaggtagggagcctgatatgcctgtcgactttctaacctctgaccaaaaacagaattacggttgttatgctgcagaacctaatgacgtgcaactggcgcgctattttcatcttgatgaacgggatctggccttcattaaccaa

SEQ ID NO: 68476 - DNA, 11113 bp, Oryza sativa
attttggttgaaattagagatgatgtgactgaaaagttgtgtgtgtatgataggttgatgtgatggaaaaggaccgaagtttggatccaaactttggatctaaacacagccgtataatcatatagactcacaaagtcaacaaatacagccactggaagttccaccaacagctgcaattacccgtcaacaaacctttaaaaaagattatcaccagtcactccactaccaccacagagcttcaccatgtcaacttcacgagttgatttcaacatcaccaaaagaaaaaaaaacaagtcggaataaaatcagttgtggaaaatcaagggcatgcgggagccaaaaatgataaggaatacctttcgaagaaatagaacatggcaaaagtttcattggcactgctcagagcctcagacatcatgacaagcacagcatcaattcacaccgataaaacaagtgaccatttctaaagcacagccttctcattcacctccatctcatctccattacactgcatggacttcaccaaccttcttatcacggtgctcctcctactcgctcctctgaaatacaaatctgatgttgccacagcaagtgatgatgaagacttcttcaagacttgttcatcacatcggtgcagcaagcatggaccagagatcaggtacccgttccggctttcgacacaacctccatcatgcggcgcacctgggatgcaattatcatgctctggacaagacaccatcctggatcaccctgttcttggttcctgcaaagtgacaatgatatattacaggcatgttatcatgaacgccatcccacttgtagattcctcacctcattgcctacttcacaagtttatatcagtaaatcaatcaactgctgtgtacagacctcacactttaaaagctgcaagtctagtaggttgttcaagagattccatagacacaaaccaatataatagtatagttggcccaacctcttgcctcagcctcgctaacaacgcaagccagttctggtatttggcatatccctatgaatatatgtctattcttccattgggctgcacaattgtttccaaagacatcccaatgccctacagttacgacaaaaatggtccaaactttgacatctcaatcttcaccgaaacagcaaaaagagtcatcagcactggtgagactgtattcacttggtactcaagtaacgttactagtatttgccaacaatgtgaacatgaaggtcggcgttgtggctttagctctcaaagggatcaagcattctgccagcatcatagtatgtctctttctcaagtataaattcagtttcactatgatgacttgttttagtttggaattctcacttctccatctattacatctcttatttctcgagtattcagttttcaaactacccaggatatttttcacaaatagtcaaactatccagcaaactgtgaatcagccaaaggctagcttggacgaacattttggttctaggttcacaactgcaatttttctcaaagaaaatttcatcaagagacgataatgtctgatcattatgaaaatcaatttttttttgtaaaattctcatagaaaaggttataagcaattgcagcacattttagcatatagcaatgatctaaagagcaagctttatttgtattactctagacattggtattaacttagaacattaaattagattcatatggttcaaatttactagtttggaatactgtaatagctaattgaacattaaagttagatgcaaatggcaccaatttactagtttggattactgtgggaggtactacggcgagagtagtatctcaattagaccttttgatgctagagatgcacttgatagtgcagtggcaaggggtgtatggttttaaccccgaggtcccgtgttcaatccctaacacgttcacaatttcttcttaaaaaagtttggagggacgtctctccctccaaatctccttttttttagaccttttggtgctaacaccatagtcctgattgttagaaagttgcacccatcgagtaatcaagaatgtaccagcataatttacagcattaacaagttcccacagttttaacagggtagaaaccagaacatatccatcttacacaacgttgatacgaaagttgtgcacatgcatatttccagcgatgctctgtaagattattgaattaggtagtttcttcctcctaggcactatagataaaaatgttttacttctatggttaagacaagaagcctccttatcctatttctatatgacaatgccaaataaacaagccatctaacaatcaggaattaattgtttctaggaaaaattataggtgtttctctcgatttatttcatccataaatcatgtcataactaataacctttcttcctatgtccaggtccgcgtgtcacaatcattgcaggtaagcaactaattttttttcttcattcttcctgaactgctcattctgtagaatcattgccttttctccaagtgcaactagctgaatttctctctttttttactcagtaacatcatctgtaggcacatttatagttctttcattaattgtggccactgcactctacatctccttgaagtcaaggtacaatgaagagatacatttgaaagtcgaaatgtttctgaagacatatggcacatcaaaacccacaaggtacacattctccgaagttaagaagatagcaaggcggttcaaggacaaattgggccatggtgcatttggaactgtatataaaggtgagctactgaatggagttcctgtggctgttaagatgctagaaaactctgtaggagagggacaagagttcatcaatgaagtcgcaaccattgggcgaattcaccatgcaaacattgtccgcctcctaggcttttgctctgaaggaacacggcaggctttaatatatgaattcatgcccaatgaatcattggagaaatatatattcccacatggttctaatatttcaagagaacttctagtaccagacaaaatgctagatattgcattaggcatcgcccgaggaatggagtacctgcaccaagggtgcaatcagcgcattctccattttgacatcaagcctcacaacatactgttggactacagcttcaatccaaagatttcagactttgggcttgccaagctatgtgcaagagatcaaagcattgtcacattgactgcagcaagaggcacaatgggctatattgcaccagaactatattctcggaattttggagcaatttcatataagtcggatgtctacagctttggcatgctggtgttagaaatggtgagtgggaggaggaacacagaaccaaccgttgagaaccaaaatgagttctactttcctgagtggatatatgagagagttatgaatgggcaggacctggtgcttaccatggagacaacacaaggcgagaaagaaatggtgagacagctagctattgtagcgttatggtgcattcagtggaacccaaaaaaccggccctcaatgacaaaggtggtaaacatgttgacggggaggttgcagaatctgcaggtgccccctaagccctttacatcgtctcaaaatcaacttgtgatttagatcatgagaccgcatcgccatggtttggactttggagaccagcaaagcaatggagcttggccagcatttcctataaaaaggcatcaccatggtttggtgcctgagtgagagatatgcttaatccacatatcagaaaatagttcttagtgagctgaagcatgcacatatagtgtttgattattaaactaaactgggcaaccagatatatgatatatcaccatgtactcttgtaatttgcaacatatctcaatggatttaatttgcaatataataatagttggaagatgacaactaaattaccttattccatcgttgatgctagtccactaatcatccttgctgaacaccaacaataaggtcatatttactcccagtgctgcattttcttttcaagataaaaaaagaagtgctgcatcatccagaagaggaaaaaaaataaaaataacaaaggaaggaagctaagcaaagggattattaccaaggcagcgaggctctggatggacatggactaataatgtgggagacggaggtggtgtgagcgacttgagaagacgaaacatgtggcatcaggcttggtggattcgaccggatctttgccggccgtcagcgccaccattgaagacacggtagcaacaacagatggcgccatggcggtacgggcgacggcgaggcttggtcacgcactctcgcatatgccgggaggaaacggcagcttacccatctgtctacggaggcgagaagcggcggcggaggcggctcgcggaacggcataccgccgcattaaccggagctctcgccgggaatagtggtgagggacggaggaagaagaaggggatttttttttttttgttggagagagggagaaggggatgattgctcggccacaggccggttaggatggcccacctaatcccccgcggcccatgaacggtggattgatctgacggttcacatgtagcccaattcacgagcaaatataatgcggaataagttcaccagaggtccctcaacttaacagcgtgatttttttgaggtcccttaaccacaaaaccagaaatgtctacccctaaacttactcaaaccgttcaccagaggtccctcggcggtatttttgcccggttttgctgacgtggcatcctagtcagcaaaaaaatttaaaaaaagtacgtagagcccacatgtcagctgcacatctttttttcttctcttttcttctccttctcttctcttttcttctctcccctctcttctccttcaggctggcggcggacgcagctgcgatggccgtgctcggccgccaccaccgccgtacccccgcgggtggccgacgatgctaggagaggcaccaccggcgggagaaggggaagaggcagaggaagagattgtttcttggtcgccggccgcctccccctccctcccaaactcgctggccgccgcgctcgctcgccgctgctctgccgcgcgctcgcgctccgctactctgtccgcggcctgctcgcgctccactgctcgacccgccgctgcgctcgcaccttccgctgctccgttgccacgctcgccctcgttgcgccgcccgcatccgtgctcgccgctccgccgccgcgctccgctgcctccgctcagccgccggacgaccgcaccgcgtagcctcgcccatggcgacgacgacggtagagagccgatgacgacggcggccacggcgcgcggctcctccgtccgcagcctgaaggagaagagaagagagagaaaagaaaagaaaagagaagaggagagaagaagaaaaaaagatgtgcagctgacatgtgggccccacgtgttttttaaaattttttttgctgactaagatgccacgtcagcaaaaccgggcaaaaatattgccaagggacctccggtgaacggtttgagtgagtttaggggtacacatttctggttttgtggttaagggacctcaaaaaatctcgctgttaagttgagggaactccggtgaacttattccaatataatgctccaacttatattcactggagccagcagccagtactccctccgtttcatattagagatttgcttcagtccagcaaaaaaaaccttgagataccggtgtctcgcagtactaaatcgtttttatcttagatatagttggcaggatgggcattgttacctcctttcacttttttccgaattttttttgaaaataatattattttaatggaaaatcgcaaaattataggtcggctagacgaaatcgcaagtttagcgccctgtcgaactggggcagttcgataggtacccctgtcgaactggggcagttcgacagggtactgtcgaactggggcagttcgacagggtactgtcgaactggggcagttcgacagggtactgtcgaactggggcatgctagttgtccaagaaaaaaaataaaaaagtacttgctacagtgcccgatagggacgtatcgaacagggggagttcgatagggcgcgtggcatggacgtatcgaacagcggaagttcgataggcagtgtcgctacagtgccgctacagtgtgcgctacagtgtgctacagtgtttttccttttttttaagttattttattacctgtcgaactggggcagttcgacaggtaccctttcgaactggggcagttcgacaggtaccctttcgaactggggcagttcgacaggtaccctttcgaactgcctccgttcgacagggtgctaaacttgcgatttcgtctaactgacctataattttgcgattttccattaaaataatattatttccaaaaaaaactccttttttcctagtcaagtttgactaagattataaaaacaattaggaacatctaaaataccaaactagtttcataaaatttaacattgaatatattttgataatatgtttgttttgtgttgaaaatagtactccctccgtcccaaaatataagcatttttagcatagtgtcaagtcaaacatttttaactttaactattaataggaaaaaataaaaaaaaagatctatcaagtaaaattgatgttactagatttattattaaacaaactatcgtaatatgcaactctttttatttaaaacattttacttttatagatattgttggtcaaaatagtatctcgaagaccgtgtcgaaatccaaaaatgcttatattttgggacggagggagtaatatatttttctataaacttggtcaaacttgattaagaaaaaaaaatcaaacgacttataatataaaacgaagggagtacaaaacacttgcttatttatagtagtatttcatacaaaaaaaataaatttatgcattagtatctatcaattgttggatccatgaatatggaataataacaaccattatttatgaacgctaattgctagctagatacatcattttcatcacagcctaactactggctaattcagctattccatcgtcctcttctgaaattgcagaaagatcggaggagtgaaagtaagaatccatgacttgtggaggtggcatgccatccccatcgcagaaaaatggtctcagaggcacttgcagcgcatccacacccccttcgagcatctctattgcctcactcatcgtcggccgatcgtgtgatttcatctgaatgcaccacagcccaacaaggcacaacttcctctctagctcatgcatgttggcaaagttggatatctcatcaacttgttgatctgctattagcttatcataaacccatgatgggtagtatgccttacttgcactggaatctgcatttggatctgcattccttcgtcctccgaccatctcaagcagcaacattccaaaactgtaaacatcagacttgccagatatgatgccaaagctccgggaaaccatctcaggagccatataacccactgttcctcgtaaagccctatctgacacaaagctcttgtcccttgggtacagtttagcgaggccgaaatcagcaacttttggaacaaagttatcatcaagaaggatgttgtgtggcttgatgtcaaagtgtagaatctgcatatcacacccttggtgcaggtagttgatccccctagcaatgcctagagcaatctcattgagcttgtcccatgagaatcttctctcagatgagaagatgtgtttgtctagagatcccctaggcatgtactcgtaaaccaaggcccttctcatttcctcggagcagaaccccaccaaacgcacaacattaacatggtgaatcctaccaatggtggcaacttcactgatgaattcttcgccgttgcaattagagtagccattcagtatcttgatagccacatggagatcacccgggagcagcacacccttgtatacagaaccgtagcctccttggcccaacttttctctgaaatgccctgtgattgcgataatgtcggtgtaggcataccttgtcggaccgagcatttgttgcattcggagaaatttctcgactgcatcaattgttatcattcttttcaagtacttttgtgcaaggaaaatcaatacaaccaagggtgccaacagatacctgcatggtgctgcgtacacaagttcgatcggttggaatcaagaaattgtaacatgcgtatataactagatgaaacactagaaacaattgagatgatgtgggtttataagaaaagatagaaataacattaactattaatgggataaattatatagggtagggacgtagggtcctggtcgatgacttacgtacgtgcaagcatcgtccagaacatcaaggcatacaatattatgcccaagagtatattgtatggcgatggaattttagcagttgcgcaatccatgaaattttcagtcaccgaaagactaaaccaatctgaaagtttgcctataccagtcgatttgctgcatgcaagaacaaagacggatagattcaggcatatataaatggaggggaggtcggaggaatgtgcaatcagatattatgtcaagatcaggaactcacggaatcgactccattaggcaatccttgaagcttcgatttctatggtgtctgaaaggaaattggacgcggaatcctttcctcatgaattttactacgtcttcataacttaagctatcaactgctggtgctacacgacccataccatccaaaggagtcatggctaggtaaccacaggaaggctcgaggttttcaatgtaacaggacaatctgccagtcaagacataaacgaaggagctgctggtgcccatgcaagcaacaggactgtacataacattgttgtttatttccttggaacagttgacaaagaaagaccaccaacgtgaagcagggtccaattcgacttggatgttgtatggcgatgattcttcgtcgtcactactaacatcatcatagtaataaggaatgcgtttccagcgaggaagagggcaattgttacgtgaatccgagatgttggcgtcgacaacccagaaggtggaatcactgtagtcgatgcctgtcacaaagtatgttccgttgtcgatctgaattgtagccttgtcatcggtgcaagtcagctcatacgatgcaacaccgcactcgtagcctcgccggtggaaaggagacgcgactttgctaagatggccgcaggtgaacggagggcatgcaggtattccatgaattaaaggccattctatatccggatctgggacgacaaatcgaagcacacacaggacagagaaaacttgcagggcagtcgagcgacggaagaacggaccaggaatcaccatggtgtggtgtagcagctagcttagctagttcgcccaagcagagcatgcaggagctaggtagtgacacggatgatattacaagtgtctatctccgcgcggtgcgtgcactgtatgtaagcagtgtaactagagttttccaagcaaataaatttagctaaaaagcaacacttcatgtccttgactgtgatgctgttgacttggaagtctttgatgacacgaagcagattagtctaaggcgtagcattcagttccacaagagtctaccgtgctgcatcggtcaccgtttattgatgttgccgaaaaagattggtcaaagtgcacacattaccagtcgcccgctatcacgagccttatcattaggggaacagtgcttcacgggttaatttcaaaagcccccaaagctaacatagtgtattcttctaaaactatcttaacaggacgcgactacaccgagagtgctagctatatggtgctaaagagagacacctttctttccaaaaaaaaaaagctacttatacactcaatatctatgtatttttttccttcttagagaagtttctcttaaattacttatctgatttataatccgattacgccgttgtgtttattgcaattaaatctttacaacaagatctcacatgattatattttgatgaaaaatcacaaattacttttatgatatgtctaaattacgtttacatttcactaagttacttcttaaactataaaagtaaattcagtaagtctaaaagtaatttatatatattatagaagtaacttagaacaaacgaagataactttggcatgttatttgaagtaaatccgttgtatagataaaaacatgactctatctaaaaattaaattaatcagcacaaattatggaatttactaaaaagtcatattttatccctacaacgaatttacttctaatgtcgtgacaaagttacttacgttttgttttaagttacttttagaatatatgtaaattacttttagactttattgaatttacttttatgtctaagaagtaatttagtccaatcttgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgagaagaaataaacaaagttgaaaaggtttataaaaagaaaaaccctaaaagaagtcttctttccccccctttcccttcttgggccggctcggcccacttctctccctccctctttctcctctcccccgcggcccatcggcctcccccgcgcgagcgccgctgacaggcgggcccgcccgccaccctcgctgacgggtgggacccacctgtcatcgcctacctcccgccgcgccgccgccgcgcccgtgccctagcgccgccgccgccgcggattccgccgcatcccgccttccccgcgcgccttaatgaggggggaatcattccccgcgattccctctcccgtttcccccgcttttccctctctctctccctcggattcgttcgaatcgcgcccgcaatcctcgccgacgtcatcaatggagcccgagaactccgcggccgggttcctttctctccggccgccttctctcccttccgacgctataaaatcgtccct

SEQ ID NO: 68477 - DNA, 621 bp, Oryza sativa
ccagcaaatactgcaaatagttagaacaacatattatatggagaaatgtttattttatgaaacatggaggaacaattaagagataaatgggcaattaccttttcctgcatctggcataatagcagaagcattatgtgagccagatatttgatggcactcattcttgtgctttgcacgccaatgcaattcctgaggaaggatattaccgagtgattaatccaaaacagtgatatctgaaaactctagcagcgcaaacaaactgattaaactgaaaatacaatataattgcctggttagttgatacctgatgcttctttgaacagtaactggatttcctacaacgactacaaactttttcccctttccatgtgccacaccaacaacaaaaccaagtttgggatcctaatagaaacatttgaagacaaaaagcataagtttgtgttcatgatttatacacagcatgcataatggattatttaagcaatatatcatatcaaagcaaagtgtttcctggacgtaaagctgtccataaaattatcaaaagcatagtgttttcaagaggaaatgtgagaataaaaagtgcattgtctacacaactttaaaagaatgttcaacaagctt

SEQ ID NO: 68478 - DNA, 558 bp, Oryza sativa
attccagtcgagtccatgtttgtttttcagatcccttaaatattgcctcatttttatttttgacggttcataaaaccaacaagggaacaaatgaagcaagctagagaacaaagcatgccatcagcacccacaacacaacatgaacacgaacattagaccattggagtgttcagtgcctaacatgtaacagaagcttaacacaacacaactttccctgtcattttgtctgacattgcttggcaacttggcatcaggtaacagttaaatgggcttggtcctttgggacaatctgttctttgatccacatggagacaggtaccagcacaagtaagaagcacagatcatttcgttttgttggcattgcttggcatcaggaaacagttaaattggttggtccttggggacaatctgatctttcatccacatgtagataggtaccagcacataataagaagcgcaaatcgtccccatgacgaagcggaagatgaaggtgaaaggattcactggtttctcaacatcttcagcctttggaccaagctgcaacaagaacaaaaggtg

SEQ ID NO: 68479 - DNA, 592 bp, Oryza sativa
ggggcgtgcctacgttatactacccggtgtcctatctaaattacactatattaattaatatattagtcaataattagataattagtatgtattggaccttcggtaatttttgttctgggttcgccactggccaccaccgcctatgcttggcgcagaccaaagtacccggcaccaacacaagaagaagactccatccttcgattcgctgctccacctctgacgagtgtcaccgccaccaaccgcgtaggaaagaaagtccatgcaaaattttacaatgatcaatgagaaagattggaagagccagttgacatgctagtagcacttaagggcatttttgtctttttaacataatttatctctccatttagcctggaaataataaaataatcattaaggtgtcttccagccaattacaaagtctttagagtatccttgaccatgccatgtttctgcggtgtctactagcaaagattacaaactttaaatatcctatagcaaattttaccaatttacctaagaccctcttagatgtacaaggcttagtgacggcgagctgagaagaagactggggggagagagaaaggggtaccga

SEQ ID NO: 68480 - DNA, 655 bp, Oryza sativa
ctgttgaagatactactacatctcaaaatataagtgtttagagttttaaagaagcttaaattgatcgataatataataattatgattagttaatatgagaaaactattatgtgaacatttaacaatagatggttgtttagttgagatgacaaaagcatgcactactacagaaccacatatcggtgccggttgggacattgaaagcggcaatgattagtccgccgacaccaatgtcaatcttaaaaaccggcaccaatataaaatcaatgagccaaaaaaaaacggctcctcgagccgacgcaggagccgatacttcgatccgatgaactccacatgaatccacatgatgaataagaacaacacatcaattctcattaataaatctcagatgaactcacatcggcacatcaatttcaagaacatcatctcacatgagcaacaaatgaactttaataagaacaaatcacaaatcacaaagagagagggagggggagagatggattcaccgacgccgtcgaaccttctgtcgacgccaccgttcgaccaccttcccgagctgaggggcgcgggccggctgcctccaacggtgaggggcccaggctacctccattcaaccgtctcatgccgcttccgcagctgagggggcatgggccac

SEQ ID NO: 68481 - DNA, 559 bp, Oryza sativa
ccgtttgagtttattttttatacggttggttcctatgttctcctaagtgtgaaaaaaatatcaaaaaatgaaataaaaataaaaaaattacatctctatgtactgtttaacttatatgtcattttatgtggttatattttaaattagattaagtaatttcatatagtggtagagtgcattatgtttaacatgctgatcaaagggttttactaaaagagttatggtctaattttattgaaggtgcaaagtagactaagtggtatgctagatattttcagacttagctaagtggtagtttgagtttaaattttttttgtggttggttgtatcgtgatcctgagtgtgaaaaaacatccgaaaaaataaaataaaaatgacactgttgcaactctatatagggaaacaggaatggaggcggcggcaccagccatgctggcgccctcctcctgccacgtcggttcgcgtgtgccacggtggcaggaggacggcgccagagaggctggcgacgtcccattggatgacggcgccagccactctggcgccccaaaaaggaccattt

SEQ ID NO: 68482 - DNA, 1698 bp, Oryza sativa
taataatactgtgtagctctaggatcgtctttacaaaatggctttgggcaactaagtgacttttaaatgctgtttactgcaaaacctaacccctattattatccccttgtaccccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaaatctaaaagtaacttatatatatatatgataaaagtaacttatgtatataataaaagtaatttacaaatataatttttttttcatcgtaagtgaagatttaattgtaacgaacataatagcgtaatcggattgtagatcagataagtaatttgagaggaaactttatttgaacaagaaaaaggcacccacgtgaactttatttgaaaggaaaaagacatccccgtggatggacatcatgacgacgtgcacagttagacggctctcagatgcgtcgtgctatagagctaaaccgagaacgctctcgaaatagatttcgcgatcttaatagtatacttcctccgtttcataatataagccattttaacattgtccatattcatatagatattaataaatctaaatatatatatgaatgtaaacaatgctagaaagttttacattattaaatggaaggaataataaatgatgtatactgcttatgcacgttcctataaaaaggcatcgccatgcatggtttggtgcctgagcgagagaaatggttaatccacatatagtaaattagttgtcagtgagctgaagcatgcacatatagtgtttgattattaaactaaactgggcaactgggtttgtgatatatcaacatgtactcatgtaattctggtagctagcaacatatctcaaattctcaatgtatttaatttgcaatataataatagctggaagatgacaactaaattaccttattccatcgttgctgctactccactaatcatccttgctgaagaccacgataaggtgtggtattagctctcctatcccttcagctcaagagatcaatcccagtactgcattttcttttagaaaaaaaaaacgtgctgcatcatccagaagagaaaaaaaacaaaggttattagagcaagtttaatactatagtcaactaatagctctaaatcatttatagccaatgtaatagccaattcatacaatagttacatactatactattaattcttggtcctacctgtctgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgaaggccgaggtgccccgaccccttgtggggtttgcactat

SEQ ID NO: 68483 - DNA, 724 bp, Oryza sativa
  unsure (1)..(724): unsure at all n locations
gatgagttgatgcctctgttggaccncatcaacatggtgggaacacctgctgaaaaaaaggattgcccacctaaaacctgggctgggcatttggtatgtttgtttgttaaaacggataatatgccactgggcaagattgcaaaagataaaatgccactcaatacgttatcattagtatactttgccactttgagcagttttgagaccaaaataccctctaatgtgaacagaggtagggagaaaggaacgatggcggccgcgactccgctcccgcgggcaccgagcgcgccgtggtggtcagccagaaagggaagaggactgccaccgggggggagtcctaaatgacaccaatagaagacacagaattggacgtcatgagttgctggagatcacgatatggctagatgtcactaccccaggcctcactccttcaaggactcggcgcggatgcattccagattgcggcgcgcctgctcctcctgcgctgtcttgcggagagacagaatgacctccagcctttgtgtcttgccatggactcatcatgagctcgctcccggtgaaaagcgcgctctcgcgaagaaggatcccgcactggcctgaggcccattaggcactattttacccttccttcaaccttagccccaaccagaagcaaggcttacccaggagaaccatgagttgaaaaatgagagagaaatattccaaccaaccaaccaaggtggcc

SEQ ID NO: 68484 - DNA, 613 bp, Oryza sativa
ttgattatggcctgttacctgttattagacaccacatgtataatttggattcactgaatggtttgtgctacgtcttgttactgatgactgttaatcattatgttgctttttctacactgttagaaattttatgacatggcagttagcgtagtagacaagttggatcaatttattaatttaactttgcattagcagggtcattttcccttttgctaattattgttgccataccttctcactgtccaagtatcaacttttataggaagagcaagaagaagctctgaaacaactaaggaagaatctggttattagagcaaaacccatgccaagcttctatcaagagggtcccccacctaaggttgaacttaagaaggtgatgcaccgatctcctgctatatgtgcttgagctaaaatgattatttctgtttttcgatgtgtgctcattattgttcatgttgttgaatgcaattttaattcaagtgataatatctcaacccattactgtttagatcttttccctttaattgaactgattgcgtatctgtaaaaacatactcgactacatgcttgttcctattgttatctacataggccctgttcaactgcacttgtt

SEQ ID NO: 68485 - DNA, 1572 bp, Oryza sativa
attttaatgtataacgccattgaccttttgaccaatgtttgaccattcgtcttattcaaattttttgtgtaaatataaaaatatttatgttatgcttaaagaacatttgatgataaatcaagtcacaataaaataaatgataattacataaattttttaaataagacgaaatgtcaaacgtttatcaaaaagttaacgacgtcaaacattaaaatatggaggggataatatttaacaccatgtgataaatagttgagacaaaatatactttatacgattattactcaagtaaatcagtgcagagaccgccagactggtaaaaagtggtgacagtaatagattaatagtacttctagaagaaaccgcgatacttaaatatgagatctgagcaattagggtgtgtttggttgcccatattcccctagcctggctcatttctcgcatccaggctgagtttgacctggctaagagtatacatatgcagttgtttggttggttgcattggtctagccaggctagcatgagattttgtttggttacttgtataagagatacggtttgaaagggattttgtttggttggttgcatggatgtgagtgttctttacctcttcatttagttgggtgaggttacctctacaatatatataacaaataataagagtattttgatttatccaattgaatattcacttacatatgcgaatgatactgcaaaatcactctattatctacataaaataagtcggccaacttttcacaccgaatcagtggtacgaaaaataagaaaaaggttatctattatattattaaaggaatagaaaaatgagcctccacgttcgctctcatggcctagaaattctcacattaatcggagaaaaagaaaaagcagagtccatgtagaaatacaatttagaaaatagctgaaatttggaattaaaaaaaataagaaatattagaagaggagactagagtccatatagaaatacaatttagaaatagttgaaattcggaattaaaaaataaggaatattagaagaggagactagagtccatatagaaatacaatttagaaatagttaaaattcggaattaaaaaataaggaatattagaagagaagactagagtccatatagaaaaacaattaggaaataactgaaattcggaattaaaaaaataagaaatattagaagtagagtatagagatacaatttacaaaaaattcggaattaaaaaaaagaattattaaaagacgagtctagagtaggaatatatataatttacaaataactaaaactcgatattaaaaataattaataactaacacgtatataaaataccatatgaatattacacatttgtagtttcgtaaagttattgtaaaatttaaaattatgatgttattttaatatatttgaataatataataagaaaacatatatgctattatatgagagaaaatataatgatgctagcgcgcaatctgtgcatgccactatgctaggttttctttaagctagatgaaccggtggaactaattaatctattagtagtcattgtgcatacattgac

SEQ ID NO: 68486 - DNA, 705 bp, Oryza sativa
agggagttattggaggctccctgttgaccggttgaggtggggatcggaaagccacaagcgcgcgcgcgcgccgagccgagccggccggcccgagggcgtggggaggccgaggcgttgcgttgtgtctgcatctctctctgtctctctctcgatccttttgcaatggaccggaatccaaccccgcgagattgcctctgtaacgggcaggcaattcaatacgcattgatcgcgtcgttactgcggcaacgggcggattcctctcctgcgctattaggaaacagagacccccgatcagatctctacgctttctctccgattgctggttcttcctccttgcaccgcttgtgctgcttctgcttccccggttctgatcgcttgcgcacatgagagatcggaacgagcaagccctccgaaaccacacctcgcctgagatctgcaccgggtaggcgggtgatcaagtttttggggagtgcttccgcacgactgctcttcttcctctgttcgtcgtcggttcatttgcatcatgtcttctggagatggcgcacctggagcgggagctggcgcaccgggagccggagctggtgcaccgatcgacaacaccaacggaggcaattctacctcacaatccagggatggaatttcatagtgtataacattctaccgctatctctgtttttgttacttctgttagtcgcaatgttattg

SEQ ID NO: 68487 - DNA, 1895 bp, Oryza sativa
tggttccaatttataagttctaactgattcaactgttgttagttgtaattgtcagattccctagtttttttgagttcccagttgaaatttgtgctggcctgcgattctattcagaagaagcaaaacagtcattaatttagacccatctgaatggagttctttagacacgagggaatgaaatgccattacttttgatacttctcttattcgtggtatacatggtatctttcacatgtaggatttgaaatttgaacttcaaatataagctggtttctccttgatgttgcacttaaaggtaataccaccattaaaagtgtccagtgctgtcatggaaaacttatggaagatataatcagtgttctattatcttagcctcatatctttggaatacatgaaggatttaacaaagtacagtcaatacagtttctaatccagtacaactgttatcttcttgagttcttgacatgattttgtatgtgttgcttgattataggtcagatggcgcatcaacatctaatatgcgtagaggacggcgaagaagtataagttttacccctgaaattggtgacgatattgtgaggttggtaaacccgacctttaaccctgagcaatgatacaatgtggttaattgaattgtttattcatagttttgcccaataatacaacttaacaacaatagtaaaatccttgcttgcatctaaatactcaatggaagaaaatttcattttcaaagaaataatagaactataaaaattggttatttggacaatccaggtataatttatccatatcatgcaacctggtttataaatctttgtgagttttgttccatttagcgaagttgtgtgtatgcgaactgttttttgttccaagtaattatgtggttttagttctctcttttttttaacttgcatcctgtatttctggctttctgcattgaaccgtttgtgtttctttgctgtcaggactgataggaacttttacttgcttgtttacagcgcagttcgagcaatgagtgaaaggatgagagagaatcgcctttcaaggggacaaatgatggtagtcctggacaattgaatgattcacaaaaaaatgtattgttttgcccctttttagttgattttgttgatatgctttgctgttcaattttcaataatctttatgtgacctgcttatggaggacagttgtatgctcattatccaatgcataaattttgttggaatggtttttgattatttagtctggtattcacatttcgtgattgattccatatgttatacaggaatcacctcatgatttcaatgacaatgaactacatgtaagaggaccagatgagcaagagggctcaagaaggcaagttagtaaccagaaggctgtgtcattaccttcatcgccccatcgattgcgcagtgatggttctggcctcagaggaccagccgagtttctgacagcagatctgatgtccacttggaataaggttttgcgatcttcaccatttctgaacaagcctttattgcctttcgaggaatggcatattgagttctcagagattactgttggcactcgagttgggataggcaagtacatggttcgctatctatattctgctacattcaggaagtccctgcattatgaaatacaccacttcgttagtttttatcttttattgaactttttagaaaatcataatgaatgatcaattatcccaatataaataaggatgttttaagttgaccttttagagtcaagaaacagcctcttggtagaatgtcattttaaaactgctaactcatctgaatgttttccagggttctttggagaagttttccgtggtatctggaatggaacagacgtagctataaaattattcctggagcaagatttaacaacggag

SEQ ID NO: 68488 - DNA, 581 bp, Oryza sativa
aatacgtatgtatcgggtttgttttattcctccttctcgattcctctttctgtttcctcacgcacgtgcccaaaaggacggagagccggtgggtcgaggcgacagtcggcgcggcgactgcggaaggtgacgggggcagaggaggtggggccagcggttggcgcggccacgacgggcggtgcggcaatggagaagggcagcgaggcagtggggcacgcgagaaagccccatccatagtgatcggccacctccgcgcatcccccacccgtccttgcatacgccgtctcctcgcatcccccactcgtcctctcatcttccgcctcctttcgcatccacatctggggtggcatggctccctcaaagaaatcgattcaagcgcgccgacagttgcgcgacgctactggcaagttcagcggtcgcgtctctctgggaggggtgcgtggtgcctcgacatcggcgaaggaaggggcgcgccaggagctcaaaaaatttaagtaattattaattcttttcctatcatttgatttattgttaaatatatttttatgtaggcatataattttacatatttcataaaagtt

SEQ ID NO: 68489 - DNA, 2154 bp, Oryza sativa
ctaatgacggattaattaggtttaataaattcgtctcacagtttacaggtggaatctgtaatttattttattattagtctacgtttaatacttcaaatgtgtgtccgtatacttcaaaaatattttggccaaagaactaaacacagcctaactccaaagtttgcaattaatttggtgttcaattaaggaaatttctgctcactctttataaccaattctcaagctggtttttatccaaagatgtttttcgacaatgcaaaaattggaaaaccacatatgtttgaaaaagcaaatatgcaaatgaaaatttggaaatcaaatatacaatttggaaaagtaaatataagataactaccgattcacctattggcaaaggactcaccattttaagtccggtgagcagggcttttctccatcatgttcaatttcccatcgcggcatccgactccagagatgatgagatggatgactgttgttctttcaatcgccacaccttcttggtcttcttttgttttaccgatgtggtcgattcaacggacttcagggactgtgacttgggtcgtgcctgttggtatttgttacggtcacagataataaatccacaagcgcacgaataccgatgtagcactttaagtcagagtattctaagggtatcgaatcataaggaacgtgtgtgtataatttaagaacaggattcatccaagcacaacaactaaatggtagggttaggatagagaggattcctatgggttaattaacttatttaagttaaggtaaaactttatcaattgcttcggtcaccggctctcccctggtccgccaagttgagtccgatttgtagctttatgatatacccgaacatggaagaacacgaaggatgtacagggctatcaccatctgccacctacctctactttgcgtggagcacacaataaacaaaggtaacctctaacctagacatcacgtctatattattgattactactctagcctcggccaagaacttccttctttatctagagtcttagtaccagagcactcaatataaatactaaccgacgaacccgcaacaatgagaatctatcttacttaaacaagaaaactaaatacccaaaagaaatcacaaatacttatataaaagaagcatctgtcgaggtataagatcggagagagggccgacaactccggtgctcctctaggactccttaggaaataggccaacatctctggaacatctcaaagagaactccgatatttggggcactaattctggaacttcccctatctctcttcctatattctaactctactatcgagtagcctagatatgaaagtgagttgcactccacttgttgtgttgtgctttgagagtgaagtgagaactcattttaaaggcagcaatgatggttactatggcggttatgaggtcggttcacccacaaccaccacagggaaccaatccccatcctccacgtgaaaggtagggatgagtggctgcaaaggtggttcggccgaccccctggcaccgccatttcccctctccttcggctggatcaccgtccaatgggcctttatgactgtgcacagtggttagcctattttgaggtgatttggtcagcttgtgggccctccaatacgtgtactcgcgtctgattggccggatgtgtgtttcttcgcatggctggtggttttcatataaaatccctgcatacacatatttcaccaatacctgtggaaatgattagtaataaccattaccacaaagtttgatgtattatttcaattgcttgtatgcaggaattaatggtcggatttggtatttaggctgtgtttagatccaaagtttggatccaaacttcagtccttttccatcacatcaacatgtcatatacacacacaacttttcagtcacatcatctccaatttcaaccaaaatccaaactttgcgctgaactaaacacagccttaaggactgtcaacagtaccccctgcctcttgggtgtcttggtgttgcggtattggagagggggttcctggatttttcacattttggtccttttgaaaaacttattttgcaaatagacccctagaaaaacttattccaaaaatggtcctttttggggcgccagagtggctagcgccgttgtccaacaa

SEQ ID NO: 68490 - DNA, 1541 bp, Oryza sativa
tcctcctgtcacgtcggttcgcgtgcgccccggtggcaggaggacggcgccagcctccgtcccgttggatgacggcgccagccactctggcgccccaaaaaggaccatttctgggataagttttttcagggatctatttgcgaaataagtttttcaaaaggaccaaaatgtgaaaaatccaggggggttccctcttcaacacctcttccatgaatacgaaggatggtggaaaggcggtgcgacagaggagacaggcagcgataggctacaggccttgccgggctatcggtgtggggttggtggcgtagagcacgaagcagcacggcagccaccgcgatagcagcgaggacggcggtaccatttctagggcagacaagaggggccatgatggcctgcggtgcagtgccaacggcacagctgctgcccatgtcgtgcgcaggaggggcggcaaaaggcaaggtggccgtggcgttagggcagtcccaacccataacactagacatggtttccataaactccacatcatcaagaaactagtactagacactactcttccaatgcaaacaccactattccatacttcaatttaatgctacttatctcacatgatgtcttggatgttgtgtagaaaccatgtctcatgcaagacatgatttccttctctttcctcatttattaacttgccacatcatttttttgtcctaggtggcaacttatttaatgctatggacaccatcctagtcattgggttgggaatgcccttagaaccacgcgtggcagagaggagacggcactaccgacaaatggggccacgctgtcggcatgcgcgcagcgcaattgggccgtgggccggcgcggcattacatgggaggctgggccgggagaggggaaagagggaaggagagaaaggaataagtttactttaggtcccttaatttgtcgccgagtctgattttcgtcctcagtccacaaaaccggatataacgcattccccaacataccaaaactgtgcagatgaggtccctcggcggtttggaaggcggttttagctgacgtggcacctacgtggctggtttgactaggtctccgtcccacgtggcattgatgtggcgcttacgtggcaattatttctcagaaaaataataaaaaccatggccccacatgtcagctgcacacaaaaaataattttaaaatggtgggccccacgtggccccacaagtcattctctcctctgtcggctctccctcttcctctccgctctccgtcgtcctctcgacagagtggcgacagcgggcagagtggaggggcgggcggaacgacggcggcctcgccaaggacgccgctccgccggcggcggtgcgggcaaagcggaggggcgggtggagcggcggtgacctcgccaacgacgtcgcgtgtacctccgacgcgagaagagcggcagcgcacgccggccggcgggagggagggagggagaggaatggggctctccctcttcttcctctccgctcttcctcgtcctcacggcggagcggcggtgggca

SEQ ID NO: 68491 - DNA, 16950 bp, Oryza sativa
  unsure (1)..(16950): unsure at all n locations
acagtagcccatcatcgcggatgaaggcttgacgttccggggcctgccggcgcactttctgccggaccggccttgcgcccggccgcacggcgagacggtgctcaatcacctccctggggaccccgggcatgtccgctgctattggatctatgggagattgactaacagtggtataggctttatcttttaatgtgtaatcatccataagagaacctagcctattccttaaaaacccatcaaccttttccttaaacattacatctaatctatctttaaaattaaccatagatgaatctattgtagatgcaatttgttggttgatagattgcgatacctcgtcattacttaccatgtcgggagcgagtttgggacgtggcccgggcttgatgatcacgccttgacgagtcctagtagttgctctcatcaacgcctcccgtgtgagctcgttgatgtgctcttccatggctttacgatcctctccttcaaagtcatccaatgtgaccggtatcacatgagatggctccacctccgtcttagatgatggcttcgtcatggcgaagtcgaagtcgagttgacgatgaacggatcttgtccccagcggagtcaccaaaaatcgtgttggcaacttttttgacaagttgacaagcacgatcgcagcaccttaagccttgcggtgatcctagagtcgccaaccacctcgatttagcaaagagctaagcctagatgggttttgataactaaaccggctagtggagccgatttctaaataactacccgtctcgtgggcaaaacggaaggttttcaggacaaacctacaaagagatgtcgcactctcgcagcggcagcggacggtttacggcgcaaaccgacaaagatggacaaactaagagaaaactaaaagcaatatgaaaagaacgattcgattgattgatagtagattattttttacaatgaaccggccttgtcccttatataggggttggtcttgccctctacaggcccttcttcacgtccaactcggggtagaaaccaaaggaaacccgaaacatgccttcccgagcaaggaaacctcgaaacccgacgcaacagaatcggattcgggcctgccggtcagaccggncacataccgncggtctgaccggccttcaaccggcggtctgaccgtccaacacacggcggtcagaccggcctacctcgaaggaaaccagtagacttccaaattttggcaatatttcctattttaagcctaggtgctaaatttgggtgtaaacaggaacctcgggggtcggtcgttgtgatgttgcccgtcagtgccgccacccgggccagacgaggaagaggacttttccttgtccttcttcaacgtcgcgacgtcggtctgcagggcggcgatcgtgccggtgaggctctcgatcagcttggcgaggtcggcgttggagggttccaccattggtgcggtgacggaggtggctgatggtggagatggtggagggctgagtggtggcgcggcggctgggaatggagcggcggcgttgggtgggtcggcggagcaggaggatgaggatcggcgtgaccgtgataccaggttgtcaagggcgtcaaggcccctggtagctggaccgcggctacgtaattcgtagccggaatccgtcttctccggcgaggttttacccctcagccgtaggttcaggtttgggagagagaagaggagattaggtgagtgattcttgattttttttctccacagtgccgaatacaagactcaaaaatagtccacagactgaatcgaacatgcctacaattaaggaagaaacaaggaaactaatcccttctttctaatcttagccattcccggtggcttcctcagctgtgcgctgggcgcgctctgtagcgcggcgcacgtcacgcgcgcgacggcgtctcgcgtacgtgcggccccacatgacaagtagatcctgctgaaagatgacctgctttagtgcattactgcgaaggtcatttttgttttggatcatagcaaaaatcaccgagttggataataccatagcatatgccattaacatggcccccgcatgtcattctcacatgtaatggtatttctaaccggtgcatctttatactactaatttttctgttaatatagtgatctcataaaaaagaagaattggaagcagaaatgaacacaagcatgatacactggcatggctgcacctgcaaaaaattactgaagaaacaaaacttacctgctatcacagatgcaatattccaattgtctgtagcagcagttcaaggttcgtacacagatactccctccatggctccatccataaatgtttgaggcgctttgacttttttaaacatatttgaccgttcgtcttattcaaaaatttaagtaattattaattcttttcctatcatttgattcattgttaaatatacttttatgtatacatatagttttacatatttcacaaaagtttttaaataagacgaacggtcaaacatgtttaaaatagtcaacagcgtcaaacatttagggaagaagggagtagtttagatagaagtaggtaatttggttgcttgtatggtacaattagagttgcaacgagatgctgcttgattgtttacttattttgatgggtgacaaggttaaatagatctgaggtgtgatagacagatgctttgcaacccctcatctgccttatcccaccctaataactcagtacttagcagttagcaccagcaagatgcttattgtatttgctgaacatgacgtagggagcatttctcatttacagatatattcatatagttaatacacataactggtcctcagaatctaaaacttaataagagcaaggtcaatagtatagctaactactggctccaaaacatctatagccaatctaatagcccattcatacaatagttaactataaaaatatactgtaccattaatacacggtcccacctctcatacacacataacatcttggagtccgtgttgcagccggctacaaatctgtagcccgctttcttctctctcttctcttttcttctcgatatatggttacagccggcttatagcctgctattgtacctgctcttaagcgcatcccgcctgggggtctggttccactaattgcactatagcaatcacttgtaaataaccataaatgttggggtttaccttttctttctaaaaaaaactacttttcctgcggtgtgcacacggaaagcttgtgtgcacaggatacgttcacttaatcaaaatatcaatcaaatctaaattctcttgtttggtatttgcaggttcacatgtcaaagtaattgcaggtactgctcaatccaaatcttcctttgttcaaatcaaagtaaaaagaaagaagaaaatctatctgttacatacagagtcttatttttatctactactgtcatacattctcttttacacattacaatcaccaagtctggtgtctttatattttctatcctaatcaacgtgtcgatagtatgctcctccttcgatttatgtggtagcatggttttcccagcatgttcctctattccattttcctgagttataagaccttagtatcaataaaagttaggctatgagactttgggcagaaagaatgcaatgcactaatttctctctgcataatcagctacatcatcggttaccgcatttgttgttcttttatcaatggtagccattgcactttatctttcactgaagacaagatataacgaagagatacacatgaaggtagaaatgtttctcaaaacgtatggcacatcaaaacccacaaggtacactttctccgaagtgaagaagatagcaagacggttcaaggttaaagtaggacaaggaggatttggaagtgtgtacagaggcgagctaccaaatggagtccctgtggcggtcaagatgctagaaaatccaaaaggagaaggagacgaattcatcaatgaggtcgcgactatcgggagaatccatcatgcaaacattgtccgcctccttggcttttgctcagaaggaacaaggcgggctctcatttacgaatacatacccaatgattcgctggagaaatatatattttcacatgattctaatacttctcaagaactcctagtaccaagcaagatgctagatattgctttaggcattgcccgaggaatggagtacctgcatcaaggatgtaaccagcgtatcctccactttgatatcaaacctaacaacatcttgctggactataacttcagcccgaagatttcagactttggccttgcaaagctgtgtgcaagggaccaaagcatcgttaccttgactgcagcaagaggcacgatgggctatattgcaccagagctatattctcggaactttggggagatatcttacaagtcagatgtttacagtttcggcatgctggtactagaaatggtcagtggaaggaggaattcagacccaagtgttgaaagccaaaatgaggtttacttcccagagtgtatctatgaacaggttaccactgggcgggatttggaacttggtagggaaatgactcaagaagagaaagaaacaatgagacagctggccattgtggcactatggtgcattcaatggaacccaaagaaccggccatcaatgacaaaggtggtgaacatgctaacagggaggttgcagaatctacatgtgccacctaaaccatttttctcagctgatagccatcctataatgtaagacttgcagaacatgctgccataatttagtaaaagaatatgtgatagataaactaaatgcaatgtaataaatgcatagcgacagcatgcaatgtattctcttattgttccattctattagccacctgaaatacattcaacgatgaaattggaaaattgtagttcaattgccacggatacctcattctgttgatgtgcttttgcatgcccgtgcatttgttgtgctctgtgagtcgtcaatatgaccaattcatgagccagacgaatctggtggaaaactggaagtgaataattaactccataatttatatagaaaagaagagctgaaatcaaatcaaaggtgttacctctgtcaattcgaagtgtaggagtctgatctcaactcccgagagctgcaaacctgagcaggaagccctcacatagctagcttgaggagagggaggtggaagctccggtctgggaggcggaaacctcggcatggttaggagagagaggtgtcgcgagcggcacagaagagaagggcggaggtggctccggcgatcggccagcgccatggtagtgtggcactgcagcctggggggcggacgtttgagcagctcaggtggcacgtcttcctcgggaaccccacgcgcctccggcgagccgaagaggcggcggggtgcgccggcgaccgagaaggtgaacgacaagtgaaccaggaggaatttccctagccccaacatcccttccagcccaaacaaatgggccgcacgtaattccccaaccctttgttgggccgcacctggtcctaagtcagaatctgtttcggtcgaattactgtgggccgttccattccagcccacacaatcgacacgaaaggtggcagtggcaccctcctgggctgtcctggcattggtctgactagagtttatacaaaaagagagaaaaaacgcaaagcaaatgaattttaccatcatcgatgcctgacattctgacaaggagatctctctcgccgtgtgtttcggtcttacaacaacagcgacgagatttacgaaaagcagcaaaacactaagtcttgtgtaaactctttcaaagtcttaatctttttcagatactcggtaaatagtacgagctcactttatttgcttattatatgtgctacaaacttacaatatacataaaaactattgaagttacaatatatcgatctcagcatattgaagtttcgacagcaaaatgggcatacaaattaagtaaatacagtcatcataaatgtacttgctactaagttactggtagctttcgaacagacatatgctttcgtcgtcgtcgtcctcatgctcctcggagattgcagttagatcagatggcatattgtaagactccactccagggaattgctcatcatcacagaagaatggccttggaggaacctgcagttcatcactaccaccttcaagcatctctatcacctcgctcatcgtcggtcgatcacacgacctcatctgaatgcaccataatccaacaatgcaaagcttcttctctagttcatgcatgtcagcaatatcagagatctcgcttgtttctcgccgagtcagctccctgtacacccgtgatggataatatgcttgacttttttttttcgccgggtcggcaaagaacgccgaccatagtatattaagaatttggagaatgtacagagatggcgaggcttcacagccaccgcctatttacaagatgccacaccactatccggagaacccggaggaaaccacagaggggcctctcacagcgcccgtaacaagctgggcggcttcccaagactcccattcatcttcaatggctgcgcagagcaaagaagacgatgtcccacgccctcgaagacccgagcatttcgttccttccaaatcagccacgtaattaggatgatgcccgcgtcaaacgtttttctatcaatcttggcaatcttcttgcgcgcttcgcaccaccacccctgaaagtccgaggcaggcttcgggcagcggagaccaagtcgatcccggacggactcccacactgcctgagtgaaggaacagtgagtttgctgcatttggatctgcattccttcttcctccagccatctccaaaagtagcattccgaagctataaacatcggatttgcttgatatgacaccaaaactccgagagatcatctcaggagctatgtagcccacggttcctcgtgcggcactcactgggacaaagctcttatctcttgggtacagcttggcaaggccaaaatctgcaacttttgggacaaagttatcatcaagaaggatgttatgcggcttgatgtcaaagtgtagaatctgcatctcacatccctgatgcaggtagttgatccctcttgcaatacccaaggcgatctcattcagcttgtcccaggagaaactcttctctggcgagaagatgtacttgtcaagagagcctcgaggcatgtactcgtatataagtgccctcctcatttcttcagtgcaaaacccgaccagacgcaccacattgacatggtggatccttccaatggttgatacttcactgatgaactcatctccgttgcagctggagctaccagtcagcatcttgacggcaatatggagattacccgggagcaatacacctttatatacagagccatagcctccttggcctagcttgtctcgaaaatgtgatgtgattgcaataatgtctgtgtaggcaaacctcatcggaccaatcatctgctgcattcggaggaacttctctaccgcgtcgatcgtgatccttgttttccagtacttatgggcaaggaagatgaatatcaccagtgaccccaacagtaacctgaataaaacttctcaaacaaaccaacatacatgtatataagttagtatatatatgttcatacatgatatcaccggtgtgatgattaaaagcaagtaattcgtacgtaccgaaatgaaacttggtgatatcaatagccgataccatgattcccaaaaaaatcatgtctttcttggaggcacctagattactgcaatctacttcggagtatgtttcattccagaaaagagcacgggttaaatcttgaatgcttgcacgagatgtatgctgcttgaagtacctgcaaatcacaccattgtacaagacggggttataagtgaaggaaccacatctgttttataaaaacagaatcatgagaaaaacaaaactaattaacttgcgtttgagcgcagactcacctctttgaacccttcaggcattccgtgacgctgatatcattactctggtaaggaccaattggaaacgaaacactaactcctttccttatgaatcctatgatatctgtgtaacttgcattctgtagctgtgagtccgatatatgccaaccatcaaagggaatcatggccaaatatcgacatgaaggttgaaactctccaacggcacagtcatcaaacgagacaaaaacaaatgaattgttgggaagcagacatgtaacgggcctgtaccttggcataatatctgttattgctcggaaacaattcacaaagcatgcccaattgcgtgaaacagtgtacaaatcgatagcgccataagaatcagttgaagttttccccgaatacagacgccagtaattcttcgtgtaaggaaggtgatcagagcgaggaagaggacaactgctgccgtttgtatcatcatcttgcaaggtggcatccacaacccagaattcctccccggtatagttgatgctagtcacgtagtacgtccctttgttgatctgaatggcagccctgccattgttacatgagaggttgtaccatggacgaggagtagcaacgcactgacgtgaatcgccttcaagacggaaagggtaggatatgttgccaagatggccacaggaggaaggaggacagtactgggggtttagccctgttccaacaacttctgctgcaacaaccgcaagcaaagaggagagaagtagagatttcgccatggctgcagcttccattcccagtccgtccctagagaaatgaccactataattggcagggattagccttgctgagtattaatttggtggggtcggggtgggtgctttaactggggagatactgactactagtactatctttttctttttcaatgtatgattctgttgacttttcagataatatttaattgttcttcttattcaaaaattcagtgcaaacatatatatataaataaagtaaggttagggtctctttgatgacaaaataaatcacaacaaaaaaacattcttataaattttttgagcaagacggatagtcaaacgttatgacaaaagttaacgacgtcatacattaaaaaacagaacagagtaactatctctctttcataatatataaaagaaatagacttagaccaggtattagaaaaagtatgtaaaattaaacgagagaatgttgtgattgtttaagagaaaaaagtagacaaaaaaaatttaaatattgaaagattgtgattggttgagaaggaaatgtaggtaaagaagttgttatattttagaacaaattttaaatactaatagtagaatttgttttattttaagacaggaacgagtattaatttttgggacttttatggaagcactcaatttccacacctgtcaatttcctccgtgtaatacacggtacagtacctataggtaacggtcaatcgcgatccaataaagtaggagagccaagctcccccatttccattaagagaaatgagcatttgccagatgtttgagggtttctacaaataaaccctttcccagacagataacaggtccagctaagctaaccaagcaaaccctcaaaagatctacctataggtctttttccacacggcaggatggatgctgctgcgattcactagactgcaggcagcttccggccgggtactacactgtggtatagtggtgtccatcttttaactcgacgcaacgcaacattgccctgccttgcttacttgttggatcgtctccatctcgcctgcctgtcacagtgcatacagaaaataggatgagaggatttcttgcagcaaccctcctggtgttgagccttcttctcaacctgcacacagcagcgtcagtgtcagcgtgggaagacaaggatttcttcagctactgcccgccgtcgaggtgcggcgagcatggccccgagatcaggttccctttcaaacttgaatccaaaaatacaccatcgtcatgtggcgtgccatgcatgaagctatcatgctctggccaatataccatcctacataacaaataccttggaaggccatacaagttgaccgccatagattacaagcatgctctcctgaccgccgtcccgctcgcagacgaagacaactactcctcaccgtctccctgcccacttctaaaatccatatctatcaggccaaacttaataacagggccaggctatggttattacaacacagggtaccagaacccttgccaaacatacgatacctactatgcagcactagtaagctgttcaacagaatttgccctagctagtgtccctggcactgccaccgataacgattatattgctggccccatctcttgccttagcaaccaaacccacttctcctatttggtggcttatcgtgtaactatgtctcttcttccgttggactgcgaggtcatctcagatggccccattccgataccagctttttattactccggttatatcccatccatgttcacaacaagtgcagacagaatcctcgactatccttccggttatgtcttatccacgttcagagaaagtgcagaaagaatcctcaattcttctgagaccatgatctggtggtatttctacaagtacgatggcagacattgtgaacaacaaggccgacgctgcgcattcagctcacaaaggaatcaaacattctgcatgggtagaggtattatttcttactggccaaacaactactcctatacaactcgcagtaccattcttgtttatcatctgtaagttttacaatttccaatttacagccccacacatatccatgctagtgctatttgatcgtcaaaatccagcaaaacactggcaattatgcccgatggataagaaaacaatatttatcagcacatgagcatcacttatattatctttatttaagacccacttatattatctgatcatcttaaaaactgaaagcaggaaatgaccataaccttgatatgccagcacattcatgcatggttgcacttgaataaagttaccaaagaagcagaacttatttggtcacaactgtagcattccgattgcctgtagcagaagttcaagggatacaggtagctcagatgggatgagacttgagggtatacaagtaatacctccgttttcaatatatgacatggatgactcttgaacatacttttaatatacttaaaaatggagggagtaggtattttggtctattgtgtgatacaacgagagctgcagtaagatgatgcttggttgctttgatggctgttgaggttaacatagatctgagatgtggtgtgtagataattttgtaaccctttttccacgttatcccaccctaaccattcttaatctgccattccgtcttgcttagccaccatcattagcacatggcaacttgcttattagtatgagttatgatatctgctgaacaaaacgtagggatcatttctcacttacaaatatattcatatataggccttgtttagttctaaatttttttcttcaaacttccaacttttccatcacatcaaaactttcctacacacataaacttccaacttttttcttcaaacttccaattttagtcaaatttccaattttggtgtggaactaaacacagccataattgaataattcaaacacatctgattccacagaatctaaaacttacacgcactccactgggtgtctggtcttccatactgcactatagcagtcagctgtatacccatgtcagattttaccttttctttctcaagtcaatttctcctctctttttttcctaacgaaactatcgatcaagtctgaattctcttgtttggtttttgcaggttcacatgtcaaagtaatagcaggtattggttcaataatccaaaccttcttttgttcaatgaaagtaaaataaaaggaacaaattaaagttatctatcacatactaagtcttattattagctcctctggtcttataatctcttatcattattacaatcctaatggtggctctctaatttatattcgtaatcaatgtgttgatagtctatttgctcttctgtttgtacggaaagatggttttgccagcatattcctctacattgcttttctgagctaagtcttataaatataagttgggctgtgagccttctgtctagaaacaacacaatgcactaacttttattatctgcatcatcagctacatcttcggttgctgcatttgttattcttctgttgatggtggccactgcactatatctttcactgaggacaagatataatgaagagatacatctgaaggtagaaatgtttctcaaaacatatggcacatcgaaacccacgaggtacactttctccgaagtaaagaagatagcaagccggttcaaggttaaagtaggacaaggtggatttggaagtgtgtacagaggtgagctaccaaacggagtccctgtggtggttaagatgctagaaaactccaaaggggagggagatgaattcatcaatgaggttgcaactatcgggagaatccaccatgcaaacattgtccgcctccttggcttttgcttagaaggaacaaggcgggctctcatttacgaatacatgcctaacgattcgctggagaaatatatattttcacatgattctgatacttctcaagaagtcctagtgccaaacaagatgctagatattgctttaggcattgcccgaggaatggagtacttgcatcaaggatgcaaccagcgtatcctccactttgatatcaagcctcataacatcttgctggactataacttcagtccgaagatttcagactttggccttgcaaagctgtgtgcaagggaccaaagcatcgttaccttgactgcagcaagaggcacgatgggctatattgcaccagagctatattctcggaactttggagagatatcttacaagtcagatgtttatagtttcggcatgctggtgttagaaatggttagcggaaggaggaactcagacccaagtgttgaaagccaaaacatggtctacttcccagaatggatctatgaacaggttaccgctgggcaggatttggcacttggtagggaaatgactgaagaagagaaagcaacaacgagacagctggccattgtggcactatggtgcattcagtggaacccaaataaccggccatcaatgacaaaggtggtgaacatgctaacagggaggttgcagaatctacaggtgccgcctaagcagtttttctcagctgacagccatcctactctgtaagacttgcacaacatggtaccataattcagtagaggaatatgtgatacatataaacttagtacacattttgcaataaatgcctagcattagcatgcaatatattcttattatgccaagccacatgaagtgccactcttcactgtataaaaattcaatgagggaattggatatttgtggttcagttgtcgtgggttaccttattgtgtcgttgctgtgatttatcctcaccatgatttattctgtggtgctccccctgtgaagttgtctgaagtccttgtccaatttatgaaccagaatctggtggaaatttcacaggaggattgtattaactgtgtgagtaagactcatatctgtcccatcatggaattgagcgcagtagttccaaaatttagatagaacagaagaaatcaaatcagaaagtgttaccttagtctatggctatcgaaaagcagcagcgatcatcgcgggaagaccgaagacctaagacctcgactcgcttgcgggggtcgtctttcccagcactattaccctccctcctcatcccatccaagcccccagatcccgcgagatgggtggtggtggtggaaggtgacgacgtggaccacatggggacgggatggagaccggggaggagnnangagnnagnaggatanagnaagatgcaggtcggctccggtgtggggnacacggtgagcgcgcgncgncggagaagagtggtagncggctccggcgaccggccagcgcgccggcggatgaggaatgctggatgccaaggcaaaggggatgctcggctcgcgaaatcgccgccgccgctttagccggagctcgccgggaagtgtggtggggcgaaggcggagcaatcacaatctaattaaggcctagtttcgatggcccatctaggcctggcccatcaagtcaatcacaatccctttccggcccagatatatatgtttgtgggctttgcaaaaggaaacttaattaacaagaccactaaaatcctgccattagcaatggtcatcttgataacttggtcattagcaggcagcaggttagcagctagcacaaaaatactactccctccatcctaaaatattttgacgccgttgatttttttaaacatgtttaaccgtttgtcttattcaaaaaatttaagtaattattaattattttcctatcatctatctattatattattaaaacagctctgaaagggagcaccacgttcggtgcgggagatagaaattcccacattaatcgaagaaaaacaaaaaaaaagaaaaagagagtccaagtagaagtacaatttaaaaatagctgaaattcggaattaaaaataagcaatagtgaaagaagtttccatataagaacccaatacgagattaatcaaaattcaaaataaaaataaaataaaatccaaaattagaaaagaaaaggagagcccgagtagaaatacaatttaaaaatagttgaaattcagaattaaatataaacaatattgattgaagtttccatataagaacccaatacgagattaatcaaaattcgaaataaaaataaaataaaatccaaaataagaaaaggtgatgagagtccaagtaggaatacaatttaaaaatagctaaaattcggaattaaaaagaaggaatattaaaagaagagtccatataaaaacccaatacgagattaattaaaattcagaataaaaataaataaatccgaaattagcaaaagaaaataaaagaagagttcaagtaggaatacaatttaaaattagctaaaattcggaattaaaaataagcaatattgaaagaagaatccatataagaacccaatacgagattaattaaaatttagaatagaaaataaaataatatccaaaaatagaaaggggcaattgcaaatttatcactactttgaaccgttattacaaaactgccactagaaaattgcaaaaatatcactagaactgtcattcgagtggcatccttgcaatattgaaaaaaccagtggtaaatttgcaaacgccccaaatagaaaaattaaaagagagttcaagtaggaatacaattttgaaacaactgaaattgaaaatataaaataaaaacattaaaagaacacagtacggtattaactaaaatttaaaaaaaatctgaaattagaaaaagaaaattaagatttcaattaggaatacaatttataaataactaaaatttgtgataaaaattaagattattgaaagaaaagaccatctaaaacacatgacgagataaattaagtaacatgcctataaaggagtagagtggtggcggttgatatgacatataaaaattgttaataaaacacctaatagaatcctaatgacgattaaaaggagggacgtcagacaggccgtgaagtaaacgagtaaggcggttgtcgggacttctagaaagtaaaaaaacaaaccccattgataatcatattcgatttttaaaatctcaatgataataaaaaggagaagcagcgggcggggtgtataagagtatagttgcagagccgccgacggttgacaggacttatagaaaataaaaaatgaattccaacgatagttatgttcgatttttagaatcacaatgataataaagagtaggcggcggacgggctgtagagggtgatgaggacatcctccactattatttgttcagcctcggccaacctcacctgggggcatagtggcatcgtttgatgtgacttttaaaacttaataaaaaattaaactacaagtccaattttaaaggttcggaacttttaaaaagttaaaaaaaaaagaaacccaatgataatcatgttggattttaaatcttaaatgataataaagaaggaagccagcgggcgacccgtagaggagtacaatggcaaagccgctgacggtttggcgggacttctaaaaagtaaaaataaacccaaacgataattatgttcgatttttaaattctcaatccaataaagagaagagcagtggcaacgtttgacgggacatctagaaattataaaaatgaaacccaacatgacaataaactccaaaaactataaaatccaatttttaaaggttccaagaagaatgaatataaatagtggtagatcgagcaagtaaataaaaaagaagatgacataaggggtagcaactggtgtgacttttaaaaactatataattagaaacacgaggatggtaaggtttggtctttcaaagtcttaagacaatgagatagctatttaacaaattttaagtaaaatcatacttaaaaaaaatatgattttgtttgggtgctagccgcgtaattgcgtgggccacccagctagttatattattaaagaaatagaaaaagaagcctccacgtttgctcccatggcctagaaattctgacattaatcggagaaaaataaaaaacagagtccatataggaatacatttaataatagctgaaattcggaattaaaaataaggaatataggaaggtaggtctaaagtccatatcgatatacaataaaactaatagaaattcagaattaaaaaataagaaaaaaaataaatgtagaggttagaatccatctagaaatacaatttagaaataaagaaattcaaaattaaaaaatatattggatgaagaatatagagtccataaagaaatagaatttaaaaataattaaaattccgaat

SEQ ID NO: 68492 - DNA, 1044 bp, Oryza sativa
cgccgccccttcctaagctagttcgggttcttcctccccccgcgccgcgctcgcctgccgctgccgccgctttcacttgttctgcccgcccttttggtgcagtgagcagtcctgcttcgccccgccctttcccgggtccgccccttcctaagctagttcgggttcttcctccccccgcgccgcgctcgcccgccgacgccgccgcttcgcttgttctgcccgcccttttggtgcagtgagcagtcccgcctcgccccgccccgccgccaccctcgtctcccgcgtcgctccgtcaaccagcctacgcccctgcacagagaagtgagagaaagaagggagagaagaggggaaagagataaggtgttgatgtggacaccctgaccatgtgaggccagcgtgggtcccacactgactcagccgccacgtcagataaaaccagggtcaaaaccaccgaaggacctaaagtgaacagttttgtaagttgagggatgtcatatatctggttttgcggttgggggacgattttgtaactcgatgacaagttgagggaccttcggtgtactttttccacaccgttatgccgttccagcccaacacgtctgtcataggttcatccaaaattccacaaatcatgctcacagcatcatactttttccacaccgttatgccgttccagcccaacacgtctgtcataggttcatccaaaattccacaaatcatgctcacagcatcataaacacatgacatccaaaattccacaaatcatgctcacagcatcatgatagattcagaaacacaagaagttttccttgagagagatgagagtgaaatatctatggctgcgttcggtagaagtagttcccaacccatctctctcgttttccgtgcgcacgcttttcaaactgctaaacggtgtgttttttaaaaaaagtttctatacgaaagttgctttaaaaattcatattaatccatttttcaaaaaaaattagcaaatactcaattaatcatgcaataatagatacttcgttttgcgtgccggggagg

SEQ ID NO: 68493 - DNA, 1840 bp, Oryza sativa
cttgtggaagggtcgacggcagcaatgtaggaatcgtagttagccagcagtttttcccgccggcgagcccctgcaaagttgcgcatttaccgtataaaggtcggtgtcagatgacaccgatgactttcggtaaaacctatgagaatttttacggtacaatatactatcattatatactaccaatatataaaagggtatattcggaacttaaaaaaaattgaataagggatttttagtaattcgtcagatctgatggggagcaggggcggatccaacgtgagtgcaggggggttcgagtccccctgcacccacaagatctatggatacccctggagcacccccttcaattttttcaccatgaatgataaattaaaggtccttatatggctggagattgaagaaactgtgtaattgagcactctcaattttttgtttctatatctgccccctgatggggagtaatcggtcttggatctcatcatgcatcgcgagcgcgattagattatggcgcgtgtggcggctgcatggtttgatgagcaacgagaagccgaggagacgctggacgcaggccccaagcattcgcggtggcctgtggcctgccttccggctgagcctcaccggccacggcaagaaactgcgacgagctgattcatagtgtacattgagcgatcttgttagttcaatgtagattctactcaaaattgttggctagtacggacaacgtgaggcaaataaatcaggtactgatttagtgctcttgggcttgtcttgcgttcagtaccagatcggcagatgaacatggaagttcataaaaccgactgtgtacattgcccttacaattttatactggaatctcattaagtggggaggagaatgaatctacaccattggatcatttatgctagcagtgtatactggcagtatagtgtaccgtctaaacataattagcatactatgacatcgataaatacgttatgacaccaacgaatcgattttctatatccgccaccactgcaaacctcacacaaacgctacagcgtaacaacgtgcttttctcgatgcattatatatatcccctctacttaaaggaaattacatgcaatgcgcgcgagcagcgcacgactgaactcctgctgtcctgcacttgccgcgcagacccacgactcaaaaaagaaaagatgccaccgcatgaactcggatacttaggcctatagctgtgcacatgaacgtgttcgtgcagatcctaagaaggatactgtggtacatagcgtgactcgcctgaaatatgtcaacaattctcagtacgggcccacctctgacggtccacaaactatgagccaaagtgctcaaggatgttcacagctttgatgaatccattgagagatcgtaacaggtgaagccaccggccgaggctcgtcccaggtatctagacacatgtgacgggccggcacccacacctaccagaaggatacctctgtcaggtgccagtgcaagcccatcacaggtgaccaaatacctgtgacgagcctcgcaattacgtctcgtttgaggtgagtataactcatatctaacgggcttaaaccctaacccgttggagttgtcttgtcgtctataaatacccccaaccactatatgtttttcatcccaatcctacgcactgttcacattttgggcgggagaataaggggggtgaatttttgttgcaagaaaacgtgtgataattatttgatgacgaatattatgtattttgtctgatacttgtcatcttattgtttgcagatggaccaaagttggatgtacggtattgatagttggtcccaagagtatagggatggggtcg

SEQ ID NO: 68494 - DNA, 1496 bp, Oryza sativa
aaaaaacatgaaagtggtaccaaatggactaattaacagtcctaatgacatattatagcgggtatgccgattgggtggtaaaaaagttgaggcacgtgaatttgatggtgaatagtctaaattctcactaaatcgttggtattttgaatagtagtttggctagtgtttagtttgctatcaaaatataccaataagacacataaattgctaaaatatttggcactatcaaatttacctatggtttggcattattaatattttggcatggtagcaaacaaaacaagtcctatgtctttggctgattgattagccgtgtatggctgactgattgattactagggtgtcctcgatgatcaccgtgcttaagctgctgtagcctgtagcagagggcgatcattgtcgctagtcagttcgtcatcagaaacgcggaggggagaatggacggacagcgttggatgcctcccctgggaggcaattaggcaaaagcttggcgtctcacgcgatgtttccgcgcacgctagcgtcttccggattggagtttgggctctcctgatttgttgttcttgttgtttttctttgatcaggtgtatttgagacgcctggtttacggcagagaggattgcttcaggaagcaaacccgggctgctgcctcacgccattgctttgcttcaagagggcgtatggtatctacgtagataaatcataaatggttgtatttatctcgtcgtaattaatgggtgaaattggaatctctacttgtttaggtacttcagctaaaagatggaaaaaattctttcgtaaaaaaaaatgatttacagaaatgcacagtacagcgtgtgttctagctacctgctttgagcctgaggcccccgttgttcggcttattgatggaataagacaaacggcatatttataaatgaaagataatttgtgaatagaaattttacatacgtgttcttagcgatttaaaattaaagactgaaaaataaacttcgataaaaaaaactcaaaattaacatcaaatttaaagttaaaaatttaaaaattagttgataagcataagcattagcgaagaaatgaggctgttaatcttacccccgcgtgcaggggagggacgttgtatggtcttgagctaggcatgctgaaaacgccagaaatcgagcttagctcctcatgatcatctgaaattgagctcgtgcagtgagggccacccatgtgcatgagagaagggtcgcgcatcccatcacctcccttcagagttgaaaatttcggtttatttccctttaaaaaaattcggttcaaaatattacaataagcaatcaaatatttatcaaatttgaatagcttgactatattaaaaaataaagaaaatctatgtaaatttcggacgaaatagtgtcagccgagagaaactccccgaaatgttgaaattggactacactgtggtgcaattgtaagtactagttttttcttttaaggaaagagtatttgaggtg

SEQ ID NO: 68495 - DNA, 547 bp, Oryza sativa
aactagccatgtaagcgacatggcagcgaaaaccaccgtccaaaccgccatgggacctatattgcgccggttttgacagttgtgggatccgttatatctatttttttggttgaaggaccaaaatcggattcgttgatcagttaagggacctcaagtgaacttattcctaaatgatatgaaaagaaggcaggcgacctatcctaaatatagaaacggcccatcccaaactcgcctccactcccactgacccacactcctcacctcacctcgccctccaaatcgcccacacccctggaaccccattccacccacccacgcgcagccgcagcgacgagaggagaaacgagagagagaaaaagaagaaagagaaaaatgctgcgccacgccgcccgccgcctggccaccacccgcgccgccgccgccgccggccgcagcagcagggcgctctcgacggcggaggtgccggccgaggcggccaccgactccgccttcgcggaggcgtggaagaaggtggcccccaacatcgaggcccccgacacgcccatgt

SEQ ID NO: 68496 - DNA, 17833 bp, Oryza sativa
gtttgaggcaaattcgagatctggaagctgggtttctctttacaaataacactaaccctaccatcaaatcaagaaaggaggctttgaacaaatagcttgattgaagtatgaagtggctcggtgggcgacgatgacgggcgagctccggcgagggcctgggggcctgagcgacgatgacgggcgagctccggcagcggcgagctctggtggtcgcgcgctggggcctgggggacgccgacgggccggcgctggtgggaggcggcgacggaggctggcggaggagggacggcggacggcaggcggcgctggcggtcgcgcggcgagggacggcaggccgcgcgcccgccggaggaggagggacggagggacggcaggcggcgctggcggtagcgcggcgagggcggtggcggcttaggtcgctggggggaggaggactggagccgactagtatacctggccaaatgggccgggccaaggcgtgccggcccgagcacggcagcactgtagccggcccaggaacggcacggcacgcccgctcgtgggccgtgccggcacgacccgttcagccgtgccgtgcttggcccgacgtctgagcccatgggccggtacggcaccgcacggttgccatcgggtcggcacgtcaacgccacatcagcaaaaccgccatccaaaaccgctgagggagtcaaattgcactagtttgaatagttcggggagtcatcctatccggttttacggttgagggtcacggattagattcgggtgacttttaagggagtcaaagtggacttttttccttttattaaatttaacattgaacatattttgataatatgtttattttatgttgaaaatgctagtatatttttttataaagttggtcaaacttggataaaaataaaagcaacttataaggacaagttcactgtacttctttgcttgataatactaagttcataaaactacatatacatgggcctccgcgtaatgacgctagcgtacacagaaaaatacaatcatcacatatataagcagcttcagcagtcagcatttcgcaacgtgcatactactagtactaagttactggtagctaaagctctgaaacaggctaatgctttcgtcgtcatcgtcctcttcagcttcagagattgcagtcagatcagatgacagatggtaaggctctactccaaggggttgctcatcatcacagaagaatggcttgggaggaacttggagatcatcgctgccaccttcaagcatctctatcacctcgctcatcgtcggtcgatcagatgacctcatctgaatgcaccgtaatccaacaacgcaaagctccttctccagctcatgcatgtcgacaatgtcagagatctcacatgtttctcgtcgagtcaactgcttgtacacccgggatggatagtatgcctgacttgagtttgctgcattcggatctgcatttcttcttcctccggccatttctagtagcagcatcccaaagctatacacatcagatttgcttgatatggtaccaaagctccgagagatcatctcaggagctatgtaacccactgttcctcgtgcagcgctcactgggacaaagctcttatctcttgggtacagcttggcaaggccaaaatcggcaacttttgggacaaagttatcatcaagaaggatgttgtgaggcttgatgtcaaagtgcagaatctgcatctcgcacccctgatgcaggtagttgatccctcttgcaatgcccaaagcgatctcattcagcttgtcccaggagaaacacttctctaatgagaagatgtatttatcaagagagccccgaggcatgtactcatagacgagcgctcttctcatttcttccgagcagaatccgaccagacgcactacattgatatggtggatccgaccgatggtggagacctcactaatgaattcatctccgttgcagttggagttaccggacaacatcttgatggcaacatgtacattgccggggagcagtacgcctttatatacagagccatagcctccttgtcctagcttgtctcgaaaatgggatgtgattgcaatgatgtcagtgtaggcgtacctcattggaccaatcatctgttgcatctggagaaacttctctaccgcatcgattgtgatccttgttttccagtacttgtgggcaaggaagatgaataccaccagcggcgccaacattaacctgaataaaactttgcagaaatgccaagagcccgagaagcagttttttttagatagtggaagggtacggaacaatataggctatagcattataggtgtgtatcactcaaaaagaatattagagctatgatgattaaatgaaggtaattcaagcgtaccaaaatagagcttgatgataacgatggcagatactatgataaccataagtgtcataaactttgtagagcttgatgataacgatggcagatactatgataaccataagtgtcataaactttgttgtgtaggcgtgaccagcaactctgcagcgtgtgaaatacagttcgctccagaaaatagcacgggctatattcggaatgcttgcgccggttatatgctcgttgaagtacctgcagatcacaccattttacaggatgggttaagcgaaggaaacgcgtctttctccatagacactacagaatttatgagggaaacaaaaaaaacagctcacacgagggtcgagagtattcatgccatacgtatttgagagcagactgaccttactgaattgttgaggcattccttggtgctgatatgatgattgaggtggtgtttggatccagggacttaactttagtccctgtttttagacactaatttagagtattaaatatagactacttacaaaactaattatataaatgaaagctaattcacgagacaaattttttaagcctaattaatccacaattagagaatgtttactgtagcatcacataggctaatcatggattagttaggctcaatagattcgtctcgcgaattagtccaagattatggatgagttttattaatagtctacgtttaatatttataattaatattcaaacatccgatgtgatagagacttaaaagttttagtcccatctaaacagggcctgagggaactatgatccattgggaatcgaacacgaaaccccttccctatgaatccaatgatatcagtataacttgcattttgtagctgtgagactgatatatgttgagtatcaaagggaatcatggacaagtatcgacaagaaggttgaagctctccaattgtacagccataaaactcgttgagataaacaaaagaattgttggtaggcaggcaagagacgggcctgtaccatggactagtagtatcttgtattggtctggaacaattcacaaagcatgcccaagcactgtctgaagaagtagccaaatcgagaaagccataagaatcagttgtagtacggtccaacagatcgtcagtactgtaaggagggtgatcggatggaggaagagggcagctgctatcatcatcctgcatggtggcgtcggtgaccaagaaggacagatcggtgtagttgatgctactcacgtagtatgttcttgtgttgatctgaatggtggccttgccagtgttgctgcaggacaggtcataccatggacggggagcagcaacgcaatcgcgcgaatcgccttgaagacggaaagggtaggatatgttgtgaagatcaccacaggaggaaggaggacagtagtggttgttgctttgccctcctccaacatctgctgcaacaagcaaagaagaagagatcactagagctgtctgcaaggtgtaggtaatactactgctactaatggagctcgccatggctgcaggggcctgcaggctgcagcttcaagacctggatgaatgacttatgacttatgaccgcgagtggacgaactgcagcagtagtactagtcaaagttggacggccacaccagtcgtccaggcacagatgagacacgctcctacacgaattattgggatattatatttgcgttaatggctcttcttcgcctccatgggtcagacagacagaaacgaatagtccagtcaagatgagctctgagcttgctcttgttgcaggaccctgcttgctgctgctgtcgtctctgcttctgcagctgcaggccacggcatgggaagacaaggatttctcagctactgcccgccgtcgcggtgcagcgagcatggccccgagatcaggttccctttccaacttgaatccaacaatactacaccatcctcatgtagcgtaccatgcatgaagctagcatgctccggccaagacaccatcttagatagcagatactcgtaccttggaagcccatacaaggtgaccgccatagattacaagcatactaccctcaccatcatccctatcggagacttggattcatgtccgcttctaaattctgtaccacttccttctcagccactccattatcattatcacggtgcaaactggagctcttgcgacatatacaattggggttctgcagccctagtaagctgttctcaagagttgacacaaactgatatcccttccactcatattgctggcccaatctcttgcctgtccaccaactcaactcacttctcctatttggtggcttatgatgtgcctacgtgtcttattccaatccagtgcgaggtcatctcagatggccccattccgataccatatttttactctggccatgcctcgctcaccttcaggcaaagtgcagaaagaatcctcaattttgctgacacgacggtctattggagatccttcgcaaacccagccgcttacaattgctcacagtgtgaacaacaaggccgacgctgcgcatacagctcacaaagaaatcaaacattctgcatgcgtcgaggtatttttttcaaacccggtaaatccctttacagcaggcaccgtctttttcctgcaagttttacaattttcagtttacaatccactcatatgaatgctaactagtagtatctgattgtcaatagccagcaaaacacacatgagcgtcacatacacttcatcttaattccaaacgtggttgctcaaaatgtagaggctaaataaaaagctttaccaacctcatcgtaagatcactggcatggcggcattcacttctgggagcccatcatcgagttacaacttacaacaagatttatggctgccatccttcttgtactggaggtgcaatatatagtagtgtcaagggcgtcaaggcccctggtagctggaccgcggctacgtaattcgtagccggaatccgtcttctccggcgaggttttacccctcagccgtaggttcaggtttgggagagagaagaggagattaggtgagtgattcttgattttttctccacagtgccgaatacaagactcaaaaatagtccacagactgaatcgaacatgcctacaattaaggaagaaacaaggaaactaatcccttctttctaatcttagccactcccggtggcttcctcagctgtgcgctgggcgcgctctgtagcgcggcgcacgtcacgcgcgcgacggcgtctcgcgtacgtgcggccccacatgacatctcccccctcatcgagagccagctcgtccccgagctggaagtcggggtacttggcgatgaaagcgtcggcgtcttcccacgtcgccgaagctggggactctcccttccattggatcagcagctggcgcacaccacgtgcgaggcgcgtcttgacggctcgttccggctccgggaccacggcaccatggtgaacagcaggcaggggcggtggagcatccggcggggagccatggaacttcttgaggaggccgatgtggaaaacgtcgtgcagacgagctcggggtggcagagcgaggcgaaccgcgacgtcgttgatgagctcggtgatgcggtagggcccgtagaagcggggcctcagcttgccggcgacggtctgtggcagtgaagatgccgcgcgctgcctgaggcgtagtagggcccagtcacccacctggtacgtgacatggcgatgtgccttgtcatagtggcgcttctgggtcgcctgtgcttgttcaaggcggctgcgaatgtcagcgaggaacttatcccgctcttccatggtcttggcgacggcggccaccctggtgtctccgggctcatatgaccggatggatgggggatcgcggccgtagacgacgcggaacggtgtgtcccgcagtgacgtttggtaggcggtgttgaagacgtactccgcccacggaagccactggagccactgccgcggtcgatcaccagtgaggcaccgcaggtacatgacaatgacgcggttggcggactctgactgcccatctgactgtgggtgaaaggccgtcgtcatgtgcaacttggtacccaccaaccacatcagctcgcgccagaagtgggaggtgaaaaccgtgtcccggtccgacacgatggactgtggcatgccatggaggcgaacgatgtcggcgaagaaggcctgggcgacggtctccgcggagtacgggtgagacagggggatgaagtggcagtacttgctgaacctgtccaccaccgtcagaatgactgacttgccccggacgcgtggtagcgcctcgacgaagtctagggcgatgtccgtccagactccttgtggcacgggcagcggtagaagaaggccagccggatgtagatgctccgacttgtagcgctggcacgtagggcatgcccgcaccaaatcctgcacgagctgtttcatgttaggaaaatgaaaatcacgccgcagccggtgcagcgtgcgctggacgccttcgtgtccttcctcgtggacagccgccatgagctccggcagcagaggcgaggccgggggaatgtacagccgcccgctgtactggatcatcccgtccacggccgcccacggcagagcttgggagcccgaggtgagctcttcatgcatggcgacgagggccgggtcagtggtttgcgcgtggcggagcctgtcgacgaagtcaaagcgtggggccgagagcgccaagatggtgccatcctccggtgtgtcccggcgcgacagcgcgtccgctacggcattggcatgtcccggcttgtactcgacggtgaagtcgaacccgagaagcttccccacccagtgatgctgaggaatcgtcgcgagcctctgatcgagcaggtacttgaggctgtagtggtcggtcttgacgacgaagcggcgcccccacaagtacggccgccagtgacgtacagcgtgcacgaagccgatcagctcacgctcgtatgctgcgagcgcgcgatggcggggtgccaccggcctactgaagaaggcaacagggtggctgtcctggacgagcaccgctccgaagccatgagacgaagcgtcgcattcgacgatgaagggcttggagaagtccggcatggcgagcaccggggcggtggtgactgctgccttgagcgcgtcgaacgccgttgcggcctcccctgaccaggagaaactatctttcttgaggagggcggtgaggggcgcggcgatggcgccgtagttgtgcacaaacttgcggtagtagcccgccaagccgaggaagctgcggactgcgcgcgccgagcgtggcgccggccaatcccgcacagcctgcaccttggccgggtccatggcgacgcccgcctcagagatgacgtggccgaggtacgcgacggacgcgctggcgaaggcgcacttggcgcgcttgaggaagagctggtgccgctgaagctcgctgaggacggcgcggatgtggcgcagatgatccgcccaggtcttgctgtaaattagtatatcatcaaaaaacacaagaacgaaacggcgaaggaacggccgaagtacgtcgttcatcagagcctggaacgtcaccggggcattgcacagcccgaacggcatgacgaggaactcgtagaggccgtcgtgggtatggaacgcggtcttgtgaacgtcggccggccgcatccgcacctggtggtacccggagcggagatctagcttggtgaagaagcgcgccccgtggagctcatcgagcagctcgtcgatgacggggatcggaaacgcatccttgaccgtgagcgcgttgagggcgcggtagtcgacgcaaaagcgccacgatccgtccggcttcttgacgaggaggaccggggacgagaacgcggagtcgctgcggcggacaatgccttgctcgattatggcggcacattgcagctccaattcatccttgtgagccgccaggtaacgataggggcggacggccactggcagcgcacccggctttaagacgatgctgtggtcccgagcgcgctgtggtggcagaccggatggctcgcgaagaccccttcgaaagaggccagcagcccatcgagaaggacctccgaggctgctatgacggcgacagtcggctccgggcgcgccgccacgtcggaccagcgaacctccatgccgtggcgcgagaacgacatggtgcgcgccgtgaagtcccatgttatcggccccagggtaaccatccattgggttcccagaacgagatcgtatcccgccaacggcatgacgaagaggtccacgtggaactcctctccatcgatggtgatcggcgcctgtcggagcacgcccgggcactggatcttctcgccattggccactgtggccgtgaggcgcggcttgggctggatggccaggttggtgcggcgcgccgcctcctcggcgatgaaattgtgggtggagctggtgtcgaggagggcggtgagggtgaccgcgcccagcatcacccggacttgcatcgtgtcgcagatcgggactcctgcgaccgcctgcaaagagaagacaggggcctccccatcttggtccgcgtccaacgcggcgtcctcggcgtcggtgagcgtcacgccgtcgatgtagaagatgcggcggcagacccggttatggccacgggagtacttttcgtcgcaattgtagcacagcccgaggcggcgacgttccgcctgctcctcctgggagaggcgtttcaccggtttggcctccatcttggccacgggtgcgctcgccggcggtgcagggagcgcgaggcgctggggcagtgccggcagcaggccgcggggcgctggccgggcgggaactggagccggcttgtcgagctccatcaactcaacttgacgggccaggctcatggcggccgcgagcgactgcgggttgtgaatccgcacagcgtgactcagcggcggaaggagtccccccgtgaatagctggaccagctgggcttcctgcagtggaccggcgcgtggtaggagcgcctggaagctgttctggtactccttgacggtacccgtgcgccggcactcggcgagctcgaacagcggcgctgagcgcaggggcggtccaaagcgcaggtggaggaggtccttgaagcgattccatctgggagtaccctcgtcctcctggagttggatataccacaattgggccacgtcctccaggttgtatgaagccatccatactttctcctcctccatgatgcgttgttgatggaaataagattcacatctgttgacgaagatcaggggatcggtcgtgccatcatagcggggaaagtccatcttctggaactgttggcaacttttttgacaagttgacaagcacgatcgcagcaccttaagctttgcggtgatcctagagtcgccaaccacctcgatctagcaaagagctaaacctagatgggttttgataactaaaccggctaatggagccgatttctagataactacccgtctcgtgggcaagacggaaggttttcaggacaaacctacaaagagatgttgcactctcgcagcggcggcggacggtttacggcgcaaaccgacaaagatggacaaactaagagaaaactaaaagcaatatgaaaagaacgattcgattgattgatagtagattgttttttacaatgaaccggccttgtcccttatataggggttggtcttgccctctacaggcccttctccacgtccaactcggggtagaaaccaaaggaaacccgaaacatgccttcccgagcaaggaaacctcgaaacccgacgcaacagaatcggacttgggcctgccggtcaaaccggccacataccgccggtctgaccggccttcaaccggcggtctgaccgcccaacacacggcagtcagactggcctacctcgaaggaaaccggtagacttccaaattttggcaatatttcctattttaagcctaggtgccaaatttgggtgtaaacacatgcccccctgcctttttgatgaacgacgtgaatctaaaagcatagaacatgtttttggtcttaggacgataatccaattaccggccatagtacctcctaagcgtcttgccaaacactcgggaagtatttctttaagtatttcccattgattgctcgctgaaaacgctccccttgtagtgtctccaaaaagtatgcgttccctcgaacaacgccgcaaactcgataaggaccctcccaactaggagaccacttaccgaactccttagatcgagtacctaaaggcaaaattgtcttccaaaccaagtctccaacttgaaacaattttgctttcactctcttgttgtacgctttggccaccctcttcttctctttctctatctcttccaatgccttcaagcgcttgtcggtgacttcatcaaggttgtctcccataaacgtctcgtaatcttcacttgacaaatcatcttgcttgatataacgaagagaaccaagatttacctccaccggtaaaacggcttcttgaccataaaccaactcaaaaggagtgactttagtggcaccatgtttatatatcctatgtgcccacaatgcttcagaaagcacctcatgccacctcttcgggtgttcctcaatcttcttttttactagctttaacaatgtcttattactcgactcggcttgtccattagcctgagcgtagtaaggagaagaactcaacaatttaatgccataagattcggtaaaactcttcacttccttagacataaaagaagcgccttggtccgtagttaatgtttgcggaataccgaatctatgaataatatgcttcaaaataaagtcaattacctccgtatgagtcatattcttcaaaggtacggcttcggcccacttggtgaagtaatccgtagcgactagcacgaacctatgcccctttgatgacgaaggataaatttgaccaatgaaatctaaagcccatcctcggaacggctatggtttgattataggattcaacacggcggcgggcaccaattgaacattgccgaaccgttgacaagcctcgcatcctctataatatttgaagcaatcatcaatcatcctcggccaataaaaccccgctcttctaagcaaccaattcatcttgtgggccgatttatgagttccacaaattccttcatgtacttctcccatagccactttagattgatctttatctaagcacttcaacaagacaccatctatgtttcggcgatacaaatctccttccacaaattccttcatgtatttctcccatagccactttagattgatctttatctaagtacttcaacaagacaccatctatgtttcgacgatacaaatctccatcaagcaatgtatatttgaatgcttgccgccgaatttttcgatcaaccttaaatgtgggatctttcaaatattgaatcaaaggaattctcgaatcctcttctgtatcctggacacaaacgtccgaattcacaattaattcggcttcaaaattacttgaaacgtgccccccagcattctgcctagaaccggtcagaccggccacacagggccggtcagaccgctcagggatgccggtcagaccggcggcatgtggccggtcagaccgcccctggtcacggtcagaccggccgtgcaacgtcggtcagaccgcctctggtccccaactttgccaattttgcgcaaaaatttaaaatcaagcaccggctcttctaatatcagaaataaccccctttttacattataaccagatgtttgttgtgccaagtcatttgctctagaattatcacacctagcaatatgtctaatagcaaaattatcaaaattggcaataatatctaaacatgaatcgaggtacctatttagtgatccatccaagcacttgtagatcccggcgacttgttgcaccaccaattccgaatcaccaaaggcctccacatatttagctccaaccatctccatcacttgtaagccgaacaataaagcattgtattcggcttgattatttgtgcaataatattccaaacgaaccgatgcctcataacacatgccattaggtgaaatcaaaactacccctttgccttgaccttctttgcaagaagaaccatcaaaataaatcttccaaggtataacttcaactaagcaaacctctccctcataagcaacatctatatgatggtccactataaaatcacatacaatttggccttttatagttttcaatggttcataagccaaatcatattctatcaaagcatatgcccacttaccaattctcccacttagaattggcctttgcaacatgtgtttaataacatcggcttgacaagtaactatgcatgtactagataacaaataatgcctcaatttggtacaagcatagtataagcatagacaaagtatctctataaaaacatacctcgtttcagcatccaaaagacggcggctcaaatatgtaatgatatattccttgccatcttcctcttgcgtcaaaacggcaccaatgactttgtcctcggaggcaacatataaccgaaaaggctttccggctttaggcgctcgcacaacgggtggagtagataaatacctcttcaactcttcaaacgtctctttttgttttgccccccaagtaaaatcggcttcttttttcaagcgaagtataggaacaaaagcatcgattttacccgctaggttagaaataaacctcctcaaataattcaccttacctagcaacttttggacctctttcttgcatgtcggcgctttgaaatcatgaattttttctatcttcttaggatcaatctcaactcctctctcatgcaccatgaatcctaagaacttccccgccgacacaccaaaagcacatttaagtgggttcatcttcaaaccataccggcgcatcctctcaaaagctaatctcaaatcggctatatggccttccataccatccgatttgacaacaatatcatcaatatagatctctaagataatacctagcaaatcatgaaagatcaaattcattgccctttgatacgttgcaccggcattcttcaacccaaaggtcatgacaacccactcaaataaaccaacaaaccccgggcacctaaaagccgtcttgtacatatcctcttccgccataaagatttgattgtagccgacattaccatctaaaaagctaatcaccttatgacccaaggcatcattaatcatcaggtcagctataggcataggatactcatctttaggagtggctttatttaaatatctaaaatctatgcaaactctaattttaccactccccttcttctccactgggactatgctagaaacccactccgcataacgacatggcctaataaaccccgcctttaataaccgatcaatctcctctttgactcggtcatataataaaggattaaaacgacgaagtggttgcttataaggcctaaaacccggtttaactggaagccgatgctcaacaagctcacggctaagacccggcatctcatggtactcccatgcaaagcaatcaacatactctttaagtagctcgattaccttaaccttataatcggctttcatgtttttctgtacaaaagtcggccttggtttagttccatcacctatatctacttcttccaatggatcggccgatgtaaacccttgtccaagcttctcaacttcatcaaaatcttcaacagtttcaccaatatcgttctttgtagaccgatattcttgcaccctcttttgtaaccactctaaactagcctctttactcattatacaaatttatatggcttagccgtgctacactagccggctttacagagataggtacaaatttgccatcggagatactaataaaatcataactagaaagatccctccccgataagcattggatattcccatgacgccactcaaacgtagcatcggccattgcaacttcggccgatgtatccgcttgaacaatttcaacatcatcgccgtcccattgaattaaacattgatgcaaggtagaaggcacacaacaatttgcatgaatccaacaacgacccaaaataacattgtagttaccttgcacatcgacgatgaagaaagcggttggtagcgtcttatttcccacggtgagctccgccgaaaaaatacccctcgcctccgttggttcaccattgaatccattgagaatcatgttggtcttcttcaactcatcaccctcacgccccaacttcttgaatagcgaatacggcatcaagttcacggcggcacctccatccactagcatcctagagaccggcttcccatcaacatggcctttgagatagagaggcttcatgtgacggtttgattcatcgggtttctcaaaaaccgcgtctttaggacctaataagaattgggcaacctcggcttcatccatagcacaaaactccatagacaacatacacaccatgttgatatccatgtcctcctttggagacgatttaccttcatcaacctattgtccttccttctcctcttcatcaatcggttttgccttctctatggatttaggcctccatactggtggtggtcgcaactcattgaaccttttatcccttttctcttcggcctttttctcccttaattcttgggcccgaagacgttgcaaccttctcttttgtgtagccgtcaaatccttaggcatccacctaggattcggctctgttccaggaggtaaataatgtcctttattaaccttgtttgaagacgatgaagcccttacatcggcttttgcaactctcccgtcaaaccggcgctggaaaccggtcagaccggcagcagaccgccggtcagaccggccatatgcgccggttagatcgacgttagacacacggtcagaccggcctgaggcgtcggtcagaccgtcgtcagatcggcggtcagaccggccagatggcccggtcggaccggcaacatggccgcggtcagaccggccagaaggcctggtcagaccggccgactgcgaggagctagaaccggcttcggactttttacttggggactttccaactccatcttcggaaggtataggcacatcatgggatcctatcttgatggtaatcacctccgaagtcctctcttctatcttgacgcgctttccttccctcttctcttcattaacccgatttttaccataaaatcggcttttgtttggtgaagataaacgctcatgaattggcctccgtggtcctccccatccttggttgaatctcattggcggcatatgattgtacattggcggcgttgccccccctggcataaagtaaggataaggataacccggcggcggcattggataaggaccccatgacatgtcttgtggatgaaaatatggaggtgaacatgaccgtcttggcgaatgaccaaatcgctccctaggaggtgatcttggtcttttccctttgttgtgatccctctcaccaccttgcctctcatacttttccaaaagcatatcaaaagtcactttggtctttctaggggccttagaagtcgaagcttcacccttattctccttccaaacgccaatctcctgcttctttggcaccatcatcttaggccttggctcaccaatgaccactttctttcccttggtagattcggcttgctccggccgaatcaacaccttcttattattgaaattaattgtattcaccggaaaaggatcatgatcaaacttcatcttggagccatcggtgaatttcaatcgtccctcatctatggccgattgaacctgtcgtcgaaacacattgcaatcattagtagagtgagaatgagaattatgccatttacaatatgctcgacgcttcttgagaaggtatgacatggcctttaggtaatctaatttgcttctcttgcaaaagataatcaaaatcttatcacacttagccacatcaaaactatatttaacctcactttgccgatctttacgaagagtcggcattaagttagaacaaacaaaaggtttatttttgttagtccatgaccattcggcaacataaatatcatgatcaccctcctcctcactatcactagcatcagagtaatcaactgcattaacattaggatttttgtctaatggtctagcaaattttttattatctttaacctggctttcttgagccagagccctttacataagttgactaacatcaagaaattgttggccatctagtttttctctaagaggagcaactaaaccattaaaagcaagaccggccaaatctctatcagttatattcaaagtataacatcggtttctaacatctctaaatctcttaatatagtcaacaacagattcattatacttttgcttaaccgatgttaaatcacataacctaagctcagtttctccagtatagaaataatcatgaaattgttcctctaattgagaccaagtatgaatagaatttgccggtaaagaagtaaaccatgtaaaagcattaccggataaagataaagaaaacaagcgcaatttaaaagtatcactattagcctcaccacattgcgctaaaaattgacctacatgttcccatgtggtcttaccatcttcaccactaaatttggaaaattcgggaactctataatttctaggaaacgacacattatcataataatcgggatatggctttttgtaagctctagcacgattcctagtttcgatcccgaatctattcctcataatatcactaatcatatcctccatgttattaggcccttgtggatttggtggtgggtttggtggcctaataggttgagtttgtgacgcaatatgattatattggccttgcctagtatcgggaggatatcccctagaaacatcattataaacgttagaaatatgtgggggaatttgaggattagtggtagcagtagatacaggaggatcaaatgttctaaagtgatacaaataactagcattagtcattggatcaattccctgtatcgggacgattgcgccggtctgaccggctcagggcccggtctgaccggcgtcatgttgcgcggtcggaccggcctgagggccggtctgaccggtgggataatacccggtctgaccggccatctggccggtcggaccaacggctgtgtcgctgtctgaccggccatcaggcccggtcggaccggccgtgaacgccgctccgtcggttttagaccctattggatctatgggagattgactaacagtggtataggctttatcttttaatgtgtaatcatccataagagaacctagcctattccttaaaaacccatcaaccttttccttaaacattacatctaatctatctttaaaattaaccatagatgaatctattgtagatgcaatttgttggttgatagattgcgatacctcgtcattacttaccatgtcgggagcgagtttgggacgtggcccgggcttgatgatcacgccttgacgagtcctagtagttgctctcatcaacg

SEQ ID NO: 68497 - DNA, 4686 bp, Oryza sativa
ggctcgattacgtgtcttggagatcatcttgccgcgattttatctccttaccttgtttgtttttaggcttgttgctttgcttgcttgatggatttccgtcttatgtggttcatattatccaatacatgtttgatgttaggatatggggcttgaaggaactcatgttgttcatattatccaaaacttgtttgatgttaggatatgatgggactgtcagtgtgcttggcagctggacattagtaatcactgaattattgccattttgccaacttgctgcgtcatattactggagtcccacactgtaagttgcagaatcctttcagtttccacaaactagcatgccaaagatagtaatccgctcaaggtcgacgcttgtaaactcttatcgtttggagcagggaaattttcctatttcttgcaagaaatgaattacttcacaccatttgtagcagtgattcttttccctacttcttgtaaactctttagtttggagcagggaaattttcctatttcttgcaagaaatgaattacttcacaccatttgtagcagtgattcttttccctacttcttgcaagaaatgaacgacttcgtgtgaagttcatgtgaaattcgccaggcaagtttttagaggggagaccaaagacgtgaaggcaccaatgttttgtgacacaagagatatgtgtagattgcaaatcaataggcaaacttagctcctttataaaattcccaacaaacataaggttagggatctaccagaaagcaaaatctgccgacgtagaccctaaacacaaccgtggagtaattactcgtgcaattaacttagcttaatctccctctaggctctagtagtttcagtttcagtagtactgtagttttttcaccagctgaatctgacccacagcagcaacgaaccagagcgcaagaacacaacgcatttctgcgttttttttttggctggaaatggatatattccccaagcgtgacaacaacttttgagtgccagtgtgtgtgtgttcccctcccctccctgcttaattacatcatctctaacgtaaatgattcgtgatcttcaacgggaggaaaatgacgctctcttcgacctccagagcggttttcctcccgagacaaaaagcacaaatccaaagctccccaaaaggctgtacaaaatggcaaaaagaagaaaaaaaaaagggagatcgaatgatcccacatcggaatccgacctcgaggcgacggtgtatatgagcgtctgaccgtgctagctccggagcgcgaccgcggcctcgtgcacgagcgagccggtggcctgcgcgacgccgtgcgcggcgctctcggtggcctcccgcggcgagccagactcggacatgcggcggacgaaggcgacgaaccggcgccagttgtccgggtggaagaggtcgggccccatccggaggtaggtgaaggcgaccatccggtcctccgccgcgcggtcggcggcggcggcgaccacctggtcgtgcgccgtgccgtcgtaccgcggcagcgcgttctccccggtgagcccgacgcccgccgcgcgcgccgcggtggacacctgcctgacgagcgcctcgggcatgcactgcgcctcctgcggctgctcgtggtcgcgcatctccacgcaggtgaagttgagcacggcgccgtggcgcgccagcatgcgcgcgatcgggaggtagccgtcgcggtgccgcgtgttgtagtaccccgccgtgagctccggcgcgtgcgaccgcgtgccgtagtgccagtggatgccggccaccttgaccgagatcttggcgccggcgccgttgccgaacacggacgtcgcgcccgacagcacgcgctcgccgtgctccagcagcatctgcgaataccacgacaggaagaactcgccgtactcggtgctccacccgccgcagtcgccgcggaagaacaccgtgtcttccggccagttgttgtagccgccggcgtccgtcggcccgccgtggccccactccggcttgcccctcgcctccgccgccgccttcaggctgctacgcatgtactgcaccacaggacgtcaaaatttatccagataagagtttttctcgaatccatgacgacccaaatggagtttttgctcgtcggagattagttaccctgtcgttgcattggaaggcgccgatgccggggaacctccaggtgccgttgctctccgggtaggacgggtaccgaagctcgccggcggggcccatgccgacttggatttcctgcacaaggagacgcacggatgatcagcgtcgtcgtcgccgccggcgaaacggcaacgatatcaaaagagtccttcctcctacttacgacgatggtgtcgccgaggaaggaggcgaagtggtcgcggaaggcgcgcatgaagtcggtgtagcactcgacgggcgtgcggcccttgaagacgggcatggcgtcgcagccgagggagatgtactcgaagttgcggcgtccccattggtcggtgtaggcgaggtcgttgtccttctccatctgcttcaccacccacctcgggagcgggatgctgcacgccacaccaacaacaagaagaggttagaggagaaggatgagatagatgatcgaggaaggagacgagagatgcgtacttgacggagtcgccgacgttgccgccgcactggtggaaggacatgacggcctggaccttgaggccggtcttgcgggccatctgcatgagctccacgtagccgtcgaagttgtaccgggcggagccctcgatcttcacgatgccccaccacacgtgcaccatgatctccttcacgccggcgctcttcagcgccgacaggctcgccaccaccgccttacttcggttcagcgcgctcccgcacttgctcaccgtgtccagcggcatcatcacgaacaccggcacgctcgatcttctgctgatcgccgacgccgactgcacgtgcctggacaccgcccggaacgccaccaggtagcacgcctgctgcctcttaattctcaggctcgtcgtggccgacgacgacgacgacgggatggcgaccaccgaagcagctcgccgttcatcaccggcggtcgcgaagcacgctgccggcgcggcgctctgagccaagttcaagggcatcgtgtagaaaatcttaacccgaaaatcgaatccccaacaaaacgcgggaaacaaagaagtgatcaacagatgaaccaccccaaaaggaaattgttttttttttcttttttgggatcgacacagccttgatccgaacagaactgggagagatcggattattgggaggttggggattgggaatatatctaaagcccaaaaaaaaaaactaaaattattaaaaataattattcaatgtggggtggaggtcgatgaggaggaggagccgagcgcgaacaagtttatataggcgggcgggagctctcgagagagtgccacgtggctggtgtgaagggaggaaacgagtggtcgagatgaggccggggccgcggcgatggacgggcgggattgtcggagcacgtggcggttgtggattgggctacgtggactggcgagagctagtctcgcggcggagacgcggagtggccgtttttaaccgtttcctcctatgtgggattttagctcgttttttcctactctcccggtgattcgaagaacctaattaccgtggtttcatcggttatttctttttttcgcgaagaatatgttgatttcttctgaattatctagctctcacttgctgaagatttgattcgagtagcaggatgattaagctcaatctagaccactcgaagggaacggaatgattgatcagcgaatctacgagtgtctaaaattctcagatcagggacagattgctgctgctacagcacgtactccggattgagaacaagattcagaaaatctgaacaacacgttgcattcattggagccatggaaacgatgaaccaatcaatcagagtaaggttctgggaggagctgcagattgggagcctgaaactcagccgcgtggaagcccgcccgggaggagagggagaggaccagattgttcagatacatcgccatcgtcgtcgtcgcatgttcagactgttctagaatctgaatctgaactccatttcatacttgcccctgctctccccccatgcggtcctgatggaaagatcgaaggctatagtttgggcaagacgacgagatcttgcagaaggccaatttatgggtttttttttttactttattcacccagcaggttcagtgatatcacgaaccacaaagccatttacaaattctgggagagggtctattttggtttgatgccaaaatgtggtctactaaatcgggagaatatagactatttaccattaaattcgcgtgccttaactttttttaccacccaatccgcatacccctttataatatatcattaggactgctaattagtctatttggtaccactttcaggttttttactgtgtttctcatttcttaattccatttgcatattttttcaagatttgtggacgtttttgcccctaggcccacccgtcagaaccaaagagagatatttctctctagatcgatcgatccctccagtcttgtcaccgtgagcaccaacctcgccgccgggcacggcaaaccccgccgccgagcacccccactccgccgcccaatagccgccgca

SEQ ID NO: 68498 - DNA, 644 bp, Oryza sativa
atagtaaaactctagcaggtattttatctccccaatctataataaatgggcctaactgacacattatcacataagtagcaggaccatcattactgatcaaacgaaatccctatagatgatacatatgaaactgtatttttagcatccactaatagtttttttaacctcttcagcaaacaagcttcactatactttcttagtttagctgattaactcctgcaacaaaagtcattacaaaaaagcacgggagatgtaaaattagaagagggagaaagggaagagtctaacaatcttctaaggtaccataaaccaaaagtttttaccctctggggatttattccagcagcagcaacatatagatccaactttccaatggcaataccaataccatgcaccccgagatcacccaggcccaatatcctgcttccatcagtcactactatcatgtcaacctgcaaaggaacggacatattttatttactttgagattatatgacattttttttcttgagagatgttcaaaaatcaaaagcaaaaggtagactgtcttatgctctgagatagcgttactgaattataccactaaagattaaaccaatgaaagagctcagctgctaaatgtaaaatcagtaactggatgaaca

SEQ ID NO: 68499 - DNA, 13946 bp, Oryza sativa
gagacggcggcgccggcgaggtgttcggcagaatgccactgcggcggccggcaccaaggcaaaggctgaggagtttttttttttcttcctcacgatttttttttaaaaaaatgcaaagaaaattggcagcggtgcttaaattttttttaaaaaaagataatccgagcatgtgtttaattgatttggcacaaactattgacttttgaaatgaacatcattattatgtgcttcctccgtcatataatataagggattttgactttttcttacactatttgaccactcgtcttattctaaaaatttgtgcaaatataaaaaagaaaaattgtgcttaaagtattttggataataaagtaagtcacaaataaaataaataataattctaaatgtttttaaataagacgaatggtcaaacaatataagcaaaaagtcaaaatcccttatattatggaacggaggaaataccaacactacatgtttgtcttattgaccaaagtctaagctgtgaattataaaccactctaataattcttttgtatatgctaaaaaatgaaaataaaactaaaaccattgaagtaaaagaatgacacgttcacttaaaagtaataaaggaataaagtaaatactttacgtattggttacttctctatagctctataacccatttgagaaaaatatattttacagatctaaaaattaagataagatacacaaatgaaagtctaaaaatttatatattatagatctaattgcgtttgatttgctcaggtcatctcgactaaaatttttactctctacgattaaatctaagagtaaaaagatttactcaagataatatggataaatcttaaacacccatttacatatctagaagtagttttcggatttacaatatatgtatatatgtatagtttgcatcatatattttcctcatttaggatgagcctcatcggccaacatattatacgttttgtgttgagttaaaaagagaccggatgcttataaaagctactaaggatgaaaaaaataactaaaaacataaaaaagcagtagagtggctgccgctacaagcctacaaccaatgatatgctactatggttgccgaatatgatcctttttactatggttggtgcccaaactatgagctcacggaattttcatcactactccttccattctaaaatatgaacacttctggcatttaaaatttacactaaaatataaatacttcaagcgctatttagagtattttctccaccgattatatccctctcaaatatgttcttatggtttcttaaaaaaatatatgttcttatgttgaatcctaatcattatgtcatttcataaatctatcaaaatattttctacttaagcataaattctactcccttcgtttttaaaatataacaacttaataacaaattcaacaatcttactactacggatgagattacaaaaaaaaatagattttagaacagatgaagtattgtattaatataaatttcttaccctcaaaaacttgtcgatccttctctattagtacaaccagcagcctacatttctagatgagtaaagtccatcaccggtccctaaacttgtaccgctgtgtcatcccggtccctaaactcgtaaaatcgaccattcagatcctcagacttgttcgactgtatcatcccagtccctaaacttacagatcactcgtttaggtcctccaacttgttcagttgtgttaccccggtccctaaacaggacggtctaaaaattttatatcaaaaaataattcataactttttcatgtgaactctaatgaagacaatctttatatcaaaattgtagctctagacgtgacctacaactttatagttgaaaagtttttgaattaaaactgtttagggtcccaaaatattggtgcatgtttatatattttgaaattttaattttaaaattacattttgggacaaaaaatgacttaaaataaaaaaaatcaactacaaagttgtagatcgcgtccaggactgtaagtttgatataaagtttatcttcattagaattcacatgaaaaagttataaattatttttaaatataaagcttttagacagttctatttgacccagatgatattcaaatacaagtttagggactggggtgacacaactgaataagttagagtatttaaacgagtgatctgcaaatttagggaccaggataatactgtcgaacaagtttgagaacctgaacagtcgatttgctagtttagggaccgagatgatacaacggtggaccggtgatggactttactctttctatattctaactgctcctaattgattatgcaactacaccatcttttatattggattctcggatgatattcatcctaatatccaatatccactcattagcagtttagcaccgagactttgagattaggccaagtcaaagcggatccatctgctcatcccggaaatgaatccaaccctctaaacccggaaaccctaaaccctctaagagcacgaatgcacgatgccatttccactcggtaaaaaaaaaagaaaaaaagaaaaaaaaaagagcaaagcaaagcaacggcttttcgcccatcggaaaaccaagcacgacgacgtataaaatccacgtttttgagcgcgagaaattaatttctctcggtattttcttctttcttctctctatactccagtactccaccctccaggagcagttagcttctccccctgctttctgctcctgacgcgagagcaagaagaagaaaaggccatggcggagaagagggcttcttcttgaggtgaggttggttgctcgcttctcttctcttctcttcctcctgctgccgattcggttggcgattttgctcgagacttttttttttcttcttctttgttgcgagtcttcgcgccgctttaatcgggagagcatttggagtctgacttggcttccactcgcgcgcggtttaatccccttttttttttctatttttttcttcacttctgatgatgatttcgtgctcttctccctcatcacgatttcttggcttgcaggcagctgcttcgctttcctcaccccccaaatcgcgccagaattcgatcttttccggcggcggctggtggagcgcaagatcgcgctgcgcgtttgatgggcaaggcgtgttcttggtggagtttcttgggagccgcctctcgtcctggatccgtggcggccggcgacatcctgggccggggagggtttctcggatccggttcttgctaatccgatcggaatccgagcggatggggtcagcgatggatgtggtggacatcagctccgacgaggagggcttcgccgcggcggcggtggcggtggcgacgacgaccaagaaggcgtccgtcgactccctcgggtggattgcggaccttcttagagaggaggatgagagggctttgtcggatgagttccatgatctggaggtgatgagtgagctgtcggcgccgccggtgatggcgcagcacaaggggggcaagcccgattgcgtcggcgaggaagacgacgatgattgcgtggtgctggatggggatcctgatgatgttgtcgctgtcgcggggtataaagggagtgagggagatggcagctcggatgaattgcagatcgtcgcagagaaaggcccggtattttggcttaattgcttattactaaaattttgatctgtatttattgcattctgtgcatgaaataggaacagctcaattgttatgtttgtaggctatgtatatagagatgaaatgttctcgtaattgggggaaactgttcgtaataagtcattttgttatgatctgaactttgaattactatattgttctgatttcatttgaaggcttatttactcattgcatagtttagtttgatctcctttgttcagtgatgtggaattcagattcaaatacattggatagcgtggaagtggtttgatttaagtgcatgtgtttctttccccatctgtacttgcctatttgtctatgaatacatgtacctctagttcatgtcacttgtaataacgaaatgataaatttcatgctagctttttaacagaaaccacagtgtggagtggacatgtagtagcattcatttcttttgttattttccttaactagtagttgtctatttatccacaggtagcatgcagggacttccctcattcccgccatttatgttctaacttgcccttcagcaccacttctcatgtgaagtattgtagcatggtaagtaagaaataattttccctccagtgaatctactagaggagcagcttatagattttgttttgacacgatttccatgttcgcttttcaaatgcagtgccactgttttgtatgtgacactccagccccatgcaattattggggtaagggcaccgagatttatgatcattgtcatgctacagataaggaaaaaaagtggaaagcaatgagacatacattcaagagcaaaggtctgccaacatctcatccagaaaagcgccagaatgtcgtatacccaacaacaacgtcatttgtacagcaagatacacagtgcgaaatttcactcatacaatcgcatatgactacttactttcccaaccaaagtcatcttgcgaatgttgtgaaccaggggttaactcaaacaagacatacatcagtaagagtctcaccgagtgtagggagaactgtcagtgcaacaagaacaactcctgcaacaagggctggaagaggtatgagcaatgctcccagcattcagattcctcaatcacgcacaagattcaaacgagtaggggctacttctccaggcatagtaactctaaatgataaccagtttggttctgctgctccgaacaatacccagttgcaccagccatcctcgccacatgcatcccagccagctcaagttgcaccaagaacattgtttggtactgttcagaaaaatccccctcagagatcgctaagtgccccaatagcgcttcaagggcaacaagatcagtcggcgtcgtcctatcaggctgcctcaaacggaacacacggtacaggaccacaattttctcggtgcatttctcttacggctcagagaacacaattactgcctgaaccagcattggatgtttacagcaaaagctggcaagacataattgatagtctggcatctgatctggaggtaccagattacaatatgggcgctgcagagtctcagcagccagacaggactatttctcaacctcttgattccattacattccagggggtaggtcttcacagtgagcctgttgtggcattggcgaacttgatgccttgtaatgggcagaatgtggccaatggcatgataggcagcaattgtcttgcacaaacaacacaaattttgcctcacctcaatcaccagcctagccttgttcccaatgaatcccatcttaataattcagtaagttccactgcggacggattactaatggaagctgctcatcagagagacacgcaaggatcggattctctagatcttctatttgactttgagtttgaggattgggattcagcagagccctgacaaacaacctccgcatttttgaaccccaaggacaataaaatctggcgtcaccgacaagctggttcgttagcttccttcctaggaagaggaagagatgttccttgtacattctgtaggttcagtggtagaaatgttttttttttccttccatgggtgcttgtttacagtagcggctatacaggccttctaggccttagattagcagttatcgctctgaagttttagggatgaagttcaattcccaaactgttgttgatcatatatctatgggccataactccataatcctatatctatggtccataactccataatccaattgccagaatgcatgtttcaggtagcatagcactgaagcaaaatcttctgagcactggtgtggattggctctagtaactgctgatccagcgaagcaatgtatagtttttgcttgataatggcaaagagtgatctgctcttgaaaagccttaagctttccttgcaatgtgaaatttgtgttacaaatagctgagttggctatgcagaataccaaggcaaggaggaagaaaccaatgcttgcgttgttctacctccattgaggtaaaaatctttccttttcctcttatcgtagagatttgtcatttatatgacatgagttactccggctataaatatttgataaaattaagtcaaaaatttgaaattgtgaccgtcaataatttttctccaatacttattagttactttgaaaagtactgccataatatcataaacttatttaaatgtaaaaccgatggccaaagttttaaaagtgtaatcgaatctcattctaaactcaaatactccatttatgaccagttaaccacagggagagtacacaattccttttgttaagagtcagtaataaaatcagcatgtagaggggataataatttctttggtggccccacttgtcaggaagggtcgaaggcgtagtgcatgtccacggcggcggcgatgtgccaggtgcaccgtgtgcccttggggaagacgacgatgtcgccggcgccgaactcgacgcgccgcccattctccggcgagccctccgccgccgacgccgccgccgtcgccgtcgccgtcaccttccctctcacgatgtagcacgtctgccgcgcgccgtagctcagcgccatcctccccggaccaccgccccacctacaacacaagtacatatatacggtacaatacgtgtattttgtacaccgtataaaatacgcgtatgatgtatcggagggagatttatacttgggccaggacctggcgccgagctctgacaggcgagactccggcgggctcctctcgacggcgatgccgccgccggcggccaccgtgcacggcggcggcggcgacgagctcgaagccatggacaatggacgatgcagtggtttggattcgccaggtctctcggagaagttgcaatctcttgccggaaacaagacatagtagcatactttccgacgacttgctgctgtcgtggaccgcacctcgacatgtcggcagcggccgccggcggcggcggtggcagaggacatgtcggccgcagcctgcaggtggcgcttggtcagccacgttgaccggctgccagctggctgatgacgtggcgacgcagcactgggcataaataaatgtgtatgatgctgatgccgttgatttttcgcatagcatttggccatttgttttatttgaaaatttagtataaatatataaaagtataagttaagattatattttatttgatgataaaatatgtgctaacaaaataaataacattcatataatttttagtaagacaaatggttaaacattacgtcaaaagtcaacaatgtcatacattaaaaaaaacgagaaaattgacattttaccatcatcaaaaaggggtttcgcccaaataccactatgcaattgggattcaccaaaataccattctcaattgaggggcttcacccatatgccattttcttccaattctctctttcctctcatcattattgaccaaaatggccctagttgaatcaatttaagtatatcaaaatacgtagattataaagtaaatacgctaaaatatttttacatgctatttttttcttacacagtatgcatcgtattatatccataacataaaaaaaaagacactatcaacggaaactctcataaaaaatacgtaattatttttttatttatgctgtggagatagtgtcttatactctgtaatttggtgtaaagaaaaaaatatattgcatgtcaagatatttggacgatatgtactttgtctgtaatctacatatttgctttacttgaattaattcaactaggggcattttggtcagcaaagatgaaaggaaagagagaattggaagaaaatggtgtttcggcgaagcccctcaattgagaatgatattttggcgaatcccaactgcatagtggtatttgggcgaaacctgttttgacgatggtattatgccaattttctcgatttttgtagttgttaacctttgctatgaaaaatctgaactttgacaacggttattcaacccattcattcaactgaaagtccttaaattcagcagggagctgaagacttttgtttctgattggttttgttaaaccaaacataatgctctagaacttcaaatgatagctccaagggaagaaatcacaagtccaatccttgacctggtagtctatgactctatgttacaaagagatcaccatgtcccaacctgtcgacttttgaacaatagctgaagcatggatcttttttttttttgaaagtagaaacatggatcatttattcaatgacaatcttttttttgtccctcgcaatttcgacaaggtctaacacaggtacttagtcaggcgtggatcggattgccatggtaggccagatcgtgcgccgattgctctacatttgatgcctgcctgaagcatgaacaggaaatatcccaatcaaggtaagaagtgaagaacaaaaaaactagtagtatttttgtttcatttctgtaaatgaaggaagttgttataccacttggcaagcaaaaggcagcatcttttctggaggcatctctgtggatagtcctaagtatattcaatagaggaaacattgaggtcacaataaataattaatgataggcgatagctaactggattttaatatttagttaaaacaaaaatacttgaatagcatcatatatataagaatcatattcttgagcaaagaagtagtaatcttaataactgtttatgtcgaattcccgtctcctcagggagacataatgaagaaagtaaatagttattctggaagaagttaatggctcaccatgaagtactgctcctatgaatgcatcaccacaaccagttgtatcaacaagctctgaagctggaatactttctgctgttcctatgagcagccttgcaaatatattcccagaccctcttgcagtaagtctcatgaactagaaagtaaaatggaaaaaggttaggtaaagcagtaaaagagatccaaagcagtcatcaaattactcacatttctgatgacataacaatgtaaacgattttgattgccagaaatatctcataccttagatgatacacaagttggcaggatatcatctttatctactttcagccttaaggactcagcgacattctctatatctactggctcagtttcataattttcacctatttaagagtggaactgcagataaataggttgaagtcacaaaggcaaaacttatacacaaactttatccagcatgtaattaaaattgtctggacaagatcaaaactaaccatctttgcccctctcaagcatcatgcatccattttctccaagggttacaactgcgaagcatgcacgaggatattgcagaaggatttctagtagtgcagagggaatagatgggactgatgtccatttctgtaggtaaagagtcactgtaaatagtgagtgggaaaaaaaactaatgcagctttactaaagcatgccttttaaaaccattcatgcctgtcaaaatgtatcacaaacctctggaaatttcccattacagactatgtaacttgctaggctgagcaaacctcccaattcttcccttgttctttctggttcggcatcaaccaaaataggaatcttcatctgatcagcctgtacatttctggttttaatcaagcaacaaatcaaaatatgatctaattctctacaggtttatgatactgttactgtaaaacaaaggtcatttacattattgaaatttacctagacagtactaactactaagatgtatgaagattggacaacctagactacatggtgaaagcattacatgatacatgaatggattaatgttgcacactccaaacgaacttacctgcttagcaactgccaaggccatctcatctgaatatccatctaagtatagtaagcttacgtcttgcagtgcagctgacaaacttgacattctcaagtcactaggtatcattggagggtaccctgatgtgattatacacgtacgagtttttctgcaaatgtaaatggcccttctatgaatatgcacagaaacttgctatgatgccagaaagtgttattgtaaaaaagcaataattgagtaagtgtggctaaataaccatattgcttagacaagcttaacagcttcaaccatataaaggatgttcagtaaccagcaaaccaaaaaagtagtgaccaaacatcaaaatggtcaagtataaagggtcagttggagggtaaaatttttatccttatttacatgtatctactaaatgcatatatgccctatttccatgcatttttttcctttatctgatctagatgcccagtcctttagaataactgagcgaacggtgtacgcgccgaaagggaagtttataatgaagtgagaaccatgatttataaaagcaccttgtttttatatataaaaaggtaagtcaggttactctaatataaataggtgtaacaaaactaaaaattggttgaacttcattcgaaatgtacctgattgagtgtgcaaggtgaccagaaaattcatttggaatatttcagaaatgcttatcattacaacctaggagcatgcctttaattgttccatttacatgtattgctacatgaagatacaaactagttctcttatcgtaatgatgcaaaagaaatattcttacgtttgcttatcaataatgacatatacaaatgttgtgtttccaccatcagaaatctgcaaagcagaatcatcaaaacaatgaggtataagataacatggaagaaagtccagtgcattgatagtaccccaatatctttcactgtgcatctttcttttgttaatccttgacattttggttaccaatttattgtaccttactaccttctcgatgtacacatgattacttgcattgcagcgcttgatgaacaaagatgcagaaattatatatttgtaaaccaagccttactataacatgagatatatcaatcccagcttccttaagctccgaaagaacggttcctccaatttcatcgtttgccacctgatgaaaaaaaaaagagaacatcagcacttcagcagggttgtacttgtaactaggcaatgctgtacaaatagatgactcaatttgacaattcagtaaatgctgcactgtaaatgctaatttcaaaatgactctaaattcaatttaccttggagatgagcctcgtgttgaggcccaggcgggcggctcctgtcagcgcgttcccggcgttgccacctccagacacctgcaacaatggcgaaacaccaagaaatcgccaggagcgaaacgtcaatcttttccccatgtttcttggtgaagaactaaagaagtggggggtttggtttggtgtggtgtgtcacctgcagctcgccgctgcggatcttgtcgtcgggccgcgggtacgcgtccaccgtggcgaggtagtccagcgtcaccagcccgcaacccagctgcaagaagaagaacacctcacgccaggagtcaggtcaggtcagaccaaccaaaggcagcgggagagcagagggcgcaaatcacagtagctcaccacgacgcggcctgcggcggcggggagcagcggccggcgccccggcggcgcagcggagaggagggagccgctgcggcggcgcgggagcagaggcggtgacgccgccggcgagcatcggaggaggagcggcatggtgagagcgagtgattaccgctcgctgctgccggtggagccgacgagagttgtttggtgggtagttggatggatcatggatggctcccgttgtcattgtcgcgtcgtcacctctgattgcgtcattccatttccatggattgctcgatcagttcagacattttcgagttgaagaaaaagtttagaaactttcacctcaaagaggggagaattccatctcaaagaaagaatttccgaaactttcagtgcctgtaatttttatttaccggcatccaaatcccaagaactgatgttcttatcagtgaagtttgcagacctatcttagacatgcatggttcttagaaaaactgaacacatatgtcgaaaattttttgggactcttgcctttttaatttcaagtaggattgagctaacaatgatgccagtacagcaacaaaaaaatgcaaatatatttctttcacaccctcaagttcactttataacttaaaaacacacaaagaaaggaaagaagagccctcacatttgcaactttattctgcagaaaagcccctcatttggatcgcacagaaagaatggctgagagccagacgaagacgaacagctcatgggccttaattcgggatgtactatagactttgtttcatggaccataaaaggcccacattgcgagcccagcccaactccgccacggcaagacgcaaacctaagcctaaaccgcaactataaaatgcagcactatctccaaaccctcgcgaaccctagcgccgcacacacgctcaccccacctcttcacccgccgccgccgccgccgccgcgcgaagggaagcaggagtaggagccgccaggatgccggcgggccacgggctgcgtgcgcggacgcgcgacctgttcgcgcggccgtcaggaagaaggggtacatcccgctcaccacctacctcggcacctacaagatcggcgagcacgtcgacgtcaaggtgatcggcgccgtgcacaaggggatgccgcacaagttctaccacggccgcaccggccgtgtctggaacgtcaccaagcgcgccatcggcgtcgagatcaacaagcaggtataacccccgatccccaaacaccccggcggcggcgccgcctctttgtcatagatctgtggttgtgtcgcttaagtgacttggtgtcatgtttttgccccaagtgactttggaatcatgtagtttagttgtgccaatatgaaatttcatttttgcagttgcaggaatgggaagccattgcatactcttgcatggttgtgtaagatctgataaatagtgtagtctagatggtttactggttatatttactggtaacatttgtgcgattttactttgtgctttagtatttggattttgttttctctttaaatgtattgagaatgttgtgtactgaagtagagctattgtgattgtggctttggttcatttcatttctaggtttccattcgtccaagtaggatagtggcaaatcaatcctcaagtttacgtcgattgtattgttatcggttatgtggaaagtttaaccgtttggttttatgatgtagttatgagaagtgcatttaaagatatacttctgattgttcatttaatcctgtgtgcatgtgtagttatatgtttcaatcatataacatgctaccgtctaaacacattctgttggtgtagataaattggatagatatgtagttagctgtcggcatgtgtaatgttcagtcatgtggatatgtagtcttcgggattatttaatttttgaaatcatgtatctgttttactgattgtttgttaatctcttggtaggttgggaaccgcattatcaggaataggatccatgtccgtgtggagcatgtgcagccatccaggtgcactgaggagttccgcctgaggaagatcaagaacgaccagctcaaggcagatgccaaggctcgtggtgaggtcatcagcacgaagaggcagccgcagggtcctaagcccggcttcatggttgagggtgcaacactggagactgtcacccccatcccgtacgatgtggtcaatgatctcaagggtggttactaggattttcaatctatctgcctgcgctaccaattctatatccctgtcactctaatgagtaaaagtttgctcgctctgagcattattagtctgcacctttgttctg

SEQ ID NO: 68500 - DNA, 28189 bp, Oryza sativa
acgttgcaagtaaaaacttaaaattccttatactataggacggagggagtagcattcacttccctccgtccttacgtctgcggattacgcacgtgagaactgcgggggaatcaccggcgtccggcgtaagcctaacctcctgccgtgaggtgattttatttcgttcaagtttaaatacttttatatttaaattttttttatattattacattgaatatatgtacgcactctgatggagaaactatctttgatcggtcggtcaaaatccacaatagtcaggttgcaataaaaaactgctggttaagtttagagctatttattttaagtaaatttcacaaaactacaggtatttttcacaatttatcacaaaaatacatatttaagatcttgttttattaaactatagatttagtgtctactttatcacaaaactacaggtactttatataatctatcacaaaactacatatttaagaatttatttcacaaaactatagatttagtgtattcgtctatcccagaactacacatttagtgtcttcttttatcacaaaactataggtttagtgtctccattatcacaaaactacaggttttaacaacgctaaaacatatagttttgtgataaatgaagatattaaatatgtagttttgtgatatattgtgcaaagtgcctgtagttttgtgataaacgtagacactaaatctatagttttcttaaacaagcttttaaatatgtagttttgtgatagatcgtacaaactatatgtagttttatgaaatttactcttttttttatctttagtctcggttggtgttaaaagatctttattacagcaatcgagactaaagatctatttctagtcccggttggtaacatcaaccgaaacaaaagatcggcatgcgcggcgaagagtacaaggcatgtgcaagatcgaggaggagacgggtggccttatctcttcctctctaaccttatctcttcctcttccttctctccttttaactcctctcctcctttccctcccccatcatccccactatgatggatgagccgggcggccgggcagcgcggagggccgggcggccggaggcctcgcggcggcgggcggcgtgggagcaggcttttttttcttttttttagaatttatgattcggatctgtgtatttgatttgtgtgtgatgtgaatatgtgatgtattgtgatgaattttgtagaagttgtgatgtaattttttttaagattttgtgatgtatttggatatggccgatttggggatttgaggatttggggataatttatttgggattttgggatggggatggagtgaaattaatatattaaaaacacaatgaagaaaagaaaaaaaataatatatcaactggatctagctagcctagctctatctttagtaacaataaatggatttttactcctggttaattcactcgggactaaagatagtattctttagtcctgaattcgtagtggaaagttttccaaccgagactacaaagggttacgaaccgtgactaaaattccaatcgagactacgaagggttacgaaccgggactaaaaagcacttctccaccagtggaacactctctctgtcaaaaaaaaaaaaaagagacaaccctatgtccatatttaatgtactaggagggggtgagggggtgttttttttttttaaaggacggagggagttactgttagcacttgctagttactgttagcacctgcgcgtgtaatatttgcagagcacacataaatgtgttgttctcacgtgcgtaatccgcggacgtaaggcgtattagatttttacacggtatctaacatcatttattaattcctacaaaactgatattatgttaaaatacattgaaatagttctattccgattctatagtttttaacatgcggaaatgtagtactcatttaagtagtactagtagtcaacattttaatctataatactccatccgtttctaaatatttgacgccgttgacttttttattaaaaaaaattaagttattattaattcttttcctatcatttgattcattgttaaatatacttatatgtatacatatagtttttcatatttcataaaagtttttaataagacgaacgatcaaatatgtgctaaaagcctaaaagtcaacgattttggccgaaattttcgtttttctcaaattttaaaatatttgactaaaatatagtttttcatatttcataaaagtttttgaataagacgaacggtcaaatatatgctaaaagcctaaaagccaatatctcggccgaaattttcggtttctcaatttttgtgaatttagtcaaaatttggtcaagttcaattaaattgtccaaatttcagaaaatttcggcctaaaaatgggtgaaaatttcgccgaaatcgaaattggaaaccctggctaggggatgtactgattaatcgcaatattttttttttcaaaatttagttatcagcaacattaatttgaaatacctacagggcaacagactcccgcttcagttaaagagtgatggctgaaaccaagatccatgcaaacaagcaagcataagttgccatgacgaaatgcatcaaaacagacatcagaaatgagcaaacggcacaacgcaatactgccggtaactgtgttaaaacgtcatcctccaacaccgcagaagctcccgggcatgcatctgtcactattccgtccaatgttggcgagaacactatggctgacaataatggtgttagacaggaattgtcagacaaggaatccgacaccagaaggttacctctgctgctgcgggaatgctctctcatttcttgaaaggcgtgttcaatcaccaccaagaaggttactatattattctttttctatttctcctgttggggttgattctggcatccactgcaacatggctcgctcgtaagcacttcgcccaggcagttgcccttcttgcacttgtttcacaggttcttgtggctggtttgatcgcgtccacattttcataacaaaggctgaaggactctgcgatttgctcattcatttaggggtagaattgtggtatatgacatcatttaccacgcatgtctccacaaatacgatggtgtgcatactttagttggtacaaagggtatgatcgagttatacttccaatgtaaaaaaaaaaagagagggatagaatagtatattataaaatttacttgctgtgatactaaaatattgattaataaaatgttgctatcagtttgtcccaatgatctgcttggcaatttcagtaatgcattgttctcagttctcagtactaagtatcccaatttataggatgctcttatttttggaaaaaataaactcggtagttttaactaataattacttaagcgatatctacatcatttgatttgtatttaaaaatattttgaggtgatattttatagtcgttgatgacatgatatgaaataaagtaatggttaaaatatatcataaaagatcgtgtaaaaatataaaagccttgtaatttaggacagagggagtactgacgtgtaagtgtaagacaaatttattttgttaaaaatctatcaaattgaagtcaaatttgtcaatttgattcaaatttatcaaattgaaaccaaatatattaaacttgtatcaaatgtgaaagatatgtcaaaaggtttgaatatatgcatgttttgatgtaacagggccaataaaaaagcaagggtaaaagggactatttgctccttagttaacactgttaactcctcttaacggaatatggctagcctttatcttcgattttggaaaatagggtcaaataagcaaactataaaaagtagggtcagattagtgggtcagattagtgttagactccaaaacatggtcaaataagcaatttccccggaaaaaaatgttgcctgcaacgctttgtacatacaatcagatgtttacatgaacaaattttaactatcactagaacataggcatattaggctgcgtacgttcgagtgtgcacatgtttatcctgctaaagtgctaatcaacttctaccgtgttctttttataccaaatggatgaataattcagggtagttattcaattgtacaaatgaattgattaactaataataaaaaaattgaacataaatttataataatattctaagaaatttatttatagaatttttatcaataaaaatcacatatttaggagtttagaaaacatggacaatattcatccgatatttaatacaagccaaaaaaaaagaaaaaagaacaccatatcaaacaaaatttcaatgaccatatatatataccatcatccataacagtttgcatataccatcatccataaccgaacgcactcttagagttataaacaactaaggtatacagcattaaataaagaaaaaactagttcaataatttttttagatgtataagatactagtgccttccaacggatagcagacagatcgcaatgttcccagaaatactactcagatagacatagtacgcatatcatctatcaatttaatcaaatgagattaagaagggagtttttttttttgatctcatgtgaaaaccctttttgttttattataagctttaagttagcattgcaatctgaagtccaaaacaataaccttaccaaaactatgcacgagagattgtttattctttggacccaaaccacacatcataatcaaattagtactgtcacaagatggttagtattatatagaagattcgaacagtggcagggtaaatagtaaaatagctttagaaacaggttccaaatagtctacggatcgacataattatattcatttgcatttgcatgtgtacgaaagaaaaacttgtacatctcaagcgtcaacactacacaaaaggcaaaaggggccaacgtcaataccctgaggcacgaggtggggccacgaggttggatggcccacatgtcggtgacggtgagtggattaccctgaggcactagtactacgagtactacttactgctactgctaccggtgagactaaccccctcaaaacgcaataaatagcgctgagagtacggcagagacgctcagagtactcccccacgtagtcgtctacggagtactcttcacttacgggggaatcgtcggcgtaagcctaacgccctaaccctgccgagctgactttattgtgtttaagtttaactacttttatatttaaattttataactatttattaattacaaatttatttatttattacatttattaatacatgcacatatatacatgcctagctagccaactgcgtgcgtagtcctaatctcacttagatttttacacgacatataacatcatactgtaatcaccgactaatatattatcgataatttacatatatacttaacttcatacaaatctaacgatactactacatacgtggcactaaataaaatacacactctctcattttttttagaatactataaaataaactatggccactactccactagttattactagtagtagttacttaacctattttattaattcctacaaaactgatatattatattaaaatacattgaagtaattattctattccgattctagtcttgtagtatttcaaaaagtttacaaaatgtcgtcagctgatatttttaagttaaaaatgtagtataatgttagaacttgaaaattgtattttgggacggttagtatcagacctgacactgacaaatatatactgtatctctttaatccaacgattcattgatctcctccattctcaaggtcttagctagggaagtaattttgtcccttagctattcaactcaatacatttgtcagttcttccccagcagtgagccgacggccgagctccacgaacaagcagctacggacggcggcggcagcgcctcctccggcgaggtagcgggattggcggatccgggtaaggccttgttcgatttgaatggaattgaaaaggattggagatgattgaatgtgaataattccacaccatgataggtgtggaataaatcccctccaatccctccctcgtgaggattaaccgaacaaggcatgggagggtaggggcgaggagaaccagtcacatgcactgggattagagggggatcgatggcgacgaggcggcggcggtgttggtttgcagggacaagaaaaatagagtggttagacttagaattaacttagaagacggcatgggaggagatcgaggtggtgtgggggatcaagcaggggcgaagctaagtagtgttatgggggttcctaggcacccggctgcaaaagaaaaattagtgcttaatacccctttgtaaccatatgtgcacccccctcagctaagcttggtgtacccccacgctagaaatcaggccattgaagcacgaacggtacaaccacaaccacgataggagcccaattcagtcctgcttgccgcatcaccgtgaggacgtacgcacacgcacgcctcttctctttctttttttctttttggcgactcgctcttcctctttgtccctaccagtgccgacgcctcttgccgctaatgccacaattaatcctcgcctcttaccgccaatgccacaattaatcctggataactaatcgacgcctcagcaagatgatgggatgtcaccgaggctgggcacaggcaattccttgcctcctctatcttatgttctttttactaattctttaccagtcaatgcattcattcgaatagctccttcacttttcaattacgcgataatagctctgtttttttccagatcgaatggttatggttagtgcagtttttatctttgcttctttgttagtgcactccactgttatcgctgatgataacaacacgcaaaaatattataatttactataatattgctttaaaaaatatataaactactctctctgttcaaaaatataagaagttttaaagttggacacgattattaaaaaagttcagatgagtagtaaatgtaggtaggaaaagtgattggttgataaaagaatattgatggataaattgttatatatcttgcgataaattctaaaggctaaaaattgttatattctccccccccccattcttctctagctccgcccctgggatcaagcaccatggagaagaaacatggcttccgcgttggatcgagcacgacaggagagggaagaagaacatgcgatgatcggttgaggggcgttggatgcaaatccaatggctgctagctgtccggaagcccgggtcttccaaagctgaggtttttctattctccattgggccaaaaaaaaataaggaggagagattctttttttaatcaatggcgcaaaccctttttgttaaaagaaaaatggctcaagggattcattccctttccttttcttccctcttcatgcatactatgccacacggatggttttggtgttcacttcctactatggtactataagaaatgggtttagtcactagaatctgagcaatttaattagttttttttaaatgctttcattgtgtgtgttctgacctaatacctccgtttcagattataaaactttctagtattgcccacattcatatatatatattaatgaatctaggcacacatgaatgtctagattcattaacatatatatgaatgtgggtaatgctagaaagtcttataatatgaaacggaggaaatatctaacaaaatttgatcatacctcctaggggaccgatcgattaatcatagtggcggatccagaaaattgattcattggtgtcataatgtgtctattagtatcatagtatgctaattatacttatatcatggtgttataatatatggataaacagtttttgctatagattttatcaaaagtccttgctgtcgcctgacaccgaccattacattgtagatccacccctgattaatcacaatatattattcttttcaaaaaaaaattacatttggaagtaccaattagtcgtaatcaaacaacaccctgcatcctcagcaacatttggtcttgttttgcattacctacagggcaacagactcctacttcagttaaagagtgatggctgaaaccaagataatccatgcaaccaagcaagcagaagttgccgtgacgaaattcatcgaatcagacatcagaaatgagcaaacatcacaacgcaatattgccggtaacagtgttaaaacgtcatcctccaacaccatcgaagctcccgggcatgtggttgtcactaattcgtccgatgctggacaggacactatggttaacaataatgttgccggtaactatgttttactgccattatccaacagaactgaagctcccaggcatgtgattgtcaccatttcgctcgatgctggccagaacacagtggttgacgacaatggtgttagacagggattaacagacgaggaatccgatactaaaacgaagctgttggaaagaggtgttctgactgctgcctctgctactgcagcaatgctctctcctttcctgagaggagtgttcaatcaccaccaagaaggttactatattattcctgttctatttctagtgttggggttgattctggcatccactgccacatggctcgctcgtaggcactccgccaaggtcaggggcggatctacagttataagaccggtgtcaggcgacaccgacgacttttaacaaaacctatagcgaaactgtttattcatatgctacaacaccataatctaagtataattagcatactatgacaccaatagatgtgttctgacactaacgaatcgattttctagatccgccactggccaaggtggttgtccttcttgccctagttccacaggttcttgtggctggtgtgattacctctacatggtcttgacgaaggccttggccatgactcttgcggaactttggaagcatcattgatagatggtggaatcgtgagtgcatagatagggtccagggttacaattatacatgtgtatctgtgtgtaggtgattcagatggcctccttggttcttcccgacgtatctgtgtgttggtgagatgttttttttttcctttgagaaatgaaatatattcttttagaggtattgtacttaattaatttgtccgcaaaattgaagagcggacgtttcctttagataggcccaaatgccagcccaagcacgtgtttggggccgtatccaaattccaatacgaaaaagtacaccgaaggtccctcaacttgtcatcgggataaaaaaggttctcgaaccgcaaaaccagaaatacgaatacgagattccttacctatacaaaacctgggttttgacgccggttttggtttatgtggcggctgagttagcgtgggacccacatggtccccatatgtcaggtgtccacctcaccctatctctttcccctttctctttccttcctgatctctctctagcggatgaggagcggcgtcggcggccggcaggcgagcgcgcggcggccggcggatggggagcggcggccagtaggcggtggtggcggaggcggaggttgtggaggtggcagccccctagcggcgggtatggtggtcgtcggcgttggcgtgccccgcgcccgctcatcccaacggatcctctcctcctcgtcggcgtcgtcgtccccctctttcccgccggatcccgccgtggcgcggtggccggcgtcctcctcctccgccgccgccgcatcgacggtgcgtccagggagcgcccggcgccgtggagttcctcgtgtccgtcgtcaaggagcgcgcctccgtgggcgtggacgacgcaacgtcggccaagccactgggttcttcccaggaagagatgacgtgcggcgtgcatgatcccgcgaaggcgagctctgagcatcctccggcgtgcatgatccagataatcagacaagccattccatgtgttggaaaagaaaaacataatatcttgaccctgctaattccatctagctggatcaatcatttgtcctgtttattcatgcgaactcgatcctcaacaaacgtgcagaaataaccgctaaagatcctaacagatctgtctgaccaagtagctgtcgcttttgagaaagttcagtacatcacaaacgcaagtttggcctgtgctactgcttcagatttctcaatgaaggagagatcaggctgcaatgcatcaagagaattcagatgcacacatgcaatggttgatcactgcattaatcaaccggtcattcctcctgaaatggcacatggtgatgagattcagcagcacacatcatcgtcagttgatttctgggtcaaaatgggcaccgtggaggagttttcttcgatctgaacatccttttttttctcctcgtttgacattgctgcagtgtctcgccggacgaggcggctctgagcatcctgcattcgcttaagctctccgaggagagcttcaagagggtcttggagggcagcggcggtgaagatttcttggaaaccttggcgtgcgtgctgcggcggccgagctacctctcgcggatgcagggaatccacctgttgaaatcggcgctcccggctatgcccccgcgcggctgacatcggtgagcgccgtgctggtcgacgttgtggtgggggtggtggcggagaaggataaaattatagcgagggctaaatcaaaatggccaagagcaactatgagagatttagggttgggttaggactttttggccttcttagccttttgggtcttctaacaacctcaaaaaagggcctgttcactttgatgccattttcaacattaccaaattttgttaatgttgccaaaaaagtggctacatttagtttactgtcaaattttagtaactatataagaaatcatgccaaaattttagcaagttaccaaaatttggtaagttttttttttgcatcaaagtgaacatgcccaaagtctatattagcctctcatctataaatatatggattagaattttagggtgggtataatggaggctctaatggtattttagggggacccccccctcccccccacgctgtctccgcccctgcggacaggccgtcggcgaaggcggtcaaggtggcgctccacgtgctctgccggctttgcccttggagccgaaaccgcgtcaaggcggtcgacgtcggcgccgtgtcggcgctcgtgcacctcctcctcaacgagggctgcggcggcgacaggcgcgcctgcgagctcgccgtcatggctatcgaccacatctgcggttgcgcggaggggcacttggcactggtggcgcacccgacggggctcgcggcggtggcgtgcgcggcgacgcggctgtccaccgcgggcaccgagagcgctatgcgcgcgctgcacgtcgtggcgacgcacacggcgacgtcggcggtgctgcaggagatgctggccgtcggcgtgggggcgaggctgttcttcctggtgcaagtcggcgcctccggcaagcggacgagggcgaggtggaccacgagacggtccaggagctgccgtcgccggccgcaccatccttcggccgcgcgcgccgccgtgggtgccctagcgctggtatccccatgccctgcgagtgtgagagcagagagcgaggaaggaaggagagaaacagagaaagaaaaagggaaaagagatagggtgaggtggacacctgacatgtagggttcacgtgggtctcacgctgactcagccaccacgtagatcaaaaccggggtcaaaaccaccgaaggatctcgggtgaccgattttatatagttaagggacctcgtatgtctggttttggggttcgaggatgttttttatcagatgacaagttgagggaccttcagtgtactttttccattccaatacgtaactgggctactcgggccagatgggctaataataaatctgcaatggaataggtctatttttgcctccctcaactcttgcccctaattgaatcgtgtatctcaaccgtgatactgggtataaagcctcctccattatccaaaaacagcttaggaacttaatttgctccagttttcgtagatgaagagagcgtatatgtgatattgagattcaacaagggcaaggttttaagggaagctaaatcctaaccgttcttttttttctccaatttttgaattttttttggggggatatggagggtggaaccggttgcattagtaggctattttgaaaaaaaacttctcgtgtttgcacggaatatcagatatttctatcatcacgttgtattttttatgtataacccctcgtcttccaggaaaatacaacgcgaagaagagaaaattccgcttttaggggtagcgctgtaaacatgaaaaccatagggtttttttacaaaacgtcctacactaaacaaccaccccctccccctcccccaatcctgaaaccctcctcccattctctccctttcctctcctcccctcccctctcccaccttttctctctcggcatggattccggtcagaacaagcggtggctgcgcagagggtggaaccagtggcagatcccctccctcttcctagatccggtggagggcggaggcggcgtggagggtggatgcggcagcggctccgtcgggagggagaggtcggtggcggcggcgaccctcccctccgaatctagcgcggtggctacgcctgcggctggatccacagccgccgttagatctggcgaccgaaaaagatggcgcggtggaggaggatgaccgcgataggcgctggtgacggagtggcgtaggccgatgggtgcggcaccatcttcaccttcatcgtctgccgcccttgcacgggacatcgcgtgcacgtcggcgtcagtgcgcccctcgccccttctccttcccctcgcggcgatgtcgaagccggcgccagtgcccctacccctttttctcccttccctagcggcgacgttgggtcggaggcagcgtcggtgtcgcccccccctccctccgctcacggtggcgtcggggcgggtggtgcgttggtgcgtcggagccgacgccggtggccccggtctactttgagtgctccatcgacgtcgtgtcctacaattgcgctgcctactccagttgatataataatacaaaatatcgtatgagctgacatataaattatcagggactgaaatataaatatactaaggggtggtctctattttaggtagtgtggctttttttttatcctactagtaataagcccgtgctaacgctacgacgatatttggcaatacaaaccaaacaatacaaaaagataatatttttttaaaggattagatatattcaagattgattgaaaaaaggaacaacataaagttatattggtattgattatatagcttgtgtctaaaatataggaattttgtttatcattcgaagccatttaaattgttgtgctaaataaattcatatgtaactacagaaattccatttttagataaattcccattgtgttccaataagtgaatgaatagcaaatagttcatgtaacagaaaattaatgcatggtttcaaatgacagagaaacatagcacggacatctcataaaaaaagagtaaattgtacattgtatatatttttattttaagtttcatctttgtaccttcccacggacaatcttttcacttgtgaccatcttttataacaaagactcgtgaccgtatgggagacaaattaatgctctcgtgtttaccactactttggccaaaagtgcaacttttggtaaagatacagagttgaatgagaatcttaagttaactctagtccaatgtgaaacattaaggaaaaaattagtccaatctgaaatttactaaaaaaaacacggttatatacagtagtgcaatttatatcacaactcagtcaatcaaaatctaccaattttagaatctcgtgctatacatgacatttgagaaaaaaaggtcaaaacacaagtcatgttatgctaagtgtaccaatagtgtcattatgtgtttgctttgtacagaaatctttcacacaacgaacggccaccaaaatatttcatgtcgtgcccttctctctcgctttagctcgagaattggaattcatctccctagctgaaagatgatcaaataaaaaataggtggaagacaaaagaaggtgcattaaccaactgaagaaaaaagattcctaacctccaacaattatactgttagaaagaatcgcactactccaaacactttcatgtatcaccacgatgagaaattgagaattgagtacagagggagcagcccaaccatttgcaaataaatgatcagttgagacttcaataaccatgatatctactaaatcacttatacaattgcataatgccataatgcatacctatgaacccgaacaaaaaaatatcccgtctacatgaataatttccaaaagacagaacaataatccttttatccaatttagaaatggttttataaatacatataacacttgcattagtatcatggaccagcaccaaagttcctatacacgatggaaaagcacactgatttatctgttttgatgaaaataaactatagatatgtagccagctgcagcacggactttaagacgtaatgtgtgtatgataggtgggactatagactaatagtatagtaagcaattattgtatgaattagctattagattggttatagatgaattagagctaacagtgggatttactattagacttgctctcaaagccgcggcgaccccgacgtcctcgcgctcctgcgcacaagctgacctcgaggtgactttcatattctttatacttttgaggggtgtttaagatactaccctaaaatcttacaccccatcacatcaagcattcgaatatctacatgaagtattaaatatagactaacaaatactctcaccttccaaaaatctgaaacctattttttttcatcaaaaccaagaagcaattaactaactcaccatgtggcaaaaccaataaacatgtaaccaataagtactataatggctttttgtttctgatcaacaatttaatttagcacatagtgactataaataggactcagatttttagagaaaccaaagaatgaaataggtctcagatttttgaaaggagggagtaactaattgcataatttacgactaattttcgagacgaatcttttaagcctaattgcaccatgatttgataatgtggtactacaataaatatttgctaatgacgaattaattatgcttaataaatttgtctcgcggtttacatgcagattctgtaatttattttgttattatactacgtttaatacattaaatttgtgtccgtatatctgatgtaacacgccaaaattttacatcgctggttctaaacacagcctgagtacatttatatttacctcttttaaacatttacatgtattctttggtagcggttgagagcccatctccttcgcacggaaaacaaaacggtccatagcgcgttattaattaagtattagctattttttaaaaaacagattaatttgattttttaagcaactttcatatataaactttttacaaaaaatacatcgtttagtagtttgaaaaatatgtgcgcggaaaacaagagaggtatgggttggaaccgggaggaacgaacatagttataattatattttaacgtctagattaaaattatttattgttcaactatagaggaaaaggatggtgcttaaatagtaatgaggggattataaagtggttagcttttaatctagggataaagtgtgactaaaatttcaaaagcattttagtcacctgagatctaaacaaatccatttttaaacatccattacagttggacatgttaagttactggtagtactccttccatttcaggttataagacattttaacttctggtttaagttcgactaaggttgtagaaaaaaaataataacattttcaacccaagacaaatttattatgaaaatatattcaattattgatttagttaaactaatttagtattataaatattactatatttgcctataaacttagttgtttatagttaaacttaaagtagtttaactttaaccaaagtcacaaaaatcacatttactttcatggaaaaaagtccaattcaccaattcaactattgcgttaaatttctcgttaatataattaaaaaaataaaaacacttttaactaggagaacttattttgtaagaagttgcaatttgttcatatgagtattctattaatcctctcgtgcgcacctgggaatttctcggcatcgatgcccccgtcgatcaatgcgcaccatgcctgcgcaactgcctcggtcacccatcccaaattgctccaggctaagcacacttaaccctggagttctttgaagattggcttccggaaaagaaattgcaacttgctgatatgagtattctattaattctattaaaccctaggccggcatgtcacaagcggtttcactagttggtaatccaaacgaagtagttaaaactagtaaattttaaacaatgtatactatactgctactccatctatttcatattatatttttttagtcaaacttatttaaatgtgactagtttatagaaaaatatagtagtaatttcaacacaaaacaaacatattattaaaatacagtatcaatgttaaatttaatgaaactaactcgatattttatatgttgctaaatttttctatcaaacatattattaaaatatagtgtgcaatgttagatctaatgaaactaatttgtcaacgggtgaagtcccaaatcacggtgctctcccatctcttttgactctccccctaaaaatcccaaatcatcggtcaccagcggccacgaccgtacccgatgagcaaggtgtgttccggctatcaatcttgtagtcttatagtttacatatagaagtctacttgtactttcttatctgaaactcctttaatatacgaggtatgattttgtataagacttggtatatggtggatcccgctgagtttagtcgattactatatcgggtatgtattatccataaccctgacataatatatatgcccacggttatgggttagcttaacaatattttttatgattagttccacactaattaaaaataataatgtgataaataatgatactttggtttagctcctggtttgaaatggttaattcctggttcggagatttggtcggttcaatctggcttggttgttcatttatggttgggcctatgcaacgagtatgttatatagcgttggattagtactgtttaattaattactctatttatttataaattcttaactctttgtcaaatgatgctttgcaaatgaatactaaattatgccatcctatattatctatgtgcacttgtataatgttttgtggcttgcggacattctattgcaataatcatcaaacgttgtccaaaccgaccgcgaccgatgccagccaaaaccgtccgcgaccgatgccagccaaaaccatccgcgaccgagatgccccaggcccccaaccgtctaatataaaagccacgtactggatactcgtcccatcaagccgccgcgaccccgacgtcctcgcgctcctgcgcacaactacacaagccgaccctaaccgagctcgaggtgactttcatattctttataagtttgagtacatttatatttacctttttaaaacatttagtagttatcattatattttaacgtctaaattaaaattatttattgttcaactataaaggaaaaagatggtgcttaaatagtaatgaagggattataaagtggttagcttttaatctagggataaagtgtgattgaaatttcaaaagcatttgtcacctgagatctagacaaatccctttttaaacatccattagagttggacatgataagttactggtagtagttccatgtaatcgacaaaaatcgcatttacttttatggaaagaagcccaattcactaatttaactattgcattaaattccttgttaatataattaaaaaatcaaaacacttttaaattggaggacctacctctgtacagaatttgtcctacgtggcatacaagctgcagcggttttaccggttggtaatctaaataaagtgtttaaaactagtcatcccttcattttatattataagttgtttgactttttttagttaaatttatttaagtttgatcaaatttatagaaaaatatagtaataatttcaacacaaaacaaacatagtattcaatgttagatttaatgaaactaatttaatattttagatgttgctaattttttctataaactttattattgaattaaactagaaaaaaaagatttgtaatacgtaatacgaaacgatggagtactagttgacttgacctatcaggctctcaccccatatccccccgttagctctccgcctctccccccctaaaaatcccaaatcacccgtcaccggcggccacgaccgcacccggcgagcaaggtgtacatgttccggccattgatcttggctgcgtgaaactgagatgctcagcacgagcacaccagccgctggccgccgggcgatatgcaggatctgggatgggaggcacaagctccggcagcgcccggtgttggatccaaccaaacagcgggcgaagcgccgccgaagctgtctgtccgatctactcgcgattttttagcgcatccgacggagaccgcgccttccttcatcacgattttagccttgtgtaaggcttggaagaaatgtgtctctccgttggcttgttggaagaaatgcttgaagcgttatttaagatcgagcaattttgctctatgaagtgcttttgttgtgacttgtgatctctctaatagaattggatcacacctcctagctaggggcactcattaatcgtagtattattttatccttttcaaaatttaattacatttagaattgccaattaattgttacctgacttgtttgtttaagcaactcccatttcagttacaatttcaaaaacaccgtgcatcctcaatgacatttggtcttcttttgcattgcccacaggacacagggcaacaaaatcctactttaaagagtgatggctgaaacgaacagccctgcaaccatggaagcacaagcacaggttgccttgacgaaatccatccaaccagacaccagcaacgaggaaatgacatcaggcaatgttgccggtaacaatgttttactgccattatccaacagaactgaagctcctactccgaggcatgtgattgtcactatttcgctcgatgctggccagaacacaatggttgacgacaatggtgttagacagggattaacagacgaggaatccgatactaaaacgaagctgttggaaagaggtgttctcacggctgcctctgctactgcagcaatgctctctcatttcctgaaaggagtattcaatcatcaccaagagggttactacatcatcctcgtcgtatttcttatgacggggttgattctggcaaccactgccacatggctcgcccgtaggcactccgccaaggtggttgtccttcttgcactagtcccacaggttcttgtggctggtgtgattacctcaacattttcttgacgaaggccttcgccctgactcttgcggtttgttccactttgaactttggaatcatcatcgtgagccaagtgcggatccagaattctaatagagggagagcttatatcctcctccccacgcacacacgctcttccttctctctcttcttcctcctttatcatcttctctcaataatgatctagcgaggtagaagaagacttgagtgatgagtcccaccagtatccacgttggatctgttcctgttgtgagtgtatagctacatctacaagggtcgagagttacaattatgcatgtgtatctatgtgttgatgaaaaatatatatttttgagaaatgaaatattttcttttcaaggcattattacttaatttgtccacaaaattgaagagcaaaaacgtttcctttagataggcccaaatgccagcccaagcacgtgtatggggccgtatccaaacaagacgcaactgggctacatgggccagatgggctaatatatctccatttgtcgacaaccctcgtacgcgtccgctcaacgcacgcgctcacacacgcggtggactcggtccagaaggatccggtgcacctaccttacccgagagacgccacctcaccgcaccccgtctcacagctgtccgggccccaccgcctccccggccccaccatccccctccccaaaattcgaaaaccattcggggaaaataaaaaccgctttgatgctaccgttacaactccactcaccgtcaccgacatgtggaccacccaacgtttcgggccccacctgtcagcgagctttctcccacgggtcattctctccctataaaggaggatacgtactagtactactagtctatctcacacgggaagtcgttcgagtcgtcgtcttcgtctccgttccgttgcgccgcctcgtcgtctcctcgcgccgccgccgccgccgccgccgcggggaagagctagccctagaggagaagtgggggtgagttgggagagaggagagggggcgagatgttccggtacgagaagggcggggacgtcgaggcggggacctcgggcggggcgagggagctctacccggggatgacggagccgccggagatgcggtgggcgctcatccggaagatctacgtcatcctctccatgcagctcctcctcaccgccgccgtcgccgccgtcgtcgtcaaggtccgcgccatctcccacttcttcgtctcctcccacgccggcctcggcctctacatcttcctcatcatcctccccttcatcggtgagttccccgttcttcacatggttgtttcaattttttagggtttcgatggtgttttttttttcttgcgaaggaaaatgggggaagaattcgaatcagttcgattctgctgcgttgcgtacggtttagatttcgaatcggatccccccaaattccactggaaatatgtgttcccctgcaaaaaatgtgtagtgaagtttagtgggatgatcaactgcgctgggtttgcgtgttgtgtgtgttcgtgcgtgcacgtattgatgcctttgcgtccaggcaaagcgatgggttcgtggatggtggggtggtgggtgcgtggtgtattttcgcacatactcctaataatggctaatttgacctagttttcaccactagaattagattgttttttatttgtgtgtgtgtgttctactgtgtggattgcaattgtttgttctgaataagaatggttgattggtttggtgtgcagtgctctgcccgctgtactactaccaccagaagcacccggtcaacctgatcctgctcggtctcttcaccgtcgccatcagcttcgcggttgggatgacatgcgccttcaccagtggtaactgatcatcgatctcgccatcattttttttttgttttgtttctagtgttcacaatttttacacccgtttgtgtttcatgactagttctcttgaaatatcgatgtccgtttgcatttagtttcttgctttcgccgtgttaagtttgctaagaatatgcttatggtggggctacataggaagtttcggagacattgtcggaatgcacattttgcctggtctttgtgtaaggccaggttgttgtcactttaatatatgcttgtcgagtcataagcatttggaatatcttccccttttggcatttcttagtttcttaatcttataaaagtattcggaatacaatcagcttgcacgttaggttagtttattaatgttggctccttttgccttttgtaatgttgaggcttgagcatgtttaacttttcttttgtagacatgcaaatgaatagaatcttccatagactattatctggaacctatttctaaagctatttactatttaccctgtcactgttcgaatcttctatataatgccatcttgtgacagtactaatttgagtatgatgtgtggtttgggtccaaagaatatcttgtgcatagtttttgtaaggttattgtttaggactttaggttgcagtactaacctaaaactgataataaaaaaggtttttcacatgagatcgaaaaatactcttatcttaatatcatttgattaaattgagatggaatgcatgctatgtctatctgagtagtatttcttggaacattgcgacctgtctgctatccgttggaaggcactagtatcttatacatctataaatgttattgaactagtttctttgatgatgtgtaccatattataatatgcccgtgttctagtggtggttaaaagttgttcatgtaaacagcagatgtatgtacaaagcattgcatgcaacattttttatagatattttagtagataatgatgtttactcttcatatgctatattcctatctttgctcagtactctgtttctgtcccggagttgctttttttttttggttgtaaaagatcaggtggtcactaatatattatgctgttttaacaggcaaggtcattctggagtctgcaattcttacaacagttgttgtgtttagcctgactgcctacacattctgggctgcaaagaggggccgtgacttcagcttccttggccctttcctcttcgcctccctcattgtgctgctcgtgtttgcgttcattcaggtcaaaagatgcagcattacactctcttgatctcctgtgcacctcatcttgttcttgacaaactcggtggctgattcgaaacttgccgtttgcagatcctattcccgctgggcaggatctcccagatgatctatggcgggatcgcgtcgctcatcttcagtggctacatcgtctacgacacggacaacatcatcaagcgctacacctacgaccagtacgtctgggccgccgtctccctctacctcgacgtcatcaacctcttcctctccctcatgaccctcttcagggcagccgactgagttcctcgcatcgcgtcacatcgtgttcatatacgttttcatcagtgaatgtgaaaatgctctgcctttatcatgagtcgcgtacccaaaaacaacaattgtatagatgccacaagtaggatggtcttttatcatgctgtgttcaacctagtgatcttatctacgtaggaaatgcgaacaaatttagattctatatggatatggaggtgatgttggatttgggttaatttgcttgatgtatggtggacggatggatcatggatggcttggtttacctttggatgaatggaattgcttctctctttttaccattgttttaacccttttttttaactaaatttactgctcaattctgagcaattttgatcctgtaaattcatccttgaaattctttggcagccataaattttgatcctgcaatagaaaagagggggtatagtgccacgtggcatctgccactcccgccatctctccgttgtcctctccaccgaccaagtgttgcaagtgcatgcgcgtcactggtttgcggcggcgatatgggcaagcacaaccaccacgacgtggaggcgccggccgccggcggcagcagcttcccgccgccgccgccggcggtaggcgtcgccggcgtggcgtgcacgtacatgatcgagaggccggagctccggtgggcgttcatccgcaaggtgtacgcgatcgtggcgacgcagctggtggtgaccgtcgccatcgccgccgccgtctactccgtcccggccatccgccgcttcttcctcgcccgcacgccggcgtcgctcgccgccttcgtgctcgtcatcgtcgcccccctcatcggtgacgactgacccacattaatttcatgcagcgctaattaacacatctaatacatataatgccacgttatagtatgattaactgttggattaacgataattatattgtgctgatgggtgacaatatggagcagttatgctgccgacgatgtttctccgtaagaagcatccgatcaacctcatccttctagcattgttcaccatttgcatgagctgcgccattggcctgggctgcctctcttccaaaggtacatatttgtgttccctacaaaattttctatcaaattattgcattccaaacggacttgcatccatcttaaaattaatattctctcttttcctttccccttccttgaaactaagccggcattgttataagctatctaaaaaaccgtcacaattttttaatggaaaacttttaaatttaactacagtatgattgtaactgaagcgggtattccaaacggatattaaccttgcatccatcttgaaattaatattctcttcttcttatttttttttcttccttgaaactaccaagccggcattgctataatcgaagcggcatccctaacgttcgggctggtgttcggcctgacgctctacacattctgggcggccaagagaggccatgacttcagcttcctccgccccttcttggtcgcggccttcctcgtcctcgtcctctacggtctcatccaggtctcataccaacaaccaaacagctgcatatcgatcgcaaaaactaaccattttcgtctccgacatcctgaatattagatttgatttcgaactccgtcattttcgtctccgacatcctgaatatttgatttgattttgatttctcaatgacatttgtttggtcgtgcacagatgttggtgccaacggggaaagtggcgacgacggtgtacgggtgcgtggcggcgctggtgttctccggcttcatcatctacgacacggacaatctgatcaagaggcacgcctacgatgagtacgtcacggctgccatctcgctctaccttgacaccgtcaacatcttcattgccattttcactgcactcgacgcttcagattcatagaatatatctctagagtttgttactagtagttgttaccctgctgaaaagcagcagccagtaactataactctttatagggaaaacatatgtagttatcgtattgcattccaatgtattagccatgaatttgaggtaaatatgaaccattacagtaataataataatgtacgtggcttacatgctgcaactgtttatgatgttggcaaacataatttggtagatgcgttgtatgtgaggcgtctcttagctcttacaacagtattcggcagggagatcagccattccaggaagaacagtatttgcacagaatacaatctaacgaaagagggaaaatttagctactgcactggcaaaaatatgcagagaacttggtttgaacttatctttcactgaggtgatatcatgatagtattatcctaccacagttaaggagcacgcgataaatttgagggcacgggattgcaacgtccagctaagttgcattgtagtcatcgaatgaggatgatttgtgatcaagggggactacaaagggattgaaatgcaggtgagcagattgtcccccagaagctcttggcacaagtcataagtcattgtccactgtttcctagggttcatatctccaatccagaactcaacagccaccggatgaacaacaggtttcaaggtgcgtcgagctgtacagtcctcaccttacgcaacaggacaccaagcctgtgtatgtgcatcaagctgacagctaattaacctgggaaggtaaggagataaagaggtttgagccgttggaatgacccaaaatggtagcatgacataccaatcaagatatcttctacctcatcaacggccaacaggatggcctagtaagcaattccgaacccgaatgataccatcatagcagaaacactatctttaagcaaatgattgcctgcagcaaaatgaagggaaaaatcataagaccaggtccttggctccaaagatgataaaggttttcataccatgtttgtcgacaacgaacagcctcttggcgaactctccttttcttatcatcaagagccttgattgcagcttgtaggatctgcaagagcatgcctttgtcatataagtgttttcaatttaataacttctatttgcgtctaacaaattcatctgaactaaaaaatatgaactaagcaaataaaggtaagttgtattaaatgcatttatctatttgtactaaaaatgtgcagctgaagacctgaagcatgacaccttattatctcctgccaataaggagacaactatccatgagccaaggcccatagtatagtacaagtatattaacagttgacaacattatgcctactccagaccatatcggctgcatatttttccaaagaggatactacagactattgcatgcatatttttccaaataagttacaatcagaattacctgtggtcgcatgcgataaatttttgagtgaggaagactagacatggcaactaaacattgtaaggctgtctctcgaacaacctaaaggaagggcaataagaaaaggttgtgagacatgttgagccataaacagaacaaatgcacggttagtattgaatggttaatgcaaataacacaaaggtaccatcatgtgaggatacgaaacgagctgcgtaaggacactgacaatgatgtggatgttctccacaatgcattctttgcctgcataggaaaaatgatactgataagttagcaactagatcgaataatgtgcatcaagtttgcagcagtgacaacaaaaaatgaaaatgtatataaaacagagcaataaatgatctcacctttttcatccatcagcattccagataagacgagcaatatactatacactagatctttatccttaacatcctgacttaatttagctatgctatcaaccatcacaagtagaatctgaaataaaaagggggaacaaaacaatgggttgattagcaatttaacatggtctggatgtatgatccaacaaaggatgtccatgctaatattaatattgcacatgtaatagtatggatcataatcaagaactaacccgatgggcttctgttataactgctggtactggagcattggaaatgatatgcccaaaagctcgatacaaaaccaatctgcagagaatgatatttttctcagtaacttcgaagaatataacatttgtaaaaggctccatatatataggaatcaattttctaattaataaggccactgccaggcaatatcataacttaaatccagaaacaaaaagagcactttttaggcataaactcatgatgaagacattttatgagaacaggcatgaaatttatacatagttaatgacgcttatgctaattagtccttaggctataaaattacagtacccaactaatttgtcaacagaaatgccttccccagataaaagaaataggcataaaagtctcttttacttcagtccattttggattgttatgcctgaagttaactatgtatcatttttgtatgacaaatgatgcagccgtgtcacttgtttcagcacagaccataaggaaagcagtacgaatgtagacacttactttgtagtcatcacagtagattccttgattttagagagaaaaattggcatcaatattgagaagaaacgctgcttatatagtggttttattcttgcatgaaacttcttattcaggcaaacttctgaatcactcatcatcacatggaatgcatcagctgcagatgttgcaagagaagcatatgatgaatcactgataccatgttcttcctgatgggatgaaatgccagccaaactctgatctgagcatagacatttaagaagaaacagtgaaacatccttcaccttttcatctcctctcataagcaatcccttgccaagccaggccaagccagagatgatatcgtcctttgattcaatgcttccagacaagatctctgagcaattagcatcatctgaacggccagcacaagagagagatgtcttcatattgcttcgcactgatattgttgagaaacacctctcaagaatagtatcaatcactttatccagtttattctcatgtgagaattccgaattgtgtaggtttttgttgaaaatagaagctaatgcatgggcagctggaatttgtcctttcagtaggaagaccgtaaagagattaatcatcatcagcatatctggtacaggtgtttgaggccgaagaccaactatgaccgatgaaagcatacacatgagaaatgtatcacgaacagagtatagag

SEQ ID NO: 68501 - DNA, 50626 bp, Oryza sativa
ccggcccaagagaggaaggggggggagaagacttttagggtttttcttttttataaaccttttcaactttgtttatttcttctcaattattatttgtgctctgaaaattccactaaaatttgagggctccttttagaccaaggagaatttaacaaaaattctccgggtcacatttgaatttttcttgtacgtattttaatgtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccagggtgcaccttttggctgactcagactaggttgcggtagtgcagtgatgcttccgttccagaacttctcatgattcatatcttcggagtcaacctcggacaagttatcaacttcgtgtcatgcgtcgtaacctgcttgtcattactaggatactatgtttgtcatcataagaatatcatgcttgtcattcacttctaacttgccatcaactgtctcatattagctttcctggtctccgggtgatagctacttctgctatttgatgcaagggtcaaccactctaactataagttatgcttcccaagagaaccaatttatcccacttgacatactttgacgtcttcccaaatagctttactgctggatttgttattgtctaatcattatcccgccaaatctgaggcttcactgttacatgtgattttaaactgacctctgcagactatcttcgaacatatcacttggttcataactgggaatagctcccacgaacaagcaactcagattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgtgtagcatctgataccgagtggaagatttcactctttgccttcatagaaacacttttacctaggtcatcttgcttactcaatgacaaggtgactgttgtgggggggggggggcaattactatcaggggtcttccgtgagcgatgcagagcatgtttctgtttatcaatcacctttcggcccacttctttcatgctagagaacatctttgccaatctctttttatcaatcttctttcggcttatgtctaacaggtggtattctttaatgtggattgcggacgcttctggggacgatgaggtcctttggcttgctgcctttcggtgaaaccttgatgtggttcgtcaaaaagctgtactgactaccttcagggaaatacattgcctgctatttgtatctataccactagggtttaattggcgatgatcatccttagtgcttcctcgagatggggagcatccaaattgttcttctgccacatcacctttgacccttttctgatacctgatcgactaattaccaaccatcgactactatgttctcaaacattgatgtctcctggatctttgtaactgtttgcaggtatatccgaacttatcaatgtagaggcatggcaggtacccttatgggtttcatccaacaatccttatcttgatctgtaaaaggcgtatcccaactcctatcctcaactactgtctcgttggctttttgacccaacacagtttaattggttttcttttccatcaacaggttggttattaactcgaggttggaacatagttcctctgaaatgagaccctaggtctcctatgtcagtaaacaattatacacatgatcacatatccgcatctttcaaacgaatcctcatggaacttgtctgtattacacatttctccctcattacatgaatacgaggcactaccttaaacaaaaagggacggtgcttaacatcggtacattgtattctcaatatgaatcatccataagcatagcaagctcactgtttatagacatgaatatatttatgtattacatggttgctgcaaactttcgattacaccatgataagtagcggactgaaaaccacaaacatggctgctcattttgattctggagagatatagctggcattgttccagtgactgcatccttgattggttctgtgatgatgtgataggactgcataatgctatcattcacaggagaaagcggatgacggtcttctgcttggtatcgccctccggaggttgattgctcttggctcggcctggagtaggtcggggagagacacaacttcttccatctacgacaattcttcgctgaggctgtcgatgcagagagtggttgctatggtttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggaataatgcccttcttcactgcagttgtaacaaacaataactttcttacactcgggttcttcatcttgtacttgatttctcagctgctgtattggaacttccaaaggtacaacgcagatactggcccctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaacggtgatcttggcggggatttgtgttgccttgatgcttctctccgttggaactggcgggttggttggccatcttctttgtcagcagaaaactgaattgacaatcttttggtacatgatcagttccttcacaaaagaaacaagtgatcctgctcgttggacacctgtcgggtagatggtcttcctcacaatgaacgcatgtagaggcacacgagctggcaacatgaccgatttctccacaacgagggcatgccttaagttctacttcatcttcatcatctgaggagacttgatctgaatcttcactatcagacactctacctccattagctaaaagatgctctgtcaactgttgtgcacctcggaaggaatttcttctctgatgttttgtcattcctggtggaggccattccgtgctggtaatgatcatcttacggacttcatcttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgtacttgaggttgcatctgactcgggttcaaaattggcatccgatgctgctgtagtatctctataagcaatttgttctggttaatcaggtgttggaccactgccacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaacacacgactaacaacactaccctatagggtggcttaggttctacgacgggttctccaagatcttcactcctgcttcacagctggcttcactgcttcctttgcttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggggaaggagaaaaaggaactttcgcaaataatttttttatttataaaatatgtccttgggttttatccacttggcttatcctacagtcgagatggctctgataccagcttgtcgcgaccgggaaaattgccttttcccgaacgctagtgtattaatccccgtcccaggaaaagccggggtataccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggtacaagggaataataataggggttaggttttgcagtaaacagcatttaaaagtcacttagttgcccaaagccattttgtaaagacgatcctagagctacacagtattattaaacaaggccgtgaaccctcacgagcctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctgcctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaatagaggcccgagctttagtccttatagtggccggggtgctacttcccacatctggcatgcacccaaaccccaccgaaaacaggttttaggggttttgaaagaggaagagaggtgtgtgtccaattccaacataagccaacaattccatagtgtccaaatgatatgagaattcccaaagtctaaagttataaaaccacctaaggttgcctaattattcagcgaagcatctacctaaatttatactagtggaaccatgaatagagtacccactagttggggtttttattttcctagggtgaacaaggtaataataacaatagcaataataatgtcataacaaaggtaaataggcatggctaaataaaacagtggtaacgcgggaatttaaacaaagcgataatgcaataatttaaatcaaaataattttataaactgggattcaatatgctcaagggtgatgtgacttgccttgctcgctttcccaaacgacggcttcaacttccacgaagagcggatcttccgaagctgcagcgtctacacgaccgacggaaaagaaaaggcttttactctactaaactccacataacagcagaaacaaagcacaaaaatgggttctttacttcttaaggaaaaattagagacttgaacggtccaattccgagttcaaatggccaagatatggccatttgaagtttatatgctctttaaatggatatttgcgaatttcttcatttaaattttaattaaaaactcatttattgcgtcagccgagggagcgggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggatgacggccgggcccacctggcagccgcgagggcgcgcccgaaggcggcctcgccggcacggccgacgggagcggcgcgcccgcgccccgatggtcaccgccggcgaccaccggcgcggcggagcggcgcccgagagagcggagagaaggggggaaagcgaacggcggtcttcggctcaccccgggacaacgacgacgacgagaacggcggccggagtggaggaaagcggcggcgcggctcgggatgacgatgacgacggcgctccgacggtcggcgagcgaaacggaggcgcggacgaggtcgacggcgatgcggcgatgccgagggaggtggcgccgagccgggaggaagaccggagcgacgacggcggcgaaccagagcggaggaaggcgacggcgcggttcgggatgccgagggcgacggtgctccggcagtcggcggacgaagcggagcggcggacggggtcggcggcaacacggcgaagcggatggaggtgtcgccgagtcgggagggagaccggagcgacgtcggcggcgagccgaaggtcgacggcgacggcggagagagaggagcacggcgcgagcacgaatccgacggcgagagcgagcggcgagcggcggaaacggaagagcgaagcacggggagcaaatatatagcaacgggagggggagagcgcggccggggagagaggaaaccgcgcgcggagatctcgggcgccattgaagacgccggcgaacttcgcggggtgaatccggacgaatccgagggagagagagagggaaaagggggggaaacgggagagggaatcacgggggtgattttccccctctttaatgcgcgcggggacggcgggaaacggcgagattcgcggcggcggcggctctagggcacgggctggcggcggcgcggcgggaggaaggcgatgacaagtgggtcccacccgtcagcgagagtggcgggcgggcccgcctgtcagcggcgcgcgcgcgcgggggagctgatgggccgcggggagaggagagagagggagggagagttgggccgagccggcccaagagaggaaggggggggagaagacttttagggtttttcttttttataaaccttttcaactttgtttatttcttctcaattattatttgtgctctgaaaattccactaaaatttgagggctccttttagaccaaggagaatttaacaaaaattctccgggtcacatttgaatttttcttgtacgtattttaatgtttgccaatttcttttcgaattttaattaattctattattccttttagaagatgatttttattttgggatgaatttatcaggacgtgacatttatgtaaagaagaaaagtccagtttaaaaagggaagggtacatgtggtatccccttaagagataaaaggaccatgcccacgaagagaaggggggattttgattttcccgggagaggagagggctggttgatattttgtaacttgctcttacacagatccaccaaaaacacaggagtagggtattacgcttcccagcggcccgaacctgtatacatcgtctgtgtctcgcgtttcttccgggcacgcgatctttccacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttttcttgttcagcctaatggccgagcaagcaaaggtgcacgacctctctccgagtgtgagcggcgacgacggggagccaaacccacgccgtcgagctcgtactcccccacctcctccacaccaaaatcctaagcagggggaggcactcgagagagtcgaaaaatccgcagcatcgccagtcgcgggtggtgcaggagaacggcgagatggggagcgtcgcctcctcgtctacggtgacggcagcacgcctcagggcgcgcttcaggctgttggcgcgctcctacgtcacccgcctgtcgtccctgacccggagtctccagcccagcgatggctggacgacgtggccaacttggtcatgacggcacagcagcgcctgggtgctggtggacggtccgccaccaccaagacctccggcgccgccactaccggttccgcgtcgtcgagacggagggcgcggcgagcggcggctgttgcacgccattcggctgccactccctcgtcggcacctccgactcgggaggatcggcatggagagccggatgcccgcctcgacatcgagcgtcggcgtaatagccggcgtactccccgcgcaacggagggcgcctcttcgtccagagtgtcacctcgacagggacgtgaggaccagccctccatgcccccggctggtggtgtcggctgtagagcctttgtggcgagtcttcggaatgtccgttggcccccaaggttccggcccaccatcaccgagaagtatgacgggagtgtcaaccccaccgagtttctccaggtctatacgaccgggattgaggccgctgggggtgacgacagagtcatggcgaatttctttcccatggccctgaagggacaggcgcggggttggctaatgaacctgccgcccgcgtcggtccactcctgggaggatttgtgccagcagttcaccatgaactttcaaggcacttatccacgcccaggtgaagaagcggacttgcacgcagtacagcgaggggatgatgaatcacttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgttccgcgggccacccgaaaggggaggcctgcgagcgacaaaaagaaagaggctggtactcccagcagggagcgcccagccagcaagtggtgctccgtccacaacacctccctccacgatctcgcggattgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacatcgatgacggtgatgatgacctaggtttccaagaacctggggccaccattgccactgtcgatgggggagcgtgtgctcacgtttctcaccggagtttcaaggccatgaggcgagagcttctcgccgcggcccctactcatgaggcgacacgtcgggcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctatccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacactgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccccaagtagttagtgcagcgttggttgtggagcgcgatgaaaacaatcctcatttcgtgcacccccattctgtgctaacttggcccgggagcgagcggggaggagaggcccccgagtcggacggtggcctacggcccctgacgaccggagtcggccctctgcccgcttgtcagacggtgctaggtgcccccgaccctcaggagggccccaaggccactgcgggaaggccgcacttaacgccctttgaccccgaggctaaccctgtgctgactcgacccgggaaagagcagggagaagaggcccccgagccgaacggaggccagaggcccctgacgaccggagttggccctttgcctgcttgtccgacgatgccaggagcccccgacccccaggacggccccgaggccactgagggaaggccgcccctttcatcctccgaccccgaggtcatcggcacagaagacaagtgcgccccgaaaggccacttgaatgaagaacgccccggggatacggcccctagcaaagaggatcggccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttatcccctcggtcaaatcttgtataatcgagagggtacaggacgggtggtaaaatgggcaatcgagctttctgagttcgatctgcactttgaaccacgccacgctatcaagagccagaccctcgccgattttgtggcagagtggaccccggctccagagaccgtctcaatccccgaggccagcacgaactcctcgcagctgcctcacaccacccactgggtgatgcagttcgatggttctctgtccctccagggtgccggtgcgggggtcactttgacctccccgaccggagacgtccttagatatctagtccgcctcgactttcgagcgaccaataatatggcagagtacgagggactccttgccggactcagggtggcagccggactggggatccgccgtctcctggtgttaggcgattcccagctggtcgttaaccaggtctgtaaggagtaccggtgctctgacccgcaaatggacgcctatgtacaccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtcctggcctcgggacccgaagggagcgctccaagctcccttagattgattgcttggatctctgagatccaaacatacctcacagataagactctacctgaggaccgcgaagggagtgaacgcgtacaacgcatttccaaacgctacgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctggggacttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttaccagcggtgctctgggcaaaccgaaccacaccaagccgagcgaccggggaaacgcctttcttcctcgtctacggcgcagaagcggttctcccatccgagctcaccctgaggtctcctcgggccaccatgtactgtgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgtacggctggccacgggcgacggcactgagctgccaaacccgtggaacatcgaacaccttcgtcgcttctacccctgaggggggggtcgggtgtcaggtttcgggctcgggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttgccctcgggggctcggttcggtcagctaaaatcgccaagcggggcccagaaccgagccatgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaataaagttaacatagaaatttttcatcatttttgattgcagattaagttgatctatacaaaaagaagaaagaaaatgaaaaagttggagattggcgggggcctgggggctcattccaatgcgcccgggtcgccggcctcgtcgccaccgtcgtcctcaccgctggcgtcgccctcctcgtcggagctgagggcgaacgcgagccgaggggccgacccctcgaagctttggacgatatggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtagagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacggtgtgttcggcagctgcgaggcgggcgactaagtcgctttcgcccgtagccgccccgccgctgcgctccctcgcgtccagctccttttctcgcgcctcgaggttagcagcccgctgctccagcgcggctctctcggcgcggatgcattccagattgcggcgcgcctgctcctcctgcgctgccttgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctgatctccacggcgccggcatgatcttccagcgccatggcacgggcttcaagggcctcttcgcgccgtcgggatgccgcttcagcctccgttgctcgctgctctcgggcagcggcggcgtcaaggaccccctgggcggcgtcgagctttttctttagctcccgtgttgaaggcggagggagtcctgcgcctcaatcatcgcggtggtggcgatgagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggcggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccttgtcgcgagccgccccggaggttgtcgcctgagcgtcacccgagggagtgggcccgagcgacgcgccggcggtcttgtcgtgaaccgcctcggaagacgccatcgcctcagcctggcgagcccgggcggtttcctcccgagtggcttcttcagcctgacgagcccgggcggcctcctcccgagcagcttcttcggcttggcgagcccgggcggcctcctcctgagcggtatcctccgcctgccgaacccgagcggcctcccgggcggcctcttcagcttcccgaaggcgatctgcggcctctcgccggtcagattctcgcctccgttcctctgcggccgccggatcttcggcctcggattggccggacttgggatggcgggaggaacgcgacgggacatcgctgaagcagaagaaaaaaccggaagacaaacaaggtggataagagaaaacttgctgattgggataaagggaagatggttgtgaaaggcgtgaaacgaacctgcgagggggtcggttgaacgaccaccttggaggggaaatcaggtttccccgggatggttccgtctcccccgtcttgcggagccgcttcttcttgcgctccgtctcgggctgtgatgtcggcgcggccccctccgggcgcctgcggctggcacgcaccgccccgtcccctcggggaggagatgggggaggtgttcctccctgtttcctcttcccccgggcgtcggcagggcggttgctccccgagcccccgtcgcggggcccagaagcacggccccctcctggggttgattcttcctggcggctcccgccggcgccgtcgtggcccttaggagccacctcctctgaggccccgacccccatcatgatggtcagaatggaggcgcggtctggatcgcagcagagggggaggagtccttgaggaataagagacgcctccatggagctgagattcagcaccctttggaccacgatcttgaagtcatcgggagcccaatcccatctgactccccggtgggtcctcatgtagtcctcggacccggtgtactcccatgcgctccgggcgcgccgctgaagcggcgcaatccggcgacggaggtagtcgccgtacaccatggcccctgtgagcccctgagatcgcaggcccgccaggcggtcgaggacggcgtcatagtcatcccccagatccactggcgcccgccagctggagaccggcgccgggggctggcttgggagtcggaggcgcgcttcgttggcaaggggggtgtagaaccagtcgctcttccaatcgtcccacttcttgcggagggcgcaggggatgtagcggttcaacactggcccccgcggctggaagtagcaaccaccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggaggaagaagatggaccgccccgggtaatctggtgctgggcgcgcctcgcccagcatcactatctcccggccggtggcggattccggcatgaagcgacgcggcagcccagcctgcctctcgcccacaatgcgggaaggcggtagtacgctaccgtcgagcagagcggagccccgtgccatgtcgtcggagaaagagagggttgagaacgagcgtgtgtggcgaaggtgaggcgcagcaaagagagagtttagggcgcaaacggcgaaggaaaggggaatagtggcgaaaggaagggagcaagtcctttcctcgatggctttatacccttcccatcgctgagcccggctcctcgtttctcgtgcccactatctcgctccctcgttactcgctatctcgctccctcgtttctcgcgcccacgcttccactaattccattcgcccgcttgcggcgcatgaggtggatatgcggttgtggcagtcgagatagatcgtatcgtgtgcgcgttaattacgatcgccgaccgaagcgacgttaccatatctccagacgaaacgaatctgcacgcccagattcgagcgctgctcaagtgatgtggcagtcttgaagagaccgcccatgactgacggccaagacaccattaccgatatgcgtggtttgagaccgttgggtttctgcccaatcacggagaccggtcccacctgtcaccaggctttatgagtggcgtcatgcccgaccgcttcccttgagaaggatgatcgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgagggccgaggtgccccgaccccttgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcagatcaacggttaggtggcgactggcggtctgacgcacgcctcgccccgtcccgtcaagacgagagcctctaggcactcgtccccagctggagctagcgtgatacatcccagagatggcacgttagccccgatcgatatatgccaggcttcatcctaaccattacaggcaagatgttgtgtgaagaagggcaaacatgcacgttgctaagctgacacgcggtggacaagaatgaccgattggtgaccggtctgacactgctcatgtcgtcagcgcacagccacgttcccacgacgcgcctgcccccggcagaagtggaggtaggtatgtgccgtcccatcagaaggacgttcggagggcaaccgtgcaaatctccgtccatttatgtaaagaagaaaagtccagtttaaaaagggaagggtacatgtggtatccccttaagagataaaaggaggaccatgcccacgaagagaaggggggattttgattttcccgggagaggagagggctggttgatattttgtaacttgctcttacacagatccaccaaaaacacaggagtagggtattacgcttcccagcggcccgaacctgtatacatcgtctgtgtctcgcgtttcttccgggcacgcgatctttccacatacagagagagcttgagatctcaccctaagcccccggccgaactggcaaaggggggtctgcgcggtctcccggtgaggagccacgagctccgtgactgtcatacacacattacgtctcggagtccgtgctgcagctgctcttttctctcttccttttatctctttaaaatatatttatagttggcttatagtctgctattgtatccgctcttactgctcttagtaccagtactaataatgtgagagacggaggtgggagagacggaggtggtgtgaggaacttgagaagacgatacatgtggcatcgggcttggtagattcgaccggatctttgccgaccgtcagcgccaccattgaagacacagtagcaataagagcaagtttaatagtatagcccactactaactttaaatcatttataaccaatacaatagccaattcatacaatagttacttattatactattaatatctggtctcacatgtcatacacacgttacgtcttgaagtttgtgctgcccgctgctcttctctctttttttatctttttaaaatatgtttatagctgactagtttgctaacctgctctaacagatgcgccatggcggtacgggcgacggcgaggcttggtcacgcactctcgcatatgtcaggaggaaacgacagcttacccatctgtagacggaggcgaaaagcggcggcggacgcaaaccgccgcattaaccggagctctcgccgggaagagtggtgggggacaaggatcggaggaaggagaaagggatgtttttcttttcttttcttttgttttttttgagagagagagagagagggagaaggggatgatgattgctgggccacaggttaggatggcccatctaaggccttgcttcgatggcccacctaatcccccgcggcacatgaacgatagattgatcggacggttcacatgtggcccaattcacgagcaaatataaggaaaaagtacacccaaggtccttcactttgtcgtcgagatacaaaatcgtcctcaaaccgcaaaaccagataccggacgtccctcaactaataaaaccattcgctttagatccctcggtggttttgaccccgattttagcctacgtggcggctgagtcagcgtggaacctacgtggaccccacatgtcagcgtgtcacgtcaactctctcttttattgcagtagcagcaacagcaagcagcagctaatctcgccggaagaaaaaccaaagccagaggcgacacgggagtcgtcgtgcttcggcgacagctcggtcggcatcgccgccgccgccgccggtgactctgggcgcggcggcgcgctggatcgcaagctgcaggcggtgaccacggcggtgtacggtgcctcgttgcactccgggaaggagctcctcatccgggtcacgtggacgccgaacgctgccggagccaccggcctcgccgtcgccttcgacgacgcgctctctccgtcgtcgaggtgcgcccaccatgtgctgcacaagaagcgcgggagcaggtcctcgctaccaccaccggcacggctgtgggcgtccactagaacaccgccgaggccacgtacgcgttggattcgtcgtcccctgagcccaccggcgaggcggcgactactacctcatcgtcgttgctgacaccgaggtcacgctgctcctcggcaaggggtggcttctgttaaatatgtgatccgaattttgggcccacaatatattcggattagtttcctaataagagtcctattaggtgtctttctattatcccttatatatactcttgtaagccgtacgggaatgggtgacgttcccaatgtgattcccctacgtttgtaatcatctcctctatagtgatcattgccggtcggcgcccgtggtttttttccgcaagggatttccacgtaaaattcgtgtctccgttgtgcatctattttcataacaagtggtatcagagcattggagatcgatctactgcagtcccggccaccggcgattttttccgatcgaagaaatcgatctaatcggcggtacgcgtcgtcgtattcgttgttccgtcgaaattctgttcggcgaaatccaatccaaagcggagtcgccatcaactccgagtcgacgtcgtccttcctgccgtgcgcgtgtcagaggagcagcgcaggcgcagcagaagccatcggcagcaagcagccgagcggcacaggaaaatccatccatcacaaagcgcacgcataccgagggaaattagggcagcagccgcctgttggccctgttcacatgaagtccaaactcacgttgaatttctacgcgcacacagccaatctaccaggagatttacagtacttcgcttggtgcacacaggaggtgtaccatagttcgtgtttttttctagtttaccctaatttcttactagcaaatttcaggattaattcccatggcgagtttgaagtatgatctaccgctcctggaccgagacacaagattctcactttggcaagtgaagatgcgagccgttcttgcacaacaagacctcgatgatgcgctttctggatttgataagaggacacaggattggtctgttgatgagaagaaaaaggatcataaggttatgtcatatattcatcttcatctatctaacaatattttgcaggaggtgcttaaggaggagacagccgttgggctgtggttgaaattgaaacagatatgcatgactaaggatctgaccagtaagatgcacctgaagcaaaagttatttttgcacaagttgcaagatgatgagtctgtgatggaccatctctccgctttcaaggaaattgttgctgaccttgagtctatggaggtaaagcatgatgaagaggatttaggccttattttattgtgttcattgcctagctcatatgcaaacttcagggatactattctttatagtcgtgatactctaactttgaaagaagtttatgatgctttgcatgccaaagaaaagatgaagaagatggtaccctctgaaggttcaaattcacaagcagaaagcttggttgtcggggtaggcaacaggagaagaacacaaacaacaaatcaagagataaaagctcaagtagctaccgtgggagatcaaagtccagaggcaggtataagtcatgcaaatactgcaagagagatggacatgatatcttcgagtgttggaagctacaggacaaagacaagagaaccggaaaatatataccaaaaggtaagaaagaagaggaaggtaaagccgcagttgttactgatgagaagtctgatgcagaattgcttgttgcttatgttggttgtgcacaaactagtgaccagtggattcttgatactgcatgcacctatcacatgtgcccgaatagggattggtttgccacctatgaaactgtgcaaggtggtactgttttgatgggtgatgatacaccatgcgaggttgcaggtattggaacagttcagatcaagatgtttgatggttgtatcagaacattgtcagatgtgcggcatattccaaatttgaagagaagtctcatctctttttgtactcttgatcgcaaagggtacaaatattccggtggagacggaattttgaaggtaactaaaggctctcttgttgtgatgaaagctgatattaaatctgccaacctgtaccatctgcgaggtacaactatattaggtaatgttgctgcagtttctgattcattatctaattccgatgctactaatctttggcatatgcgtcttgggcatatgagtgaaattggtttggcagaattgagcaagcgaggattgctatatggacaaagcatcgggaagctcaaattttgtgagcattgcatctttggcaagcataagagggtgaagttcaacacatctacacataccactgaaggtattcttgattatgtgcattctgatttatgggggcctgctcgtaagacatcctttggaggtgctcgttacataatgactatcgttgatgattattcgcgaaaagtttggccttatttcttgaagcacaaatatcaagcttttgatgtgtttaaagagtggaaaactatggttgaaagacaaactgaaagaaaggtgaaaatccttcgtactgacaatgggatggagttctgttctaagatatttaaatcatattgcaagtctgaaggcattgtgcgtcactacaccattcctcacacacctcaacaaaacggcgtagctgagcgtatgaacaggacaattatatcaaaggcccgttgtatgttgtctaatgcaggtttgcctaaacagttttgggcggaagctgtttccactgcttgttatcttatcaatcgatcacccagttatgccattgataagaagactccaattgaggtatggtctggttccccagtaaattattcagacttaagagtatttggttgtactgcttatgctcctgttgataatggtaaattggagcctagagctattaagtgcatttttcttggttatccgtctagtgtgaaaggctataagttatggtgtcctgaaaccaaaaaggttgtgattagtagaaatgttgtcttccatgaataagttatgttacatgacaaaccttctactaatgttcctgttgagagtcaggagaaagcaagtgtgcaggtggagcacttgatcagtttagggcatgcaccagaaaaagaagatgttgctattaaccaagatgcacctgttattgaatattcagattcttctactgttcagcagtctccaaaatgttctattgcaaaagataagcccaaaagaaatattaaacctcctcgaagatatattgaagaagcgaacatagttgcttatgctttgagtgtgacagaagaaattgaaggtaatgccgaaccttctacatattctgaggctattgtttctgatgattgcaatagatggataactgctatgcatgatgagatggagtcacttgaaaagaatcatacttgggaattggtgaagttgccaaaggagaagaaacctatccgttgcaagtagatcttcaaaagaaaggaaggtatgtctccaagtgatgaggcaaggtacaaagcaaggttagttgctaaaggttatagccagattccaggtattgatttcaatgatgtcttttcccctattgtgaagcatagttcaattcgcactttacttagtattgttgcaatgcatgatgatgaactagagcaaatggatgttaagactgcatttttacatggggagttaggagaggacattaatatggagcaacctgaaggtttttttgttcctggaaaagagaacctagtctgtaggttgaagaaatctctttatgggttgaagcagtcacccagacagtggtataagagatttgactctttcatgctttctcagaagtttagaagatccaattatgatagctgtgtttatcttaaagttgttgatggttcagctatatatttgcttctttatgtcgatgatatgttgattgctgcaaaagataaatcagagatagaaaagttgaaggcacaattgagtagtgaatttgagatgaaggatttgggtgcagcgaagaaaattctcggtatggaaattactagagaaagacattctggcaagttatatcttagtcagaaaggttatattgaaaaagttcatcatcgtttcaatatgcatgatgcaaaaccagtgagtactcctttagctgcacatttcagattatcttcagatttatgtccacagtcagattatgatattgagtacatgtttagagttccttattcaagttcagttggttcacttatgtatgccatggtatgttctcgtcctgacttatcacatgcattaagtgttgtcagtagatacatggctaatcctggcaaagagcattggaaagctgttcaatggattttcagatacctacgtggtacatctagtacttgtttgcagtttgggagatctagagatggacttgttggttatgtggattcagattttgctggagatttggataggagaaaatcgctcacaggttatgttttcactattggaggatgtgctattagttggaaggcaagtttgcaagcaacgtttgccttatctactactgaagcagagtaatggctatttctgaagcttgtaaagaagctatttggcttagaggtttgtacactgagctttgtggagttacgtcttgcattaatagattttgttccatgagagaacaaagcacattgatgtgagatatcactttattcgatgtgtgattgctgaaggtgatgtcaaagtatgcaagataagtactcatgataacccagctgatatgatgacaaagccagttcctgctactaagtttgagctttgctcaagcttggtgggtgttacagtatagtcctagagactatttggcgcgcggtgattttacctacatgaggtattttttggtgattgatgtttttatgcaacaagaggaaattcgtctcaaggtggagattgttaaatatgtgatccgaattttgggcccacaatatattcggattagtttcctagtatgagtcctattaggtgtctttctattatcccttatatatactcttgtaagccgtacgggaaggagtgacgtttccattgtgattcccctacgtttgtaatcatctcctctatagtgatcattgccggtcggcgtccgtggttttttcccgcaagggttttccacgtaaaatttatgtctccgttgtgcatctattttcataacagcttcttcctgcatgtgcaatgtgttactaacaaaaaagttcagcttctctaattcgagttggtgattttattacagtgtaaatcatggtgtacatgaaagatataagtatgtctccagcctgacattgtatgaacttgggtaaatgcatgctgatgtgagcgttttctggttatctgaatcgcaatcaaatggcatagatagatactgaacatggttacatggaaaaatgatgcttacattgcctccagatagcttcactcagatcaagcagaaacgctttgcattctctgcaacgatgctatcaagtaatgactcgcatgcgttttccagcagatccagcaccagaaaaacattgtgcaacgatagctgtcccctccctccccgccgcctgccttctctttccccaccgccgccgctgccctctcgcgcgccggccgccgcctgccttctctttccccgtcgccgcctgcactatgacgcccgggcgacggactggttggtggggatggcggcgagggacggcacggcgctgaagccggtgctgagcgggttgtcgatgaagccggtgccgagcggtgagcgactccgagaggcgcgcgccaccgccgagcgcgccctcgccgccgccgagcgcggagggcgacgaccccgcggcggtcgacgtcaacctcgtccttgccttcctcgccgcccgagacggggacttaaacgacgtgagacggcctcgcctccgcctccgcgcccaacaccacggcgcccgcccgcgcggggccgcttcgccaatggcggcgacgcagcgtcaccgacgccattcgcgaccggctgccgccgccgcctcgcccggtggcttgctcctcagccgcccgccggcttgcccaaagaagtgaagagaaaagaagagagagagagagagggagaagggaaaggaggggaaagagggggaggcttacgtggccaggctggcatgtggagcccgtgtgggtcccacgctgactcagccgccacgtaggccaaaaccggggtcaaaaccaccgaaggatccattatgaccggttttgattagttaagggactccgaatatctggttttgtgattaggggacgttttttaactcggtgacaagttgagggaccttcggtgtactttttccgcaaatataatgctccaacttgatgactaataacacactagcaccagcagctagttgcttatttatagtagtatttcatacacggaaaaaattttaagcattagtaaatatcaattgttggatcgatgaatatggaataataacaaccattatttatgaacgctaattgctagctagattcatcattgtcatcacagcctagctactggctaattcagatattccatcgtcctcttctgaaattgcagtaagctcggaggagtgaaagtaagaatccatgacttgtggaggtggcatgccattgccaatgccatccccatcgcagaaaaatggtctcggaggcacttgcagcgcatccacacccccttcgagcatctctattgcctcgctcatcgtcaggcgatcgtgtgatttcatctgaatgcaccacagcccaacaaggcatagcttcctctccagctcatgcatgtcagcaacattggatatctcatcaacttgttgatctgctatcagctggtcatacacccatgctgggtagtatgccctgcttgcatttgagtttgcatttggatctgcattccttctacctccagccatctcaagcaacaacattccaaagctataaacatcggatttgtcagatataacgccaaagctccgggataccatctcaggagccatataacctactgttccccgtaaagccctatctgacacaaagctcttctcccttgggtacagttttgcgaggccgaaatcagcaacctttggaacaaagttatcatcaagaaggatgttgtctggcttgatatcaaagtgtagaatctgcatctcgcacccctgatgcaggtagttgatccctctagcaatgcccagagcaatctcattgagcttgtcccaagagaagcttctctcggatgagaagatatacttgtttagagatcctctaggcatgtattcgtaaaccaaggcccttctcatttcttcggagcagaaccccacaagacgcaccacgttgatgtgatggatcctgcctatggtggcaacttcactaatgaagtcttctccattgcaattggagttgccatccaacatcttgatggcgacatgaacatcacccgggagaaacacacccttgtacacagacccatatcctccttggcccagcttgtctctgaaatggcttgtgattgctatgatgtccgtgtaggcgtacctcttggggcctagcatatcttgcatccgaaggaacttttcgactgcatcaattgcaatccttgttttccagtacttgcgagtaagaaaaatcatcacgaccaacggtgcgaacacaaacctgcatagcactgaatacgaaaaggctaatgaattttgcaatgcaatatgtggtgtgaccagctctgatactgtatactgtagaattgagtggaacaaaaatgcaaaagttaattaccagcaatccacttgacaagacacaaggtgtatattatgaagagcttatggtaaagagaatgatcaacgccgcggatcatgtcgctgatggaaagacgcatgtcgaggtaataccgtctggatatgcctatcatgcatccccagaaacggaggtcaatagaaaggatgtcaatgatccggtctttgatgcctactctgggtaatggattgtcatggctatcagctaagctgcaagatcatttattggaaagagttaattaaacgggattggaggagaagagctaaacaaaatcggcccttttcagatgataaagtaaaggtttcgagattataaggaattaaggcgctcacctaacagactcgttgaggcaatctttgatgagaccataccaagtagtccaaggtcctccatatgtaggaaatttgacggcaaatccacccctcatggattttacaacatcttcatattcggacagattaatgctgttaccgttactgccaccgccgataggagtcatggccaagtatccacaagaaggttcgatgtcttggatagatggtgctccaaacgatgggagcatataataaacgtaggacgaagtcgtggtcaggcaattcatgggctggtatttgctactactgttcgtaattagttcctgcgaacaattgacaaagccgacccaagtaatcatatcatcaaggcccaagtcccagctgtcgtgtgatcctgggatacccagaccaacgtaaggcagctggtccgagcgaggaagagggcagctgctgtttgcatcatcctgcaggttggcgtcgacgacccaaaagatggaagcagtgtagtcgatgctactcacatagtatttccctgtgttgatccgaatggtggccttgccatcatcgctgctgcagtctagctcgtacgacgagacgccgcacctgcgagggtcgcctcgccggcgaaaaggatgagttatgtttgagagatggccgcaggagaaaggttggcactgacgatgccgtcgtccttggacatggacgacgtgatgatctgcatccgctaccacaagtgcgagcacacacaggacggtcgacaaagcagctgcttccattctagtgtaggctaccaagctagctacttgttgctcgctcggccggctcctacttataagtagtacgacgtacgcgctaccaagaaggggaaaacagaaaattgagtatacgtcttagccattaacgcataattaattagatattaattattttaaattaaaaaaatagattaacgtggcttttaaataacaatattgtatatatattgttttcaaaaaaattacaacggttaatagtgcggaaaacatgcgcatgaaaaacaagtaattttttcaatctttcagctcggccgaacctttaaagttcgaatttatattaggtcgatcttatgctataggttgtgtccattacatatttcttatttatattaagtcgaccttatgcgaccatcgaactcgttcgtcgatcaaagaaaaggcagtgaaagccaaagccaaagtacagatcaagtggccaaagccaaaactctcggctcacagtgctaaaagcagtaactaaacaggctactcggtagtagaatatactaccctttttatttttttaatgatattgttgattttttataatgtttgattatttgttttattaaaaaatttattacaaatatgtaaaagtataagttaagattataatttcttcgataataaaagcaagtcataaaaaatatatttatatttttagtaaaatggatggacgagcggcgtctgctgtcttaaaaaatgaacatacttgcgtgttgcgaacttttgactgtagtactgtacgacaacaaagctcgcgcgcgtgaattagcatttctgcgtgcgccaggcctaatttccacacgggaattaaactttactggccggtttcttcaattcttcatatgttaatctctcatgagattggacatgagtggactggagcaagtctacgatgttcaaggtcagtcctaggccggcatgattttccaaagcaccccctccgtttcatagcttttaactttttttacctgtcaagctctttcatagctttaccttttttttttactagtcaaactctaatcaaatttatagaaaaatacgacaatatttttaatacaaaacaaacatattatcaaaatgtattaaatattagttgtaatgaaactaatttggtcttttagaatttatatgttgctaaatttttttataaatttaatcaaacttaaaaatgtttaattaggaaaaagtcaaagtgacttgtaatatgaaaaacgacttatatagcacgaaacaggaagaacatacagcgcattgttgcttacaatgaagcacacagttacactatcctgagcccacatatatatatccgccttcactttatgtacatatatggagtacctacagactacagttatcaaaccaattgcttttgcacctatagagtcagagatcaggatgagtagcaaatttctcgccatgtatctcctgcttgctctcctcagccatggcacctacagctacagtgccaccacagcttcaggctgggaagaccaagacttcttcaggcattgcccagtgtcccggtgcagcgacggtggaccagagatccggttccctcacggcctgcaatccagcaacacatcatcagcatgcggcgcttcatgcgccaagctagcatgctccggccaagacaccatcctacatcacccatttctggggccttgcaaggtcacctccatagattacaaggaggccatcatgagcatcatcccgcttgtgtactcctcgtctccatgcccgcttcagaagctcatctttgacaatctacagccttacgactaccatagatgtaaattatacagctgggctcctgcaaaaatagtacgctgttcaaaagagttcacaccaaatggtacttctccagtcgatggctacgctttcatgaacaacgccgattatatcaccggcccaatctcctgccccagtgaggcaagtcacttctcatatttggtggatgctcggctatgcatgtatgtgcttcccttggactgcaggatcgtctccagaggctccattccaatacccggtccagcctactctgatatcggtggcccaacattcaaggaaagagcagaaaaattcatcaactttgctgagacgactgtcagttggtattctgatgacgaagttaccattaactgcacagagtgcgaacgtcaaaagcaccgctgcgcattcagctcacaaaggaatcgaacattctgcatgagccgcgagcatcacggtaccattgctaacttctcaaaatccaatcctatcaccctagttttatttcctgaactacttttctattttccactccctccgtcccataatatagcaatctagtaccggacgagacacttcatagtacaacaaatccgaacctgcttactgtttagattcattgtactatgaagtgtcacatctggtcctaggttgctatattatgaaatggagggagtagctattatgatttagccatacagtactagagtgctgctctcgcatcattaatcttacatgagatatactgcaaaattatttttgcaggccagtagtctgctcctagcaaccatctaggaagcttactagctagctttctcgcacattaagtcattattccttccatacaattccaataaaaatgtcccaatacttagtgaaatgaagatagaactatatttgttcgacgggcatcagtaggataatttgatatttgataataaaatctggaacttctcagagatattttcaggtatacaggacactagagcattgttacaaaaaggaccagaaagcaaatgatgaaataaaattggccaaaagtttcatgagaagtacggtgatataatgttacacacaaaagattgcacacataataactgtctgagtcttttgcaccaattaataaatagccagctttttatttttaaacaagcataaccagccagtttttatatgtaacaatctcatatactgttaagatttttcacgatatttacccaagaaacacaatttggataacatagagaagaaaaatcctccatcaacatatttagctcagcatcgtcacaaataacaaaaaggaaaaattaaagaacttcgagttgctagagttggtaaacggaccagtacacatgctagttcatacgcacttgatacaatccttaagaatattttctgaggaataaacacaaactaaaacagaaaagattacctaccaacagtatcaagtgactcatgaggccatagaagtaaacacgtcagaccatattatacttcagtcgctgagtccataggaatcacattcccttctggcattactgacttgtcagattttgtggctgcattttcgatactgtcctggttcatcctggaactgcaggagagccagttgacaaccaatcctggaaaaaaaaaagagaaaatgattgaatatcgatgtcactctggctcattctggagctgattttgctaatacactgaggtaatgtgctcctggaaaaatgaaatagtttgatggacccatatgaactatgaaaccatgcaagacaaaacaaaacacccaggagtaaccaaggtggcgtctggctgcctctagaattacaaagtagctcgaaagtgtaaataattgagactgcgagggagcacttgactgagaaagatataacctgagtattgcttttgttaactgatacaacaggagctgcagctagatctgtggttgcttcaatgaatgatcagtagatacaagagttgatatgtggaacccttgataagttaacccgcaatcaacctcaactcgctctaacatccttatctggcattctagcataatgacaaaattatcagagctagtatgcagaactggcttatgatgatactgctaactaagatgtaaggaaaaattcactattgcaaacatattcatataaccatagactcatagtgcagttgttcctttaaaactaaaactctatcctatcccactagggccatgttctgttgacatgttgtgtaactaattaactatgctggatctcattgttttttcaagaagtacttgttcattatcagttaaaccatcaatcaaatcttattatcttttttggtacttgcaggttcgagtgtcaaagtcatttcaggtactgctataattcaaacctaccctctattcattattcaaaagagagaagaagcactgttataacttatcagcaataaaaagttcttattgctggcgcttctgactcaatattttgctaaaaaggacactaccttgccttacccatcaggcaactacaatcagttgatcactagtccatagctttctatcctattgcaatgcgctgatttcccattctctgtttattcagctacatcatcggcagctgcatttgttgttctttcattgatcatagccactgtgctctatatttcgctgaagtcaaggtatgacgaggaggtacatttgaaggttgaaatgttcctcaggacatacggcacatcgaaacccacaaggtacaatttctctgatgttaagaagatagcaagacgcttcaaggaacaattaggtcagggtggatttggaagtgtctacaaaggagaactaccaaacggagtgcccgtggcagttaaaatgatagaacacactacaggaaatggagaagaattcatcaatgaagtagcaaccattggacaaattcatcatataaacattgtccgccttctgggcttctgctctgatggaacaagacacattcttatctacgaattcatgcctaatgaatcattggagaaatatatattcttgcatgacccaaatacttctcaagaactcctagcagcaaacaagatgttagatattgccttaggcattgcccgaggaatggagtacctgcatcaaggatgcaaccagcgcatcctccattttgatatcaagcctcataatatcttgctggactataacttcaatccgaagatttcagactttggtcttgcaaagctgtgtgcaagggaccaaagcattgttaccttgaccaaagcaagaggcacaatgggctacattgcaccagagttatattctaggaactttggggagatatcttacaagtcagatgtatacagttttggcatgctcgtgttagaaatggttagtggaaggaggaactcagacccgagtattcagaaccaaaatgaggtctactttccagaatggatctatgagaaagtaattactgggcaggactttgtacttagtagggaaatgactgaagaagatagactgaaggttagacagatggccctagtggcattgtggtgcattcagtggaacccaagaaaccgtccctcgatgacgaaggttgtaaacatgctaactggaaggttgcagaatatagaggtgccccctaagccatttgtttcatatgaaagccatgctgtgccataaatcatagtaatgttatgggagttatacacttatacttagttgacgtgttgcatagtaatgtctagaaattgcataatatgcaccttgactgcacattgataactgtatgaattatgaatcgtggctctttaccatgtaatgtaatacaagtaataagaaacacatcagttgatgtgattaccgtgttcagttgttgctatgatatatctccatcaaaccatggtgtgcagagtactcctggctgcactatttcagtaattcatgggtccgtagctagtggcttgcaagaaaatcctgaaaggaaattgaattatggcaatttttcccaggcagcacaaatataaaatatcgaagcaaagagtattatttttgtctgtttgtccgtgcgaacggccgactagggtaacattcataccctgaattcgtcactgaataaagaagtagattcatatcctaaattcctcactgaactaagaagtataataagtaaagttggcttggtcacattcctatccatcccattcaaaaagtcagggcccgcctatctatctgatggaaatctcaagcaaacaggatgctgctgggcaagcaatcgaggagctacgaatttgcaatgtgaagagatgaatgggcatggactcgactagtgaataagtacactttaataaaacttagcaaaaataatcaaaagcagaggaaacgggctacctttatcaatgcaaggagggggcagcgaactgaacaaccaccggatcaggagatctccccgagttctgtcaatcctgcggctcggcatggcatctcgcttggggcctggatttgcggctcgggtctcacaaggacgcagggagaactgaaggcgacgcatagaccgggcaacgcgcgttgacggcgcagtgctaagaagagacatcgccggggaagcagaggcggccgggagtcggtgggatcgccggcgacggcgaagggttcgtggcaagagagggaggaaaggggattccgtacggtttgcaaccagaaactaagctcggcctagggctagtaatggggccggccctaaagctcctgccgctaatgggcctttatttgcatttggaccaaaaaagacctgcgggaggcctgtcttctttctgctcgtggaaatttttataactgtaaatcgaccatttttataacttatagattttgtggttttttcacggaattttattttatagcatttacttttgaattactaagaacccgtatttaaaatttttatctacaatttttttaattgctaataagtcgtacaaataagcatatagataagcaaaatatgaatcggaaccgggaattgctagatttcagtcacgtaggaaagaacatagcaacagtgccgaccaacacagaacactagcttagctcgatttttgcatgcattcatacagatgaagcacaagataataaatcgtacaagcccacatatacgcattctacaggaatataggaataggagcatagaaactgcatctgtgtgactgtctacaatcatcacaggcttgagcacaacctgctcacgaaaagacatcaacacaccatacttgctagtactagctaattcaactcagtgatactctcgtcttcctcctcggagattgcagccagctccacctcggaggacagatacagcgactccattgccgggatgtagtcatcgtcacagaagaatggcctaggaggaatttgcaaacaatcaacaccaccttcaagcatctctatcacctcgctcatcatcggtcggtcacaagacctcatctggatgcaccacaatccaacgatgcagagcttcttctccaactcatgcatgtcggcggcagcggtgatctcacctgtttcttgtcgggtcagctgacggtacactcgtgatggatagtatgcctggcttgaattctccgcattcggatcagcattccttcttcctccggccatctccaatagtagcatcccgaagctgtaaacatcggacttgcttgatatggcaccaaaaccccgagagatcatctcaggagctatgtatcccactgttcctcgtgctgcgctcactgggacaaaactcttgtcccttgggtacagctttgcaaggccaaaatcggcaacttttgggacaaagttgttgtcaagaaggatgttgtgcggtttgatgtcaaagtgtagaatttgcatatcacacccatgatgcaggtagttgatccctctggcaatgcccaatgcaatttcatttagcttatcccaggagaaactcttttcagacgagaagatgtacttgtcaagagaaccctgaggcatatactcgtacacaagcgctcttcttatttcttcagagcagaacccgacgagtcgcaccacattgacatggtggatcctaccaatggtggagacctcgctgatgaactcttcccctttgcaatttgcgtcacccttcagcatcttaatggcaactcggacatcaccagggagtagcacacctttgtagacggagccatatcctccttggccaagcttgtctctgtaatgacttgtgatggcaataatgtcggtgtaggagtatctcgttggggtcagcatttgttgcaattgcagaaacttctctacttcatcaactctcatctttattttccagtacatgtaggcaacggaggtccacatcagcagcatcaccaggacgaacctgcatgctacaccataaacatgttcatccctgctgtagagaccaagtgtatgaacaaatagagcatgacgagactacaatacagcgaaaaaggaaaatgtaactgaaatttgatatgtgtgattgtcacgtaccagaaatgacccttaaaatccagaaagtttgtggcactaacatcaggagcacaacaaaagggtgtggaagttgagttgcatggcggccgcatatcgagaagtaagaattgatattagtaacaatgacgaagatccgatatactgtcggttctccattactgtcgctgcaagaccacgatgtcatgcatgagccattgtacagcaaagcaaatttccaagataatgttatttggcattggtaaatttcactatcaagaatgtacaaggaagacgggccaaagtgttcagttttaagtcccaaataaattgactcacctgatcaagccccttaggcagtcgatgaatcccccagacctgaaaggaaaacgaacagcgaatccttcactcatggatctgacaacatcttcataatttacatcctccagtgtcgcagccgcagtagcagttcgccaattctctagaccacccagagctaaaggagtcattgccaggtatccacaggaaggctcaaggttctcagctaaataagatcccagaccagttagcacatagacgaaagaagagttgccgctccggcaagccacaggcctgtacatgacattgctgctattcatttcctgcgagcatttcacaaaggtagcgaaccaatccacatcaggggacaactggacttggacacggcggtgtgaatcttctccaagcctgtagttttcattataaggagtctgactccaccgaggaagagggcagttgttagctgaatccaagcttgcatcgaccacccagaagtactgatcactgtagttgatgtcagttaccaagtatgttgccttgtcgatctgaattgtagcattgctgtctgcacaagtcagctcatatgatggaacaccacattcagcggggtcgccttgacgacggaatgggaaatgcacatagctaagacgtccgcaggagaaagatgggcacttgcctctcccctgaacctgatctggtacaacaagtgcaagcacagagaaggcagccatggcctgcagggcagcagaacgacgaaacgcaccagccatcgctacggtagctagcttcacaggcagtgcaaacaagcctattacaatagagaggggcctgctgtccaagctagctagctatatgcttagcccacatgtcagtgactttcaatatagggataatacagcagaggatctcaattgcaaatggacacgggtgggtaacaattacatggctgagagcagatgacagtgatggcattgactgacttggggaaggaaacaatcgagcctggatgtgacaaaagagagcatgtctccagcctcaatccattagagcatcagtatcagtaaagcagtgaaaactatgggattcaattcatgtggtctggtaaatttggagagagcaaataaaactggagtacctcatctggaattccagagtgaagacgagatgcacatttggactgaagctggtccgtcccatcatctgtcacaaaataattaggaagatcagtgtgcagaataaggctttcggagaactcttttacaattggatatggattggagtaaactatctatgaagaacttcacaatatctttactacacagggctgtgctgcagagggtcatttacaatagcttctagccactgccagcaaattcacagtttaagtttaacactaacaacagttcaccgttgcatggaagtgcggcttcattttctgatgacgccaggaatgcagtcacactaaaaaggactgcaacatgggaccacagaagtttcattgtactttgggattgctccaaaagtacgctgctatcatgagttcatgacaagcacagcataaactcccagtaaatttcattatagttacattcatggccttctccttgtgccttcaatcttcaacagcactacagaaacatggctaaacttcttgttgttgtgctgctactatctcttctcatctatgcggccacagcatgggatgccgagagcttcttcaacttcaagagttgtccaccaaatcagtgcagcaaacatggaccaaaagtccggttcccactccgccttgcatcacaatctccgtcgtgcggcacacctctcatggagttatcatgttctggacaggacaccatcctgtatcacccagttctaggctcctgcaaggtgactgcaatatcttacaagcatgctgccatgtccatcatcctgcttgtagattccacacctcactgcccacttcagaagctcatctcgacaaatttatcaactgatgtgtacaaacctcaaaaattggaagctgcaagcttagtaagttgttcaagagatttaccaagagatcagcacggtgtagttggcccaataacttgcctcagtaacaacgcaagccagtggtatttgatacatccttatgcatattgtctgttcttcagccagactgcaaagttgttagtaatggcatccaggcaccctcaacttttaaggaaacagaaaatggagtaatcggtgttgatgagttggtattcacttggtactccagtgacataaccagagattgtcaaaaatgtgaaaatgaaggcaaacactgtggtttcagctcacaaaggggccgagcattctgcaattatggtattttctctttctgaagcagaaatcttacatcaatattatgacttgctttgccttggtaggaaactctatggtctttaccttttcattctcttagtttaaagtttgccaattaaattgttcaaaagatttccatagttgaattagttgtaaacactgcagatcagagcagctgctagccaatggaagcataccaaagctctaggttcacatgcatggttattctaatttaaaacgcgcgcacacaagagaaggttataaccgattaagagtaacggaatttttttgaaattcttaaaattaaaaaaaaaaccattcatctacaaggtaacctagatcaaaatgaatttttctttaggattggagcataggcatcccttggtaactagagagggtgctatgaatgaacacactctccaaaataccattgttagtatcaacgtatagtttatttgattgtaaccatttggactggaccgcctatacatgttccaagttaaagaaaaaaaaagaaagaagaaaacataatttacttagcaacaactgctaagcctcacgttggttccatgtattccagccatagaaaccacacccacattccttaatgtcaatactatactctctactctagcttatcactagaaccaaggatggacatgctctcagatttgatgtggtgttctggttatctttaatttctcactttttcacaataagcatgacctgaactttggcttgtcagcaccttcttggatacatattcttgaaaaaaacaccatactgggtacttgcaaaaggaaaaaagaagaaaaagtgaactccatgtagggtcatattgatattttaattctgaactcttgcatacctatgttagatacacagaaagcaacaggatcttcagcatgaacatgtttgcacgagttctaggtcactggtgatccatcatgaaacacagcttggtgcccaaagaaaccagcatcccatctgtctattgataatatatatttttttagagtaaatttcacttagagccatcttttattactgatatttcgctttggccctttaatcaatgttctcactttcgaccagttctttgtttttaacctttgtggcactttggaccaccctcaactattttatccatctacatccaacttatcatatgccaaataaatggtctttcatatagctgagagagttaattgacgagtacaagccgacatactcgagatcgttcatatgcttgagaagagagttgtgatggtccaaaatgaagcgaaggtaagattacccggaatgcatgaacctaacaggaatgcatatctattttccagacaagttaggatccttattggaaaaggaataatttttgaggagtttatacatatatagccctttgttccatgttgtccttcacctgttatgcttcctagtgatagatcagagatgccctctctcagtgacatgttgcgctagaatatatatatgggcgctggttgtcacatggcaggatgcttctcattccttctttggcccatctcctcctatacatgcgcaggcatgatgcatgcatacggttgcatgcacaaaccagttaagatcagagaatcccagcagtgtagtacatgcatacttgcgacgtcatatgctatatacctatactccactcggtgctagctaggttgaattgagatcgatcgatcagatatggggataaaaactgatagagctaagctagggcctggatgcagagagatgcagccatggccttctgttttgttttgttctcaagtgagatacgacgaacctgcatgctacaccataaacaggttcatccctgctgtagagaccaagtgtatgaacaaatagagcatgacgaaactacaatacagcgaaaaaggaaaacgtaactgaaatttgttatgtgtgattgtcacgtaccagaaatgacccttaaaatccagaaagtttgtggcactaacatcaggagcacaacaaaagggtgtggaagttgagttgcatgacggccgcatatcgagaagtaagaatcgatattagtaaaaatgacaaagatcctatatgctgtcggttctccactactgtcgctgcaataccacgatgtcatgcatgagccatggtacggcaaagcaaatttccaagataatgttatttggcattggtaaacttcactatcaagaatgtacagggaagactggccaaagtgttcagttttaagggattctttttagaaataatacttttttattagagtcgcaataatagaggttgacagacaaaaattgcaagtataacaccctatcgagcaatcgaactgtggttgttcgacggataaaaaataaaaactaagagagaaaaatcactgtgcgccactgtagcatgcaggacctatcaaacatccccagttcgataggccaccctgccatgctcttccatgtattttttttaagtggaccaacaaccctgtcgaacaacctgtcgaactgtggttgttcgacagggtataaaacttgcgattttagccaatcaatttatatttttgcaattttttattaaaccaccgggcagcggcacagttcgattgaatcttcattgatttcaattgaatcttcagttacaacattaagctattccagtgagtatgggcgctctggatcctttatatctctaatatgatgtaagaaggttaaggagtgcaaacaaaagaaaaattttgagggcagcagaactccagatagaggtaagtataacaggaaagaaaaggtacacagcatgtagataagttaacgaagaaagcacatcaaatatttctagctggtcaatagcctctgccgcattttcatctgtggtttctggtgcctgccgagcacgcctctcttttttctcataaactacaggattagcatttattaatcccacaaccatttttctgatgcaatgcactaatttatatcagaatggcgaaattcctgcaagttgaaaacatggaaattataccaatatcagtcttgaataattttgttaatcactataaacgttcaatggagatattccccgcccaatctatcactagtagtctactagtaatattattgtggactgttaataatcaagactaaattgcgttcgttaaactatgaaatgtaatttgatccctcaacaccccgatgaaagaacagattgctaaacagaaatgcaaaatagaggtgtgataagaaatttgctaaaggatatttagcaggctaaactctgaagcggtcgcgggccatatggttaatcactaaagactgcaaggactgatgtaacatggggcatgggggggttcagctgaaccccaatttctttcggaaacaaattgcttagtataattaggttaaggcaaaggcaaggagtaccgtattgcaagagaagctaagcgcatctgtagtatcgccccaaattaaacagaacccgcagcgatagtaaggagtatagcaaccgtacgtcgcgcaggaggcggcgcaaggcagaggccaccggagagcaggcgtcgtcgtcgcgcgaggcgaagaccaccggggagaaggggccgccgccagcggaggaggcggcctgggatttgggggccgaacgaacgaacgaacgaacggggccaccggaggaggagactaaatcgaaccaaaccatgcaccggagaggatgcggcaggacgccgggagacgctgctcgcggggtggagatcggcgccgccggccggcaagcccgcgagttgatggcgacggggagatcggctagggcagggcaggaagggggagatgagaaaacgcacccctccaactccaaccacaggaaacgggcaggaagggggagctcggaactcggaactcggaagagaagaaaagctcaccggcggcgggcggcgggcggcgtaggcggccgtacaccaccgcgggggcgtttgagcccatctagtggtgctggtggtgttccattctgacttcgcttgtaacatctgggccgggctgtgaatcctcctccgtcatgggccgacatgccagagtccaacatgaatcacccccgaacccctttccttccttgggtatttcatttactggccgttcgatgcgatctagattgcgcggattaagggtcggtgtttaaaactcctaaccccttttttaggttgtgagcgcgttagattgagcggataataaataagccattcgtcgcaaaacgcaaagtgagccgagcgctaatcatgctatgcttgcttagatctagggatgtagctatatttatggcgccatattttttataaaaaatagtcggtatatatttacattgtaagtatctaaattacatatgtaattttagtgtatttacaatgtaagtctcaaaattacatatgtaagtactaaaattacatatgtaaattcgaaaattacatactaattatatatgtaagtggggtgtaaataagatataactactgtgtaagtggctaaaaaaatcaactgtagcatatagcgccatatttctagcaactccgtagatgtagatctagtgccatcagatcattaaatcaccaacggattaatggccatgtcgtaatttcctccctatcaccaacagtcaaatgtagtattcattggtcaggtcggatgcgattttatatgcagtacgttgcactgtcttcttttcttgtgcccctgtctaaataaaaatgaaatcctgaaaccccctttttcattaggcataagaaaattacaaataactaaaagagtgacggattaaattctgaaatggcgacgaacacacagtgaaaaatgccgtcgccaaacttcttctcatcggcaataccgttttgagtcaactacaatattatggaccccaaagcagggcacggctgcagatacgttcaaattttcagatgttgggcggaggtctttcagttctgatcttgcccgagtacccgcgttacgactccaacagcgattgtgcttccaccagaccttaagaatgccctgccaagagctcggcatttggagaattcttcaacacagaccggagcgtctaaggtaacctgacaaatatcaagaaaatcacaacatcgcaaatgatgacttcggaagcaatggctcctcacaaggatctgtgatcagttgttacctgcacaactgcattctgctttgacttaagaaatcgaggtgcagttttgcttggtttgccagccttgtcaagcaatgccacgattttcgtaaccctcgcagcctccttcacatgatgtatgtgaaactcgacctaggcccatatttttatcagattgcatcagggaagaaaataatcaaaaggagagcttttggtcatatctttacctgatagccaataaggataggaatggtgacgtccaacactagaacccttagctccaagaagttagagacaggcactgggaaaccagggttgcaaagaatcccacctgctattagcttactcccatcgatgccctgtaaactaaccgctacattatcaccagctcttgctatgtcacatgaatttgaatcccgctcgatggatttcactgtcgccacttccccacaaggtgaaattaaaacctgcaacagcaagttccaagctgtcaaaacagataggaatgtcaagacatttgcgtacaaaagcaagtataaatatatatattttttaaaaagaccaaattccgacatcatgctgttactgaaagattggcatgcaaatatgcaactagcaaatgtcacaatgtaaacgctcttgatcaatctttcctctatcctcatatttggagctcatctcaatgaaatatacaagtatcaatagtccctgctgatttgtgaggaatgtacctttgaaccaattcgaatagctccagtctctaattttccaaatgctgccaactgccctgttgactgagacttgataacatcacagataggaagaatgaggggctttgaaacatcccgagatggaagctgcaaggaatctatagcatccaagagacaaaatccttgatacctgaaaggacatcagttcaagattcctattcttcagataaacaaatgattttttttctaataagacagtatggtcccaaatatttcaaaatatcagtaatgctattctcacgagtgcttactacaatatgtcgatattaccatgtgaaaaggttagaaattgcaagatgcatgaaacagccatctctgttgaaaaattctacacaatgtagtgtttcgaatggcatggaagtagtgtgtcaaaacataacttaccaggaagttaaacggacatcagaaggaattttgatcaaattctgattttcaacagcactaagaggaatccaggtaacagatgaatctttgaagttgcatgcccgcagaaaactaccaagttgaaccttgatgaactcgaatctttctttggagtacccgatggcatccatcttgttgaccgcaacaataagctgttcaacgccgaagcttctaataagctgagcatgttcttttgtctggccaacacttttccctccttcaccgtccatgccagcttcaaatgaaccagtgcaagcatcaacaacaagaatagctgcatcagcttgcgttgcgccagatatcatatttggtacaaaatctttatggcctggagagtcaagcaaaactacacggtacttattggtctccaaataagccacagccacagtcattgtcacacctctttctctttcttcactgctttcatccatagcccacgcataagcaaatgatccttttccctggtaaaaaataatttccataatacaagaatatgaatggaacatcaggatcaagtatagtacaataacaacaataataaacttactttttctttagcctccttctcattcttgtgcatatcttttttcgatatccttcctaacagatgtagcagtctcccagagagtgttgacttgccagaatcaacatgacctacctaaacaaattgttcgtagacagtaacctatttagacaaagcacttttagaataacaaaattgttacggaacatatgccatattcagaacagaagatgagtatagcatactattgcaaggtttagttggctcagcactcctgattcctcattagcaaacatccacttctcaggcttatattcttcaggtaaataaggttttgcagtatctacttcattcttttctaaacctagcttctgtatgtcagaagaaagtttctgggccacatcctcattctgtgcagaactggtagccctactactctggtcctccttcagctgaaaatgatcagaaatcaattgagctgtcctctcgacaggcacatcttcaggaagtgcaatgtgtttcacctttttcccagcgcctgatgagctaccaacagatgcgtactgtgtggaaccaactgttgaataataaaataatttaaattaaggtgacaataaaagaacaaagctaacaggcttttttttcaacaggaaggcttatcaaccaacagatgatacaactggttgggaagatctgcaaatcaagtacaaataagtcacccttacaaaagtagcttggttcagacttcagagggcatgacacgtgagctgtgggttgttgttgtccaacaagtgaaacattttttagtggtatgcaagggaacaatctgttcagccacagtaagtgacaatggtgcttgggaaagaaaaggatcaaaatctgcttcccgcacataagatgagctaatgtgattcttttatatggtgaattatgaattatccttttcataactcaataaggtgttatggtaggagaagctagtttaaaggtagaacagagttgcatacacaaaattgtacagcatctaccatttgcaccagcagtacctttctcatgagatatgctagcattctttatctcagggtcaccaccaaagtctgtagtacgagtattcactggcatctttgtagaatcagatttcggcatcgaaggtgtcccaaaatcacttggtatcccatggactgtaatttaatagttatagtacactatgattacattagaattccttgtcagaatacaaattgtgattcaaagagaattagaatgggtgaaggatgttaccttttattgaaccatccttggcagatttcataaaggattctcgaaaaaccccacacatctcacaatacaccatgctttcatgattatcgaacatgcacatggagcatctccaaagcacaggcaccatacttgaggacttcttcgatgactctgcacaatagagtggtgacataacattagagatcaaggagctgcactacacgcagttagcttgatatgctgagtaagtcacaaaaaaacttcactgtacaacaacaaagcaaagcattcgatgcgtggagcttatgcggaaagcaacggttaaatgtataagcatatgaattatttcaaaatgtgtcaaatatataaaacaataatatgcatatgcaccaggattcagcaagcaaccagtaggtaatactggtagttctaactggcagccagctatgtttcgattctcacccaatttgggtagatttaatttgtagtaagtttttattttgatggactggatgaatgatatttgactcattccaaaaaatgcatgttgaataacaatgccttcaagaaaacaaatatctgaagtgcatatgatgggataaatgggcaaggaaattatcacaagaccaggtaatcggcaaacataagctacacgatcactgcatttgtttgaacaagcaatgctattggaagttttagagtaattaagcactagaaattcttatttgcataatcaggcaatagaggatgcgatagcaagtacgaatgcaggatggaaacaatgtaatgacattaacaacatttaacaccactgagcaaattatgataacgggtgaaggctcctagtaacctacaccgccgtgactaacctacacgagtagatatgttaggtgtgcatcatgaagcgactccaatagctatttcaccattcttacatgctgaggtgtacactgtctagtactagcttcaaacctttgacataatacctttctccttcgtagggtgctgaatgtcgtcactgtgcccagtcccaccgtaatcatcatagtcttcatcatactcatcatagtcatcattgtactcatcatcgtagtcaggcccagagacaaccttgcgcggcatcctgctgacacagggcagacctaatgggggaaaaaatagtgttatt

SEQ ID NO: 68502 - DNA, 36117 bp, Oryza sativa
cctaccattgaatgaacttttgtatatcaagtgcttcatggaaataagctgatcaaccatgaaaaaagatgttccatcggttatttttgtcagagcaaagatatccatgtaacatgtgaaaaaatagttggctcaaccatgcagtaagccatgcttccatggtaattggttgaatactggcagctccagattctcgaccaacaaagtggttcatctgtatcaaaacattgttttggtatagcagatcatggacatcaatacatcatgttaatagaagaaaaacataaaacttgtttttttaaccacaaattcatatatatatttttgtatttttctaggacatagcgcctaaaaatttgcaaatagtttgctaattgttgtgggctttgaactacattttgcttctacgccagtctacttgaataagaacgcagacgaaaatcaggcacatgcacatatcaaagcaaacatccaactggccataaagaggcaaaaaaaaaaaaagatagcgtaaaatttccgtacaacagaaaatggagcaaggctgtgccagcactatgagcttcaggataaatagaagtcgatgtataaaacttattatatatagtactatatctttattagagacaaaatggaatgtatggcatacgtctatcacactcatgactcatgaatggacatgactttcgacattgatatggtgattgttgtctcataagcaactgtacctcatactaaattttgtataccacttgtaaaggaaaaccttattttgtaagttgtgtgtgattaggttcactgtaattttgtgctcaaatccaaatattattgctcatatttgcaggcaataaagtggagatgcaagcagagaagcaatatcagacaaatgatgaaataaacaatgataagaccaaagagcaaaacttgaaggaagcttctctaaaggacatccaaaacaaggcctgtatagatcgtcagaacattaatggaacagagccccatctagctaactcttttaaagattctaggcctgcatcaccaggaacacaagcactaatgtgtgatgaaatggatactacattcggaaatgaggattatagaagtccatttgtggtgccttcacgtgatcaggatatttctgagctaaatgctgatcaagaaagaatagtattgacagggctgcgagattatcttcgtgtgcttatcacacgtggaaatataaacggtgagtgcaacttgcttacactgttattgtgaatttgtgatcctagatagcacatcgtgttcggtttgctaaaatgttaatttcacacatactttgccatggcataagagatcaaatattatgataaatttaaagactatcaaatctttgaaaaaataagcaaagctttcctggacagttagaatatatggacattgacttcaaaatttcattgatcactatggatgtttatgatgaaacgcagaaatattgttataaaatagctccatctgaaaattatataaggttaataattttccatgattgtatcttcttttgtcgttttcgtatagtcctcacatatcagtatattactagaaaatagcatttctaattctctagtgatttttttttctgcttttacctttattattggaatgtgttggttattagacctgcaatatctttaatttgattgcctttccaataaatctgagaacctaatggtcggtgccacagcaaccaaattctcgttagagacagcaatggaattggattcccggaggcatcatggagcaacaactgttttttcccaagacaaatctatgtcttccagttgtcgtgaaacccttggaaataatcaaacatctatgtcaaatgatgaacaaaaggaaaaaagtggaggttaagtagtagtattagatacacactgcactgtaaatgatcacctctgtacatggatggataagatagatagtataatcctcgttgcctaatttgggcaaccggcctttgtagaatcgatcattgttcattgagtgtagcaaagcaacactttcactgatgtgttgatcaattcaataaaaagtcaattgatttttttggtcttcgaaattgtctttctgggaattgtgaaaagccgatgtcactagtgtcgatgggggatacccgtagaccggatacagagggtattggggtccgttggaacgagaatttacgtaatacgacataaaacaaacaaaaggcgaggattatactggttcaggccccttgataggtaatagttctaatccagttggtatgggattatatgatggaaaccacagattacaaagggaataacagaacttgataataccgacgagaccgtagtcgagttggtccgactagatctcctagtgacttgggtcctgtaggctccgactccgtaggctgtagtgggtatgttggcggtgatattcgatgctttaggtcctgcctagggggtcccttttataccgcgggtcagttgatctccaagtaggactcggagatatcggacccctcacgatatgataaagacctagtattgtccgagtagaactctttccatccgtagataccatatatatcacatgatagatttccttaatgtatacggaaactatccgtatacgtgcgggtataccgtatctgtatacaatgtacatccaaggatagagggtataccttatccgtaaccctgacagtagcccccgacttctgcttaaatgagctcatgtcatcgatcgcgacttctgatgtcggaattgttgtcgttctcatctggtcgatctcggtgtgaaaaccgtagagacgaagagccatcgacaacaccgcatgaagttcaacggtcatgagtgaatttaaattgaagtctaaaaactgccgcgcgcaatggacccaggattttccaatggcaatctctctcctttccttgggatacgcactgtcggaagtgtacctatttaaagggattttgggaatccatttgaagtctgtttgccaaaaactctcctgcttcctagcgctcttcgtcttctccgcttcccgcaaagaaaaccctagctcatttcctccgtcttgttcttcggtgatcctccggcggcaatggatcttgaaaagtctacctccaccatcgcgtccatgaagaagctgcaagacgacggtgccctccctggtcgggggaccatgcagagggaggcaggaggtaagaacctgaacccatcttgggccgcatggttgtggtcgaagattatatttcttgcggttttattcctccgccttccgagtttcttcttcttgtcttgaacttctatggtctttctttgcttcacttgaacctcaactccatcgcattctttagcatcttttctcatctttgcgaggcctacattggggtagatgttggcgggtgttaaatgtcaattctataccgccaacatttgcataaagatcagataataaaacatccaacatagtgataggtgcttaatctcacatattccacaagtgttggtgtatatttgtatgcagatgataaaccccggtgttgggagaaaaatcggactaaagtgaggagaattatgcatccttacaaggaggggttgtgaactttatcaaaacattagtgaatcaacccaaaactccgagaaatggacagaggagagcccagggagtccaccgactgaaggtgtcacgccctgaagtttcccccttttcttgctaaaaaaattggttaaataaattgctcgaagaaattgtttaattaacctagagttgaatccctaattaatcaatgcaattaataatcggaaatggcgtggtggaatttttcttgagttccccatgttgcaatatattaacaggatttttagtggaattttcagagccttggaaataattttaaccaattaaaaatgagcaagtgcaatatttaaccctcaggaaatcctttttccatttcctcctttttcttttctttctttttctttgttgggccgtcggcccaacctccctcccacgcgccgtccttgctgggccggcccgctcctcccctctcctccctgaagttctctctccctccctctctctctcaagcgccgacaggtgggccctacctgtcgggtcatccctaacctcccgccgccgccgcctgctccagccgcccacgtcgtccgcccactccgtgcccactccgtgccccgcgctcgcgcccacgtcgccgcccacctcctccacctctcccgtgcgcgcgcgcccgtttagaggccgggattcggtttgaatcccgtctctcctatctctcttttcctccccactcccccacgtcgctggcgcaataggggccatccccggccacgtccaccccttcctcacccataaaaacactcccccaaacctcctctcccatttccctcactcgccgcgccctcccgtgcttcctatcgtcgccgcgccgctctcccgagctccgccgctcaccgccgcatttcagccgcgcaccgccgccgctagagccgccgccgccgctagcttcgtcgttgcgcgggtcatctcggccaccgcctcgcgtcgccggaaccccaccggaaccctatctccctcgcgagccggtgagatatccatccccctccgtctccggtcaacaatggtggccgccgtggtcacttaccccacccctaacccatctctgctctctcctagggtgccaccgccgctcgtccgcgcctcggcattgccggtcgtcgccgccaccctcgttttccgcgtcggttgccgctgccccctctagtgaggactccctcccctcctctctcccttcccgcgtgcgccgccgccgttggccgcgccgccgctccggccgttcgccggtcgccgtcggtggccgcgcgccgccgctgccgcaccatggccggccggcttgagctgtgccgacccgccagccgcgcctcctttccgccttgtgccgctgcccgtggggcccgcgtgccggcgccccctccctctctcttgagccgctgacatgcggggcctgcttgccggtgccgccccccttgctgacgtcagccctggggatttattgcgcaataaattgattaaggacttttctttgttagtaaaaacatagattatcttctaaaattcataagtaattcatccgagctccgtttaagtccattcaagtctcagtaaattcataaaaatccctagaatccattaaaaatggttttgtttcctgtttcagtagtcttatagcatgttttgcttgtgtgctttgtttgtcgcatagatctcggccgtttcgtcgatccgcggtttctcgaagacgttgctaaggtctcataagtgcgagagcaaggcaagtcatgcattacaattgatcatattgtacccaatttacaaatatcccgcatttctgttaaatgttacattcttttacaatgtcatgtgggatgggtccccttactcagccatatattgtttaccttatgccattgataacatgggtatcaaaatgactagatgttggtttaggaaatgcttagccatgcttagttcaactagtatacaaatggggatcacattattgcatagactttgactattagcatagctttggattggtgccaccgcaatggtgttagttaattaaaatacactgaatggtgggctgtgggtgcatggttttgctggtcgcaccatggcaattaaggaccggttcacgggaaaccctgggagacttaccgtgtttaccacaagcgggagtgggtaactgcttgatctaaaatatagctcgaccctttcctaggcatcggtggcgagggtgggcgtgatggagttgggtcggtcggggtgtccggttgtctagctgccggattcaccgcgactcaagaggggaccgtccactgccttttgaggggtgggggtgaaaccttagcgtggtgtggatggttaggggagggttatgcggagggtcttgtcacgatttcccccttcgcagtatcatggtgatacttcggggcatggcgacatgtgtggaatcgtgtcttgtgggtatagttgtacacctctggccagagtaaaactattcgaatagccatgcccgcggttatgggcgatcaaccagattcaccgtgattagtctcaccccttgtttagcttaatgaactggtgtagttcaagtggttggttgggcctattgcaacgtggtgtagcgttggacagtgattggttaatattgattaattactacaattgttttactgctttcaactactgcttttaaatgctagctttgtgcaaatgaacccctaacctcctttggttatatcatgcatcttacctccttttccggtatgacttgcggagtacagtgggtagtactcagtcttgctctcttttcccccacactagagctgaagatcttcctagtgggagctgtcctgttgaagttggtttcgtcgctgccgtcaaggattgcctgtggaatagagtcgccccactgtagaagtcaagtttccaagtttagctcgttttatcttttccgctgcatttgtaatcttttatatttttgtaagacgtggatctgtatgtcaacaattgtcgtttgtgtaccctggctggtcctggacagggatttaatgcacattcagcctagaaattctggttagtgaatttctaggcgtgacagaaggccaggccaggagggcccagcccaggttcggctaaacccctaggttcggccgaaccccctggttcggccgaacccccctaatcaccgttgatcctggggtttggcgtggacgctccagatgctctcccaatgacggttgcggggcagttcggacatttccccttcgctaaccgtcatacctacctctatattaaggcttcacttcctcactttacacatacacttccaagcttgagctgaattataagagtcctccctgtccggctacgtagtagagcgacatctgggaacaacgggttaccaatgcctgaagtattgcgttaggattaaaattaagctttccctagacactgtttctcactagtcaatcctctctatcctggcctatcatttgcttggtgtctttggatgaaccggaggaagctctgatcacacacgttctcttggattccatacccttggaatactccgtaggggaagtgctacatcggtatatccgtgcgcttgcggattttatctgtaatcgtatcaaataccaacagtagagcccttccttgatctcttctgcttttactatgagttgcgttggatggaacccaacagggtatctagatgcgttggattccgacttcgggattgtctgaagtcgcgttacatccccttccaatgcccctcttctcgcagcaagtggcgagcgagatggttctatctttagatagagaactcggatcccgtccttgttgtccctaaagaacagccaaacaaaatcccagagtggaccaccaaacccgccctgactccctccctctaatctttcatcgacatcattgatgatctccgaaaacgggggttgtcggtgtacgaagtcgctgccgacttcgtagataggcggattcaaccgctgcaggcccgcgcccatccggcctttgattactctaggccagaggacacgacccgggtctctcctcggggtatttttttctcgtatttctaattttgttccgagtgcatccgtttctcctgacttatcgagttctcgttctcgatttacaggtctggacagtgacaccgtggaacgccgtgtcggacaggtgatgatgagcgccccctcagcggcggacgacatccccgtctctctttgcgagaagaacccggccgaacgcatcgctgcaattaatgtgagtgtactcgatgattcctttacatctttcttctcgagatcgcgttgtgacttcaagttgtgcaggctctccctctgacggacgtcatcgggccactcgtggaccaccaggcggcagcgtcgttgaaggaaagcgtcgccaaggaggcgtctgacattgttgttgctgccaccacgagtggcagcaatgttccaaagaggggaaggaaattctccttcgtactcaggacccatcggaaagcgacgaactctgcggtaagcctctctctcgttctttagcgcgtagtcggaacgacttgacctcaccccatttcatcttactcaggactcggacgcgtcccctctgcctcagcgaaggcagaggttcgtgacgatcggcgagaagtaagtaaacgttcttgaagtcttttcattctcgaagttttgatcgcctagcctcatgaagagaaggcaaatattcgcaggatggcgcgggcgaaggtggcgcaaggcaggactgatgctgcttccagcgcgtcccctacggcaacctcgacaggattcgtggttaccgctaaggaccaggaggtgacgccgagtagccctgtcgtcagcctcgtgcctacccggagcctgtccaccgacgccctcacctggggagaactccaagcggagatggagcgcctcctccaggccggtgcttgcggcgtaggttgcgagatcgaggaggccagggcggcggcgttgtcggcaaaccagcgtgccgaccagctggcgcgcgacctggcggaggctcacgaggacctccaaaagatgagggagctggtggccggcaatgagatgcagtggcgtggacttgagcaccggatgtcggagctcgagggccacatgatcgacatccgcggttctctgcggacgtcgttcaccagcctgcactaacttgtcggggagtgcggtgtcatgactactatcccggcgtaccccgatgagttctcgctgacgtcgtcgctcgcggaactgactacggcgatggaggagatcccctccaagcacgtgaccaggatcggcgaggagacgtctaacggcatctataccggagcatgccacgtccttgcgtgcatgaggctggcgcatcccgatctagaccttaagagagctttggatcggggggccgccgatgacgcgcgcaagattatgacggaagaagtcggtgacttgggggagtccgtcctccccctttttgaagagtaggatatcttcatgctgtaaaactatttgtggatccaaattgctcttatctaaacagctgtttcccttgtttccttagcatgtgattccgagtactttgttgtcattgtagagatgttgatatcgaggatatccagcagcacgggcagcccgatatgccggtgattgttccggcgcttacgctcgagccgttcgtgccgcgggaggagatcagtcaaagcccgtccgcggaggcgaatatggcaatgatgtcccaaggtttgtgtcttggtctccttcactccttgtgtttggattgacttaattagccgtgttctcggaagagaagagtagcttgactcagtcctttccgtggcgggcagacttcgagaacatgttggctgaccgagatcgtcgaatccaatattggaagacgaagctcgaggtggccgaactcgagaaaaccatggtggaggtgaagaaggaccaggccgtggaggctctccgaggtcgcgaggtgtggttcaactcgtatctcaagagttgctgcacgacgatggcgagggtttgcaaggagctccgagttccccgcggagatcccgaggagtcggcggctggttatatctcgtagttgaatgggcctgcgcacagctcgaagggattggcaagcgcatcgacgaggccctgaagcagaagtgtcgtcaagcaagccgctacgccggaggacatgtgctggcctgcatccgagatcaccgcccgcagctgtacctcgagttcctgcgtgaagggttcttgcgttctcggaggacacccgcggagatcgacggccttgcacagtcgatggcgccgctcgccgagaaggtttttcgctccatggattggcgttggccgtcctggtagtatttgtatcctgtagaaaaacatcttaaggaagcatgtaatatactttgaagtatttatgacttgtaagaaatacttataaaatagaaaaggaatctatctaagttttcttactctgggtatgttgtgtatgagtgttttctcactttgcgacttcgatcagtcacctgagccatacactctccctagcccctagccttgtcatcagaaaatcgttctcagaggataaggctcttggacccttgacctgccttggttgaaaaagtactgaccctagcccccagccgtgaagttggaaaactcaatttccgattacacggcttggttaatacacacggtgagaactcttatatgaccagatcttatatggtcgtttgtctctgcatgatccgacaatgccttatctgctctaggcgtccccagccgaagttctcttaggtttctcataggccttgccagaacgacacctagagttgagactagtttttttttctgtccataataatcatgaaaacattgtactgatctactgccatggaaacatcagcggagcagagaaactgctattatatgtgtacaagtaaacgtatcgtttacatattgacaccaagtcaagtggagcagagaaggatttggatcagatagcgttttgtgttacaatgatgccaagctatatattagagcaacaaacagatgtaagatgcaatgtacggtgtatcatcattcacctaagtatgcttccaggcatcgtgggcaatgcgttcaaatgatattatcattatactttttatttgaaacaggtagattatattaaataataacatagattacgttattcgagaaaaaaaaacatagttacaagtttacagccacaaataggaaaaaaaatgtcaaagtagactgggtgtgtttgcaaggaggggaaataagtagactgtaaaaccatgtaaaccattaggttatgatttattgagtaatgactattaattattttaaacttgaaaaatatattaatataattatttaaaagcaatagactatttaaaaaatacatcatttagcagtatagaaaacgtgagcgtggaaaacgaggactttatccctcttgtgcttgaaattgtcaaccgaaacctaaggggggggggggcgtctacggatcggacgtccgatcttttaggagaaatcggacgcccaccccagtctccgtcagcgcatgcagacgcagcctgcatgcatgcaaactaattcagcctgctcgcacagaatgcatgtatactagtaactgttagggtggttaaagtttttaagcaaactttaaactattttttctcctaaattatatatccaaatcatgatccgattgcaccattaaattcattgtaattaaaattttaaaacaagaccacacatggatatattccgacgaaattttttttagcttattatagaattatgtttaaatgttgcacgatgtttcactaagtatatcggaattgttttactaagtagatcgaaaatgtttcaatcgtttaaattgggtgttgtttcatcttttataaaaacaatatttcagcaaatagcgaaagaatatttcagttcactgcaacatttgatccatacatagtgaaacattgtgactacactaggtgaaacattttttttggaaaaaaaataaaacgaattcccttaatagagtgtcggtgacatggggccgggggtatcgtgactagaggcttgggtagccgcgatcacccacgtggcccgaccccctcgggggggttgggcccgagggtgacgtggccacccctccttctgtctccccgaggggtcgggccgctcccgtttcggccccgagggctggggcgccccgaccccctgtggtgttggcgccacgtgtgtgggttaggtgagcacagcggcgctcacctaaccgcatttatagcgggttagacaagcgcgccacgccgtattcaatgcggtgcagcgcatgcttatccggtccgtgaccagtcgcggtatgtgaccggtcatagactggtcagatcgcgggttaggtggcaacaggcggcctgtcgcacgcctcgccccgtcccgtcggaatgatgagagcttcctggctctcgtctctagccggagctggcgtgctgactcctggagttggtatgtcagtcccggtcagatccattctaggcttcagcgcaagcatggcaagaaagtcgctggccattgaatgaaggttgaaacgggcgtccaccgggagagctgacgagcggagcagaaggcgtgtgctgtgcttgtcaggggtcacttctggctgtagactagccctcattgtaaaaagaatgtttcttttcttaggcagcttgaggcccatgtggtgacccctgaccagataaaaaggaggcccaggcctaagagaaggagagagagaagagagaggaaaaaaagagaaaaaggagaagaggagggaggggttctagagcctgaacggtctctcgctctccggctctctgtattccttcacacacagatccatcagaacacaggagtagggtgttacgcttctcagcggcccgaacctgtctacgtcgcccgtgtcttgtgcgattcttctcgctgacattccttagatcgagggcgaagaacctcacatagcgcccccggccgaaccggcaaaggagggcctgcgcggtctcccggtgaggagccccaagctccgtcatctggcgcgccaggtagggggcgcgcgtgtctttctaagccctcgtcctctttcgtgtgcgccaagcttctcccgctcagcccaatggccgaacgggcagtggcgcacagcctctctccgaacgctagcggtgacgacggggagcagaacccgcgccgtcgggctcgcaccccaccatccccctctcgccgaaatcttgggcggggggaggcgctcggggaggtcgaaggatccgcgacttcgccgcccgcgggcaacgggggaggacggcgagacggggcgcgtcgccgcctcgtctacggcgatggcggcacgccccagggcgcgctccaggctgcgggcgcgctcctgcgtcacccgcccgtcgtccccgatccagagactccagcccgacgttggctggatgacgtggccgatttggtcatgacggcacagcagcgcctaggcgccggcaggcggtcctccgccaccgggacctctggcgctgccgccgccggctccatgtcgtcgaggcggagggcgcggtgagcggcggccgttacccgctgttcgtccgccattccctcgtcaacgcctccgacccaagaagatgtgcgtggggggccggatgcccggctcgatatcgagcgccggcgcgacgatcgtcgcgccgcccacgcaacggagggcgcttcctcgtccggagcgccacttcggtccgggcacgggggccggccccccgtgtccccggttggcggtgccggctgtcgagcctttgtggcgagccttaggaacgtccgttggcccccaaggttccggcccaccatcaccgaaaaatacgacggaagcgtcaaccccgccgagtttctccagatctacacaaccgggatcgaggccgccgggggtgacgacagggtcatggctaatgaacttgccacccgcgtcggtccactcttgggaggatttgtgccagcagttcaccacgaactttcagggcacatattcgcgcccaggcgaagaagcggacttgcatgcggtacagcgaagggacgatgagtctcttcgctcgtacgttcagcggttctgtcaagtccgcaacaccataccatgcatccccgcacacgcggtgatctacgcattcagggggggcgtgcggcacaaccgcatgctcgagaagatcgcctccaaggagccccaaaccaccgcgcagctttttgagctcgcggaccgtgtggctcgcaaagaggaggcctggacctggaactcctccggctctggcgtggcagctccggccgcccccgagtcagccgctcggtcagggcggtgggacaggaggaggaagaagaggtcggcccgttccgacgacgagggtcatgtcctcgccgccgagggcgcttcgcggtccccccgaaaggggaggcctgcgaacgacaaaaagaaggaggccggcgctcccaacagggagcgcccaaccggcaagtggtgtaccgtgcacaacacctccctccacgacctcgcggactgccgcgcggtcaaaagtttggctgagcggacgaggaagtgggaggaggagaagaggcaggagcgccgtgagggcaagaccccggcggctcccgccagcaaccggcgaggtgaggccaagcagaaggccaccgccgaagacatcgacaatggcgacgatgacctggggttccaggagcctgaggccaccgtcgccaccgtcgatgggggagcgtgcgctcatgcttctcgccgaagcctcaaggccatgaagcgagagcttctggccgcggcccctacccatgaggcgatgcggcgggcgcggtggtcagaggttcccctcaccttcgaccagaccgaccacccgccgtgcgttgcccggggaggacagatcgcgatggtggtttcccccaccgtttgcaatgtgaagttggggcgtgtcctcatagacgggggtgcagctctcaacatcctctcccccgcagcctttgatgccatcaaggccccggggatggtgctccggccgtcccagccgatcatcggtgtgacgccggggcacacctggccgctgggtcatatcgacctcccggtcaccttcggtggttccgccaacttccgcacggaacgggtggacttcgatgtggcggatctcagtctgccctacaacgcggtcctggggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggcgtccaagcctgcgggtggcgacgagaggctcagcacctccgtcccggccgccccaaggcagcggatggtcacgtgcgacgaagtcccggtcaaggaggttgccctgggtgacggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccatgcggccgggcgcaaggccggtccggcagaaagtgcggcggcaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttgtttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgccccccccagcaagcttagggatgtgcagtgcgtcaccggctgcatagccgccataagtcggttcatatcgaggctgggagagaaggcactacccctatttaagctcctcaaacgctccgggccgtttacctagacggaggaggctgagcgggccttcactcagttgaaggcgtacctcagttctcccccagtcctggtcgccccggagccagatgagccgttgctactctacctggcggcaaccccacaggtggtcagcgcggcgttggtcgtggagcgcgacgaggacaaccctcgctccgcgcatccccaccctgtgtcgactcgacccgggagagagcaggaaggagaggcccccgagccgaacggcggcccaaggcccccgacggccggagctggccctccgcctgcttgtccgacggtgccaggcgcccccgacccctaggatggccccggggccactgcgggaaggccgcgcctgtcgccctcggaccccgaggtcgtcggcacagaagccgagtgcgccccgcgcggcctctcggacgaagagcgccctggagatgcggcccctggcgaagaggatcggccccgccgaaaggtgtagcggcccgtctacttcgttagcgaggccctccgggacgccaagacccgataccttcaggcccagaagatgctttacgctattctgatggcttcgaggaagttgcgccattatttccaggcgcatcgagtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcctgtctccacccccgaggccagctcgggcccctcgcagctgcctcacaccgcctactgggtgatgcagttcgacggctccctgtctcttcagggcgccggtgcgggggtcacgttgacctcgccgagcggagatgtcctcagatacctggtccgcctcgactttcgggcgaccaacaatatggcagagtacgagggactccttgcgggactcagagtggcagctggactggggatccgccgcctcctggtgttaggcgactcccagttggtcgttaaccaggtctgtaaggagtaccagtgctctgacccgcagatggacgcttacgtgcgccaggtgcggcgtatggagcgccatttcgatgagatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggggacggacgcgcctgaacggcccccgaggcccgtcggagtccaggcctcggggcccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcctaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagtgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcgtccctccgagccgcgcgctaccagcagagcctgcggcgctaccatcagcgccacgtccgggcctgatcactctgcgtcgacaacctcatcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacacattcgtcgcttctacccctagtgggggtcgggggtcgtgtctcgggctcgagccaaccccgcaccccccccccccccccgggtgtgcagggttggccgggggctaccacatgcatatacttaccttttttctcttccgtatttcaataaaagcattttcgatttcctgaggactgtgtctgtgccatcgtttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatcataaccctcggtcaccgcgctctcggcctggccagtctcgacacgaggatctccccaggcactagccccgacccgcgccgcttgaggctgggacctgggcacgagcccttgttcaagccaagacacagaaggaccgcggcacagaccatcctcgtctcatacacacaacaaacagaactgacgcagaaatttcctctttacttgattgcagattaaatcagtctatacaagaagggggctcgaaggcctcgcaagaagaaggaaaagttattaagattggcgagggcctgggggctcactccgatgcgcccgggtcgccggcctcgtcgtcgctgtcgtccgcaccgtcgtcaccgccctcctcgtcggagtcgagggcgaacgcgagccgaggggccgtaccctcgaagctgtggacgatgtggtcggcggcatcccggacctgcgcgcgcgcgccgtcctcggttccgggagggaactcttccagcgctgcccacggggagaagtcagggtccctggcctggtagcttgccagtacgagctccaccgccccccgggcgaggtccctcgaggatgacttgatcgtctcctcgagctcctcggggagccgctcgagggccccggccatctctgagaggcgctgggcgaggcccccctggttggcggcgtacttcgtgtaccgcccgccccagaggcctgcctgccgcccggcgcggtctagacgggagacggcgtcccaaagcatgccgggccctacctcgttcgccaagcgaagggcctcgacctccccggcggacgagtccagcgcgccctgcagctcggcgatggtgtgtccggtggctgcgaggcgggcggctaggtcgccgtggcccgcagccgccccgccgctgtgcgctctcgtccagctccttcgcccgcgcctcgagctcagcggcccgctgatccagtgcggccctctcggcgcgggcgccttccagattgcggcgcgcctgctcctcccgcgctgcctcgcggaggaacaggctgtccaccagccgctgcgccgcggccttggcctcctcgagagctcgctcccactcagtgagcgcgtcctcgcggaggcggagtgcggactcctctacggcgcaggcggcctcgtgcgccgccagtgttgcctcccgggtggcgacggcggcctcgcggtccgccaggtctctctccttcgcatcgagggcgcgggcgcgctcctccagcgccgtggcgcgagcctcaagggcctcttcgcgctgccgggacgccgcctcgttctccgccgcccgccattcccgggcagcggcggcgtcaaggactccccgggcggcgtcgagcttctcctctagctccgccgcccgcctcccgtattggaggcggaggtcgtcccgcgcctcgtcgagcacggcggtggcgatgagggcagtctcccgctcctcctccacctccctggcgatctccgccaggtctctacgacgggcctcgagctgtgaggcgtgccggcggtgtgccttgcggcccgcctccaccatggcctccactgagcgccgcccctcctcgacgcgcgcccacgccgcgtcgagctccgcccgctccgcctgcaggacctccatctgggcacttaacccgtccagtaccgtgctgttcgcggcggccaaggcctgcaggaggggctccacgctcagtggggcagcggaaggcagagaggagagccgcctcggtgtgggtgccgcgcggctcggcccaccgatcgacgtgccggactcgggggcgtcccccgaagctggctcgtcccaagcgtcgcccgaggggtcgggcccgagcggcgcgcccgcggcctcgtcgtgggtggcctcggaagtcgtcgtcgcctcgggcggagtcgggtcgggggcttggcaggccgcctggcgtgcgcgcgccgcctctgcctcccggacggactccccggcccggcggagtctggcctcctcccgagcggcctcctcagcctggcggacccggacggcctcctgggctgcctcctcggcttcccggaggcggtccgcggcttctcgccggtcggcttcccgcctccgggcctccgcggtcgccgtctcctcggcctcagaccggccggatttggaatggcgggggagggcgcgacgggatctcgctgaggcagaagaaaaaccagaagacaaaaagaaacgggtgagtgaaaactcgccttgggagatgggagaatgaatacggccgcggtgggcgcggggacgaacctgcggggaggtcggctaaacgaccacctcgggggcgagatgaggttcccccggcatggctcggtccccctcatcttgcggagccgtttcttctttcgctccccctcgggctgcggcgtcggcacggcaccttccgggcgcctgctgctggcacgcaccgccacgcccccttggggaggagatgggggaggggtaccctcctgcttcctcttcccccgggcgtcggcagggcggctgccccccgggcccccgtcacggggcccagaagcacgaccccctcccggggtagattgttcccccctgcggctcccgcccgcgccatcgtggcctcggggggcccgctcccccgacgccccgaccacctgcatgatggtcaggatgttggcgcgctctggatcgcaacaaagggggaggaccccttgggggatgagggatgcctccacggagctgagattcagcacccgttggaccaccatcctgaagtcctcagggtcccagtcccatttgcgcccctggtgggtcctcatgtagtcctcgggcccggtgtactcccaggcgccccgggcgcgccgctggagcggcgcgatccggcgacgaaggaagtcgccaaacaccatggcccccgtgagcccctgggatcacagacccaccaggcggtcaagaacggcgtcgtagccgtctcccagatctaccgccgcccgccagctggaggcctgcgccgggggctggctcggaagtcggaggcgcgcttcgtcggcgaggggggtgtagaaccaatcgctcttccagtcgtcccactttttgcgaaggacgcagggaatgtagcggttcagcacctgcccccgcggctggaagtagcagccaccgactaccgttggcggcgacaccggctgtacggtgaagaaccaccagaacagccgaagaaatgggcgcaccccgataaacatctcgcacaggtgcgcgaagatggccaacgtcattatcgcgttgggggtgaggtgcgccatctggagatcataaaactccagaatatccatgaaaaaagtagagaatggcgggaccagccccgccattgcgaaagagaggaagaagacggaccgccccgggtagtgtggcgccgggcgtccctcgcccagcgcgaccacttcccggccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcaagggtagggcacaggaaacgaaaagttagagcgcaagtggcaaaggcaaggggaagagtggcgagaggaaggaaacgaatcccttcgtcggcgtctttacacccttgccaacgctatgcccggctcctcgtttcccgcgcccactacctcgccccctcgtttctcgcgcccacgcctccactaaccccactcgcccgtttgcggcgcacgcggcagatgtgcggccgtggcggttgagatggggcagatcgtgcgcgcattaactgcgctcgccaaccgcaaaaagcgccatcatcatgtccccaggtgaaacaaaccggctcgtcccgattcgcgcgctgctcgagtaatgtagcggtcttgaagatgccgctcattattgtcggtcggtttttcccttgccgatgcgcgcgatttgcgaccgttgggtttctgcccgcctgtggagaccggccccacctgtcaccgggcctaaggagtggcgtcacgcccgagcgcctccctcgaggggggcggtcgccctggcgtaacgccgggggctactgtcggtgacatggggccgggggtatcgtgactagaggcttgggtagccgcgatcacccacgtggccacccctccctctgtctccccgaggggtcgggccgctcccgtttcagccccgagggttggggcgccccgaccccctgtggtgttggcgccacgtgtgtgggttaggtgagcacagcggcgctcacctaaccgcatttatagcgggttagacaagcgcgccacgccgtattcaatgcggcgcagcgcatgcttatccggtccgtgaccagtcgcggtatgtgaccggtcacagactggtcagatcgcgggttaggtggcaacaggcggcctgtcgcacgcctcgccccgtcccgtcggaatgatgagagcttcctggctctcgtctctagccggagctggcgtgctgactcctggagttggtatgtcagtcccggtcagatccattctaggcttcagcgcaagcatggcaagaaagtcgctggccattgaatgaaggttgaaacgggcgtccaccgggagagctgacgagcggagcagaaggcgtgtgctgtgcttgtcaggggtcacttccggctgtagactagccctcattgtaaaaaaaatgtttcttttcttaggcagcttgaggcccatgtggtgacccctgaccagataaaaaggaggcccaggcctaagagaaggagagagagaagagagaggaaaaaaagagaaaaaggagaagaggagggaggggttctagagcctgaacggtctctcgctctccggctctctgtattccttcacacacagatccatcagaacacaggagtagggtgttacgcttctcagcggcccgaacctgtctacgtcgcccgtgtcttgtgcgattcttctcgctgacattccttagatcgagggcgaagaacctcacatagcgcccccggccgaaccggcaaagggggccctgcgcggtctcccggtgaggagccccaagctccgtcatagagggtttccaaaatatgtgggtgatttgttgcaaaagaatgttctaattaactacaatattagactatacatagtgaaacattgtaagtacactagatgaaacattttttgtgaaacaaaaaataaaacgaaatcgcttaatagatggtttctgaaatatgtgggtgatttgttgcaatgcggcgcgtttcataatatcaaaatccactacaacatttaatccgtacatagtgaaacatcataagtacactagctgaaacattataaaactactggttgaaacatcaaaagagaccatatgcaacattaaaaaaatcaataaaaaaactaaaatatttttttcaaaatataatcatgtgtggtcttgttttaaagatttaattgtaacgaatttagtgctgcaatcagatcgtagattagataaatagtttacaagaaaaaaatcttttgaagaaataagagatgtgagcatatgggtaaaagattctttgaatgtaatgacagacacatgcatatcgatttttctccccttccgtcgaacgtccgacacccagcattatcctaaggggctccatatctttaaaatgcctacgagcaaatgtgcacagccacattgatcaactccgacacgcgtaaaaacagaagaacacatatcggcggatcggccatcatcttcgttcttatgatggaacaacaaaattatgtcattgaacaagtcggtgacccaaatctcacagttagcgctgccgattcaatcgataacccaacagataaaccatactatacgtctttcatagtttcattggtgaccatctggccgtggctggtgattttagtctatccggagtcgtcgcctacaatggaatttcacgtcgaaatcatgtacagcacagatgtaggagtactgctacatttttcaagaatgtgcgtgtcgttttgcaatgccgtggagaccagttcagcgaattagtcagcaagtgtaagtgattgtgaaaatgatggaactaatgtccgtacatatgagtacttgcatataattgttactccatctctgtttttctgctctaccatgatgatttaattttaaaatgaagtccttttttttagttacggcatgttcatttgccatgtgcaatttatgttagagaggtggtcaaagtagaatacttgttgatattaattagagtatagtacttgcttacaaaaattgtcgcaacgattctataggttctagtgatttagtcctacggctacacactatgtagatggcggcattactgttgtcattaatgcatgtcaactttgctgcaacctaacaatgccgtggcatgacaaggttgaaaaatatctagtcttttgtaaaagaaaaataaacttggtatgcccacataaccatttcatcaattacttttattatctacacacacacacaaaaagaaatactattaagagcgtatgcaatttctctgttctttctttattacagatctgttcatgcataccagaagacacaggagcactgcagtggagtcgccggtgccttgtgtggtctttgtgcaaatgcatgacatgcatttgttggaacttggaaggttatgagcaaatttgatccgaatgtttttgtctctgtccaccattgcatcaaaattattgctgcaagacgtgtggaagcacccaagaagaattctgcagcatgttctcacttgccgtgctgtttggtcatgtactcacgtccatttcaaagaaataacttttaatgcttttagaaaacttatcatgtttatagcctaaaagaaattaatttcgaattgcctgtgtaattctttcgtgttacacaatactttgagatgtaagatctggctgctctgcttgacggagatgagatagagttggaaatgagggcatcttgctaattgtattactccctctgttccataacataaggcacaactattttttaaaaatgtttcataatataatgcatacatgaatgcataccattaattagcacttctttcccactaaattattattattttagtcatccatcctcaatatcttaaattctattagatgcatacattatatttataattagggtgattcaaactataagatgataataattatttcttagtttttaaattgagggtggttgagccttatattttgaaatggagggagtattagtaaaaacagttttactaattagaagcaataacatattcttgcacaacgaattaatggcatgttcagattgtagccaaaataaacctcatcaaaattttggctatgtatttaccaaatttggcaacaaactaaacgtagacattttttttagcaattttaccaaaaaatgatatggttgaaaatgacatcaatctgaacagtccctaagtctcggatataaaagggatagacgccaagtcaacggaaaataagggggtgtttagatccaccggcaattttttttgtctcgtcacatcgaacgtttgaatacatgtacagagtattaaatattgataaaaaaaaaactaattacacagtttgcgtgtaaattgcgagacgaatcttttaaacctaattgcgccatgatctgacaatgtggtgctacagtaaatatttgctaatgacagattaattaggcttaataaattcatctcgcggtttacaggcggattatataatttgttttgttattagtctacgtttaatacttcaaatatatgtcagtatatcttatgtgtcccggcaaaaaaaattttcccgtggaactaaacacagcctaaatactagtaccttcattctccaaagaataatattctagacatcgatacaatccctcaatctctatcaggcatgttttatctctttttttcacaagctatggtgttcgtttctgctaaagatgaagatgaagctaggaaaaaaaaacaagaaagtcattagcgcaaaattaattgagttttaattgttataatcttgaataatagatttatctgatatttcaaaataacttctctagaaaaagttttcgtatggaacacatcatttagtactttaaaaaatgtgctaatggaaaacgagataaaatctaaatcttcacgagaagaacataaaatgtgaagaatgtaacctgtgaaggagttcttcaaagaaatctattaatattattgaggtttgaccgcacatatcttaggatttttttttcttttcagaataaaggtacaacaacttgatattgcacaatagacctttgcttacaccgaaatagctattcttacgactaacatctgactcaactagttgtttagacacatctgctattttcctgggtccatatggaaagaagccaagcgcaaggattagtggatgaggcgaggtcagatgctaaagtcatgctcgtgaatagtaataatcaaaatgaaggcagcatcagaaaatgaaggctttgtctgtgccattaaggcttgagcttagagcatctacatttgtaaaaaaaagaagaagaagctaacattaaacaataaatgttgcaacaattaatacaacatatttactattgtggaaccataagacgtgatcacaaggcaataaatatttttttattactagcacatatactcgtgcattgcaacgggacaaaaaaagaatgcttgaagattaagttttttacgcaaagcgaggtggtattaacgtatgattgattgagttttaattattacaaacttaaaaaataaattaatatgatattttaaagcaactttcatatagaaagttttcgcacgaaacgcaccatttagcagtttgaaaagcgtgccacgaaaatcttaatctttatccaactcttgtcggagaaaagaacgggacctgagttgagaagataaacatggttctcgacagatggagtgaggtgttggtatgaaagagatgagtgatcgttctaaaaaaatacctgagagtttcacatgcaaaggtgactacagatcggatgtctgatcttttagctaaaaatcggacgcccatctcaatctccgccaacacatgcagacacaccaggactaggtgcagcccactgcaagtatcggaagccatgcatccatactagaaaataaaagttaggttggtttaagtttctttgagcaaactttaaactttttttttcttaaattacttttctaattcatgattcgattgcaccactaaattcattgcaattaaaattttaaaacacgaccaaacatggctatgatccaatgaaaaaatatttagctttattcatgaatttttttaaatgttgcacctattacatttaaatgtttcagctagtattcataagatgtttcactatttaatttgcaaattttgcacctattatatttaaatctttcagctagtattcatacgatgtttcactatttgatttgcaaatgttgcacatggtgttcttggaatgttttagcaagtattttatatttttttaataattatagtttagtgttcatatgtgatataaaaatatttcaacaacatcatgttttataaatatattgtatctctgatatgattttttttgttttactcattaggactcagtgtttcatataagtggttgctagtgttgcagcccaaatttttaaatgttgtatttctaaacatcgtttgattttttatcaaaatataatcgtgtgaatacaatgatgtaatcatatgtagattggataattattttaggagaaaaaacatttaaaggcggagaaaagggtgtagatgagtaaaaaaaattatatgtggacatgtatgaatggacatgacatgacatgtgcaacatacactgtgaatgagaaaagaaaagatttggtgtttcatatatgatatatctggaaacgcgaaggatttggtgtttcaaagttaggtccaagctaactgtttagtacggatattaaaaaaaacaagaatcttgtcgatatgtaaaaagtgtgtagtattatacataattggaaacggtcttgtgcagcgtgctcatgcgaggcggtgtgcgaggcagccgcgagcgggcagtgcatgtggcatcgaatggactctggctgaatcagaggggaaactgttttgatccctcgaggggatgcccctcgttgtttgcatgttactcaaatagttataacttttttaaaaaaaataaaaaatgtattaacatgtgatatatcactccacaagcatgcaagtttaaattcaacttctatatctcgcaatgaaaaaaacaaattaaactacagctattaatgtatattcacagtcaaatttgtttttttcatttcgagatgtagaacaatataagttaaatttgaactcgtatgtttgtggaatgatatatcctatgctaatacatcttctcaattttttaaaattattttataactatttaagtgacatgtaaaaaaataagtggacatcctctctctcaatggatcaaaatccactcccgaatcagagtgggcgtgcacaaatcacggcgcccggcaaggaaaacaaatcgcgcgcggctgaaatggactcggacgcaatcgacggttgaacggcacgcgcgtcttggacgaaatcattgcgcgcatgccgcacacgggacgacgtacaaaatccctaacaaaaacatcttaaataatatttatagtagtagagattttagtatggaacatagatttatctcgagcgatggagttcacgagactgttatttttacttggtgggaccgacctacctttacttcatagcagaagattgagctagctatactgaccttattattgtattatattgtggtgtacatattttttaaaattatgatacaaatgaaaacacataatcgttataatctgttttaccaatcgaattacggttgttacatatcatatctctttcacctgcttcatttatttaataatataataatactatcccgtatcatttaaggtatatatagagttaaagcagtttaattcaaggcacctatcaattgggcgcctgactgttttaccaagtagatcggatatgttttactaaatagatcgaaaatattttagtctttcaaaaagctgaaacacaatcaaatcatctcataaaacattttgttacaacgtatgaaacaacggttttcaaaaaatcagacgttgtttcaccttatataaaaataatatttcagcaaatagcaaaataatgtttcaattcttaaaaaaattgaaacacggtcagatcgctagatgaaataatttagttcaacgtatacaacaaacgatttgaagccattgtagcacttaaattccatatacatcaacaaaccatgtgtccatcaagatagaaaatattaaacagtataaaaatccactgcaacatttcatcaatgcatagtgaaacattacgagtatacttgctgaaacattgttagtggaataaaaaaagaaatggattctcttaataggacgttttcgtaatatgtgggtgatttgttgcaacggcgcgtgtggtggtgcgtgtggtggggacggcgcggatgcgcgtcgccccgcgcgaaggggcgggcgcccgatttgaggcatttccgggtttaatttgtcaaacaccgaaatatctatccaagaaaatggttgcaccatcatccatcgcaacatccaacggaggctaactatatggccgagatcgaccggatcaatactcgatctgttcgatcgaattgggtcaccatctatcacttgctctaccaacgccgatttttactgcatgattcgacgcgaatagacgccgacgacttcacgtagacttcaacaataatccagattatttcagaatcatcatctatatatgttgtagtaacattgctcgattaatcaccgagctaattaagctgagagcccgagatcttaattaattcctagaagctccggtgcattggcgccatgatgatgatgtgcgcaggtggtgcggcggcgatcatctttctgacggcgctgtcgtcggcggcgtccgcgctcggtgtcgccgccgccgccgccgccgccgcctgcgtcccgagcgagcgggcggcgcttctcgccatcaaagctggcttcaccagcgaccccgacggccgcctcgcgtcgtggggcgccgccgccgactgctgccggtgggacggcgtcgtctgcgacaacgccaccggccacgtcacggagctgaggctccacaacgcgcgcgccgacatcgacggcggcgccggcctcggcggggagatcagccgttcgctgctcggcctcccgcggctcgcctacctcgacctcagccagaacaacctcatcggcggcgacggcgtgtcgccgtctcctctcccgcggttcttgggctcgctctgcgacctccggtacctcaacctctccttcacggggctcgccggcgagataccgccgcagctcggcaacctcacgaggctgcggcagctcgacctgagctccaacgtcggcgggctctactccggtgacatctcgtggctgtccggcatgtcgtcgctggagtacctcgacatgagcgtcgtcaacctcaacgcctccgtcggctgggccggcgtcgtcagcaacctcccttccctgcgagtcctcgccttgtcggactgcggcctgacggcggcgccgtcgccgccagcacgcgcgaacctgacacggctgcagaagctcgacctgtccaccaacgtcatcaacacgtcgtcggcgaactcgtggttctgggacgtgccgacgctgacgtaccttgacctgtcgggaaacgcgctgtccggtgtatttcctgacgcgctcgggaatatgacaaatctccgtgtgcttaaccttcagggaaatgacatggtaggcatgatccctgcaaccttgcagcggctgtgcggcctgcaggtcgtcgacttgacggtgaacagcgtcaatggcgacatggcggagttcatgcggcggctgccgcgctgcgtgttcgggaagctgcaggtgctgcagctgtcggcggtgaacatgtctggccatctacccaaatggattggggagatgtctgaactcacaattcttgatctgtctttcaataagctttcaggggagataccgttggggattggtagtctatcaaacctgacaaggttgtttctgcataacaatctcctgaatggaagcttgtctgaagagcattttgctgatttggtgagtctggagtggatagatttgtctctgaacaatctgtcaatggagatcaagccaagctggaagcctccttgcaaattggtctatgcttattttccagatgttcagatgggtccccatttccctgcatggatcaagcaccagccaagcatcaagtaccttgatatctcaaatgcaggaatagtggatgaattgccaccatggttctggaaatcctattcagatgcagtctacctgaacatatctgtaaatcagatcagtggagtgctgccaccttctctgaagttcatgaggtctgcgctcgcgatatatctcggatcgaacaacctcactggcagtgtgccattgttgccagagaaattgcttgtcctggatctctccaggaactccttgtcagggccatttccacaggaatttggtgccccagagctagttgagctagatgtctcctccaatatgataagtggaatagtgccagagactctttgccggtttccaaatttgttgcatctggatctttcaaataacaatcttacaggacacctcccaaggtgcaggaacatatcatcagatggccttgggctcatcactctcatcttgtacagaaacaattttaccggagaatttccggtgttcttgaagcactgcaaatccatgacatttcttgatctggctcaaaacatgttttcggggatcgttcctgagtggattgggaggaagttgccatctttgacacatctgagaatgaaatcaaacaggttcagtggtagcatcccaactcagctaacagagcttcctgatctgcagttcttggaccttgctgacaacaggctatcaggctccatacccccttctctagcaaatatgacaggaatgacacagaatcaccttcctcttgctctgaatcctcttacaggctacggcgcatcaggcaacgatcggatcgtggatagtctgccaatggtgacaaaggggcaagatcgtagctacaccagtggagtcatctacatggtgagccttgatttgtctgacaatgttcttgatggaagtatccctgatgagctgtcatctctaactgggctagtcaacctgaacctgtccatgaaccgtcttaccgggacaattcctcggaaaattggagctttacaaaagctggaatctctcgacttgtcgattaacgtgctttctggtgaaatcccttcaagtttgtcagatttaacttcattgagtcaactgaacttgtcctacaataatctatcaggaagaataccttcagggaaccagcttcaggctcttgctaatccagcgtacatctacattggcaatgctggactttgtggccctcctctgcaaaaaaattgttcatccgaaaagaacagaactagccagcctgatcttcacgaaggcaaaggtttatctgacacaatgtcgttttaccttggtcttgctttgggatttgttgttgggctttggatggtgttctgcagcttgctgtttgtgaagacatggaggattgtttactttcaagctatcaacaaggcatatgacactctgtatgtgtttatcggtgtcagatgggcaaaattcagggtagacaaaacaactactacatccgtcccaaaataagtgcagccgtggatatccgtgcccaacgtttgaccgtccgtcttatttgaaaaatttgtgaaaaaattaaaaatatttaatcacacataaagtactattcatattttatcatctaatagcaataaaaatactaatcataaaaaaatttcaaataagacgaacggttaaacgttgaacgtgaatagtgcaaaactacactttaagacggagggagtacaagctaggtagatcagtcaagagacaataatataggccacaaatgaaagtttaactgtgttatctctcatggtctgtttgtgtattattcattgctttctaacatttgaatacatcaaacttatcagagtgagtgagtgagtgagtaaaatgctctgacttggttccaaaattccatttgttcatagtagtagatgggcacacacatcaccacaacgaacacattacatgatagactttacaccttacattgataatcaaagcaagacgttcgaacttgggtgagtcagattactgccttcccccttacgttttaagtgaaataaactgggaagctgagatgactattcggagagcatgcatattattttactacaagttaaaaaaacactgtaccatatacattttaatgtaacactggagtaaaaggctatcggccataaagttacagttttgtggcatccgaagccaacatttattactccgattgccatagcaacccagttcggaaaaccggaaaggccaaaatatccaaaagagattacatggtgaacactgctctgacctcctttttcaggtcccagatatgagggtcaactagggtgccgatgcacatcaagcaattattctgccatcagctgaaatagcatctcacatgcgtgacctcgacgaagcctgctgggttgcgtttggtgcgctctgcagagattgtaacatgattaattatcgaacaagctgatagagcatcacagaacactaaagcgagaagcacaatgaatgagcgtatgagcaggtgcagtaataatatcaaaatcgaactgtatgatcagggcccatggtcgtcccaccatgtaaccaattttgaaccaaggcggtcagtgctgacacagaggcttcgttcgttgcatgtactaataggattatttatactttctagtgagaacatcaaactactcaaatgtttgtaataatcatatgcactcgatacacatgcagatctataatatttgcctatagcatactaattcataattgcaaccgctatactcaacatatactaaaattaggaaggcaaggatcgggtactatccatcagaaacagactgcgttgtgtctttgtgtgtgagtgagagaggaagagagagagtaccaatggtaggcttcttttagctctatcttccaaataggatgatggtttgaagaaatcgccataaatttcagtccacttgctaagctttgaatgtatataaggtgctccaatagtgtcagcccaaaagacaagaccaccccttcataaaaaacatcaaaggttaaactaacactcagaataaccacaacactttatgcgcgacaaaaagaaaaaggaaagcaaaatatacatgtgaggactgacggctaacagtatcatggattgacaaaattatacagcttcacacgaatgcataataatataaaacttgagagttgtttggtattagacaatgatgtaacagaacttagcaataaacactcatttggaataccttatggtggaattccaagtgctaaagttaaacaccacgttataaagcaacataaatttattttgatatatacgccatgcagccctaccctacataaggattaaataaggttcatgtttagatatcagaagtgttctgataaaattttaagtccatatgttatatttgtgcacaaaccaaacatgcatctcaatccaagtatctaaatattgatacaactaaggcatacttcaagtgcatgctaattattagcatttagttacataagacgattatgcaagtgaacgtaaattgtcacctgctaataacataccacacaacttaagcttaagcaacagttgtttacctgaacttgggaaaacccatcccaaggatagaagcaatatcaagatcagaag

SEQ ID NO: 68503 - DNA, 11941 bp, Oryza sativa
aagaattcaacacattgtgacatactagggtattaaatccacatccatatctgaaacgaattgcttcatatccagaagaattcagatacatgcagggagtagggtcaattaaccaaacagacagagacaaacagaaggatcagttactgttgaaaactaaaccaaacaattgatgatcagttggtcttcagtactaacatggattagtccatatatctatgaaacgaactgcagcatttcagataaatttccaactaacgttttcccttctctgttcagttcacaccagaattcaggcaaaacgcaacccatacaaaatcatgaacaggaaaacatcccacagcagaagctcctgcgcgcaggccggtggggaagcggctagacgccagcagagaaggggaacggaaggagaggggcgccggagagttccgccgttggcggaagggaacgcgatgcacaagcgccgccggtagaaggagtcgaggcaccggcggaaggagtcacgctctccacctccgctcgattgcgatagatgaggattccgagcgacgctaaccatgagacccacatggagaaataaattaagtgtcaaatctaccccaaatctgtcttagcaccaatctacctaaaaaaataaacggttcagattagttctactggtagtatcatctctctacttcctaagcaatgaccttattagagtttatgcaggccaccacctccttccggtgatccattcctcaccagagccgagggcatccagctcctggccgctctcggcagcgggcatgcagatggtgctcgccgccgccgtctcttccatgggcgccggcgacgaccagctggacctcgagctgcatctctagatcgacgaccgtacacctctagtacgtacttctgctcttcaatttcctgaatataaataatttgctttgcacgtaatatactttgtgttgtttgtaaggtataggatttgggtgatctcagtcgtgtttcttttatcttttatggtataccttttcttttcctggttacgacctttccgggttgtaaccttgtaatttttctcctgctatatcaatagaactttacaccgacttatgcgagtcgttcgaaaaaataatttgctttgcacgttgatgtaatatgaaccgtgtttttggcctccccagttgcaacaaagctctggttagtgatcatggggattaatttccaacatgtattattaattattaatttgtgctaccatgggaattaattatctattatctatctatctatctatctatctattatcttctattatctattatatactaaaagtccattaatcttcctataaacactcctaagccaccatgtggcgctcctacaaacgctcctagatcgccacgtggcattttataatcttaccgtcgattttcatttaaattggtgtacccgttattttagaccattagattagattagatctatttgctttgctttctgtcctgtgcataatgccatttataccgggaaaaaaattaccgtcggtatgtacttggaaaaaaaaataaaggtacgtttagttgatgttcctttaaaaaaaacgaacgtactttgtagttacgtacgataaaaaactataaaacagaaaaaaaaagaaactgttcacttgaaaaaatataaatatatatatatagacaaaaaaaaagaaaagagcctttgaatattttttaaatatgtttattgatgttttcctattaataatattttcatttattatcacatatttatgtacataggtagaaaaaaatagacattgatctttttaaaataaggattttccgtacaataaaaataaaatttattccatagatatgatcatgtggcgatcttacaagtacccttaccgccacatggtatgccaattttcatttaaaatgatggacccattttatagattattagattagtccgcttactcttagtttcatgtgtatacgagagattgtttacggatgttcgattgaaacaaaacaaagaaagaaatatatgtgcatacgataataaatctataacgcccaaaaaatacatgtataagagtacgtaagtacgataaaaaaaccatcaaacaaaaaaactttagatattgttcacttaaaaaaaggtacgtacttatgtaggagtgaaaagaaaagcaataaaatcttaaaaatatatgtacgtcagtagaaagaaaaatagacggtctttttaaaataggattttctatactataaaaataaaatttattactccacaaatatgatcatgtggtgtttctacaagcactcttagaccgccacgtggcagtctataattctgctgtcaactttcatttgaaataatggacccattattttagatcattagataattagcccgcttcctcttaatgtcatgtgtatatgagagaaactatgtaccggatattcgattgaaaaaaaaaacaaagaaacatatgtacatacgataatgaagccataaagccctaaaaaaatacatatataagttggtagaaccttaaaaaaatatagatgttcttcagaataggattttctatactataaaataaaattcattactccaaagataaatatgcaggttaaactattttaatataaaaacaaactaaatgtgtttaatcactcattttcttaaaattatttttaattatatagtcaacttataataaggtgtaatcaaatgttgatgacttatcatagttatattatagtgctaaatacattacaacacatggagccgacataataatttaatataaaaatactttttcaaataatttgtgtgacatataataattaatgttatgataatctttgaaataatttcatattatattttatggtcaaatatcacttgataattatataacactaactgaaatctacgtgcatgaaaatgaaacaacgttatgttttgtcaattatatctgactttattttaatttttgtgagattaagattcttaattgtttattgtatttttcagagttatttgataggtatgcctaggcaatgatgttgctacaatacaactccttaatccatcacaaaaattatggtcatttacatttgttattttgtgaaataggtttggtaacaaatgaacaatcttataacatgtacataaacctactcatgatatattttcttacaattgagaaattataatatgttgggcataagtgataattgataaatgtacgtcaaacatcccactgatgtaactataactgcacttcaacaaattagttattataaataatttgaaaaaaataaatacatttagaattagtaaaggtgtctcttgcaattatgaacaataggtgagaaaaacaaaccagatgctaaaatatagatctttgtcaaaatacaaactctgaagattgtcacagtcacatgtttgcttagctatatatatgtttaatgatcaacctcacttatttctaaagattacattgatctgtaccataaaaaattaagaagtattgcttaacaccataaacaaatcgtgcctacataaaacataaagaaactatttttttatgggaagaaatgaagaactattttcatcacatccatattgactttgtttccttgaaggataccgagcatgaataacagagcttgctatgctaccacaagtatagcagggggcacatatggttgagttgaagaaagcccagaggaggccaccattgataatagtgctcaattttctacttacttactgatgcaatcttcttcgagggtgccgatagcgaactaggattagttaaaattgtgctccacactaattgtgagagtcacgactatgtcaactcatgcttgaaggcagcggataaataaagcctcgatggttccacccattagagggggcattcatgtctatttcttaatggcgctatcctattaaccaataggttaatacaagcggtagttttagaatatttattcatagatttagaaataagtgttgagataaacatttaggtatgtagtggaaatgaatgtcttatgtattaatggcgtattaagtttattttggtggtacaaatgaagttccatttattaaaaggatatctaccttttaagaaaaatgataataaataatggtgataataggcaagtttacaagtaacctggataaaagtgatttttttaaatctaagagacattcttatcatttatatattaaagtttacgatctatttcaccatatagaattttgttattatgagacaaaatctataatttcttaaatctatttgatgagatatgacttaattctaatagcattatttctataaacaataaataagatgcccgcgcatctgcgcgggcttcctttctagtttaattaaacttcgttatgccatatctaattgggtgatgatggaacaacggcttggccttcatcttctcggtcacccggggaagagaaaggggatagaaagagagagataacggagagggagggagaagctggatttttcacattttggtttttttgaaaaacttattttgtaaatagaccaaaaaaaacttatctcaaaaatggtcctttttgaggcgccagagtcactgacgctgtcgtccaacgcgacggcgccagctcctactgctgacgtgggtggcgggggagcgcgccagccagacaaccatattgccctcccccctccccgccgccatttttcctctcttctcctctatagtgtagaggagagagatgtgcaacatttttattttcattttatttttttcacacttatgagcacataagaaccaaccatgggaaaaatatactcaaatgaacgaaatacgtgacctgtagaatttttctaaatctataccgaaaataggcatcatttgggtgtcatttcttaaaataggcgcaactttcaaaattaaaacctccaaattctgcttgcaagattgtgttttcgaggtgagaagcttttcggtagagctttagaaaattccacaggtcacatatttcatccatttgaatttattttttctatgataggttcttgtgtgatcctaagcgtgaaatattatcaaaaaataaaataaaaataaaaaaagttgcacgtctctgtcctctatactagagaggagaggagaggaaaaattctacaagtcacatatttcgtccatttaagtttattttttttatggttggttcttatgtgctcctaagcgtgaaaaaatatcaaaaaaaataaaaataataaaaatttcagagggggagggtgggcgccagccacactagcgcgctccaactgccacctcagcaccgtcccaccacgtccgagagaggctggcgccgtcccgttggacgatggcgccagtgactttggcgcccccaacaagaccatttttggataagtttttttaggggtctattgtgaaataaatttttcaaaatgattaaattgtgaaaaatccacgagggagaaggaagaaggaaagtagggagagagaatgatatgtggacccatatgttagtgggtcccctcttttaataataaatgggtctcatattttataaaaaaaattctaatgccacgttagagtcacgtgggatgaaaaccagctcaacactatcacatacgcgtcagcgaaaccatcctccaaaattgctgagggagttaaattaagaaaatgctaattcacacgcgcgcattgccgacacccacttccggcccacaaggcccacgtgcgcgtgcgattctttcttttttttcgcgacgccatttctttctttctttatttctttctttttttgctttttcttctttttttcgcagctgtcgttgtttccttttttttttctttttgccgtttactaccgcacgcgtgtaggagtaggactcaagaatttaaactttcaactcaagatttttttttgaaattttcaactcagatttgaaaactttcaaatcaacatttaaaaacttacaactcgaacttgaaaactttcaactgggatttgaaaactttcaacttagattttaaaactttcaactcagatttgaaaactttcaattcaaacttgaaaaccttcaactcggatttgaaaactttcaactcggacttgaaaactttcaactcagacttgaaaactttcaactcggattcgaaaactttcaaatgaagatttgaaactttcaattcaaatttaaaaaacttcaagtcaagatttgaaaatttaactctggtttgaaaattttgaactcaaatttaaaaatctgagttgaaaattttttaaattaagttaaaagtattcaaatcttgacttgaaaattttaaatctgagttcaaatctggaattgaaagtttgtttcaatcaacttaaaaaaaaagaagaaagacgtgtgatgaatttttatccaaaaaaaatcgaaaaaaagttagcactaagcgctcttagcatcaaaaaacgcgcacggcatttacctcctagcgcgtacgcgcacgttaggagcccccgttaaattacaccaattttaatagttgggagtcgaaatatccgtattgtgattcagggcaagaattagattcgacctgcttaagagagtcaaaacagacttattcctagtttatccgacagtaaatacctgaccaaatcgaatgcggcctggttcaacacctacgtcgataaacccgtagactgtagtgggctgtggttttggagtgagccgtgcagtgggaagaagctggtatttggaataaattcactttaggtcacacaatttgtcactgagttcgaaaattagtcctgggtcgcaaaaccggatacaacgcatgactaacttacaaaaccattgcaaacgaggtctctcgataatattgtccctgtttctggttgatgtatcacctacttggctcatttgactagatctttgtcccacatgacattgacatggtgtttatgtggtattttaatctggaaaaatgtcacgcccagaaatttccgaataaaattccaagcagaatgtgcattaaaatccccgtccaggaccggccggggtacacaaacgacaacgttgacattcagatccacgtcttacaaacatcataaaagtcttacataaatgcaacggaaaaacgaaagataacaggagctaagccttgacttgaactgcagcgggaaaaccactccacaggcatcctcgacggcacggacgaagcctactcctcaaagaaactaccatccgacacatactcatactctggggttggggaaaatagagcaagactgagtactatacactgtactcagcaagtcataccggaataggggtatgatgcagggagttatcaaaggagagctagagtggttcatttgcataaagcgagcatttataaacagaagttgaaagaattaaacagttgtaataattaatcaatattaatcatccactgtccaacgctataccacgttgcgacaggcccaaccatccacctaaactatccaatttcaacagactaaactagggtgaaactaatcacggtgaatctggttgaccgcccataaccgcgggcacgactatttgaatagttttactctgatcagaggtgtacaactgtacccacaagacacagccccacgacacgttaccgtgcgctgacatgccaccacgacataccagaaagaggccgtgacaagacccttcgcataaccccctctaaccaagcacaccacacctcaggtttcacccccactcctcgcaaggcagcgggcagtcccctctcgtgcctaggtgaatccagaaacgacggaggccgtcgcagggcccgccccgctccatcacgcccacccttgcctagatgcgtcagctagaggaaagctacactacaagcccagccgttgcccacgctggcttgtggtaagcacgataaattcttccagggtttcccgcgaactggtccttaactgccatggggtgcgaccaacaaaaccatgcacccacagcccaccatgtgattcattttaattaaccaacaccgaagcggtgtcactaatctaacagtaccattagaaccaacagtctaaacattaataggattttccccattgtgtactagttgaactaagcatggctaagcaatccctagtccaaagtctattcatgttataacccaagctaacaaaggaacatggtaccaaaataacatggccgtaacaataggtaaacatctcatagtaacattataaaccgatgcagtatttgaagaaaaacaatagagcatttgcaatataggatcaacatgttcaagtgacaagcatgacttgccttgctctgctgctggaggaacctcggcgactatttcgaagtacaccggagcgtcggaagaaccggaatctaagcgacatacaaagcaaacaatacaaataggctataagactactaaaacagagaacaaaaccatttttaatggattctacacatttttcttgatttactgagacttgaatgggcttaaacggagcacggatgaattagttatgaattttagaagattcactgtgtttattactatgacaaaaagtccttaaataatttattgcgcaattaattcccagggctgacgtcatcaagggggcggcgccgacgggcggggcccgcatgtcagcggctcaaggggagagaggggcgccggcaagtagggcccccgggtcagcggcccaaggctgccgatccaccgtggaccgggaccacgcgggtggtccaccgccggtccacgggaccgacggcccagatcgccccaggaccgatcggacgggcggcggcgacccggctcagctcggctcaaggctggccgactggccacggtgatggcgacggcgcacgcgcgcgcacgcgttgccggcgatggcaaccggcggcggaggctgcggcgcgaaggcggcggcgctaagcggcggctaggaaggagagggaggggaatagaggggagagggatgcctcaccgagagtggccggcgcggaggaggacgacgacgaacggcgacggcgaccacgggcaaacggcggcgacgggcggacgaggtccagaatgccctaagggaggaaaagagagaggttagagggagggagacgaaccacggcggccggcatccatggccgaaggcggcggtaggggtagagctcaccagagcgcgaggggatgcgggttccggcgacgaatctcgacggaggaagggcggacggggtggagttcgtccttgcgaacccgacggtggcgacggcgcggtgcggcagtgagcctagcggcggctagcggcggccggagtagcgggagcggcggcggcgggtggttgcacggcgcgggagcgatggggagcacgagggagttcggcgaaatagggaaaaagagagagggggcgacggcggagcttaaataggggaggggaatcccggacgtggccggtaggggcgggattccgccggccaacgcggggagtgggggaggagagagaaaatcgaatcccggccatctcgtgtgcgggcgcgggcgggagagagaggggagtgggcgcgggaggtgcggcgcatgcgcgggcgtggccgacgtggcccggaggaggtggagacgtgggcgcggcggcggttgcgggcgcagcggcgcggcgcgaggtgggagacgggtccgacaggtgggccccacctgtcggtgacccgggtgagaggaggtgggcggccagctcgcgcggcctagctgggccttggccttcggccggcccagcgggaggggaggaaggaaggagaatgggccggcggccattcaaagaaaaagagaaaggaaaagaaagaaaaagaaaaagaattttcccagggatttaaatattgcttatgctcaattttaattggttaaaattatttctagagctctgaaaattccactaaaaatcttgttagcgtatttcgacatgtagaactcaagaaaaattccacatgccaattccgattattatttgcattaatttatcaaggtttactcttgctttacacaggtattttcttgagaccatttataacttcaatttaggcttgggaaagaaattcggggtgtgacaaaaaaaatactgggttccatgttgagcccacaaaataataaaaaataatggagcccatgtggtgcccacatatcaatgagacataaaaataaagaaatggaaaaacaaaatggacctactcgtcatcccctatccatttctctccatccccatctctggcgacatcgctagccagtgagcttgccattttgtccacgagaaggcggtgattgtgttaacagtgaaatttggtaagctagagaattatcacatcaccaatagtcggattcctgctatattcggttaagtaaattaatctattaaaggaaacttatccagaagtgaccgaattcaaggaggatgcgacatggaaagttatctatcaattagaaatagtttgttggtttccttttatctttagaaaagtgtgtttagcggtaagcaaagaatagaatcaactggcattttgtcattgatgtacaatagtatatccttaaagtgcaggaagttccatggtattctatcagtggctcagtgcagaatgagtactccacaggaaatttggaatagttctcttttttttttgttacatgtaatgcattaaggaagcaacgtgagatgcttagaggaagcaacaacttgacaagatagagttccatctcctatcatgaaaaacagtacgacttaacacgattactgcaacaaaaattatgctaatggtcgaaacagcattggaacacaccaaatagaactttttaggaaaaaataacctaccatagaacagaagtcattgttggttctccagaaaaccttaggggtggttctccagaaaaccttaggggaggaatccaaaagaaaggaaatgataagaataaaagaaaaaaaatacagaacaatatttaattatcaacaaacaggcagataggatatgaaactcatgtaccaaaaagtttcaataatagctgcaatggaaatggagtgtcttacacaagtttaaccacagagttgcaacaaaatagatggcattgcgatggcaccacaacatatgccttgctgctgtagacatatgattgaataaatgttcacaatcaagtgatcaacagggaagctagctttgggtttaacataataccatacaaactccaaaagtctagattatacaacttcagcacatactcaagctatattatacaacttcagtacatactcaagaaatctataggtgagctcgacctcgagcacctactcgggcacctattcatttgctgacttgagcacctccttggatatgggtgtgggggtggcagttttcttggtacgttggcgggggaaatgatcacccctcctttccccttcttgctcagcgggcagtgtggttgaaaaatcatgaaaactttatctgccttcttggtctgcggataacaagttgccaaggtcatcaagacagttagccggcggcgagcatcaggaagctatcctggtgggcatttgcggtgagcttaatggagtccaccctatcagttcgaaaaggaaaacatcgatgagaaaacattttcgcacaaaacattttgcaccaaattcacaaaacattttgcaccaaattgcaatctcagatttatggctcactcaatgttagatttcatcagctgaaactctatcatgaggacgttgaaatcagcccgcaacaggtccatctcccgaccgagatcacggataagtaagccgccgggcagtggctaggatggtagggggtgtctgcgaagtgtagaagagacgtgcgaaccacgcaggtggcgtagatgcggcggcgccggttgtcgtcgcggcg

SEQ ID NO: 68504 - DNA, 765 bp, Oryza sativa
tgcaccccaagcccagcctaaaaccattttgagggttttgaatagagggggaggtgtgaatccaattccacaataatccaaccattccatagtgtccaggtgatatgaatattcccaaagtctagagttgtaaaaccacctaatgttgcctaattaaccagcgaagcatctacctaaaatcatactagtggtaccatgagtagagtgtccactagttggggttttgtttattctagggtgaacaaggtaataataacaatagcaatactaataaggtcataacaaaggtaaataggcatggctaaataaaacattgataacgcgggaatttaaataaagcgataatgtaaaaatttaaatcaaaataattttgtaaactgggattcaatatgttccaggatgatgtgacttgtcttgctcgctttcccaaacgtcggcttcaacctccacgaagagcggatcttccgaagctgcggcgtctacacaaccaacggaaaagaaaaggcttttactctaataaactccatataacaagcaggaacaaagcacaaaattgggttcttgacttcttaaggaaaaattagagacttgaacggtccaattccgaattcaaatggccaagttatggccatttgaagtttatatgctctttaaatgaatatttgcaaatttcttcatttaaattttaattttaaaaagggtttattgcgccagccgagggggaggggcgcgcggaccgggtccacgggagtagggcccacgcgg

SEQ ID NO: 68505 - DNA, 2168 bp, Oryza sativa
tagggtagggtagggtaggggtggctatttcgggaaaggaaggttctggaaggtgggggagcggcggaggcggcggaggggggagggcggagaaggtgaatgctactgccggtcggtgagggtgggggagggacacgtgtcggaagggtgggcctagttgggccgcacatgggccttgtgtgggtgacaagtgtcggcgtgtcggtagctggaggaatccgaatcgatcaggagggggatatgctggcacaggaaatggatgggttgtgcaccgtccgatccaaaaccaacgctcaaacagtagctcgttttttttttcttctttttgggggtggtgcctacggggagtgccattcggcttaggagctgttcacttttatgttaaaaaaaattactaaattttggacaatgctaaaattttggtatagttgtcaaaattttgacaacttatcaaaattttggcaggattttttatatagttaccaaaatttagtagcaaactaaatgtagccacttttttttttgttttgacaactttaccaaaatttggtaaggttaaaaatagcatcaaagtgaacaggccattagctttattgacatgaaaaaaaaatatagttacatcggatgatgatacaaagcacttatatgtatttgtagatgtgttgcaaacatgtctgccttttgttctacatttccaggataaaatgaaagctgaaaggagaaaaacaaaatgctctagtatagcaaatcaaaggcgggaaaaaaaagagaagcacttaaaacatcagtatctctgctttagaaccaaattctaagtcttaatcgtttctaacagcaatcagcgggtgacacacgcgcggcggctgggctgcacctggcacttggccgacgtaatctcgctccggcgacacggccgccggaggctgcaattgtgttgcgtggcgccatggcccgccgtagtagcagccgccgccgccaacgcaccttgcgggcggactgtagctgtcttgcaatggcgaatgtgtaatgattggaaatttggggctaaccttgcgtgtttctttttgcgcggacgtattatacttcttgtctgtttcttcaggaaaaaaaagaatgatgttaaaggagcataaaaaaaaggaaataataacttcaggtgttcatgcacactacatataacattggtattcacaggccagtcaaattaatacagtatatacttactaaagcctcactccgatgctttctacttgtagtagaaaaaaaatctgaactgttgatcttatttgatcgaagggttcagatctatttttattaccacctcacttagtggtagtagaattgtggagagtacttttatctatataaaattatttacggagggatataatcgtcactttcactttataacaatagctaccctatcttctttcgttctggaactgacgcctgcatctggagcccatgccgagagaacctccctcgcgactcctcccttccgccgcctcagccgacctcgcctgctccgccaccctcgccctcgtctgccgcctcccgacgcactcgcctccgccgcctccaacgtttatctagctctctgagagaaatgcaccagcacatttgcccgcagctgctccattgctcgatgtcgtcaaaaatcttgtcgacaatctactgaattgagcattttgctttgcatcttttctgacacatacgaagttggttgcgtataccattgaacagaccaagggagagcttgctgaagaagcatgatagcagcaaaacctgacaaactattctttgatcaaccctaattaactttctgtccagagtttatggttgatagcatatcactgtcaatgcattttgcgaccatcgaacaagtctacagtaaaacggttttgctatataagagtacataggagtgggatttcaattaaatatataagaatgacaacttagcagcttgggatttcacttaaatatactccctcaatttctaaatatttaacaccgttgactttttttaatatgtttgaccgtttgtcttatttaaaaaatttaagtaattattaattcttttcctatcatttgattcattgttaaatatacttatatgtatacatatagttttacatatttcacaaaagtttttcaataagacgaac

SEQ ID NO: 68506 - DNA, 11874 bp, Oryza sativa
ataaatgataaaattggtgtgcttgtgaatttgaatttttttaaagatcaatcatttaatatattcagagttttttaaacatatcatgtttaacaaaaaaatacaatcatttttttaagctgcggaggtattaatgatcctatttcatgatataagtttgtcttctttctttttttagatttttcaaggttattttctttttttggatttttttaataataattttgggtttactacatattctgagttataggagtaacgagtaggtataggatatttaaagaaggaaaataaatgtaaatttgttgttttagatttgttttttcttaataattttgagtttactatatattttagagttataggagtagcgagtatgtgtggtatatttatagaagacaaaggagtagaagtttgtggttggaaagggagatagttttggaagcctctagaatccatatgtgatatttttctctagatttttcctcacatatgattaggtgttttttctctagtataaatttatgattttttcttcaaagtaagagacgccaagtggaccaatcaaaagctagcaaaagctttagattattagatatggatagctgtttcagcaggtgtgtcatgctagtgagcaaaaacaaaactaaaatgaaacatatggggcatatgtcagatccaaattcaacatctctttttttttacctgtgtttttaataacgatttaaaaaaaatcaattatgtaaaataaacaacggtgcaaacccccctcaaaatcaactccaaaattaagattcaaaattcaatttttggttatggatcatataagccaagaagaaaaagaagaaagaaagaagtacaccaatgttcagagaaagagaaggtgaagatatgcactgacaaaagaaggcaaaggaaaagccattgaaattgcaatcatgcaggagcaactctaaaaaaggggttgatgctgcaagtgcaaccaagctgtactttactctgaagggaaagcagaaactcccctaaatataagggacgcgtcatttacacatgttaatacaccatctgatgactgtaaaacccacaggtaaagtaggtctaaaatggtgcaaaatttgcatgcaaggttcattacagaaaaaattgggagctaaaataggggcctgaaagttacatcatgcacggtgattttcatttccaggagacaacagttcagtgattaggcattacttttacaaaagccagcagtcatcgagtgctaagattcatcgatgatggcttccaaagaactagtgctttcatttttcctttcttgctgaatacatcatattacagtaattaacaaagaaatgaagaaaattggatggagtcaagggctgtcatgaggcgcacctatgagcgcaaaaatcatggtatgcaatgcaccaagtggcaccacaattttttgttagggctcttggctgttcacgcgtttctgaagctccagcatttcttggtgatttggatccagagaaagggcggctcgacagtcgcgaagagcgctggggacatccccgatatgctcgtggaacgccgcgcgaagatgcaataggtggaggtcagctttgaatgcaatcgccctggttagctctgcaattgcttctttctccttgtgactatccatcagtactgcaaaccaaagccatcaaaaatcttttaactactccatttcttaaaaaacaactacatcagatataaaacacgctttcagtgttgaaagttgcatgttcaaataagagaaatgaatacacagaggaaattataggtaaggaatactgcaatggtgcagttcagtcaatagttcactaactaaatttgctctgacaaaaagaagattcagtaatgacagcagacatttactctacttaaaagatggtagcaacaaagtatctgttttgtccagcaaggatgatgaacaaattaacagttctccatgcagaagccaagataaggtatagagtaacctacatagtaacatagtattcaaaactaaaggtaattctcaactattaagtaaactttagtctttttacctgctgcacggtatctgtacgggtaaacacgtaatggatccaactgggtcactatttgcaaatctgtcatagtttgctctcgttcacaatattccgaacgtttctcataagctgaagcattgtttttagctttctctatcaactttgtcatttcttcatatgcagcatccctgttattcctgagaaaatgaacacgggcaagaccttgatgtgccctagtgtgtcggatcttcaaagcactcgtgtagcaatcagctgctgcgtctaacttctcacaatcaacataaacaccaccaagattgttcaaagcctgcaggtggaattatgcaatattagagaaaagcttatcataaggaacaatcgagagcaacttgttggatctgactaagcaagataggatcaaattttggatgtttgtattactggcagtcataatacagtatttaggatctatttgtcttaactagtaggatcaatttcagacaaaaatcatagcaagaatgtcgccctttggtccatgattaagttaaccgacacttttcatgttcagattctttaacttctctctttttgttcatgcatctccacatcatggacatgcataaaacagagtaggtatatagtatgttgcactgatgatacctcaacatcaaggatataaaattttgagttattggaatagttttgaacaataatataatttataattagccagacaagacaacattatccttttctcaccagcaactcttatttcactgagacaactgatcactgtccacaaatgcaagttttttttaatggtctcattgaaaaatttaaggcatatttaatatcacaatgcaaaataagtgtgtatacactctatagtctatactctaagttatatccagctttctatagcagctagagatctctcagtctatgtgcaaaacagaatattcccgcaatttggagggaacaatataaaaggaattttctcacgcctcatacttaaatgtttggagggaacaatataacaatattaaatgttatcttcgctttatttactgtcgagcaaagcatgcagggtcttaaaaatatagaaagtttgggaaaaccaagttgctctccaccttaccaagtctgagcaatgtgagataaactaagtgttcaaaacaaatcaattagcataagtgaatgctacgttgaagcatttgtgtgctggtgcgcaacaatactaacctgacccttccgaagccggtctgaagggcactttagtgcatcttcaagaagcgatataacagtcgcagaataagaaggatcaacacctgagtcagccaaaacataggctttcagaaagaaagcctcaaatgacctttgaatagaaatagattcctctgctttttgtagggcctcctcacaatgcccagtatcgtacaaaagccacccctcatacactagccgttcatgctcagttgctgcatgttgccgtgccaattgcaaactgcgcattgcagcctcaggacagttcaacctgtaaacaaaaaaatattaagcatcatctatagttatgttgagagttgagaccaaaatggccacaagggaatcaacagagtgaggtgctagtataactaacctaaggagcagcaaagattgtctgaaatacaaaacaccttttgctgcatctgactcaagcatccggtaaatcactgaaagggaaccaatatcatccactgatgaccagcgttcatacagctgaagccaacactcagctgtattccactgctcgacatgtgccccaagaagagtgcctattttggaagcagctacacgaccttccaacattcggtactcaggagaaagtgtaaggatagcatggatatcacaaattgcagatttgtagtcttcgagagcaagatatagacaaatccggagctccaagcattccaatgctagcttgaaacccaatagtcggttgatttcctctaaggcaagtcttgcatccttttttctcatcaaggatgcagctcgatacatgtaagggtaagtgagagttggatccagctcagttgctttgtcaaggtcacccaactttttatcaccctctgaatacagagatctctccatatacatccatcctagtggtacacttgatgttatgaccgaactgagcttctcataagccaaaccctttctacctcttgtaccagcaattctagcaagaccagcaatggaatacacatgaccagctgagaaggcaacactaaattggtgttcagcttcattatattccttccttaaaagcctaatgcatccaagctgatgaaaagctatttgcttctgtgtaggagtaacagccaattgaacaagcttctctgacaagcacacggttgcctccgtccttggatcaatgttcattgcaacctcactaagcaagcaatataacaaaaaggaggcatgtccaaccatgatgcattgctgctgttcagttgcacttaggaataggctaactacatgctcatcatttagacaatctggaagctcctgcagaaacacttgcaagcaagatgcagcgaggactggtgcattttcttcaaatgccaatgccatgagctcaacagcatcctgccttgatgaaacaaatgaagctagtttcctatcacacgcatctttaagcctgtcacaacaaaatgtatttgcaaacaccaggatctccaacaaggtttccaaaggcaaatcctctaagctatatgtacaactaaattcagatacagccctcatgccctccagtgagataccattctccgacaaatcaacaagatcaagctgagattcagtgaatggtccattgagcatggaccagaaagggatcgatagagaagcaatcttgcacctattgcatgtcaccttcccatcccttatttggaaggtcactacaggggaaactttcgaagatgtgccgatatcacaagaaccaagtatctcaaagtctccctcgggcatctcggatgcgacatcaagtggcccaaactctttgcaacacttcctacatgacgcgaggacatcggatatgatatcctccccccgcttctcataccgcagccatgccccaaacacaatcttctcatgcacagtggtcgcgcagcgccacgcagaatgcaggctcctctggcgcaatttcgcctccccaagtccccgaaacacctgggactgtatcaaatacagccctggccgctcgctcggcacacattgctcgagctcctcatggatcctggacagcacctccacataatccaagggcttatacaatggtacgaccggcggctccgcgatctttatcagcgactcgctgcacatccaaacaatcggcacaaatcatcagtatatctagttcaattttcagtagcatcacacagaaatgagctgaacgcggtgagagaatcgaaaatcttcgaatcaaatgtagtggcccttacatagaggaaggcgagtaggacgatttgggcagcttcccacgctccacctgcagccatgactgcggattgaatccatggatatgctgctcgtcgcacggcgattccgacaggaagctgctcctcatagagcacaggaaggagaaaacctcccaaatctccaccactcccagatttttacacgaacctggatacgaatcacgagctaatgggggtacgagcgggaatccacaccaaccctagctaaaatttgcgcaagaaaacgccaagaatctgaacagaaaaagggttgggaatttggtggccaaggtaaccacctttttccagctccaccaccaccaccaacccgatccaaaaccacaagaactcgaacgaaatccacaagaaacgggccaaagatgggtcccaaatctcgccgcaaaaatcccacctttccgcgccccccgcgccccccgatcgaattccacagatcaagaagccgcgcccccgcggcaatggcggggaggagctcggattcgggatcctgcgactgcagggagcagcttcgatgcagaggaaggggggagaagaagaagaagaagaaaaagagaggatttttttttcctctcctctttcttctctctcttgtagtggtagtggatgtggagaggaataaataaagtatggagattagattaacctagtgttagaggaaaaaaatatttataaatttttttagggtgtgccttttgtgaagagagagagggaaaaaaatggaaatgctctgcacatgaatccatgcataggatgcagctggatggaccagcttttgggtgtaggaggaggtggaggggatgaatcatgaatgtgtttgttcaaatttgtgtttgtaagttttgaaaggtttttcaggtttggtctgaaatggcactttgccacaggacattgattgacattgtgattaagttgaattatggaggtatgggtacaaatcagggtttatattcctcttttgtaattgttgaaacatctttggaggtaaaaaatttattccaaaatgctttcagtgtatgtaagttgaattatggaggtattggtccaaatgacgatttataaataacccttttcagatttgactgaaacatcacggtggtgagaaaatttcattcgaagcatttttaattgatcatgggattgttaaaagctttggatctgaacataagttactggcgggcttactttacaaatttaaaaattaaaaaaaaatcccatattgggaccacatatttttaatttttcgctccacacacaattgaaacaacaaagttgaagtatcatgtgtccacaaaacaattggaacaatgttgcaggtgtcagctggtagctgagagtttggcatagtttgtcgtttgttgagaacttgcattaagagcagaaaccaaattaggtttcgttgttatgagacttttgtttccaaacttttttagggggggtttggtgaatctaaactatagtgaattgaagtggcaatcgcaactagtaacaaccgtactttgtttgtggagtccgtgtatttatatcatgttcgctggtatgttgtaggtggtactaaatttagaattaataatactacatgggaaactagttgtttggaaaaggctaaccaaatgcagagtctcataggttagccaagagttgattatataacaagcatcttattaacgataaaaaataatttataagtgaaacttttatatacgtattcttagcgacataaaaatcaatgctgagaagaaactatgtttaatatatcctaaaatcaacataaaaaattaagttttagaatttaaattttgtcaacggctgatttcatatatgggaaaagatgaggccgactgagaatgagagtattaatgatgaaatgcacacctaaacaaactcataggatggttctatcaatcaattttagctgatggaacccatcttttagatacttactcgctccggtttcattttaattgacgttttatacaatgacacagtctacaaaatatatttttaaccttatttttctattataatatatataataaataaatgtatgtttacttttattatagtattttgaaagacaaatctatatatgttgttctagttcctctaaactaaataatttttaagttatttatggtcaaaattataaaagtttgacttcaactttatctaaaacatcaattaaaatagaactggaggagtactgatcaatagtgagtaggagtagtagttagttgtgcatgcatgcatgaatttagttgaggtagatggaccagcaaacagatgatggattggattggattggataaatggggtcacgagatgagcacaagtagagtgaagacttagctgctaaaaaagaggtcaaaaaagaagtacatatatgatacaactagaaaaaaagggccaagggttaatgtagacgcattgatcgatcggaatggtcgttgggaatcataattgggtttgtgtggtaccctactcttgcttatcaagaacttattatggttttgaaaaaagaatttggcgtgcattgcaaatttgcagcataaatgcattttcccagctagctcaaactgcctgccttgtagacccaaacacacacattcttcagtagagaattttggaatgtactactgtgaaatggatttggagatgaaactaacgaattcttggctttgtttgtaataatttgaagctttgattgaacatttggacgccgttttgcccttcatcgaccatcatgcatccatacagactgcaaaaataaatagactataatagaggtctctttttgctgctcgatgcatcttgttctgtgcttgctgcccgaccatggtgacaaactcggcgccctctcatgcctcgtgttttccacctcactcacgctatatcgccgtcgcaaacatcgtcgtttaaaatgcacacaaatttgtgtaaaaatctgaacacgaaagtacagataagatggcattcgtcgggttctcatttttttttccaccaattttgcaacgatgcatatcatttgaacccttttttttcacaatggagctttcttgcttggtgtgatctcttggggttaatgggatgctgaatagctaactttttttaagatataaacaaacaaattaactattatagagttgaaaggatttttttcgccggccagccggtgacagaatgacgaccaatttattactccctccgtctcataatataagggattttgactttttacttgtattgtttgaccattcgtcttattcaaaaaaatttaaaattattatttattttatttgtgacttattttattatccaaagtattttaaacacaacttttcggtttttatatttgcacaaattttttaaataagacgactgatcaaacagtgcaagtaaaaaatcaaaatcccttatattataggacggagggagtaagattcaaggaaaatatgtaattatggacaaggatataatctttgaaaaacaatttgatcactattttctattataatatatataggaacatcaataaatatatgattttagtgaaatacttttttaaaataatacgtatagcacaacattgtaacgtaaatattgagctcggtccattcactaacttcacaaagccttatttcgatgggccgaagtcacggcccatacacttgcatgggccagatccaaacgaggattagggttgaaaaaatatattttcctcccttagttatagatccagtttcattcgaaatccctcgatcgtaaaatcagatactttcagtactgtagatataatatatcccgtatagtaatacttaaatataatatgcctatatttatacggaaaggtattccgtaagtatgcataaatatacacaccataatgggattccacacatacaccttgtcctgtttggacgcggcttgcctgctccccagggcgtgctccgatcagtgctcccgtatacgcggcacaattctagcgttttcctgtttttttccccttagcccacaaccaggagaaagattcagagaatcccgttccatcaaaccgaaaaaaaatcggcatttaacactccaccgcttccagctacttgctcttttagatttctttatcctgtggcagcagtggcgaagggtagccggctgccggcgaccagaaaccggcgagcagagccggcgtggtggggcggcagcgagggatgagcaggaggaagctgcggagcgacgagtggtggcgcatcacgcgcggccgtgctggtacgggcggagcaatgggtatcactagccactgggtagtggctgaagacatcgttgctgataggtctgaaagggagcagtacaccaggatgtgcaagaacctatcaaacaacacttcgaagctctgaagtaacatctatgtattgtagaatttcctaagtaaatgaccgcaatcaagcaggggtccttagaagcatgatttgatctaaaacaactgagccttttcaattagcactatatattggtttctgacagtaagatctgattgcattgcaggtttcaacttcagagtttacaacccacactctgctccacattttatttctatcatgggagatgttaaataattgttgtaatgatttgagaagacaagtagagaataaataaatgagcagccgaacattattcatgtacactctgtagttgaatccatcaggagagaatgatatttttctcataaacagggttgatcgaaagttaaaaatcaataatgacaaagaacatgagcatctatgtttatcttttgggtttctgctggatcatttagagtctcatccattgcttttaaattttggtgtggatatccagaagtgaggtctttttctgaaaaatgtgctgaggtgacaagctaatcctcagccattccaacgacgttacaattatccaggagtgaggtgtgattttgaaaaaattgctgaggtggcaagctaatcctcagccattcccacacgtttaataaatcaatagttgacgtgccgatcgaacaacgcatttgctttgagctggcaggagtagcaaccataccgcccgcgctggccggaccggccgtacgcaccgccaccggctccggctcatgcgcggttccgctctctggtctggtctcgagtctcgacagcgacccgaacggtcaaccacttccacgccaagtcgaaatcaccccccacccgcaccatcctcaccgtccgtccgcgccgtgcacgctcccagatcatcctcaccgtccgcgtgggccccaccccccaccccaacccgtgccgcactccttccttttccccgacaagccttccgcctctctcccgtctcctccccacttcccttccaccgtggtctcctcctcctcctcctctccacccgcatccgtggctccggttgcgctgctcgggagccctcgcggctttctaggaggtcgctggagcggccgattagaggggccagcgccggcggcgtcggattcggcgcctcttccggtgattcccctctccccttccccttgtttatcgcttttccgtgccgttgcccgggtgcgaaggcttctgggaacttttactgctgtgttcgtgctgcttcgtttgtttcggatagtttcgtagtctcattctctgctgtttcgtccagcgccgtgtcggtgcgcttgcgctgcggtatggtccccgcggcctggttagggtttggtgtcgaggtggtcgggggagtcttagggaaggcggcattgttgtatggaaaactgggggttcggcgatgaatccggatcgagcgcccgttagagtttatgcgagcttggtgcttcgttttggcgaatttttgggccgtttttgattgaagccaaaacgtgaccctaccaaaattttgttaagtttaatagtaaatgtgctagtttggattgaagccaaataattggtaattcccacgctcaatttggctatattctagaatcttcttcactcatactaaattttggttttatattggtattaaaccaaacatatactagctaactttgtctaccaaaaaattggtagtgcctagattttggtaattggtaattggtagggtagagaaccaaataggcctttgttccgctgtatttattctgtcagtaagagaaacttgcaacctttgttttgctttcttgtgtttgggtgtaactgtaattccatttttattttttttttgggaggaaagagacagggagaactccaagctcatccattttactactccctccgtcccacccacaatataagggattttaagttttggcttgcaacgtttga

SEQ ID NO: 68507 - DNA, 1047 bp, Oryza sativa
tgccgcggcacaggaggagcgtgagcgactagggtgcatcgtcagccggcacttcgagccacctatgcacggccattgcgacgcctgccgatgccgccgaacgaccgcgccgtgtagcctcgcccacggcgacgacgacggtggagagccgacgacgacgtcggccacggcgcgcggctgctccacccgtagcctccgctccgccgccgggctcgcccatcgtccgctccgcccacagcccgccaccgttctgctgccgcgctcggccatcgcggctgcacccgccgccagcctgaaggagaagagagaggagagaagagaaaagagaagagaaggagaagaaaagagaagaaaaaaaaaatatgtgtagctggcatgtgggccccacgtacctttttattttttttgctgactaggatgccacgtcagcaaaaccgggcaaaaaataccgccgagggacctccggtgaacggtttgattaagtttaggggtagacatttctggctttatggttaagggaactcaaaaaatctcgctgttaagttgagggacctccggtgaacttattccaaaataaaaaggctgaataagttcactttaggtccctctatttgatggtgaatccgaaattcgtccccttaccgaaacaccagaaatatcccatccctcaactcacaataccatgtcaactttagtctctcagcattatagtggctggttttggctgacgtgatgagtgtgctgttggtatttcttaacgtcaattctccttcacattagtctgtaattcctcccaacttctggacgctcgtggaatatgctagaaatgaatcatatcactatgttagatgtttcattatttgagttttatgtagatattggcggtacaaatttggctcttaacagccgccaacatgagccccacgtgggaccacctgtcagcgtctccctcctccccctcttccctccccctcccaagatatatttctctatttgccacttttacaaagtgacaattaatgatttgttactagacccatatgttat

SEQ ID NO: 68508 - DNA, 723 bp, Oryza sativa
gcgtagaaatctgcaagatttatatcttaagagaacaagctaaggtatgcttcgggcccggcctactcttgggcccgggctcaccttagttcgcatgagtcacgcactactcgaggatgatgagtgccaagacatacaaagcataaaggtgtaaactgaggtttgcctcaggcccggccttgtttcgggccccgagctcaccttggtccttatagggctcactccctctgcctagaggagcatcgagacgtacaaatcttggaatattccttcaccaacgacatcttcgagaaactcatccgaggattgccaaacttgccgggaagttgggcgtgctccatagccagctgtgaggcagtatgccccgccataattgaaacaggatcatgggggatccccaactagtctgaagttgaaaggacgtggacaagacaccagcgctgagtcacctaggactagtgacgccttggacacgcgtcacacatgcctcgcaccacttgatttatccaagcaagtggagaagcaacggtggcactgtttcgggcaagtcgggttctcaggcccaccacgcaccacgtggcgagcacactggtgagatcctactgtctcagatggagcccggggtaatatgaatcgcaagactcaaagggtttcttgaagactgtgttagggaaccagccggcgacaataagacagctgataagacaagactaatagtagatt

SEQ ID NO: 68509 - DNA, 727 bp, Oryza sativa
agaaatttatacaaattcatattcatgaatatgcaccattttggattctaaaacaaattaaggacatgagtacattgttggagttctaattacatgatcttaagctttagtctataaacaatcccttttgcttatgcggaaaaataattgatctactgacctgagttagaagccttaccgttcttctttcttcttcttccagagatgcctcacgaaccccttccagtgcctagatcgattgggcgattaattagggtttgagattagagagagagagagagtttggtcgtctgcctctttccttctctttctttatataggcgacactggtggggctcgggggttatctcaattagtttaggattctgttttctgtaccgatcacataaaaaacaaatttattcttagtttgtttcttgtcaggataaggaaaccgatggtttagatcctctcctaacccttatcgacacaagtcgacaaaatcaaccaacattctccccttgattttgagacttacttacgagtttattaaataaaatagctccccaaggcaatgtgtcttcaacaacattatgcgtcactgagacaacaagacctatagctcactatagtactcaaataaactcaagcttaacttagtgggtgttgattgaaaaatttagtccccctcatccaggatctcagtaaggctctaatttacatatatactggccagaacataatctta

SEQ ID NO: 68510 - DNA, 934 bp, Oryza sativa
ctgcagccccttagtaaaaggctctagttatttttcctgtttttttctttatcaatttgtattctcgagtattaatggtactatatttgatttatcttcttatcattgaaggtccattaagccacaaacttcatgcgtacatcggtgaaggtgcataagttgacgacagaagatgcaatgaatacattcttaccatcaagaataaatttttgcgtcaccctgagaagttccatgcattcatacacaccatgattgatttctccaggggcaggtgagtaataggcattaacatagggtggttgcttacaaaatcatgactggatagattggagcaagaaattctcatgtgttactagttgtatgtggataacaagttttattgaaactttggttatgcaggattaacactcatactgttattgaacgtgtgaagatcctttttgatgggtatcctgatctactccttgcattcaacaagttcttgccaagaggcataaatgcaatatgatgaagaattttgtctaaatatgtttcctcgtttaaggctcaagctcactagctataataaatctttgataactttatgagttggtttactcatctattttaattgaataatttagcaatgctacatttgttcttatcgtacttgtctaagtacctaagtgccgactatattttggagtgctgttattcttattttatctatgccatctatttggtggagatagagattctaagtagctagtgagtatccatttggtgaaaaatctagagaagctaaggcatcatttgatgagattctctaattggctacttcctcggttatcgtgaacacactaactaaactactacgatgatttttttccaaacattttctgtatagaagtttattttaaaaaaataaaacatttgtcatgtttacaatagttgg

SEQ ID NO: 68511 - DNA, 17090 bp, Oryza sativa
tgtcaggtttgtacccgaaaaagcatgatattaatatttacaaggtttctaccactatttattatgttctttcttactatcctgcataggatctttactggaattatcttatagaatcgtgtttctataactcgtatgatcctatggtacagactataacattgacaacttcaatgcacggtctatcctctagataactctcttgcatcattgcatgatatctcatactgattttttctccgtaatttttcaggtttaagcattggtcttgtagtcagtggcggcacagttcttttgcttctggctctttgtgctcccctcgcaacacgtaagattaagctacggaagatgaagaaaacaaaagaaagatttttcaagcaaaatcatgggttgctattgcagcaattaatttcacaaaaggtggacattggggaaagaatgatcattaccttatcagatctagagaaggccacaaacaattttgataaaagtcgtgaggttggtgggggagggcatggcattgtgtacaagggaatacttgacctacatgttgtggccatcaagaaatcaaagatagtagtacaacgagaaattgaccaattcataaatgaggttgcagttctttcccaaatcaaccatagaaatgtagtgaagctcctaggatgctgccttgagacagaagttccattgttggtttatgagtttgtttcaaatggaacactttatgatcatcttcatgttgaagggccaatgtcagttccgtgggatgaccgactaaggattgcacttgaagttgctagagctgttgcgtatctgcattcagctagttctatgccaatattccatagagatattaaatcttccaatatacttcttgatgatagcttgacagcaaaggtgtcagactttggagcttcaaggtacattccaatcgatcaaacaggagtgacaacagctgttcagggaacatttggatatttagatccaatgtactattacactggaaggctaactgacaggagtgatgtttttagttttggtgttcttctcgtggaattgcttactagaaagaagccgtttgtacacacctctagcaacggcgatgctcttgttttacattttgtttcactacatacagaaaacaacttggtcgacatattagatcctcaagtcatggaagagggagatggagaagtccaagaagtagctgcactagcagcaacgtgtattaaattgaagggagatgaccggcctacaatgagagaagtggagatggcacttgaaaatatacgagttaagaagaagcatgctacacttggtacaacatcaaatagatgtgatggggaccaaattgtatgtgattatttgtcgactagaggaatcactgacgaatcaacaagacaatacactatggaagaggaaatattgtcgtctggtacctatcctcgatgatgtttgtctttggcctgaactagaattgctgtttgttatatgtacaacgtttgtaaagcatgtcagtagtgcaagaagtgatcttgctttattgttttggaaatgaagaattgtttctatcccgtcataaacaattcccgaaatcttttcgttggcagcgaatgtctggctcagttgaattcatacattctagataaatcaatgcatgtaaacataacaatggaaggcaattatatatttttctctatgctctgactgaaacgtatagagttattccttaccgagaaatatcatattcacacaagtcctcacgtatatacactgtgcacaccaatttataaatattaccgaaaaatatagaaaaaatgtacatgtactttcaataatattacatctacgtgtaaagtcacatcttcaaattcatcctacatagagactaacaaaaagataaaattctaatggatttatagcctcaagacttagattctattttttttgttacatctaagatataaggaatttaaggttaagattttacatgtaggaataatactattaaaagtatatacacaatttttactatatttttcggtaatatttatttgttggtgcgtacatgaaacttatatgcatatgatatgataaaatagcacatcacagatgaaagaaggctgaaaaaattaagataaaagtgtaataaaaaagataataggaggagaggaaggttagagaaataaaaaatagagagaaaagagaggtaatattatgatttttggccttatcaaaatacaatggattttttttgctaggatggttcttcataaaaaaatgcaaaatgtaataggttgcataaaaaattaactgtgtttcttttttgtcctatacggcttgaaaatgaaaaaaagcatagcaacaaaaatttaatttaaataagtggttcaaattaaaaacatgtataatttgtaaaaatcaaaccatccataatcatccatagattactatcataatttgattatgtccttagaaatactttaagttgtttgaatgtaggattttttttacgaatttttcagccttttttaatttgtaatgtagtatctcttctacactgccttatatctgttttataggttttatattctagattctatttttagttattttttccgcacacgcctattgccacatttcggccaagccatcggtccacgcacacaccctttcgccttatgttctcccttgtgaaacagtggaagcaccagcgaatgtaggtcatatgtttcaacgacccttaatatacaagagttcaccgataaatttaaaactattatttgtttgagtttaaatttttgtgaaaacgttgtgcagatttcatcaaatttatgtaaatttgatttataaatttgaaattatgttttatggtcaaatagttctgtccctttgtttttttttttacaaatgagggctcattcggaacacaaagattgaaaaaaagaataagaaaaactaggtgattccccgtactttgctgcagaaattactaactaaattttatttttttttaataatcgagctaaaaataaaaattatattactccctccgtcccaaaatataagtatttttggacttcgacatagccttcgatatgctattttgaccagtaatatctataaagtgagacattttaaataaaaagagttgcatactatgatagtttgtttaatgataaaaatctagtaacaacaattttacatgattgatctttttttttgcattaattgtcaaaattagaaatgtttgccttgacaatattctaaaaatgcttatattttggaacggagggagtagttattaacaacaaataaaattggtttgtcaaactatgttaagagagaaataaatttagtagactctgtatgaaattgtagatgaaatatgatatcccgcactttgctgttctcgtcttgcaggaattgtgtagtaacaggacggtcatcgtgcagtaacaagacaactttctcacagtaacaacgttaaaaagtagtcatgatggatctagtttcgttaagcgtttttttatgaacatcatggtgcaaacggattagaaaaacaagatatgatgtgagagatattgctctataaagattgagatttacctctttttagttcttgtctcactggaacagcgtagtaacacgatggccaatgtatagtaacacgactgcttttcgcagtaccgacattaaaaagtagttacgatggttctagttttgttaagaattttttttacgaacgccatgatgcaaacgggttagaaaaataaggcatggcatttacgttactgctatctaaagattgagatttaaaatattttagctctacaaaaaaattactacaatagtgccacccgttactctacatgttctctgttactgtaaatttcgtcatgttgttactgccaacattatagtaacaacctataaattttgtagtaacaaactataaattttgcagtaacgtatcatgttactacctttctgtgataatattactgccgaatcacagtaataaggtatgattcttgcagtaacataactgatttgttatcacacaatttaaacagacatacaaagcatgcaaacaatattttctattcacataacattagacggtgaattgcttagaaaagcttgccatgaaccatgagatcatgggttcaagtcttagtttcaccaatttatttttttctaaaaaaagaaaagaataggaggaaaaataagagatgtgagggagagaaaatggttggcagagagagatcgagagggggagggaatacgggaggggggatcggagggagggaagagagatcgagagggggagggggggaggagggtgcgccgggagtgagggagggagggatgggctggacctaggaggtgggaagggatgtagaatagttattctagggggaggtgtagaatagagctgtactatgtagggtatgtataaggtgtagaatagagctgtactatgtagggtatgtatatataggccctctttgtttaggcttaggcttattggcctaaacttttaagtcagtttattggcttatatgatttataagtcaatggatttaatgtcctaaatttagtggtggagtcatacatctatctcatataagccaaaaaagcttctctaatatagcttttggcttaacagtgttagagtggcttagtggcttcaaaaaagccaaataaaaaagctgcttgtttgttttggcttagacttttcgacttataagttggcttataagtctaaacaaagagggccatactctctctctctctctgttttttttatttgacgcaccagttcaatctcaaagcgttttttttatttgacgccagcagttcagtcccacctcttctgcacacgaatttccattcttgccccccacagatgcctcattctcctttcgacttcagcgggtggcgatggcgtctagggactcactccatcgctccaccgccaccgccgacctcctcctcggcgacgcgcactgggaccgcttccaggaggccgtcctcgagctcaggcatgacgtcaccgaggcgcaggcggtgctgcggaggggcaacgccgcaaggcgaggctcgcggccgccgtcaggtcccaatgctgggccgaaggagctctgccgcctcgcctccgccactgcggctgccaccaagcacttgtcgccgcgcctcagctttggctccatcgccgaggaaatcgagatggccgccgcggcatccattgctgtgttcatgacaaccatgttcatgttgtggccatggcatcctcatgcaagaagacgccagcatttgtggcctttgcatagaaggcctcgccagagacgcggaggtatctcttgacaagtttgaggagttggatcaatgcatcgatgagtccaagagcagctacccaaggtgttcagtagtgttcttcagacggaatggaagcattgtattcttacaagaagattttcttccaacccacagatgattggagttgcttcttactgatgattggagtatcagattatcagtaaatcacattatactggcaatttgagtaaattgaaatattgtgacttggaagaaatttaagatgagatgagagattttaacagtatcgcctttaaaggcaacaaatggaattttgcaattccatcatcatagagaaaagaaaggagtacatgtcattctcagacacatcccacattccatcattccagcatctttacaactcatgcataaaaatagagtttttactccagcaaaaatatctcaaatcattcttaaagtggagtttgcccaaattgagttctgaaacatgaatggccttttaattcttcttcttctggccacattggaaggaattcactgtcattcttagacagttatatcatgatgacaaagcataattttactaagattgttcaaccataatttggttataccacctgaactatgagcaggcgaataaaagcaagaagatgcagaggccatcaatcacgtcgtcatattgcatgaaaagtcaacagccaattgttgaagaaatgctatgtgtaatcatccacatggtaacagagtgctgaatttggtctgaacttatctctgaatttcaccaaatgttctttctgaatttagtctcagctcgatctcctctctagaccatatgtttagcatccatgtcaaatgtgcactaatctgcagcatacacgagagagagagagagagagagagagagagagagagagagagagagaaactgcgcacacattgttctcaggaacaatatcatctcaagattcacaaaccaggttcaggaacagtaccaacatcgttgacctgaaggctgaagcatggccgcccgggaaaccgaaggactcatccgaggaggcggggacggcgccgcggccaccgacgacaatctgcaactggcgtcgccttgctccatggccgcctgctccgccttgctccttggctgccatcccgcctcgctctatgtctgcttgccgccttgccctaccctgccttgccctgcttgatggctgtgtcgctgccgtcgtcagcctgctgtgtagcagttggagagtgctggtggagtgatagtccgccgccggactcatccgaggtgccaccggcagtgctcgtctcgccgccggcgcgcgtggaggaaacaccgtagcgcaaaggagataagaacgaagggcaaaagagtcaatttgcagcttccttaatttcctcaatcgtgtcggaaacatcaaataaaaaaacggagtatataatgaaaaataatgtgataatgtgaatgaaaatgattggatgttgattttgtaaaattcaatgaattatagatgatattgcaagcttgcataagttttgtatgtaattattgctagtggatgatgaggtggcatgtttgcatgttgagttttagaattagttatttataactttacagtaagatacgatacaggaatatgataggaatccaagtgtaaaatagatgattaaaaaacacaggaattttatatggataattgtttggatggatcaagggaaaaacatgggaatcttataataaaagcgagtgcaatgtaacatagcgtcacaaacagtgaagtaagcaatatcaatgaacactttgcttttatcatgctttgattggttgcttggcttgattttcctttttcccacgcgaagggatagaaaaaagaggttggtcgcagattgttctttttcctgtgatcttctagtgaacaatctttttcctgtgatcttctagtgaaatcgctaatataggaaaatttcctatgtatttcctatgaccgattccagtaatccgaacgatgctaaagtggcttaatctcgatccatacgaaaatgcttctcctcgaacgttcggactgaacaagaaaaatcgggcgggctgactctaacacacgtccttttaagcctacacacatatacctttaacgatatttaaaacaatttttctcgtaaattacttatccaatctacaatccgatcacaccattgtattcgttttacaataagatatcgcatgattatattctgattaaaattaatcatatgtttcaatccattaacactctttgtttcatacgcgatagtgatatgttttaatatatctcttcagcatgtttcacaaatttcgtgaaactacatttcactactctctcctctctctccacctcatacatgcacgcatgtatgcattttaacgagcttcaaaacaatttgtctcataaactaattatccaatatatgatccgatcacaccgttatatttgttgtaattaaatatttacaacaagatatcacataattatattttgatgaaagaaaaacatatgtttcaatccgttaacactagttgttttatatgtgatagcgatatgtttcaacgtgtatcttcatcatatttcataaaatttttaaatgtttcagttgctgattttttgtttcaccatatataatttgatgtttcactcattggtcaactagaacatttgacaaaccaattttctttaggacttgggacgtcggataggaagattcctcatgattgaggagtgaagaatgaagtgcaacaacatgcacatacacaatcgagctgggcgttcgatatttggtgatatattggacgtccgagccgtagtgctctcgcaatccataggaactgaaatccttcattttttcccttcatttaatctgaacgatgctgaagtggctcattcggattgagccctgaatgttttttcatgtcgagaattgtgttcttcttggtatgctagcatatcagcacataaatgtgagagagggcaataaaatcatttgaaaaataaactaacggtcaatttatgaaatgggtaagatgagatcgaaatgaaaaccaagtggatgcaaggaataagataaaatttagtggtatataagaaattgagaaaaactcaaggacacgaaagaaaattttcccttttcataatgctacgctgcaaggttggggaaaaatggaagcatcaagcatgccatgctagagccgtggtcattgatctaacgtgtttgcaaggatatataggacacttcagattgaccattttaaatcatatctttctttttataaaattgataaatatgtggatgtatttagtttattgtcaaacattggtaatagctagagatttgttttagaagaacagtacctttctttttataaaattgataaaaatgtggatgtatttagtttattaccaaacattggtaatacctagagatattttttagaaatacagcataaacggagtcaccactggcgcctcgctatcgatgaatacgtcgtctatcaccgaaagaataattaaccgtaatgcgagcatccgtgtcaaatttagaatttgatcctgtgtgggttggttccaccacaagtaacttaactagttgagctccgctcacttgcaaaatacctagagattttttttttttgcaataacacatttaacctatcatacaaaacaagataatgttgtcaacctatcaaaattttgtcattaccaaattttgaaaattttattttggcagtaatgtaaacagacccgtagcctacccatagcctcacgctgcatgtttttgtaaagttttttttaaaatattaaagtaaattgatttttgaaatgggaagaaagtggttaattattgtgctgttgaggtcaaccggaaaatataggagaatggtttacctcaaagggtaacatctctactgacaaaccatttcaatagtacgggtgctgccgtgccatgaaggcacgaagtatctggcttacccgattatctttgtgtttgcaatcctatgttcccaacccctctctctctctctcttcgcgcgtacgtttttcaaattgctaaacggtgtattttttaaaaaactttctatacgaaagttgcttaaaaaatcaaattaatctatttttttaaaaaatagcaaatacttaattaatcacacgctaatggaccgctccgtttttcgtgatcactgttccggatgggaaccgcttctagcgaacacagccgaatcctgactatttagtgaacaagtgcacgaagaagatgcacatgtagcttgttcatgttcaaaagagtataagcgtgcgtacacatgtgtaccttagaaatacgcgccaagtatgccgaccataagtaaggctgacactgatgtacgttgactcgatcagtcgatctcccctaaatgcaagctcgatggagtataattcaaacacggatgcttaattgatctcttcaaatgcacgtgacctccaacttgaacaccaacttactacggtggaaatatatattacatataatctaatagttattttttcagatttgttgtcatttagttgacataatagacaagaggaccgtttaaaaagaataagtgagtggactcccaatccgatgactaaaataattttccaacactaagccagatcctatcatctgtgacgggctctaaccctcacctttgatggatttggtcttggtcactgattagtggtcactgatgactacatctcatctcaaacgggtgaaagcccgtcaatgatgattggcacctttgacggaccgaataaaataaactcacacatgatgagtgaatcttttcagcccatcaaaggtaataaacacctctgacaggttcaactcaccacccgtcacaggtgtggaaaatcaacaaaaaaaaatttaaagccctcagcctctagctctcagctctcagctctcagccctcaggccatatctcatgacatgaagaacatctcaagatctcatgacacaataactttgcattttattgacagatatgttgacacatgaagcacatccacacaagtaatatacatcacaaatccacacaactttgagtaataaactacaaatccacagaagcaaccatgagtataacccaatctgaaatttggaaatgaaaatttgcacaacctataagagctggaaatggcggcggagctagtgggtgaaggagacggtggacgacgccggcggtcaggggtagaggccgccggatccaacggttggcggtgcggtggaggaggctgccgctggatcgggcaagcggcggtggggtggcggaggaggaggcgactggtggtcgggggagaggcgccagatctgcgtcccccaaacgtgttgaggctggcggtcgttaggcaggagaggcggcggcggctggcgatcgggacacggaggaggaagtggccgacggtgaggggagaggccgcggtggccggatccgtgccctgtaagtcatatccggcggccaacggtcggaaggcggtggaggcggcgccggccggtggtcgggagacggaggaggaagcggccatcggtggggggagaggccgtggtggtcggatccacgccctataggccagatccggcggccggcggtcgaaagacgggggaggcagcgccggctggcggtcgggaggcgaaggaggaagcggccggcggtggggggagagcccgtggtggccggatccgtgccccgtaggccagatccgacggctggcggtcagaaggcggctgagggaggcggcgcccgacggcggtcgagaagcggaggaggatgcggccggtggtggccgctactcgcgcgtggagttgaaggccgccaccggacccggtgttcggcgcgtgcaagcttggtgcgtgcggaggaggatgaaagaaagaaaaacgagagagagagagagagagagagagagagagagagagagagagagagggggatggataaggaagaactaagaaacgagagatgagtggtctcggactgtcggtgggtgatagataaggattgggttgggtggtttccacctgtgacggaaaaaaaaagaggacccgttagaaatggtttcataacatctttgacgggctggatctgtatggcccgttacaggtatctagtcacctgtgacgggccgtagccggatgccttaccgatggcggcatcccgtagaacctgtcaaaggtgatcctcatcactgaccaacacttatgcccatcacaggtatgtcgtcaaaggttgaggatatggcgtagtgcaagacgctttacgtgtattatttagtactaccttcatcccaaattaattgtaattctaagttatttaacatatattaagctttgaaaaacccttattgaatggtttgtaggtaagaatgaaagggtaaaatagaaagaaatttagatgagaagtgatttatgagatcgtgttgatgcaaaaaaaaacacacactggcctaagagatttgctttactctagtgcaggttctaaatttgctttcgggtttagagcgtgccagttggtttgatcctgcaaccaacaagaaaaaaagaaaccaaagttaaatctataaacgatagccgatcggctggattgccgatgacgtttcgtcagatatcaagccgatgcaatataacttggatcggcaataaagtatatagtagataaagaactaaattcactttatcggctgcagatattaacaatgtataatctatacttcaaaatatgtttaaactacgtgatcagggtagatcggatgttgccgagacagtataaataacatatgtttaaaagtacttcaaggtaaagattaaataagttcatgtcagccaataggtaaatctagcgtgtgttggctattgctccaatacttctttatactaagatattattatagattaaatatattaaacaagaatgataacctaagtagatcaatatcaagcgtaatatatttcaccttagtgagatcttaatataaagggtagatttagcatatcaagtaaatataagtgaagaacaagatagctaaaccgggtaagataggctgaaactccgatgctatctctgttagcaatcatgaagcaagttagatattatggttctagatattacttaatagatcaaacttaactgatgcagcattaagcataaagagaaacataagatctgatcaacaaaccaatgaaagccttttcgagatggtggatatactatataatctaacccgacagagttatctaattctatcggctgatctcgatgatggaggctagtcgacaagaccagatagtaatgtcaatctagattatatagcatatatgataactcgacgatttacataaacaagattagagtgtcataaagatgtaagcactaatcccgagaacgcaagtcgccataacaagctttacctctcgtcagagatcgtaaccgatgcagcccaactcgaaagcaagaactcgtcgaaacaatgaaagtagaaaaaggtggcgatgcgccgaaagtgttgttgaactggtgttaatcgtttacaaggtgtcgggcacatatttatacccaaaatatacaatatgtccacatcgaacacgactccacttctattacaactctaaaatacgaacaagtactttaggcagactcttaccgaaaatctatgaagaaactactagaatatcctaattaatagatacaattgccttcttcggactcaatccatgcttggcaatatttgtggaacatttaaatcaatcccgacaatgattctaagatcactttgccaaaattggctacatcggcttctccctatccgattcggtattagccggtgcaaacgatccgatgcgtactctgtttccgagaataacgaactccttccaaatccgcttcggttttgactccaaatccaatctatgatatattaaatttggtcgttaacacatcgttagtactctattatgataattattttgagacaaatttaaatcctaaaaatacaattgttatgggacatatgtagtacttagttagtacttacaagtactgatggcataaagctttaaccatcatatttgtaataaatgatcatagccttcaatgaattaatgtttgtcttgtgattttttttccttttatatcaatataaaaccttacactctcttatattattcatttcaaataaccaaattgttcaaattgattgtatggaccagcaaatgatttacaagttgttatagttattttcaccacactattagaaaacattttttttttacaaacgggccaaaatgatttttccagatggccatccaccccgcctgcacttcaagacctatgaaaatacatgatttttgcaagcggacattggctgattttgataggcggtatctccatcttcacaagcgttgtagccacctgcctgcgaaaatgttctcggcgaacaaaaaaaaaacgccaccgtcccatccttcgccgccccaccccctcctcctcccccaacccggccggaagatagattttcgtaggcagacggccatcttgcccccttcccatcttgcatgcggaatagtggtggtaaaattttcgtcctcctgtaggtatctcgtctgaaaaaatggtttttccaggagtgccaactaggccgtttgtgtaatagtatgtagatgcaatagtttgaatagatggtaatatatacagacatcggaagagatcgatgatgcagagggtagcaagcggccgagaagttatgacgtcgtcgtcgtcgttctgctgtttagcagcctcgctactgatgctgttgctaccgttctttgccatggcagcagcagctgcaggcgggagcagcagcagcagcagctgcaggcgggatcagcatcgagtacccgttctgcgtggagcctggctgctaccacccaggcttcaacctcacctgcaaccactcctacagcccgcccaggctattcctcggcgacggcacggtgcaggtgctcgagatcgccatcccccaagccaccgtgcgcatcaacagcggccgcatggtgttcaattctactggcaatcatgccgtcaacagatcattattggatcaggtgggaaggccgtacttcgtggcagcttcaaacaggatagctttgctaagctgcaacgcccgggttgacgtccgcgcggctgggagaaacaacaacaaaactagtactaagttgctcagttcctgcactgccatctgcccaacagacgatggaggtggtgctaccactatcctcgatattggtccagagggtccatgctcagggattggctgctgtgaaacaagcatgctactagcaggaagctcgactgctgcctacagcatccaggtccagaacttgcaggagcaggccgtcgtgctaaatcgaacggatgatctggtgtacttggtagatgagagatttaactataccttggacatgtctttcggctacagcagtcctgaagagctcccagcacggctagactggtacataaatagttcatcagcgtgtccgttgcccgcgtccgcccccgaatgtcgcagcgcgcacagctattgcgacagtacttacgacaacaaggcgtacatctgccgctgctccgaaggttacgaaggaaatccctacgttcctgatggatgccatggtaattaattaatataagcccttgctgctttaatttcttcatgttcttcaacaatcaacttctaattaactgatactcctatatccgttcaaaatgaagaaaaaaaaacaactcctaactgatatatacgcccttgctgtttgctagatacggatgaatgcagttctggatactgcagttacggcgagtgcaggaacacaccaggatcgttcatttgcaactgccctcgtggctacgagggcaatccatcgccaaaagatggatgcaaaggtgaactaaaactagctagctagttggattgcccacaaatctgtacaaggatagatttatttcaaagttttgcctctactttccttttgatcaaacttacaatgagacatttggttatttagtttctctcaattcttgtccattgcgacacgaatctattgaatatttgtttctatatctttataaatggagtatactccctccatacttataaaggaagtcgtttaggacaatgtttaagttaaatcttgggaatataaatcatgaataactctcaagttgtttagtttgaaaatataaaaattatatgaatagatttgttttgaaaaatactttcataaaagtatacatatatcacttttcaataaatatttttatagaaaatagaagtcaaagttgtgttttggagaccgtgtcgctgtccaaaacgacttcctttacaagtacggaagaagtatctaatagccagtatcacattacacacacaaccaagtgctattaatattaagggtaattttacaatccttgagaaagtaccaaaaggtatcgtattttttatataaaatttggtacttcaacatatggagtaccaaatttttttaataaatttaggtacctcaagatatattaactataaaatttctctatattaatatcactagagatgctaaatcattactctggttgtgtaaacctctatttctccatcctctcctcgtaacactagctctatattgaaataatcaaaaaaataaatctatccgctatttatcaatgcttctttctgacaaactttttgtacctaaagttttcacttttcaatactatagacaattgccttcatctttgtagtcatttactttggtggatagtatgatatgttatcattttttctccatttgaccgccacataatcatttccattataatatattgattctaatttagaatttgtatcaaactaaattaaatatttatatttctattacaaagtccaattgtttgtgtttgatgttgactttttttattttttactttttgttatattccaaatcataacacctaaagattctactttgaaatttgcatgcaatccaattactatttttaataaaaatatcatttactctcatggattgtatttggcatggactcttatgttaatatgtttggtcttacttttatttctattccaaaatttagttatatagggattttactatataatttgtaatgaaatgaaatatagttgatttttttatttgtttttattacgaataatattattttcatgtcattttacagtattgatattttaaatatttttagtcctataaattctactagtatttataaaatgtattttttaaaatggtctcttcttaatatgtatttgccaaggacacttctttacatatttattaattaatatttttgtttcattgggagttttacctgtcctttaatttcacttagatattcttattgaattaaatgatgattttattttattcttttactctaaaagtggtattgtgttccacatacgttcttattttaatattctatattctatattgtaaattccaaatttcagaatttttatagtgtatctctatgcgaattcgttggtttagtgtagactattataatctgtacccatactacaatcaacggtgtatgatcttccttttctatgattagcgtagtaatttctaaacctccaaagcattactatgaaatggctcatttttcttctatctgaacaatataatct

SEQ ID NO: 68512 - DNA, 3475 bp, Oryza sativa
gcgtgcaataggtccgcctgcgaaaatagcttcttgcgctaaaagaaaaaggcagccaccgccgtttccggcggtagcttcccgttcccattccagttcccactcattccctatccaatcgagtgaatccaaattcaattcatccagttcatccaaaaatcaccgaataaattcatccagttcatccaaaatcaccgaatcaattctagcaaagaaagcaaataaaaacattcctaaaatcacggccgcggcccgccgtcatccacgccgctgccgcacggctgcgcctcgcccccctccgaccagatctgggagggaggggccgggagccgccgttgccccctcaatccccctcgccgccgtggccgggagccacgccgcctcgaccctcctcgctgttgccgccctctgccgccgccgtcgggaacacacgccgccaccgccgggagccgccgccgcctccggcctgcggtcggggagaggagaggggaggggagggccggaggggacaggaggggaggtgaggggaggggagaggccggtgaggaggtgtgagaggagaggggaggggagagaccggtggggaggggaggagaggtgtgagagttagaaaaaatgtagcgcccgcaagtctatttatattcaagtctattttcgcaggtggacagtaaattttacccgatttatatttttgtaggcagtcatttggctctaagggtcatgcccacctacgaaaataaaacccccacatcagggaaaaaatgctttttctaatagtgagatttgttatgttcagatttgttgtactagattgtatgaaatccaattctaagttaattccacttaaattcatgcaaaactttttcagtgaaataggcgcaaaaccagtctgttgtgcaatatggtttgtttacgtgccacgagaggaggtaggagagctacgtccaaggttaggccctgttcagtttgtgaaaaaaaaatttaggtattacatcggatgtttgaccggatgtcggaacgggtttttgacacgaatgaaaaaactaatttcataactcgcctggaaaccacgagacgaatcttttgagcctaattaatccgtcattagtacatgtgggttactgtagcacttatggctaatcagggactaattaggctcaaaagattcgtctcgagatttgtacaattagtttttatttttatctatatttaatacttaatgtatgtatctaaagattcgatgtgatgtttttgggaaaaaattttggataactagacggggcctatttacacgtaggtatatatataccattttttctcttcttcttttttctttttctttgaccaaaaccctatcaatgtaacgtccgtcgaatttgatcggtcgtccgaaaaaaatatggtttgtttacttttgatggtttgtgacgaagccaactttaattacctgcaaatctgggaaggcttcaattcatgatttcgtcgccagcatgcccatgccttgcaccgatcaggcataaacttgggacgttgccggcagggaaaatttcaggtacgtgtcattcagtacattaatgcactcgctttcctgtttgagaggcagttgcagccctgatttctcattttcctaaaaatctggttatgcatgcatcatctacctgttatataattgtagaaaaatataaatataaattttttaaagctcttttatcgtaatttatttttcaatatcggttttcaaaccgcttatttctagctgttatttattttttttccaagactaactaacgttccgtgctttgcaacgaatattacaagagatttaaggcaaaagcaaaacttataaacttatagcatagttagttaactagcatggtggtccgcgcaatctgcgcggatagcatcattatattttctctcgtataatagcatatatgttttctcaatgtgttattcaaatatattaaaatggcaacatattttaaattttgtactaattttacgaaactactaatttgtaatattcatattgtatttttatatacgtgttagttattaactttttaatatcaaattttagttatttttaaattatattcctatatgtactctagactcatcttttaatatttctttttttaattctgaattttctgtaaattatatttctatatagactctatgctcttctttcaatattatttatttttatttctgaatttttattatttctaattgtatttctatgtggactctaaacttatctttcaatatttttaaatttttaatttcgaatttcagttacttctaaattgtattcctatatttgtattcctatattgaccttaaactcttcttcccatgtttatcttaatttcgaattttagttatttgtaaattgtatttttacacggactctaaactctactttttaattttattatgtttattccaaattttagttagttttaaattcctatatggactctatactctacttctaatattccttactttttaattcctaatttctattttttttcttaattgtatttctatatggactctatacttacttctaatattccttatttttaattccaaatttctattatttcctaattgtatttctatatggactctagtctcctcttctaatattccttattttttattccgaatttcagttatttcctaattgtatttctatatggactctggtctcctcttccaatattccttattttttaatttcgaatttcagttatttcctaactgtatttctatatggactctagtctcctcttcttatattccttaatttttaattctgaattccagttatttcctaattgtatttctatatggactctagtctcctcttctaatatttcttatttttttaattccgaatttcagctatttctaaattgtatttctatatggactctgccttttctttttctccgattaatgtgagaatttctaagccatgagagcgaacgtggaggctcccttttctattactttaataatataatagattaggcatataatacatccaaagaaaaacattaatgtgtgcatgagtacttcatgactttggatgcaaacccagacatcaccactaacatcgtcatttaaagtagtgtgtgtgtctatatatatatatatatatatcatacaccgtttaattattattctatgataaaatttaaactacagacttaaatttatttagaaaatgatggagtacatctctgtacattaacctctgctttctgcgacacgccgacacctcctgtctataaatacccaaaccaacagccaaattaagcagcagccagcagccaactgcatcgatatcgatcgatcactcgaccgaccatctcacaagcaaagcaaaagctcgtggcaacaatggcgaagtgggcggcgatcatggcggtgctgctgctggcggcggcgtgggcgc

SEQ ID NO: 68513 - DNA, 3177 bp, Oryza sativa
accgcgtacactcacccatataaagacacaagcacgccctaacgttaggaacacatccaaactatttgaccggcatatctttaaattgacgatgtcaatacgaatgtttcactgtcgactggtatattatttatacaattttttttagtttcatttgaatctggtgtagccggtcttcctccgccgcctgccagcgttcaaagcgaaaacgatgccaaaatcatcatttgttaacagtgcaaccagcacatcatcgccactagggatgaaaacggagcggatagtttccgtccgctccggacaaaaacggatacggatacctttcggatcggataattctcggatatttcggatacagatacgaatacggatattttctcccggatacgaatacgaatatggtatcagagtttccgtcgaatacggataataattcagatatccggtgaatagtgctattcggatatccgcaggacccatgagacataccccatttctttctaactctataaccttcaatgtacctttatagattttaataatagtttatctcttaacactagtccatactattaatattatttaaatttaaaaaaatatttataaattatacctcattttatataaaatgagctaattatatatgttgaaatttatttctattagaagttgagttggttttcgtgttccgagaaaaatttgtttccgtattcgtgtccgatcatattcgattcttattcgtattcgagataatccgtatttgtttccgtattcgagctatccgtattcgttttcgtatccggtaaaaaatatgaaaacgaatatggtataagcattatccgtccatatccgctccgttttcatccctaatcgccaccactactcgctcgtcacctttcgtggattaccactaaaaaaacgagagtgccacacgcccgcacgtaacccccggctgctactagtacaagcacgacacagccatatgggcatagcatagcatccagtgcttttcttatcgctacatcagcccactaacaacatgggatcagtaatactcctctgttagtgttacagtaggattctatgctttaatcatgccgtcaacatccgtcggtgcaaaaggtttgcaggtacggaactcttatagaaaaaggaaaatgaaacgagtgaggtacgaaatgctttaattagtacatgattaattaagttttaattagagtaaagtccatcaccggtccctaaactggtaccgctgtgtcatcccggtcactaaactcacaaatcgaccgttcagatccttaaacttgttcgactgtgtcatccaggtccctaaacttgcagatcactcgtttaggtcctccaacttgttcagttgtgtcaccccggtccctaagcaggacggtctaaaagctttatatcaaaaataattcataacttttttatgtaaactctaatgaagacaaactttatattaaaattatagccctcgacgcgacctacaactttgtagttgataagtttttgaattaaaactgtttagggtcccaaaatattgttgcatttttatagattttgaaattttaattttaaaattacattttgggacaaaaaaatgacttaaaataaaaaaaatcaactataaagttgtagatctcgttgagggctacaagtttgatataaagtttgtctttattagagttcacataaaaaagttatgaattatttttaaatacaaagtctttagactgtcctatttgacccagatgatattcaaatctaagtttagggaccgaggtgacacaactgaacaagttggagaatctaaacgagtgatctgcaattttagtgaccgggatgacacagttgaacaagtttgagaaccggaacgatcgatttgtgagtttagggaccgcgatgacacagtggtacaagtttaaggaccggtgatggtctttactcttttaattattataaattttaaaaagtaatttatctgatattttaaagtgatttctatataaaatgcttttatggaatacacacgttagcagtttgaaaaacgtacgataacacacgaagtgagcacaacagggtttaatgctatatatgatttgactttgttttgctactgttttgtttgttttgtttcgatttataatctaaattggcagagtttgtatcaatcgtaaaaattgtctttgtaacgcaatacgtatttttgccagttaacgcaatacgtatttttgctagtttaataaataaagaaagaggcctaattaacaaaggacgataggtgtacgagcatagcatcaggtcccgttcgaagccaaccgaagtttgtttggtgtttatatgggggttcacatgagggggggtgcagatctgtgtggttcacaacgagatggccagcttagatccacgaggagaagatggccaactgtcggttactagctcggttgacggtgcggctcaatttctttcaacattttccatttcttgttgaggagagaaaggtacaaacctgaaaaaaaagttattcccatccatgaaaatccctgaaaaagtcaaggagcatatgacacaaaaaaagtttattgcactcactataattatttatcttattatttttttggaatatcatttttggatagaacgatttttatgttttccctaacaaatttatttggtgtttttaaaatttcacatcatctaccacccttcttgaatttcctggatcctttggggctgtaattttcagatataccaaatgttttgacctagcaacgacaagatacagtggaggagcaaaaaaacaaagtagctgtgcaaagcatgcacaaagaacacacaatagaaaggtcttttttgggtggcagaaaaacggttaaggtttcaacagttgaaagtaaaaaaaaaaaaagaaaacacacacacaacgcggaatgtgaaaggtatgggcattctctagaaggaaggagcgttcaacgtgtttgtcagttgacaccgtctcaatatgcgggctttattcccaggggtcccagctgtcatccagcaaggggccgtttagttcccaaaaagtttttccaaaaaacattacatcgaatatttggacacatgtatgagtattaaatataaataaaaagaaaaactaattgcacagttacgggggaaatagcg

SEQ ID NO: 68514 - DNA, 8947 bp, Oryza sativa
gggggggagagagaaatgggaaagaacacatcacatgcagcaggagcagctaggctttcagctcacctgtgtgggaaaattgtctctgtttcctcgcaccgatcgatcaacacctgctcgatcgctctcctcgatcagcttttgcttgccttgccaaaaaaaattgtctctgctacctcttgttgcactctaactagctgctgttgccgatcaagaagctggctatctgaatgcgtttgtttatgtaagtagggagcagctgcgaactaactctatatatctagtacaccttctgcatggacatggttgctccagaggaggaaaaggatgagcagattatgataggaggaagaagaagaaagttgctgcctgccttgcaccactgcaattatatggagagcacttcactgtactcctaaggcagagagatggcgcaattccggagtgctatataggtggaggtaaatggaagaacggaaggagggggatggagaaaaaaggatgcgtgcgtgggtcggtggaattcaattctagagctataagaggaggtgtatgtagtactactagtatatgtatatactgggggaggagttaagctgcaggcagagctcaaaaaaaatttcaaaaataataaaaatggaggattaaatatgggtgtgagaacgtgagggaaggtaagaaaccagcacagctttcaggctttcagctgggacttgagaggagacgaaaccaaaaaaaaaaaaaaaaagtggtatctgcttgctgggctatggctcctgggttttgaacgttggaggctagctaagctatggcggagtggagatccactcccactcctcgttcccttttacactggtgctcgcacacgacctgcacggcacacgcggatgggaggaagaaaaaaggagacgatgcgtcgagctggaacggcacgaaagagacgaccagagagaggcgcccttctacagctaagcttccgtccgtcagtcactcactgcctcgtgaggacccagcaacaactagtactactactgctgctactatgcatgccatttactgggtctgggacgactacttctcccacgattattacgattacggtcacgattagcagtgtggtaaatgggttgtttaaccatccatgacgtaaaaaaaatcaaaatcaaatcagcgtggtaattaggatcgttgagcaaccacaattgcttgctggtagtaagtgctacagtacagggagatggggacggtaggtgagccttcctccctcactgctagctgtcctcgcccctgtcgtgacgttgaagtttcctccctctttctctctcctcacatccctctttttttcccctctcccagttaaccaaaaaaacccagaaaatacaaaatgctaaaatcaccagctcagattttttttctctccctcctgtatgtacacatggcgctgggttatcacacatggatgggcatgagatgccagctgctgtcacgacggtcacgactttcctcccccttgcctccgccgctcgctccttcacactgtttaaccgacagccaccgctcccgggcatcggtcgtcggatcctctgcggccactggtaaaatcctcgcacgccagaccggtcgtctcgtcgcagctactagcgtccagccgtgtcgcggttagcgcgcgcctccacggaagcatcccgcggtcgccgccgcaccgcggccgcgcattgaccgcgcggaggccgcgtcgtcttgcttcgcttgcagctgggtgagaacggtcagaaacaattggaatcggtagcatctcttataaaacaatattagattaatcggtaattaattatatttattatttaaattactcagtgtcaatagatacagcaaaaaaattagaaaaaaaaatttaaaaatagccaaaacgataccattttggaaacggcgctccgtccatcagttgatcggcagccgtatggacgcggactcgcgagccgcgcggcgcagggtgcgtagccgcatgcgacttggagaccgcgacggcgatgtgggggggcaagttgggcaacgagacagacgctgcggaattgcctcttgattgagaaggacgcgaacccgattcaaaaattttctttctcggtccaaaggactcgtggggttgtaaattcaaaacttatctaactcgatcgtcgattgcatatccgttcggttttgttttttttctatgtgcctacttgttggcgttctagggtcagcgtacgtatgctctctcgcctaacacttttttgagtgttctggtatattgcccaacccatggaggatatgtgcgcacgaacgacagtgcagttaatccactgtctctgtcaaattaatcccttcggtcgatagatatttaccgaacttaattactgccgtgcccatgttacgacttactaggatatatacatgacgtatacgcacatatataggacgtaatagtagtagtagttgatcctttgatccctgatgcattactactagattaatcttatcctgccaatcgatcgatctgcatgcatgcatgcagctggtgttggtggtagcaaagcacacctgcacatgaacgatcgcatctggatcgagcagcagtagtggccaggtcgggtcactcactcactcactcgacctacctacttctctctactactacctcctgcgtgtgtgcacacacacagccacgaatacaaacgaacgaacttggtttcgttcgtgcatgcaggtggatgggatgccatcggggactactactacacccgtctaaaattaggatatctttttgagtttttacttataacatttgactattcttcttatttaaaatattagtgtaaattaaaaaatcatatttaaagtacttttggtaataaattaagtcgcaaatttaaaaataataattctatatattttttaatatgatgaatggttgaacgttaaaaattttttaaaacgataagtatattgaaacagagaagtactgatcacacaaatcaacaacaagagttgtcctgcacaggcagcacagcatgcaagcacagctgcgccacatgtgacttaacgaccatcgtggttggggttgggaaaaaaatcgcacggaaaaaatggcgattaattgctggaaacgggagaacggagaagaggggggtgcgtggtgatggaaaaggggagcaacggaaagggaaggaagagtaaagtgaccgcacaaccgatggttgttcgggcctcactgcccccagcaaatcatatgacgggtcccactccactacgctactgatcaacctcttttcttttcttttttttctcatatcatcttctttctttgcataactaacttgggttgcactccttgcatccattccttgagctttactactccccaactcactctcactctctaccccgatcacacctaaacccattggccacgccagcaccaaagcctgttccacgtgtacgacagtcggattcgtaatgcttggcttcatctttttagtgtaaaactcgatacggtatcagagtcaatttgacgaaaacgtaaacccactttcaatcaggtgaacataagtccatatcgtcaatgaatgtttaaacttttcatatatatatatagggatctggaggatgaagcatgcatcattttattttataaaaaaaatatttaaagcgtacaacttgatgggaaggaattgaaaaggtattaaccattttgcggtgacataattcatatgtgtgtgtttttttcagtggttgttgcggttgccactgccgttttcgcgaggcataattcgagcctaatgatgccgactttttcctcgatcgcgcgctgcggacgcagcagaaagaaattcgtgcgcggcatgtctttgcttgtttgccaccgacggggccgagcgacctctgccagacaaatgggtggcatattatactagcaaaggaggtcgacactgaagagttgatcgagtgagttaacatcactcgtcaccaacccgtatatatacgttgtcaaatcaatcggccgggcaactcaaattttatgtcaatctttgttaacatatttttaaaattattaaacggtgtgtttgattaaaaaaattatataaaaattgttttaaaatactaaataaattcatcgttcaagtttgcagtaactaaaacttaattaatcttaaccgtgcagttgtatggttttcgggtctggtttttcttctaaagtggaccgattctcttcttctaaatataaaagtggaacaaagttccgccagtggtttaaaaaaacttaattaatcatacgttaatatatttttaattttaggattgctaatttgatctttatctttattagaaaaagaacaccgttgaagagtggcatactagcaaggagagttcgagactgaacagttgagtgagttaacgtcactcgtcaccaacaccaacccgtatacgtcgtcaaatcaattggccgagctattcgatcagtggctgtgctgctctctcagctcgatcagatcagttcgcttgatggccgtggctaactaggtacggcttcaatttgttggtgtcggatcactcactcacttgatatgatccaactgccgcctctgatctctctcttgcatctccagcaagcaacaattgctgtagcatttctggcctcattttcttccttcctattcttctgttgaacatataattgcacgattgttgtatactcccttcatttcaaaatatttcacaccgttgactttttagtatgtgtttgaccattcgtcttattcaacaaatttaagtaattatttattctttttatatcatttgattcattgttaaatatacttttatgtacacatatagttttacatatttcacaaatttttttttgaataagacgaatggttaaatatgtgctaaaaagttaacggtgtcaaatattttgaaacggagggagtacatcgaatggaaaaagtagtatactgataatgttggattcagtactacactgttggtggcagtagtagtaccagtgccacgacgactgtacacacatgcatgctgtctcagctcggtggcttggcttagctccaacacctgcgttccgggcagacaaggattaattatggtttgttgcaaggcgagacagccagccatccatccatccatccctacggagaagaggaccatcggatcgagtactcatcttcatctagtgcgtgacatatatcacgagtcgtcgtttaaccactcgtttggtggttagttagctgtgcgtattagcagcgatcgaacaaacacatgtagtactactggttccagtaccgtttacattgatcggtcccaaaataagcttatgtgtgggtttctatgcttaacgtttgatcatctattttatttaaaaatttatagaatgttaaaaaaacaagtcatgtataacgaattattcatattttatctaataataataaaaatagtaaattatattattttttttaaaaaataagtctaatggttaaacgttgaacataaaaatttacaaatgaactcgttttggtatggagggtgtacaatttctcatgggcaccttgtcttcttttgccattgagaactcacagagaatcagacatgtatttgttactgctactagtagttggccaggtagattggcattagcaggagcagcaacaacatgatgctgcttgttgcttgttgcaagtagagagtagagtacagtaataatcagtgagaagaagcgacaagaagcacccgatctctgacaattatgggatattcaagtcccctgcatcgatccctagggggagcggattatgattgctgcatgctcaacatgcccctttgtgctgtcagacaaataaagttactcctactacgatcagttccaatagtaggctattaggcagctgtaaacatattttaatgagataaacaatgagagagaaaagcagcgggctatagatctgtagtcagctatagcacggactccaagacacattgtgtgtatgataggtgggaccatatattaatagtataataagcaattattgtatgaattgactattaaattatctattgatgaattagagctaggagtagactgtactattatacttgctctactagtactactgcaggcagggcaccaatcattcaaatgctgccagtaattaaactggcactatctagtttatctctgccgtagaatcacttggtttttaatcaaccgtgaccgatgctgacggcccactggaattcagattctcccttctccctccttgcaagtaaaagcttgcattctggtagaaatggctagctactgattaattaatgaattgaagtgaaatccaccggtcgatcgatcgagccatgtgtcaatgtaccaaaagggtcgatccatccaaccaccggccggttaagaccaagatgagagtttatctggatgatccgggagtaacatgggattatatcagctagtaacatgtacattagttgctagtatcatggcctgctcttacttactgtagccttgtgactaatgagcaagacaacaagtagtgataacaattcatcaggattagtgagataattaattcactagtatgcctgagtatccttgtgataattaactcacttgatcgcctgttagtgagataagcgacaggctaactgcttggaatttcctctggtttcactgcacaggttaattaatcaacaagattgtagattagtactattaggtggatcatcaaacgtaaggaagattcagacaaagcatgcacgcacatggccggagttaacagacaaaccagcccaaattcatggttggatcacccccaattgcgcaatttgataatgaactgacataaacaaatcgagggcataattttttttaaaaaaataaagggagctgatggagcaaaccccagtggcgcgagaggtaacaatactggagtagtagtggtactaatcagtttgacactgatgcatgaatggatggctcctgattaattaaattaaacaatttattaataggatggtagaattagagctagaaatttaagtaagttattcagaggagaattattatagccgcgagatgagatgagatgagctagcatgtggcttgcaagctcgatcaccctggcgtcgtgttggttggttgcccggtcgctggtttctgctagctgcttcacctgctatctctccgcgtgtgcatggatgcatgtattctacgagtactagcttagttatgtatttttttaataatagaatataatatcggtttttgctcaaagagttacagccagttctccataggttcctaaatacaaacatttatagattatttagcaaagattaaaaagacaagatctccctttagccatctctcattagttaaaatttgaattttgaattggttagatttgtcttgtaagcatctgattaacttcagatgcttggttttttgtgtgttgaaatcagttccttagaaatgtttatgttgtgtattacaaaatttaatttatagaaatgcttatatttttgtaacgctggaagtattagctagctgatgcgttcttggatcaccaccgtgtccatattgctgtgcctggtcagcgcatgcacgtacaacattgatcatacagtccaaattcagattaaggtgttaatcatgtcatgtgcttgccctctattatgcactaccaacacacagtcctcgtcgtagcggtagtgccactactacaactaccagttgtacattctagtatagtatagtactatacctcattctagtatagtatagtagtgtatgctaattgttgctttgaccggagctggattggagattcgtcgcctttactaactgacgcatgggtaaaaaatgcagaggtaaataaaacaggggttttactagcttgactctgtaattatcttggagagttgagaaaaggactggttcctctgcattgccttcccagttgtactctgtcaaaatgttgttatttttcttcatcaacttgtctcgtgccaaatgttgaagtggtaatacgcgcgccgtagcttcctagctagtgaggtaaccaactctgcgtgaattcctgatctgttctaaaataaaagaaatctggtttaaaaaataaataaaataaatcgtgatcgatgcaggcacgtcatgtggatcgtgctttgtcaaacctaactgcatagtattttagaagtagtatatgcttcattcgttttttgtacgatttaatttgactgaacaaactaaaatatatcgagatgggccgttaatgcaaggagaaaagaaaatccctgtgtcctaaaataagttttatacgtgaccgttcttcttatttaaatttttttatgattaataattttattgttattaaacgacaaaacataaataatactttatacgtgactatttttttttataaattttttaaataaaacatacggtcaaatgttagacacagaaatccacggctacactaattttgtaacggatgcagtacaaagagagttaatatgttggatcaaatccggccgttgattttgtgggtgatggatggagcaggcaaggcagctgacccgggaactgtttcccaaaccggatgcgacgaccaatgcccttgcccttgtaggacagagagaatgaaatggaagatgtggctggtctacttctctactacagatgtatttattactaacaagcatagtggcccgcgcagattgcgcggctagcatcattatattttctctcatataatagcatatatgttttctcattatattattcaaatatattaaaatgacaacataattttaaatttacaataactttacaaaactactaatgtgtaatatttatattatattttatatacgtgttagttattaattattttta

SEQ ID NO: 68515 - DNA, 25957 bp, Oryza sativa
tttgtcttcattagagttcacatgaaaaagttatgaattattttttgatataaagtttttaggccgtcctgtttagggaccagggtgacacaactaaacaagttggaggacctaaacgagtgatctgcaagtttagggaccgggatgacacagtcgaacaagtttgaggacctgaacggtcgatttgcgagtttagggaccgggatgatacagcggtacaagtttagggaccggtgatggactttactcattttctcaggttgtatactttttactcttggcatacatgtgtcaatagcttatgctttactcaaacaaaatcgtgaggatttttactgattaattgaataatataccacacttacaagcacaatagtgctatcgataagataaacatacaaattatgtttcagcgaacaaaagggtgcacaacagatcatataggtggtgacaacaaattattccaggtgagcgcaaagtagaataacctatcttactcacccattaaatcaattatttctccttattttctgtagttcattgtacaggaattaaaaaccaaggttgccagtaaagtggccaaatccatagcacaagaataactagtaagtggcaacatataggtataggaacgaaattgttggtatacatacattattgcaagatcagaattacgaagtatggtgcagttaaatccaattctgcagactaatggacaccagtgtttactattccgtaaaagaccgcaatttcgggaattccagaaaatattggtacgaaagtatctaaaatttaaacaagttttgactgaatttgaataaattttggccaaattcacaacggattgaaaaaatccagccgaaattctccaaatttcaatccctgatggacactaagttgtaaagacagaaaatccaaaatataagacctctttgaattaatgaaataaatccatagccagaattgtaaacagtttctataacttgacaagaaatgtttaatgaccagtataaatgttgggagcaaggttcaggaatttctaaatgcaggaactatatctgtttgctgtatataaaaattatccaagagcaaagaaaaggacgtgcaccttgcaatttcaccaccgttatcacataaagcacaaaccaaatcaacattagcagaactctcgccttcagcgttatcagtcatatcttcgagtttacaattgcaaattcttgcttcactcttatgccttttataaaacctgtttaagcatccaaacagtatattatttagcactgtaattgaaatttacaattatttctctttccgtagcatattctataacatatgttttgctttagtcaaattattctggctgaaacaataccaataaatcaaaagtaatgctgtatgatgagaccctcattaaagtaattaactacagaatgaaactaaatgttctacattgtttgttatagaaacaggattctttttttctcatagcaaagttaacaactgccaaaaatgaagtgcatttcatccaaataagcactataaacagtacaagtggcaacatgtaagtatatcttaaattaataggctgtagctatgcctgtcaaagttaaaactacaagtatgcagaatacaagaagttcccacttggctgcaaacaggagtataaatttaaagcagagaccagttgaccactccattggttatacagacaggctcaaggcattagcagttcattgtaggatgaaatgatccaaacaatcattttctttccaaagaaatagcaaatagaaagcaacaaccttacacccatggaccccacctagtaagtacgaagaaaagctcatctagttcctccggagcgcaatatccatgaagaatatgaacaaggtaacctgccttctccaccagagcgcaatatccatgaagaatatgaacaaggtaacctgccctctccaccagagcgcaatatccatgaagaatatgaacaaggtaatctgccttctcctatcagcctctagtttctttcctttgtttttttagtgcagcctctagtttcttactatttgtcatgcaaaaattatggcatggcataaacattccatcggaaagctacagactcggtttacagatgaacttgaaacagcacatctgcaaatggacgaaccaaaatccacccgacacatcccaaaattgagggaaactaccaaactgcaggatcaggatccaaaccgcttcaaatggaaaaatatattatacttgcttttttacgccatcgaccaggaaaaaaaaaaagaaacaccgtgcatgatgtctaacagggagaaccgctcgccgaagcaatcaggcatgccacaccacatggccacatttgtgcacagaaagtggatatgcgattattaagagtctacgacatccttatttccctcagctcatctaaactgaaaaatgcaggccagtgaagtcgggagtcgaacacgagccgcggaagccggaagtggagaaacgcgtcaatggcggaagccgcggagccacaaaacatttcggtgccagtgcgcctccgccgacgcgtcgcccacctcaccgctgctccaccgccggctgattccgagcgctcctctccggtgaggaggagacgaaccgtgaaaccaaccacggaggaagccaagagatcatccgacgaagctgtgcctcctcacctcaatcgatcagaaccttcctcaaccacacccagaaaaatctcctccccgaaaaaccgcaagcattccgcccaaaaatccctcccaaaaaaccggagccaaccgatcacccccaaaattcgccacgaacaacacggaaacgatcatcgagcacgcatacctcacgattcgagcagctcgcagcaggaaaccatcgggatgcgctcgctagggtttcgatcgccgcggagagacgaatccgaatcccctcctcctgcacaaaacccacaagccaaaaacccaaccacctctctctctctctctctctctctctctctcgcacagagatgaactgaacaccacgcacgctttgaacgaagtgggagagagagagaggagagagggtcacgtccaattcatgctcgcctctctctcctcctcacttaccgacccgcccacccaccacctcactgacagatgggccccacacccgtggggcccgggtggtcatgggctaagcgtagcctccatcgacgtggggaggagtcgcgggatcctccggtggggccgacctgtcagtgagggtggaacggctccggatgcatgggggtagggccgggcgacgtaggccgtaggataggccagccttccgggggcgtagagctcgcgtgggccgtcggatcgggatgggctctgacacgtgaggcggggaggctgcgttgcgggcaggtggccgtgccggtgaaaggaacggacggtggggattgggttggacgtgtttcgtggacggcgcggatggagccgtggaggaaggtgcagcgtcgggattctttttactgtgtgacccccttttttgtcccgtggaaacgaggccgagctgaagcttttttttttttactgctcccttttgcccctttctctctcgcagtaaggggctgtttggcaggactcctctccaagaaaatagctccatctccaagtttttttttgccaaacacgagtagtggagtagctccggctcttgaatcgcagctccatctccaggaatattctggagctcctcaaggggtactccaccaaaacctggagtcatatgtcctcatggagatggtaaaaaattacccaccattgccattggttacaaaaaaaacgattcgcttctattccacagtaccgtcccgttcccgttcctcattcgtgaaaaaaatgtttccaccagagcgccgcccgagtctgcaggcaaatcgccaccgccgccaaccctagagccgccgccaccgagatggccggatccgcctctgtccaagatggatccggcctagaggaggaagtcccggccgccgagatgaccatgggcgccggactggagcatggctatgggcgcggcttccctcctcccgcaaccggccaggggcgcggctgcccgcctcctgctgccggccagtggcgcggccaggggcgcggctgcccgcctcccgctgccggagccgccctgcacccgcctcccgctgccggagcagccctggggcacggctgcccgcctcccgctgttggagccgtcctggggcacggcagccctgccgccggagccgccgtggggcgcggctgctcacccgccggcgccgcactggggcgcgggtcccagccgaccggcgctgcccagtagcaagctcgtcccccgcgtactggatgatagaagagcttttccccatttcaaaggttgtattggtgctcttgatgaaactcatatccgtgtgtcattgtcacctgatgagcaaattagatatattggaaaaactggaattcccactcaaaatgtgcttgccgtttgtgactttgacatgcgttttacttatgttgcaacgggtcaaccgggagctatgcatgacacaagtgttttatacaatgcattaagagtggatgaaaaattcttccctcatcctccacaaggtaccacacttgtattatgctctctatttgtgctaactgtgcatgtgttactaaaatgtatcaataatcatactatgctatcttttgtaggcaaatactatgttgttgacgcaggatatcctaatcgtcctggttatcttgctccatacaagggtgagagataccatttactagagtggcacagaggtatggaacccaatactccaatggaaaaattcaatcgtgtgcactcttccatccgcaatgttattgagcgatcatttggattactaaaaatgaagtggcaaattctgtacaagatgccgtgctaccccatgtacaagcaaaaaatgattgttgaggctgctatggtccttcataattacattcgtgagcatggaggtgaggatcctgattttgctaggtttgatcgtgaccctaattttattccaacaataccagaacggtacaacaaatacgcagttcctcgaacggcatctgatgagtcaactcccgaaagaagtacaggaactatggatctcttccgtgatgaactagccaccgctttatcaatttcttggcgctagatttgtaagacataagatgataatgtatctttgttggacttcaattatgaacctttgattaaaatgtggtaccttgtgcggattttgctatgtgcggattttgctcccaactcgtttctcaattgtggcagatttgcatgtgttccattaagatgtaaaataaatattacgataaaaaaattagctactcggaggtgcaattccctagtacagtagcagcattgccatgcgtgttgctttgcactctgactgtgcgctctccggtctactgtgtagctcgatcgtggccgttttggcgttttgctgcaacattacctctcgcagcaggattgaaataggtgcttgcatcgtcttgaaaaaagtctattttataattttttttttattttttattataaaaaaattagctattcgagctaattttgtaccgttcttaaaatagctacttgcatcgtcttgcaacaagtctattttgtaatatattttattttttattattgttatggctgtgagaaatattaaacatcactatatattagtaatcaacatccatacaagatccatgggcaaaacagtcctttcactcatcctcctaccaaatctggagctggaccatatgtattattacccaaacaggtgctagctccaggagctccacggtggagaagatttcctggagaggagctcatttttttgtagaggagctctcccaaacagcccctaaataactccgtcggcttccgcttgacagaaagagccaagcattttattcttcgcactcgcagtacacaatggcatattaactgaattgcaaaatatattcatttggagaataaactgttgcatttggcatgttgggaatgaacttaacaagcagaccaaattaacactaatgagtctgtcagaacatattttctaccacatctgtaaattggcacgacttacagatatcacagtttaaaactcaaatttcaaacatgctgccagaatgaaacaacattactataaatatgagcttatttgccctaacatttctcctctttactccctggatctagtattcctgtttaaaaaatacaatcaatagcaatcatatttctaagttctataacataaccattaattcatgccaatcgatctaaaattgcccctaatagaggaacaggaaggaattcatgatctcaaccaaaaacttgccattgaggatgaaaatgaactcatcgctgcccacatcttctgtatcttagacaaaatccactccttgagcagggtactcgttagtctggctccaccaagtgtcccgccgcttatcgtggcggcaagcctgcaacagcgtgcgacactgcttctcacagccccacactccaaccctgggctaagccatcgtacctcaacacgtgcatttgagccacatccctctaacgccgatatagccatctaacttgcaaggacaacaccctccaagcccgctgccaccctagaatcacttatttcgacggttgccatatggttccggagaggaaggttgaaaggaaggagatgatggatcccttcacgaggaagggtggcaggaggagcgtcgcgccgcatcagcttgggaaggggaggtggtgaggggtatagtgttcgggcaccgacaaaagggagggaagaggtatagagcaccgagaggcgttgccattggtggagaaaggcagagcgggctggagaagtcggtggcacggccactactaggagggaggaagcggatctcaagcgccgcaaccaccgctaggaaggaggaggaggctcttgaatggcacagccaccgctaggagggaggagtgaggaccggcatcggcatcgctggtgctgtggtgtatgatacacaataggataacaagtgagaggctgggattttttttcctcgtatatttttccttttcggataaggggtggtggggactctatatttctatatgtttctttccgcatactacacgtgattttctctatggttcttttttcagatggaaacgggtgactactgatttctgctgtaccattgtctcgggataatactgatctctgttgtaccattctcttgggataaccaaaatcccttataatattggacaaaccaaagggtcatttatcccctgtagttgtggacagagggagtacttacataagcattttaaatttgcaatgcactcttcgcctaatcggtgcgagtaataaccaaagttaaccaacttagcacgagaggtgacgtgtcatccgaccaaccgctttggcctctaccgctagtacttctcttaccactccattcatcactgtttcggcctttcgagcaaaggcccagcttggaaaattatggttagacaaataggccgctgaacaagaaaaatgttcactttaggtctctcttctaataattagttttaaaagataagggatgttttatatccggttttatgattaacgaacacaatttaaactcgatgcttagctgagggatctaaaataaactttatctgccaaacaaccaacggtttgctaattgatggctaatcttgtggtatctgggccgggccattggctgatccaacgttggcccactaatcacactgcgccggcctcagcctcgccgccgccggcggccaccgaagatatcagccatgctccggcggtgaactgataagtagccaggttttggctcaaagatgaaaatgtgttccttgtctgtagcgtttttaccccccctgagaatattcttgaatcgccaaacaattttcattaatattaattagcattcgcactgtcaaaacgtttcaaggggcctacgtttaaccacacaccaatagtttttttttcgcaaacgcgcaaaatagatattacacatcagtatattagaagaaaatagagttgttgttacacaatgcagccgaccagactggtcgttgccagttacaaggaaaggatttcgaacccaaaaaagagtaaaaactaaaagctgttgcttctatctagcgggagggggtggcggaggaggaggagcttcctaatctccaaataggtccccaatgaagcggatggaccccagaactatcgagaccgatgaaacggaagaatcaaaaaccctggtgaaacgaaagaatcgaaaaccctaacgttccgctctttccaaagctacagtaaaccatgaggattagagagtcgaaaccttacgaagatgcgcaggaagactagccctagccgtcggccacccgaccattagtttttgtttttgtttttactaagggaccgcgagtgtgcaccgtagttatatcatctcgatatataattaaccaactttaatagaaaatcatatatattatcttaaaacaaaacagttttcgtttttagccgccggtttgtttctacagatcatgagcatgcatatcactgccgatgcagtataaaatagggttaatttaatccatgccactacaaatgtggtaaataaaaaaatgccactactattcgtgttatcgactgggtgccactgaaaatttttaaaattaaaatcatgccactcccgtcattatttccgtcctcctctctcacgccgccaacctcaccgtggttgccgccgacgaggtcgcgcgccgaacgcccatgggacgagggggctccgtgtaggacgttgccccgacctcgcagccctttgcaccaccttccacaccccacaaccgcagcgaggaggatgggcttccggcgagcactaggttccacaccgacggcaccgcggatgatgggcttccgccgctgctcctcccaatccccgtctcctcctccagctccgtcgccgccaaccccaccgacgagggctgtcgccgctactgctcccctcgatccccatctcctcctttagctcaagcgccgccgccgctcctcccgatccctgtctcctcctccagctccggtcggcgagggccgccgctacttctcctcccgcgcctcgcgtgcaccatgccaccgccaccgctactcccgctcccgctgctacttccactgctgctgctggtgacggtgaggatgctgacgtgaggaaggaggatggtaaaagtggcgggagtggcatggatccaattttaaaaattttcagtggcacttagccaataacgcgaatagtagtggtatttttttatttgccatatttagagtggcatggatcaaattaaccctataaaataccttgtgcaattcgcaacatgcatcggataaacaagtaatcatcgactaatcatacaagcatatgacggaaatactcccataaaacttaatcctaacacaatgcccctactatgtccaaagaataaaattatccagcaaccaacaatccatgcaaaaaaaaaaaagaattagaaaagtttcttagcatcaacacaggagcagcaatccagctgaggcagatgcagcaagagccaagaagtagccggcaatgccggcgccgcggcgcgacgacggcggcgacgacgagctcttcttctcgtccgccttcgccttggcgctcgacgacttcccggggagcgggctggcggcgtcggaggccggcttggcgtccggcgccggcgccggcgacggcgccatgggcgggtcggtcctgaagatctgcatcgggaggagcaccctgtccacctcgtagacggcgacggggcgggtggagtagacgctgctgctgatcttggggttggaccacatcgacccgacatggacggtgcccatgtcgtcggtgacgttgaccgtgtactcgccgccggcgagcgtgggcaccgggctggccgcgccgcccagcctgttgaactcggcgagggagtagtacctcggcagcgcgtggtacagcgccagcgacttgagctggtcggaggtgaggttcgccgtcgccgacctcgccagcgacgcgaacgccgcgtccttggggacgaacaccgtgatcccgtccttgctgccgttcgcctggctctggaacgtcctgagcacgtccgtcttctccaggaggtcgaggaacgtgtggaacggacccgccacgctcaggaggtcggcgaggtccacgtggcgcggcgccgccggggacggcgccggcgacggcgggaggctcacggccgccgcggcgggcggacccttgtgcttctgcgcgaacgccggtgagatggaggagcagcagagcaggatggtcaccatcatggctgctttggattccatcatcctcgaagtccctgatgtcacgcaagaacagtgaagtgaagcattcagcactgaattttttttgtcatgcgtttctggagcacaagtctgtaactgctgaatagaattactcttaatcttgtgaattctacagtgtttactgaacacatttagtagagtacttaagttcaaatcaacatacaagagatctgtaatgttgttctgtattctgaaatgccagaaaaccaacttcttgtgcttcagattactacagttcgtggtaattctgaacattgagaattttaaccaggctcattattgttcagatctttctagctcctagagcagagttttcagattactgaaatttagcacaaattaatggccctttccctgtcaccaagagagacaaatgcacaagatggggcactttcaagactcgatctagtccgaattgacaactgcattatactactacttcaactgttaggtgccaccaaccaaatcaggagaccacataatctaacacaagaacaaaaacagtactcctactactacatcctgcagatctcagcaccactggaagcatccaaatctctggaatttgggagccaagaacagttaagtgctaagctttgcattagcatttcccttcaacctgaaggaacataaacgcagagcaccaagaagagacgccaagctcaagagaggcgcaaagatctgttctttcctcgggccaagaactgcgaggaacagatccaaatgcgccctaaacaaatggctgcctccaagacgaccaacccatgaaacatcatactggaactcatggaaaccaaaaaattaagagaagagattctgagcatggcattgcagctgaaacaatgctgaggagactgacctgagctgctgagctgagcagggaagtgaaggcagtgaaggaatggaggagagtaggaggggagttaaggaggagagtggctatataaaatgtggggaaagtaaaaagataatgaaatcatgggtggcagctgttgatgaggattgagtagaggacagagagggctcactactgttttcaggctttcatctggagaaaataaaaagatagtaaatccaaaagaagaacagctaaataaaagctggccagataggagctgcccctttctgtcctggctctctgttgtttgttttctgggggagtaggagtagattgcatttgcttctggtggatgattagtgatggcattagcatccataaactgctggtacttttcagtggcattgcaatgcttacaagtaaggaagtttcttgcttttccaaaaaaaaaaaactgaattgtttgcttctttgatcatcctttgctttagtgtaaataacaaaagcaggagagctggaatgtggtgatccaaaaagggtgatgttgtaaagatgaacaatgcttgcttaacttattgctttatcaagttataaagatgatcaatgcaacaaaccacccagtgactcagtgagttcatgtgatgtactgacaaaagcactaatgtgcctcttttggccttctttataaaatctagatagcaggattcctcaaacttcctcaccagctcttttgtttggtcatcgtgttgtcagccgcagctaaaatttatctaattttaaacttgattgttatgtttttattgtaatttatttataagtaaaatgcaccaacggtctttaaactttccaggaggtttcacttaggtctacgaacttgcaaagcgcacatcgaagtctctaaacttggtttattgtatcatccagtaccaaagccgcgtttgaccgtggtcttgcctacatggcatgccacatggacgatgacatgtaattttttttatttttttctcactcctgtgcaaccgagccgccgccctctcctctcctctgtgggcgcgcgtgccaccgccatcgcacgccatgggcgccaccgctaccgcggtttcgccgagccaccatgtcggaggtgagcacgcaggggcaccctcccctcgggcgcagccggcgacacctccccccgcgtgcaccaagctcgccgatgcctccccccgcgcccgccgccgccctcttcgccccacaactccggcgctggcccccacgtgtccgttgtcggcaacccctccccctgggcgcggtcggttcaagctcgccctgccgccatcgagctcgcgcccgccctgctcgtggcatcgccgtcctttttttctttccgccgcacaccgccgatctctggccactcgtcgccacgggggcggcaacgtgaccagctgcctcccaaggccgaccgcgaacgcctccttgccgaggaggtcctctacctccactccctctggttctgcgccgcccttgctcccgcatcgaccggcggaggcacgagagagaaaaaaaaggaagaagggagaaaaaaataaaattattccatgtcatcgtacacgtggcatgccatgtaggcaagaccacggtcaaacgcggctttggaccgggatgatacaataagccaagtttagagacctcgatgtgcgctttgcaagttcgtggacctaactgaaacctcctgacaagtttaagaactgttgatacattttactctttattttttatagtggcttttaaactactaaggacacatataaaagttttatacataaataattttttgatcgttaataagtgttatgacataatataatctgttgtaggcgaaacatgtgctgaacagcaaagcactactgaattcattctatttgtttagggaaaggaagagtgtgacaaacacaccatcggcaattttcctgaaacagaccggacaccaccattaaaaaaatcgagggtagaagaaacctgctgctttttcagagttattgtctggagaattttagttctgaatagaaccttcagtcttctgaaggatgctcaactgcacatgcttaatacagccatataagtaacagcttatgcattgctgtataccactagaagtcatacaagcaaaatgtagtataagattaacatgtcttatgtctcctctctttcttgccttctcttctccttttcctttttttctttttttttttctttccacacgattgacagtgcatgacagtctgaaactctaaacattcctgaatctaaattctgaagttctgaactactacctctaactctaattcgacaagctccatgtaattaagctctaaactggatgtgattacgtgaggtcgcagcagattgtgtcggtggaggaccagctgcctgccctgacggtggctcgtatccggtgtagttaagtatagtacttaatcagacaaaatttgcagagtcattagctgtttccggcggtaggtgaggaaggcttgatcatgaaaggggacttagcatgcatttcttgagctgtcatgctcagctgggctctcaattctcaagcttaaaccaagcattactcctataacttactttgcaatcgacataatcaaatggcttggaaatgaggatcacatggtgtacaaaagcagaattagtgagaatgtaaagcccagcatgccgaaattaagcacaagttttttcttcatggacacaatcacatgctgtatcattccacattgtactcctactcaactcttgttttgctttcccttcagtttgaagaaaccagagcggcatctgtgttactgcactttaagactgccattaatgacccacagcaactttcaatttctttaacctctctcttaatcttggagtaggagtactagtactagtgttccaggttttgatgctctcttggaccacttgaagagcagagaccttggtccttgttcttggcctcttggggcctttcagtatgcctcctctgcttttcaccaactaccacaagagtacaaggtttacttgatctgcaaaatgcacacttctttatcttcatctttggtgttcttttccagattaagttttttacgtgggtgatattaacgtatgattgattgagttttaattattataaacttgaaaaatagattaatatgatattttagagcaattttcatatataaagttttcgcacgaaacacatcgtttagcagtttgaaaagcgtgccataaaaatctcaatcttcatccaacttttgttggagaagagaataggattggttgaatctcctgaagatatagatgaaggtaaagattaagtgttttacgtaaaacgatgtggtaatagcgtgtgattaattgagttttaatattacaaacttaaaaatggattaatctaatattttagaacacctttcacatataaagttttcgcacaaaacataccgtttagtagtttgaaaagtgtgccacgaatatgcaaaactttatcttactggaaatgaacaggacagtcctatcaaaattatcggtttgtgtgctacgaaaattatcggttctcctatcaaaatcacacagtttcggatgcattgcaactctatcaaaacttccagcaaattgaacaaattgtgaagcactgactgctcctaccacttcaggcttgtcgtaatagttgtagctcccatccatgtgatgcctgaagagcattcaaatgcgggtttgagacgtcccaagcataattaccggttcaattatttggccgctaatgaactagtagctctgtcccaaaatattgctgcatactaattggactattggttcatattcagattcattatactgtgatgtgtcacatccaatactatgtaacaacattttaaatcaggttagtactatttctgattttttttctctctctgtgtttttgctctcttccaagccatgccaaatcggcaatcagcggcgtccgtttcgtttgttgatcgcaacgtagtagtactacaactctagtacgtgtgggtacgacgagctaatcctgtgttgcttttggtactggactggacgccgtcatactggattggatgcgccgtagatgaggtaatgtgttgttcctcacggaccaagcaagagcaaccaactgagcaagagtgtgttctagacttggattggcccatttattggacaaagtttgcctatgggcctacgtcaatctggcccatctggatcaaagcaaaacctccacaaattcaggatgcgtctgccattataaagtccaaaattgtggtactgatggaaacttagagcaaagtataggacgtatgtggtaacttcaattttaagataaaaataagggtacgtttaaaataaagttaagttataacttttcctgacactactatagaaaacctaatagatgttgggaatctcacatagatatcggactctccaaccggtaacacgaagacggtacgatgaggggactcatcgcagccggattgggaatcggcatctatggggagttcatgactaaaaaagcatcgggcccgactcgattcatcaagacgagttgattgcttcgaaccaagatcaatattcagaaattgagcctcaaaatcatcgcaaatccaactgcaatgaatcagaatcatcccaaacattacaaacccataccattcatacaaaacaaaataacaaatcaatacatggaagcctaattgtcgtagcccaccaaaggccaaggccaccgccgccgccgcatctcactggaggctgaggtcgttaccgccgcccaccatcatcactgctcaaaaatccaataggccatgaccaaatctagtgggtggtgggagagatccgggagggggattttgggggataggacgaggtgtatctgtcgttgttgctcgaccgcaattaccaccattagatcgggtcggggaactatcgttgtcgagctcaccgtatcgcttcgatctcactgacctcgagcttgtggcaattagatctagcaaccctgaccttgtggggacgcagggccaaggggagggcaccgtgttgtggataggttgccacaaccatcgtgatgagggtgccactgatgaggcgcattcgtggtgagaccatgagagtggcgttgcccgagaggagggtgccaccaccgtggagaggtctccatcgccttgaggatggcgccgccgccgaggcgccgttgtggggaaggtgcctgccgctgaggagagaatcacgcgttgctgatgactcggtagagaaaagcgaggagaagctgaggagaaaagagcgaagagctgagagagagtgtggagagaaaagcgaggagatgccaaaaccggaaatgaggtgggtgatagataagtcagggcgaacggaccatggcttagctcagcttggtgatttaatgtttcgggctttttttttaaaaaaaacccaacacatataatatgacaaccttatatatacaggtttttaatacgaaccggcacatatagatacttatatgtgctggttttaaattttagccttatgtgagatgtcggatagacgggaaaagcttcatatgtgtcggttttaaatgaaccgatacatataagggtgtccctattaggggttttgtagttgtgcgatctttctttcttttttttaataaggaacaagggcatcttttctttcagaatttcccgtaattatttggttaatgtatatattttcatttagaaaagaaatccaaccatatgggccgaatcaaatggcggaatgcacaagcaagcaaccatgtacatacgcacattacagctgacagcgtacagcatgctcaatcgcgaacccctggtggttttctttcggcctaacataaaacgcagcggcagcccatcgttctcgttgcctcgtcggccgaaagttccatgcttgtcgccgggggcaacccggcaaagccaccgcatttcgctcccacgcggtcacactgccaaatgcaccgtgccgaccttgacacctctgccccgcttttttttgattcccaaccgccgtccaccacctccaaactccaaagccctttgctctagctatttctttttgtaataatgaaatataatctaggtcgttactcaaatagttacgatcaattattacaccaattcaatcgaacacaaacatatcttaacaagttataaaaaatacactcattattcttgcataatgacactcaaaaataaataaattatccatattttcttattattttaaactctcgagttaagctgttatgtgtttataactcgacatgatatcagagttcaatgtctcgagttcaaatcctgattgttttttaataaaagttacaacctatttatattcactaaaacctcgacatgatatcaggcttaaggattctcgcgtgagaaagaatgttggaatataagtgaattgcatgtcttttcacatccgcttaaatttctattcatggtagaggttttagtgacccacgcgtgaacaaaggcagtgtttgtcaaatgggaaagggaaataatttcccacccatttttaaatcctaaccattcattctcccttttccatttaacccaaacccttcattcattttcctatcttaatcccacccctcatttcccattatctaaacacacccaaaagtgttagaaaccatgacacccccaactgacactaactccgtgtctccgcacatccttcattcgcccacaaatctcacgccaaaaaaaaaaaagaaaaagaaaaacacggcgaatcccgtgaaatcttcgcttcaattcgctcccaagcacacacgccccggcggcggcgcccgtagcatctctgatctctctcagcctttcaaaaaccatacgcgcgcacaaacgcgccatctctccatctcgccggcgtcgctataaaacgcggcgatcacgcttgcatctcactcacacaacaaaccacccccaagatcaagaacaacaacaacaacaacaacatttgtcaagatgagcgtggagatcgtggacgggagcacggtgcggagcttcgtggacgacgaggccgccttcaacgcgtcggtggacgggcgcttcgcggcgctggacgccgaccgcgacggcgtcctctcctacgccgacatgtccggggagctcatggcgctccgcgtgctggacacccacttcggcgtcgacgacggccacggcggcgccgacgacgggctctaccgcggcctcttcgcccgcttcgaccgcgacggcgacggcaaggtcggcctccacgagttccgcgccgagatgaaggaggtcatgctcgtcgtcgccaatggcctcggcttcctccccgtccagatggtcgtcgaggatggcagcttcctcaaggtggccgtcgacagggagctcgccaaggccgcctaattcaataacctagctagctaattaaccacattgaactagcccacgacgattaatttgagtactttgtttggtaaattttattgaatttggtgttaatttggatttgaactactgcattgttacaatcttacggagcactgctccctctgtttcatattataagtcgttgacttttttctgagtcaaatttatttaggtttaaccaaatttataaaaaaaatatattagcagtatctataacaccaagttaatttcactaaatacaacataaaatatatttcgataatatgtttgttttgtattagaaatattattatatttttctataaatttgattaaatttaaaaggtttgattctgaaaaaaatcgaagcaactacagtataaaatggagtaagtacttttgttatgaagaagaagaagaaagaaacagatcagtcgatcgatctatatatagttaaaattaagaggcattagggaatgatgattaatttaactgttcactgttgtatacatcgaggttcaagattaattaagtaaaagctgcagtaccttcacaaaattatactccttactccttagcatagagctgatcgatggagcgtataaaaatttaactttacatacagagaccaaattatatgcaataggattaatttgccgctgttccgttctgccaaactgcaggcagaaccatcgctgctgagaattgctttccttccttcgttcgttgtgcttcagatcctggacgggatgagcggcgtcgaattcgacaggtacgccgccgccgccgccacgccggagccgagcttcaccgggtagccgatgtccttgagcaccatctccactccactcagggcacccatcaattgcagctgcagagttatggagatcaatgagatgagtcagatgttgctgcaataattttcatctgcaaatcgatctgcagagttgtgtgtgtactgacctcgttgaggtggccgaggtggccgatcctgaacaccttgccggcgaccttgttgaggccgaggccgaggctgaggttgtaccgcttccaggcgtgcttcacgatctcggcgctgtcgatgtacggcggcacgacgacggcggtgacggtgtcgctgaaccactcctccttctgcgtgcagttcttgagcccccacgcctccacggccagcctatatatgcacatcacgccgtcagaatctcacgttcaaaagtttgaccgaatcttgttctaaacgtcaaaatgttcttcctcggtgaccgacctggtggcggtgccgaggcggttgtgcctcttgatgacgttctcgaggccttcctcgaagatgaggtcgagggcggtgcggaggccgtagaggagctggatggatggggtgtagggccagtaggtgcccatcttgtagaacttgaggtagtccttccagtcgaagaagacccgcaccgacttggccgtcttgctcgcctccagcgccttggggctcgcgcacacgatgcccagacccgtcggcagcgagagcgccttctgcgaacccgtcagcgccacgtccactccccactcatccatgcggaagtccaacgcacatatcgatgacaccccgtccaccagtagtagcgccgggtgcctgtgcttgtctgcgcgtatcgtcgtccatcgttgccatggatgagcatgagtaattcatcaagagaaagaagacaagaaagtgataaaaagctcaagatgttaccgaggattttgcggacggcggaaaggtcgttggtgactccagtggcggtctcgttgtggacgatgcagatggccttgatggagtgggaggggtcctggcggagcttgtagtcgagggcggcgaggtcggcgccgtagccccagtcgctctccaccacgtccacgttgaagttgaggcgttgctgctggtcgatccacagcaggctgaactgcccgatcaggaacgacacgatcttgtcccccggcgacagcgtgttcgtcagcgcgctctcccacgcccccgtccctgcaagcaagcaatcaatcaatcttcgggcgccaccatagataaaaggtgtaaatggttaacctacgatcccacttatagattaaaataaaccgtaaacccatttattgacctgtaagcgggtttgcgggttagccagttaaaacccttagctatggacgtggtcgatcgatgaagctaggtaggtaggttggttgggttaccggtggtggggaagaggaagggggtgccggtggtggtcttgaagatctgcttgacgtcctcgaggagggtcttggtgagggcgggcaccgccggcgagcggtagtcctcgttctgacggctcatggcgcggatcacctggtccgggatgttcaccggcccaggcacgaacaggtggttccgccccggcccatacacgtagtccgccatctccctgcccacacacacacacacaaaggcccatcaggcccaaacaaaaaataattattcgtcccacagcaataaaaactcctgcctaatataaccttctgaaagtgttctttgaaaaatgactagtgataatctcatcttactatcttagttgtactatatacggtttgttaattgttttgctctaattatccgactatataacatagcaaacatataattaatacatggctttagttagacataacagtacactactatctcgaaagaaaaacaaaggcaggagtacttgctagtactagttgtcactaataacgcagaagacgttatcaatttggacagtttcacttatccaaggaaaccattagtcctttcttccttttttttaattaaagaaacgactattagtgcgtgctctgatcctacttggcagattaactcgtgcttatccagaagaaatcaattcatgcggctactggctctctgttttgaaaattcaagttgctagctctagacaataacaaagcaaaatttctctgaacttagtctaagtttcaatttcttcttgcacatacaaaatccaaccatatggctaaactgaatttactcatacacctacgatcattgaagatctaatagaagacgctaatggagatggatgtgtgtaccttgttcagataaagcctcctcgatcttgtgctgatgattttttttttcgcacgtaatacgtgcgaaggaggaggcagggaggatggatagggtgctgaagaaggctatatagggagccatggtgtcctttcgtggggcccacacccgtccgacgtggcagataaggggccttgccggtgccttctgttcgtgaggccctcgtagctcgcctcatggagtggtgcttagctgctacttagctctgctctagctctagctgcagccatcactggcatagcatgctaacaaagcgcacggattttgacagtgtgtaacgactactcatacacagtaatctggcttcgtcaatcccatgtatatgtcctgtttatcgtcccaattttatcagatgtctgcttaatttccctgtatctgataaggtgttagctgcaccagaaattatttttcttttttcttttttgttgaaagctttgcatcagagataattagttaagcaagctgcagaggtgatcctactgtttgagtagaaattggagctagaaaggggagagaaataataataatccggtttcgctttgcttgctggctggctgaggcgatagagctgtatggcctgtgagttagtgagtgagtgagaaaaatgacaggtttggttgagtccaagcagagccaatctgcaagccaagggcgcaggagcgtccacgtcggatgttatcccctaccatctcgctttgcggtgtccgtggaaacccagcaattttttttccttctcccttcgtttttattttcagaggtgaggtcaagacaaaagatgatgttaaattgtatcgccatatgcttggagaaggttgagagggagaggatgacggcgaggccacaaacgaacagatgggaggaaggtgatagctagtgtaggtggaaatggaatcgagctgtaccaacgagattttatcgtgagaaaaatcgggtaattcactttttactttgatatttatcgctttcgtatgaactttctcctttaaaacctgaaaaaaaatcaggcgattcacttatacgctttgatgtttttcgcctttgtatgaactatgttgtgtctaggttggctttagcatgtccgttgatgcagtgacttgagtgaggctgtagctgtagctgaagccgagaaaagattgaattctgaaatatgaaccttttgctcgttattctgatgagttcacggtatctgttccatatgttacagaacctgggctgtgtatatccattgtggatgtagaggccgcattttaatctattttctaaagaaaatgttacataacctgaaaagtgggctactgggctttttttcttaattagacgcatagcgcatgttcagacatacgaagtctgaatactgatcatatgtactctcaaggaagaaccacatgcaagtgatacccaattgggtattaaagttgtgtttacagctaaaaggcttaaagaaagaaaagttcaatttttatgccagaacgaaaaaatggagactttcaaactgtagccttcaaaaataagccctcccaaccgggcatgaagtttctttcggttctatcggtcattcggttggctaagagttattaggggaagaaaaaaaaatttgtgtgtaaagacaatgttaaaaaagaaacacgttgacaatatcgtaaaaataattctaaagttaacttttcaaattcaaattttgggctgattcgttgtagagaaaaaaacaatgaggccctttctgtcttaaaactagtcctttctttcctcagcctctccatttggtaaccaagaaagctactacaacggtcggccagggagcaattcatagtctctgaattttgaacatggactaaaaaccttgctccccatgaacaaattcttcaccttcaaatcccaaccagcttccaagtttgtttcgttggaccccaaaaaggcagaaacaaatttcgtctccgacgggtccattttcgcaggaggaaacatctgcatttctttgtggctcaatgattgcgtcgacaaatcctacgcccaaattccagaactggtcaccttggaacatgcaaaaaaagagcaagggagagagaaagaaagaaagaaagaacgagaaagcaaaagggtggtatagtgcagagtgcagaggagaccgtggaccaagaagattctgcatgccatgcggatatacggatgttctccttttcctacatatagacaacgtattagcagcactatcactgcacatgaacaaatccatcaagaattgaaacaggatcaagaactgaatcaggatcatgccttgatcatgcaggattcaccggactgaaaaagatggatttttttttgaatgcgacttaacgaaaaactctctaacttttctttcaatgatggaaatggtttatatttctggtctctgctaacggtcacgcgtcgaagaaaacctctcaacatgactatgtttacatacttctattaggcttccttgcaaacacatgattgaaaaaaaaatcatatgaagaaatgtaggattttggtaagaacacaagtgcaaaacagatgattgcaaaacatacatggaaaaaaatagaatgatcatttgaatagaccacgggaaaaatataagaatcagatgagacatatagacttgaatggaaattttccaaagagattagagctcttgctaaccctcttttaaaatctctatggaattgttcatttcatatgaatttcaaataagagatgtgattcaatcatttatttcaaaagcttccttagcattttgcctttgaaatccctgaaatttcgtatgtttttaccgggagtactgcaaatgaaaggggccgatttcagcagcaatgctgctggcctgctgcgcgcgcgcagcactgaaccgagcacacgcatcattatgatctcttctactacagatcaggagcacaacatcacaaatatattcagaactgataatccagcttctgctgctactatgatcaaaaggtgtttgtgctgttgttctactatgctcgcttggcatcggatgcctgccctgcggcccctgcctgcctctcgtcgcgagacagacaggcatgatggcgctgcaagctgcaagcttagggctggtttagtccccaaaaatttttcttaaaaaatatcacatcaaatcttttaacacatacataaaacattaaatatagattaaaaatactaattgcgcaattaggaggaaatcgcgagatgaatcttttaagcctaattagtactccctccattccaaattgatctacatatagtttttttaggttattcctaaatgatctacatatttgtgttcatttattaagtctactcgttatttgtgcattggagtaaatggacattgatgcatgcatccatgcacacaagtatttataacccacatgcaatatcttgatttgctattggctggaaaatattagggatggtgcatgtatcgagtttgttgctagagtaaatatagtatgagagagttattagcctttcttggtcttggtgtatctataaaatatgtagatcaatttagaattgagggagtacatgattagccataagtgctacaataacccacatgtgctaatgacggattaattaggcttaaaggattcgtctcgcattttccaagcgagttatgaaattagttttttcattcgtgtctgaaaactccttccgacatccggtcaaacatccgatataatacctaaaaaattttcttttcgcgaactaaacaggccctgactgatactaccatactactcctacacaaaaatatggattttttctttttattttgtgaaattttttatttttaattttaaaaataaaatcttcaaaaacttattttgagattctaaacttatttcgagatcacattagtccgtctgacgtgaaaaaaaaatattgacactgcacacaattcagctgacgtggcctaaagattcatgtcttgaaaataagttttaaaagagtttattcttaaaatttaaaattaaaaaggtaaaaaaaatccaacagcatggccatgcaatgtaggcagggaaaatatgtaatgcaaaccacgtatatagtgaaaacttagaaactaccgttggatcgagaaa

SEQ ID NO: 68516 - DNA, 2254 bp, Oryza sativa
atgccaactcaagccgtttgtggagattatggatatcccatacccacacggcatgtgtatccgactgggtatgtgatgccatgtatagatagaatatctttaaagggactcgggttaaattctaaacttgtatgacaaggaaatacccgggatcctagtcggctacaattgtatctaatctgtaactacctattccgttagggatatgggctttattttgtaatacggaccccttcccctatataaggaggggtccgggtgcctctaggggcacgattttgctcctagatcatacgatcaataatacactcggcggatcaatccccggacaggagtagggtattacttcttattaagaaggcctgaacctgtattaaattccttgtctctaaacccatccacttttccagcttgatagccacccccttttagtattgccgaaatcttgtttcgacagttggcgcgccaagtaggggtagcgtcaagttcttcgctgattagtgcgatgggtttcgtctccggcatcgacgacttcgtcttccctcccgggcaggcgttccggttcggcagcctcgacttcatcaccaacgacttcggcaagatttctctccttaacttggatccgaaccagtcggggagaggctaggtctccgccccgttcgatacccccgaactcggccgagttctaccccaagatcatctcgattgagtcggcttcaaaccactcggacgagatccaatctactccaacacgacctgatcaagacgatgggccctatccctcaatcctgatgaaactccccgatgatttggccactgtcttcaccaggagggtgtcttctccccgtaagcctagacgggatccagcttcggctccgatccagtctaactctagggaagtcggcatcatactccaacctctcgggacggtttcgatggaagaattagacagctacctcagctctcccggtgttgattctcgaccaacggagatcctcgagtacgacgacttcggctaccactatgactacagcaatttcgatgacttcgatgaaggctacgaagacaactacacgcctctcttcttcggcgtattcatggctgataacgagacggcagaatagcatcgagcccgagaagcggaagaagagcgcacatgacaagaagccgagcgtcaccgactggaggaaggacgacaagcacaagagcgagaacggctgcagcgtgaacaactggagcgcgagcgggctgcgaaggaggctgaggatcggcggcagcgtgccttggaagctggacgatgagcacgagagcttatcggacaacaagacgttgaaggaacggcggtttttgcacccccagcaaaacgcggtcgcagcgatcacccttctggaaactttgcttaaggaagatgtgcccgatcacgtcgtcaacatcttgaaccagaccaagaccatgatcgccgcctcggtcccagtgaactcctcaagcgtccgcacgccgactggcagccgagttccacctcttcgatcacaagactatcaccaaccaagcctcagcgttgtcggcgcaggatcaagccgcaggagcagggatcatggcgaacgatctgttcactcgcctcctgatcgacacagggagcatcgggctgcacagtctcgctctccacgtcacaggcgtcccgtcgatcttcgtgatactattaaccagcgttgtgcggcaagaggctacatcccccaccattcatcagatcgttacgacgacgacgtggatggagttgctgccttcacaagtgacctgcgtcgagtggattggccggccggcttcaaaccaactgggatcgagaagtacgacggcacgacaaatcctgagtcttggcttaccgtcaaaggcctcgcaattcgcgcagcaggaggagatagcaaagccatggctaattatctgcccgtggccttagcggactatgcccgatcttggcttcacgggctaccccgtggcatgatcgggttctgggcggagcttcgcgaccatttcatcgccaacttccagggtacttttgaatgccctggtacctagtttgatctttacaacgtcatccagaagtccggagaatcccttcgagattacatccgatgtttttctaagcaatgtaacaagatctcggacatcaccggcgacgttatcatcgccaccttcaccaagggctttcgccatgaactcttagtcagcaagtttggccgcaagcctcccaagacgg

SEQ ID NO: 68517 - DNA, 733 bp, Oryza sativa
ctagttagcactggttttataagttgaggaacgcgttgtatctggttttgcggttcaaggacgattttgtaattcgacgacaagttgagggacctttggtgtacttgttcgtaaaagaaaagaaacaccggcccagtattgataatgaagcccagacggaccaacaggccaagcccatcttatcccaagaaaaaaaaggggaaaaattactcctttctaagcgaaggcctaggctaaagaacagagaagagacctgctcttgcgatccttctcactctcttcctccccgagtcgacggccggccaccgacttgggggaaaccaagccaccgccgccgcagccgccgtaccccaccctccctcccggcggccgcgggccatagccgcgttctcccccgcgcgtctgcctgcggcgtggaggcgtggggggcgacggcgatggggtccatgacgatcggcgccaagtacaagaccacgctcaaggaccccggcaccaccggcgtcctgcgcatggtgcgtcgcgatcccccctctgttcctccctccctctctctctcccgcatagcgtcgcctctctccctccagctccgattggtcgggtttaacccttgcggccgtgccctactggatacacactccgcgggaggtgcggtgggtgtgctgattctgtggagggatgtcgcttgacgggagggttttgatcgggtgttggtcgcggtagtgtttgattgggt

SEQ ID NO: 68518 - DNA, 1270 bp, Oryza sativa
cctgcagcccaccgctcaacacacggcggtcagaccggcccactcggaggaaaccggtagacttacaaattttggcaatctttcctattttaatcctaggtgccaaatttgggtgtaaacaatcattattcttctgtgcatccttataaacaagattaaatctcctgcgatttagcctaggaccaaagaatgcaacagaataccccaaagatcatgaaggaaaagaatcgtctcatctcatcttgtggcctgtaaacacaattcaatcaccatgacccctatcttgggacagaactggactgaggcactatgtgaatcaaccctaccggaactaatggatccaagcttgcttctccatgcaatcaagataccaccagttgcccccaccgaaggaactttaacaaaattgttatcaaatcagacccaagcatagccaagatagtgaaatgaaggaagattgtcatgtttatagagttgggatgatctaggtgacaattaattgtttgttttttaaaaaacaatagaaattttgatagagatggaaatatttgagttgcaaatatgcgtgtcatatcaggtattatatagggtgtcgcatggagtgttcagacactaataaaaaaaactaattacaaaatccgtcagtaaaccgcgagacgaatttattaagcctaattaatctgtcattagtaaatgtttactgtagcaccacattgtcaaatcatggagcaattaggcttaaaagattcatctcgcaatttacacgcaatctgtgtaattagttattttttcgtttatatttaatactccatgcatgtgtccaaacattcgatgtggcaggttgaaaacttttgctaggggatctaaagaggcccttagaatgaagattcaagatttggtttgaaaagtttaattccttctttttaatgattggttgatactgaaccataaaaatttgtgttacatagtctagtatgaatgtcttttcagaatcaccaaaaataggtttgctacaattctgctgaggcgagggataaatttctagacatcacaaaatttctaattaagcttccgtgtgcgccttcagttttttttttcaccataggtctttcctttagagaagtgcaagggacgtgctcatgttcactagcattaatccgttcgtttccactaaaaaggttaataaaattttggatatttgtggcacgctttttaaattgctaaacggtgcgttttgtacgaaaactttctatataaatgttgctctgaa

SEQ ID NO: 68519 - DNA, 6225 bp, Oryza sativa
cttgcttttgaaatacgaattgacagggtaaattggtgcttgttgggcgtttggcactggctaaaccttcgatttagtcatttagaccttgtggcatcattgtcacggccctgtgaattgcattcttatcttccatgatagggatgagatcagctcctgaaatggcttgtccctgcttagtggtaacgcagagacaaaaaggagttcctaacgtagaatggttttttttactgttattgtctatctgcaattaaccattcaccctagatgctttgataactaaaaagtgcgaaactgccattgctcgtaggtttatcaaggggaagtttctggaggcttttgtcttctatttttgtttcctgtcaagtgtcaatatgtctctgccctttttgactgaaatgtgttcttgccaaaatactcctggctggcataggttaagctgttacccggtcctcattctccttccacattggtagcttgacagccccatcttttcgcttatgcttatgcttacgacttttttttacttaaaatctatacagcttattagtaacccaaaaaataatttatggataaaacttttatatacgtgtctttagttgttattttgtaaataaactatgatagaaaacccacaaaattgagttttaaaattcaaaatgttattagcataaacataagcaaaacggttgggctgtgaaatatcaacccatgcctgtccaatttgttcgaggctgactgatagtttcaattgcacttttttttctgcatcaatcttttgcaggaggcaatttgagcgtgccaacctagaagcaatggatgaatctgctgaatggagaatgaaatatgacacagagtttgcgaaaaacaaacagatgcaagatgaacttttaaaggtctggtctatttatattatgtacttgtacacagctttcctcagtttccttctgcagtgctcatttgagaatcttgtttacaggctaaggcctcactctctgcttcaactaagagatttagcctattgaaaaaggtaaccttttgggggcaaactttgatgcttctcgttgtaacaccctaacataatattagctctatgcttcctcagtaatattgagcgctttctcctggtttctccatatatttcactctcttaggtgttaccatgcttatgctcattttttttcaactcttttgagatgctcgttttcacaactgcaggataatgaggtgttgaagaggcagattcagatcatgaaacagcaatgcaattgcactgttacatcgaaccttacacaagaataatgacattactacatacttcttttgtagtttagcattcatcttccttaaaatttgacatatgaactagcgggaggcctagtagagtggtgaagtatgaagtaggagaaatagctactgtagcaagaatattactttgcttgcaattgttagtgagttttacacatgccattttgaagtggttgctcctgactagcaaactaccagtgcaaatagaagatttttggttcatttgagtggtgtattcagttataagttatccttgactggcccttacaaggctgtttggtatttgtaaatatacgttgtcttaatggccatatccagttcctttcttgtttggtccgtgcccacatttggccatgcgttgacatcaagtggtgcagtaatatattcaaatgtctgaagtaacattatgaaaacatcatgcatcatcatttgatgctaatcatgtttcttaaacatctactagctgcaccatcatgacatcaagttgtgcatacatatattcaaatttcttgaagtagcaatatagatccatccaaaaaaaaagtacttgcattatataaacatcatgcatcatcatttggtgctaatcatgccttttaaaaatctactctagtgtcatcatcatgaataacaccaatgccagggactccaaaccaagcaatcgcatttatatccaaatgatccgttggttgagagagcatgagtacataactttcttcatgtattgtgacacataattttctgacatagtacgtccactcttgtcaacatgcaagatcaaaggacaaaccaaatatacagtgtttaaagtggctccgatagtgagagcacaaacaagataccaatacattcatggaatcaatagtatcttgccaatgtgggaactttcttccatcaacttgtgagcttcagcagcttctgacagaggaaacgtcttgtatattactggtttcaccttgccttgcacaacggcaggccatacatttttctccacctcactgacaatcagagctttattatcaaggcttctgttgcgtagtccagcagctgcacagaatcataccatttccacacatgctaaaatcagcgatatcgtttaggtatcatccaatcacataattgtgattctcagtaaggcaacaaccagcagtggtataagatcgtaaataacaaaactagaaacacaaaaatctagtatgagggacattgttgcctatagatcaacgttaccttgtatggtcaatcgtcgagcaagcatgggttgcaggttcacttcagttacagcgcctccttggaaaccaatgatgaaaagtctaccatcaacagctaagctgttcaggttacgctgaagatacaatccaccgatgttgtccagaatgacatcaacacctggtaaatatacttccatgtcaagagtcactaaagcatatgcaaacttggcaggtatcaaacattatagacagttccatggagaaatgccgttataagaaatccatctgcatataagtaccaattggctggggaaaataatatgaacatgaacacacaaaaatggtgaacgcgtgcgatataccctttccatttgtttcttctttgacacgtgcaacgaaatcttcagttttgtagtttatgcatacatcggcacccaaacctttgcaggcagctagtttttcctcactacctacaaacacatagtgtaacagcatttacttgagcgatctctgcaacatcctattatatactccctactgtatctattcttgttctactataaacaaacctgcagtaacaaaaaccttaattccaaggtgctttgcaatctgtatagcaaatgtaccaattccactcgatccaccatggatctgcaaacaccaaggatgcaccgtgctcaggaatgaatcatggagtcaatgggggattgaaaaggagagaagttatcttacgaggaacgattcgctgggggagaggtggctggtcacgaagacggtcgaccagacggtgcaggccacctcgggcaagccggcggcgtccgtcagagacaccccctccggcaccgggagcagctgccccgccggcaccaccaccttctccgcatacccgccgctgctgagcagcgcgcacacctgcaaggggaaaaacaaatctcccaaaattttacatcctatcacatagaacgtttgaacatctgcatgaagtattaaatatatgctaaaagaataactaattacatagattacgactaatttgcgagacaaatcttttgagtctaatttctccatgatttgacaatgtggtactaccgtaaacatttgctaatgatggattcattaggcttaataaattcgtctcgcagtctaccgacggattctgtaattagtttttttattagtgcgacggattttgtaattaatttttttattagtgcctaaacacctcatgtgacaccctatataatatccgatgtaacacgctaaaactttaaaccctagatctaaacaccccctaacctaacgtcctaatccaaacggcagcggcggcggcggcaatcaccgattcacctggtcaccgacggcccagcgggaggggacgttagggccgagggcgaggatggtgccggagcactcgaggcccgggtaaggggacgcgccgggcggcgcggggtaccggccctggcgctggacggtgtcggcgcggttgacgccggcggcggacaccccgacgagcacctcgccttcccccggcggcgggaggccctccccgacgtcccgctcctccagcacctccggcccgccggcgcgcgcgatcaccaccgccctcatctctccccctacctcgtcggggctcagctgctcgctttgctttgctcctctcgatgagtccacgcacgcgctgacactctgcgtctctgctgctgactcgtcgactggatattgagatgggccttgggcctggttgagtaaaattggcccagatagctgaaatctggtccagccttctaaaaaaagataagtacttcctaagtgctagtccttccgtttcatattttaagccgtttaactttttttcattcaaactttgttttgattgatcaagtttatagaaaaatattactaacatattaaaatagttttattgaatctaacattgaatatattttgataatttgtttgttttgtgttgaaaatactactatatttttatataaatttaattatactttaaaaggtttaactatgaaaaaaagtcaaacaactaaataataaataatatgaatgaaaagaagggagtaatacggtataaacgttgtttgctacattgtctatatattttgaaaatgaatcgattcggggcgagttggtattgactggagaatagaaagtctatatatctgtgtaattgaacatttggagaatactctcacattaattaaaaagatataatcattaatttggtggatcatacttgtactaaaacggataccttctgaggtatggcctgatatagacttccattaaaatgctattctcttacaacatttgagaggacaaatgactatactaattaatgcacaattttttttctaccacatgtctttctttttttttctctatccatatatactaaagttttcctctataaacgcctagagtcgacgaccattgtcacatttaacaagtatatttctctctttttttttcatttctcttatatgtcagcaacttaaaagtctgtttattaattgtctttgtatctgccctaattaactcttacattcaccagaaaaatgttcatacatcaggttgatatgacctaccgtaaatagtagtttaaagtttgtgtgtcaataataatgcaatttataaaaactatggacttattaattgtattttattattttaataattttaatgttagaattatgaatacgaagtctatacatcctatgctctcaatttagttttaactttttattttaatttcaaattaaagacttgcatgatgtaaccaatatgtacaacaactaacatattcagtcatcgtctcgagtggcaacgaatagagtgttaaatcatcaaattttgcttgtactccgtgcaaacatcccaaaaaaagaaaaaaaaagactggataattctctagtgatgatataaagttacaaactcgtgcaacacatggattgatggctacttaatgatattccatgcatatttatgaggttgtcaattttaattgtattttagtgtaacgaactactatacctaatcttgttttgcttttagtatgactagttactatacctcatcttgttttgtttggtattgcagaagaattgtttttatcttctttgttaagctacgcgttatttaaggcatcagaagtactatacagttggaagagaatcaaccagtaaccatgacaaaaatatcagttgagtggcggcaaatcatgtcatgctcgtgtgggacatagtactagtactactaatgggcgatagcaactcagcaaggcgaaagaaaagaaaagaaatgaaagtgaaaaagactgtgttctttatagatgagacggatattttgtacgtaaaacgaaatgatcactaatccataattaattaaatattagtaaaagatatatttaaggtaaatttaatatatctttttaagaaatattttttaaaaaaaatatattatttcaaaatttaaaaaacatgtgcacggaaaaataaggaataacgtgcgcactagaaatgacaagtgttgcaaagaaagctttccagattgagatggattcccacggtgcgggggcttcacccgcacgcgcgctctctttcgccaccgttgccggctaaccaaaaaagtggaacacgaagaagaagcagcagaagaggaggagcatctcgcaaccaccggatcgattcat

SEQ ID NO: 68520 - DNA, 3227 bp, Oryza sativa
cgcccccggaaccggaaggggaaaaaaaaggtccgggttgggtatggcctcgcgggaagggcgtgcggccccgtggtaatgtccaaacgtcggcttcatctccatgaaaagaaggatcgcaggcggaagaaggaatgtgtgaaaaaaaatgttggaaaaaaagcattaagagcttaggtagaagaggaggaagagggaggccaaggagaaggagcgagagcgagcgctgctcggcgttccatcgaggaaggagaagtattcggaacggggacgatcgtcgaggttgtagcttcgctacacaagattcattagtgtgaattctacttgtgttcttggaccttttgatttttttgtgctaattgatgtcatctttgtggctttgatgcagatgggcacggtgatgtggggatgcacttaatatatttgtgcaggctcttcgaaagatgttgatttgaagaacaatgtgaggattcacttagacccttgttagttttgggcgtacaaattgtgaattaatttgttgcagtgcagtgtaataaaaaattacaatgaaattataatgctggttgttgatgactctcaagttttgttgtatcgagaaataagttgaatggattaatgatatgcaattaaattttgtttgatcatttggggttgttcaaagttcaaacagaagcattttattagatttaagttgtgtattacagctcttaacatccctaatcatgtttgttgatgttccagaggaagttttttgccctgttaccctgtatagttctatgttctatccctccttttgataacactcttatttacctgctgggtgcctgtgtctcttatattagaatattagatagaaaatatcatgtttgcacaatatggcatagataattattatgtaagcacttgttgtgttgggtgcgaaactgtatctcactaaagaaaatgggggaaaaggcatatggggctccaaagtttctgtctgttcttgcttgtaatgtggtgctcctggttaaaatgcttgtttatttataatccacaaagttgggggccacaaatcgtgccgaacatacttggtacagtgttgactgatttttgttgaaaacctaaattttgttgggaccaaatttaaaatattattctgaaaatgtagcaatttatgctggcaactgtttggtggtagttaaagcgagaagcctaaaacttcattgacttttcctgacaagggtttttctttaattaattggctggtgaacgagaaacatcaaactattcaatcatgttacctacatagttgtgctattgaaaatctggcttatttttgcaacagatatttatattccgcagaaacaattggagatgacttgatgaaggagatttcagaggttttatattgcaagaagagccaaggtgctaagctgttcaggcgccattgccgccgaggacatcccagtattagcaatttgcatcagagttatcttttgtaaaaccaaccctggctaatgtaaactaatgtaatgcaatggagctttcaactctggtagaaatttcattgtttgcttgtaaagtttatcaaaaaattgcatggtggacagactcaactctcaagcacctctagattgatcaaggttggagaaaacttattttctggagcatgtcgatgatcaaagttgaaagagcttacaacatgagatgaactctcaaatatcccatttgcttgttggggagatggtcacgatgaattataggaagatcaatatatacgattttatttgggaaagatacaaaccattcctttgtgacatgatcacatcgatactacaatcacgttttatagataaaattaagaaaatctaatactgaaaaccacacacgtaacaatcaataggagtaactttccaatgattagtttaaaaatacatcatggatcaagctagattaccactacgacgccacacaaacaccacccttttttgtccatcggacacttgtaaacagtaaacctcaccaaacttggtacatttgtttttctgcatcctttggcagctgaccaacaaaactaagcatccccacgacgtcacctttttatttactgtagaattatctgactagactggaatatgagatttctcatttctttacaagacaacccagaataatgctaagtagcccaatcaccagtacgaatgccagcgagaagcctccttgatgttgactggcttgacgccttgcaagctcctgcatatttatgcccaccaacatggggttgacaaagatgatcactaacatattattttcagtgagttcaacaaaataagaaggcatttcttccacagtggaccttaactaaagttttaacatgctaatgtaatatatttgctcctattattcagacaagatcgatggaaaaaatagaaaaataatcagctccatcgtaagcaaagtgcataacgattcagcaataataataataataataataataataataataataataataataataataataataataataataataataataataataataataataataataataataataataataataataataataataataataataataataataataataataataataataataataataataataataataataataataataataataataataataataataatattgttatccattgtcgtctatggataacctagaaaaatttggtgttgagaacaagtagcatctaaaggcgcataatcgatgaattttatattgagaagaagtagcatctaaggacgcataatcgttgaattttatattgagaaaaaaaagcatctaaagacaaataatcaattgatgtatgcagcttgaaatatctagattgaaggccccttcagataaattccctggaatatatggcttatgtgtattttctacatgaacaagtacttaaggaggtgatgcttatttttgtaataatatttgaattgaaaaaggggaattcttttacaactaagtaaatgactcaaatcattaccttcaaatggaagcatgtagaatgcatgacttaaccaaatactcccagctcctttcgaagttcctattttgctaatgcagacttcttttcttcgtcaattttgcaccaacgcggacagttgaatgagagagaaggggtattaatgcacgttaagtaatgacagacaagatgcaaagtaattaaaattaatag

SEQ ID NO: 68521 - DNA, 21910 bp, Oryza sativa
  unsure (1)..(21910): unsure at all n locations
gtgcactattcaactactaaaagtattttggtaggacatgttttggcatatcaacaaaataatttagccaattgcaacacacggggacacagacaaccaaacgagatcagaatgcagacgtggtaatatatcaattcaaattcatgaacaaaaacttatatttcaatgtatggacttgcagaattgcacaaacgcaaaaggaaacaaaaaaaggggcaaggaattgtgctttgcttcactgcttggcaattggcaaggcgacggaatcaatcccggggaccataggctgaagggccagaaaagagggcacaagatgtcaagcttgttccgacttccgagaggaacttcgtacaacaaaatggaagtatatacgcctatcatgtacacatggatctatgaggtatatacagcacatactctgcctgttctaaaataagctaatttttatacataaaattaaacatagcatgtgtagattcgtgtgaaaaggttaatttatgagggtgtttagatccagaggtgtaaaactttagcgtgtcatatcggatgttatatagggtgtcgcatgtggtatttggacactaataaaaaactaattacagaatccgttagcaaaccacgagatgaatttattaagcataattaatatgtcattaacaaatgtttactgtagcaccacattatcaaataatggagcaattaggcttaaaagattcgtctcgtaaattagttacaatctatgcaattagttatttttctaagactatgtttaatactttatgtaggtgttcaaatgtttgatgtgatatggtgtaaaatttttgtgtaggatttaaacagggccttattctaaaatggagggagtaaaatggtgaaattttctgttgtactttgttagtgtcatcggtcagctcgggcgttgacctagtaatatgggaactgtggtgtgtaattccttcgaaatgaagctggtcacttcatctctccagtccatggctctgcaagtctcgcaagtcgttagatttgtttggtccttcatctgctttgcattcagattcagtcagcccaaacttactagaatcctgatgatcatcagtgtcaccactttgggatgtgaaaaatggtagtttctgtccaatgtgtggtgaaggagggagtgctgcaagattaatcaagaaaacaagggattacaaagcatggaattaagtatggtttaatgatgtggataggaccgtttggtgtccaaaattttgagggtatcaactaaacatatccagaacaaagatgatacttggggtacaaattaaagtcctcggtaataatatatcttctctggatgtctcccagtttcaacttgaatctgtttgcagtagaagtgccttcctcgctatgctgttctatactactccctccgtcccataatataagattttgagtttttacttgcactgtttgaccactcgtcttatttaaaaaaatttggaattattatttattttttttgacttactttattatccaaagtactttaagcgcaacttttcattttttatatttgcacaaattttttgaataagacgagtggtcaaacagtgtaagcaaaaacttaaaatctcttatattataggacgaagggagtatatgttacccatattactccatcaaaattcacctggtattgcaagttaataatcacagcagtcacaacctacaattgtggaaatcgttatttggtgagcatatgtgacattttgctacaaaggtaatttttcatgcgataaatttaacactgaacatcaaatcatatatttatattcgtaggccacaactaggctgcattatccaataaaagaaacaataacactctcaaccatcaaatactagtatatgagcaaagatgctgtacacatatgaaacttttggaatactacacagaaaccaaatgtgcggcttcattttaagcttatatattttgagtttttacttacaatgcttgaccattcgtcttatttaaatttattttacaaatataaaaaacaaaaagttatgcttaaagtactgtagataataaagtaagtcacaaataaaataaataataattttaaatttttttaataaaacgagtggttaaacattgaaagcaaaaactcaaaatcccttatattatgagatggagggagtacttattagtcaaaatttaaattttcaattttaaatttgaaattgattttaaagtttttttttatcaaagtttatttttagcatttacttttaattcgttaaaaacacgcatataaaagttttattcacaaatgactttttctttgcagatatgccgatgggcacccttatcatcgactcatcgtagtattagaatttattagagaaaacaaattgcggtaaaagaagggtaagatggacggcgtcagctatatttcccaagtctaaaacgtccagccgtcagctattacgcaatcaccaggagacggacggcgtttataaaccttcctccgtgcatagaatcgtcgtcccttccctccgagtgccgtacggccgctgccgccttctggaacattcgcttgcctccgccaaaaaaaaaaaaaaaaaatccctcctcccctctcccctcgagtggggcgcagccgcctcgctcgtcttccttcctcctccaccgccgcgcgtgcgcgagtgcgcagccgccatcgccgtgcgcttctctgcctcccgatctgcggtgcgaccggtgtgatcgcggagcggcggccgacgagaaggatttttttgagggaggggggcgagtggtgcgacgccgctgacctccttcaattccacctgccccaatctcggttgggaatcgaatcgaaaggtattcccatcccctcctgcttggctgagccatacggggctctgattgattcatatttgactcatattaagcatccagttttattctggatttttttttggcgcgtggtgtagtactactggagtagcaacttgtgtcccaaaataaaattgagggtttagccgccccctgctcattagatgcagtggccttatactttcatattgatatagcaagatagggtagtaattttttttcttccctgtcttgttgataacttcttggtaggtgccactatgatcttctgttataacatcatcatactatgaaattagtttgatggcataacgtgtttttttttcttatcaggaataagatggaagagaagagaatagctcggatttcggtcacttggagaggcagacagctcgatgtcgatgcagacccgagctgtacggtgaaggaattcgggcaacttttgcaggatttgactagtgttaacccagagacattgaagcttattgttccgcagtctacaaacaaaggctccaagctgatcacaccgttttccgaccctcattcagttttgacattgaaagaagctgctattagtgatgtaagatgcacaagagttgtacttgctcagcaatatgttgctacgttatggatattataatggagaatggaataatttatattcaatcattgtttgctacaggggaagcctattagaatgatgggtgtttttaatgatgaaatcgaggaagtatcggacaatggcaaaagaacagatctacggataattggatttgaggaggaagaacaacggctgaggcaacgaacatcaggcaggccccaagttccactcaaacttccacagggccaatacatcttctgtgattttcggacacttcacttacctgggattgaggttagttagcctctactccctacgtgctttctgaaatctataagaaacagttcatgtaggcatgtcaatccgccccttccatactccacatatcatttgtctcctcacggattatcataaaccttagcgcgcacattttcctctgaagtctgaactcttgcaatttcctgcttgaattaggatgcaagcagcgcacgaagtgttccatttgaacagtatgcacactataaattgtggattaaatagtttgaaggaattggaccattgtgcagtttgcactggtttctgtccaaaactttgtgaaaagacaacgttaaacaatgtggtgtgctcattttatttatcatagttaacaccttctcatttcatgacatgacttcactataataattataatgaaatcagtatatgtatgaaatgaatgggttcactatgacaattgtaatgaaatcagtatatgattcctgtaacttgctatagattatatatagtacattagatttgaacactagacattattttcatatatacctcattctttcgtaaaaaaaatacatgcatgctagtagaaaaacagatatacctgatttgtatgataacaaataggccaatcacaacatcttgaactatcgagttttgcttacgtgccttttgtttgatgccagttgaatcccccaccttcagaagctctgaaaagaatgcacatgctagcatgtgacccaggcataattgcgatcatgaacaaggtagcaatattttcaagtggtgtttctgttttttatgtttgtgtacattcgttattttacagttatcctgttggccttttcagcatagatggcgagtgggaatcatgactgaaatggcaccagtagggtatgtaggcgtcagtccaaaatgcattctaggcttcaataaggttagtataactgtataagctttttactactgcacatatggatacttgtcacacaacaatttctgaggttatatcatcatgtcttcctcattgttaatacagaacatgggagaggaaatatcccttcgcctacgaactgatgacttgaaaggatttaggaaatatgaaagtatcaagagaactctactccatgaacttgtatgcctccttggttttctgctttcatgaaatggagatttcttatgcagatcttccgtttgtcctctgtaatcatgcctattgtatattaaacttgcacttggtgatttcaggcacacatggtgcactccgagcatgatgcaaatttttttgctcttaataagcaggtgattttttttcctagacaatcctttcatgattggctactgtctctttatgtttttgagttaatctgttctttaatacaatgtcaatttcagttgaatgatgaagcagcttccttggactggaccaagtcaagaggtcatgtgctgagtggtcgcaaaatcttcgattcctatgaagacgaatttgttctggagccagacagtgttgttgttggccacaaacttggaggaggatccagttcactggcaagtgctcgtgtgttgtctgggtctgctgcttataagcgttttttgaatgcatcagcggatttagagagttctaaagacagcgttactatacctggaaatgaaattcttgtgcctaacacaaaatttgagcctgatccagatgatgttggtcaagatttttctcaggacaacactaaggtggagccagacccagatgataatgatgacatgaacgtggatgtagggactggggcatcttggtcctcagtttctagatcatttacagaacaagataccatcagtcactcagagcctgaccctgatgatattcaccagcaaagcactgctggttgcctagaacctgaccctgatgattcctcaaatgttgatattcttagccaggagttgacgattgatgggaagcagaatggagaacctgatcctgacgataatggtactagcaaatttattcccgaacctgtaaacaagatggaagtagagactgaattgggaagtaacttcgcagttcagaattctgaacctgatcctgatgattcctcaaatgctattctgaataagaagctgggaactgacaggtctgatgaaactacatgcgaagctgttgtagaagaatgtgtaaacaagatggaagtggagactgaacagagcagaaactcgacaatgtcaaaatctgagcctgatcctgatgatcatgctgctaattcaaacatcagtgagctccagaggatcgaagaaccagtggcagccctctgtgcacgccttcagaaggccattgaaatgcttcgctcacaagcaacacctacagaggcaacttctgctcttcaaacactctttaagatcatcaagaatgtgatagagcacccacatgatatcaagtacaggagactgcgtaaggtatgcttggctgttcttatgctcttttattaggttcaattggtccactaaaaaaattcttacttactaatcctcatttttcaaatatgcagtccaatccacagttccaaaggagtgtggcgaactacaaaggtatctatttgctttatagactcccctctttttttttcttcaggtcttcaaaaatcaactgtaactaacttcctcatttttttcgcctccctgaaaacagctgcaatggaggtccttgaactgattggtttctgtgaggatgtcgtctcggatgagattggtcgtgcagagacttacttggtattgaaaaggaacgatcctggcttgctgtggcttgcaaaggcctctcttgaagtttccatggcctgaattgtttcaccaagcaatctcctattgcttctgtatacctgtaaatcattttcattactgttgtggggatgctcatatgctgctcttaggcaaatgatgtagtatggtcttcctacacgatgattgtttgtatatggaaacaccaaaatggtctatactgtctgtcaacacacttcatgatttctcatcaaatatacaaactatagataaattacctggcaaaatggacacatcttcccttttgtgtggactctgatagaaattgattccagatgctcacaaatgccagccaaccgtatccacgaataaagtctcgactagacggtgtattccattatcatcacaaagatgttaattttggaactgaagtatataaaaccaaatttaatcaccaaaggtctaatgtttgggaactgatttttttttaaaaaatcaaatcttaaatctttgccctttttgttctgtattgggcctttccaacctcgatcccaacaaattccgggctgtaaattcggtgggcttggtgtctaacaacagcagaaggcccacatgcgtcccatcgcaatatcccatcggccgctcgctttcgacgcgtagcggcagtaacacacactctctcccttccgatcgtcgccggcggccatcggcggcgctagggttcatcgggttacgcaggcaactgcgnnnnaaaaaacgggggggcccccgggaaaaaaggggcggggggccccccgggccccggggggggggngggaatctcgcgatggaggcggccgtcgcttccaccggctccggcctgcgctgctcgcccaatccgatgcctaagcagcagcacgagcggcgaagtgctcgggtgggcttcgtctcccagccgcgacctcgcgctgtccgctgcgagcggtcgccccatccggatgctcgagcctacgcggcggtggcggtgggggtggtggcgaaggggcgtgaggttgggggcgtcggggtggagagaaggaggctcgcggtgttcgtttccggtgggggatccaacttccgggcgatccacgacgccgctctgggtggggaggtgaatggtgatgtggttgcgttggttaccgataaaccaggtgacgatgacgacgatgctttgcttccttgagctctttgggtggcgatgtgggtggaattgttgggatttattggggatttttgatgtggcttgcaggctgtggaggagcggagcatgcgaggggtaatgggataccggtggttgtgttcccgaagtcgaagtctgctccagagggggtttctattgatgagttgttgaatgctctgaggttgggttggttgctttgatctcaccttcaggctttgacattcgatgttctagctttagtagttcatctgttaggttttagataagtggatttgtagaaaaaaatggtcgatatgagatttttcacacttgcctttagtcttgtttgcaaaatgcatacatgatacattgctgtgtgctgataaaagttttctaatccatttatctgtcttatgtgtgcgagtagcgtttaaatgattttaaacgaagatgaattggtaactatttaaatgattttagtgtttacttattgaatgtgtgccactaccttgttttgccagatgaactttgatatcagttttatgctctgggttgacgtttagtccggaacctgttggagtgtgttcttcatcagttgtacagtgtgcccacacagtcagtcagattagcttccattttgttattgcctagctgatatactgtaatgtaccactgttgattttttcacgaatagccactgcatgttttacggtgtttgtagttcccacttcacttatatcctcttctacaagactggcttgcctactgcggatatttgttttggtcacttgcaataggtctcaagattctcaatctatccttaatttcttatgtgaaacagggaactcagggtagacttcattctacttgctggttacctgaaacttatacctgttgagctagttcaggaatatccaaaatccattttgaatattcacccttcactactcccagcatttggaggcaaaggttattatggtttgaaggtgcataaagcagtcatctcatcaggggccaggtacttcacaatctctctatcacccatcacaagcaactgctgtgcagtttgcatatctactcaatgctatttccatggaaagcaatatcttggcaatcaatttgagctgatatctcacattgtagaacaaaactaaagctcaactatacataggtactcgggtccaactgtgcactttgtggatgagcactatggcacaggaagtactctagcccaaagggttgtgcctgtgctagccaatgatactccagagcaattggctgcaagagtccttcatgaggcaacatatcttatgctcggctaatatttctttgatggaaatggccatgacaattcacttagctgcaaatgcaattgatgatatacgttcttttgctcatttattaaccttatttttcaggaacatcaggtttatgttgaggcagttgctgccctatgtgatgaccgaattgtgtggagagaagatggtgttccacttattagaagtcatataaaccctgaggagtacacttaactcatagtactacctcaaggattgctgtgcagcatgcacgtaatgaggcttctagaatgcctgcattgttttttcccaaggcatgaaggtcactcgtactaattgagataaataacttgtctggtgctgttactgaaacaaaatatcttgtgccgttcaactcaccgcttgttgtgtgactttgctccaacaatgacatgcgcataggccgatacttagaaacctcagtgtttgctggtgtgacttgcggaagcatactggttgctgcatgcaccaagttttttttttttttgtgtgtgtgacagagcggggtggggggggggggagggggtccattgtaccctttagtcttggaattgttgtaatcggctgaagtcaagtcgatcaaagagggagtaaaaactggtcagatcacacaggttttcaatgtgtaatctgattaccatgcttcccatatgttccatccttgtttggtctgaaggtgttaatatttaacccaactgaagttttctttgagattttaaaagttctcttgcaaatttcagtatgcgagagggatagaagaaggggatggtgcaaatgacagccattcttagagaaccctctccgacagaaaggttcctgccaactcttcctccattttgtttttaggtactacatttttgtattgagtttgggttagatgattcttgaagcaattaaggttgtttcttgtgttgatctcccctctcaatttgctctatgttctgaggaagatgggcaggtggttaatataccgtcaagctgcgtttctttcatatatatgcagattgcggttgtggaaacctacatttttagagttcccgacttaagacgactatattttagagtcaccatgcgtgaatatacgcaaccatgaggtccatgactagagagaacaatgcagtttcattattgcagtagaacagcgacactgtgatgctcagctgcagttcctaatatccctcaacaccatgattgagtaaatcaatcacactcattagataatgaaacaggaagaagctaactagtcgcttatgtaaagcaaactcaatcaacccaaaccggattgcaagtacttgagttatgacttgcaattttattatgcattattgtctcaaagcaaaatatcttaggaattacttagcacagaacattagcaatatacgtccatacataaattattgggtccttggcaagcttgctagtgtcctagctaacgctagactgctagatcataattatcgaggaaacgatagcatttcctcttccatggattgactacttgcttctgtggcaactccttcaattgacatgtatagtgctgaaatttgatttttactgggtctacttgattccctatttcccttatggaaggggcccttttttgataatatgttttccagtgccatctctacttctctcattgaaggccgttctcctcctttcaatttagtacacagtgcagctacttcatggacttctccatcttcctcctccttgacttgaggatctattatgttaataaggtttccttctgagagcagcaaaataaaatgtgaaacaaggccatcaccatcgaacgtgtcaacaacaggtttctttcgagtaagcaactccacaagaagaactccaaaactaaaaacatcgctcttgtcagttagtcgaccaatataatagtacatgggatctaagtagccaattgttccttgaacagttgtagttatttcagatcgatctatcggggtgtactttgaagccccaaaatctgataccttcgctgttaaactatcatcaagaagtatattggaggacttaatatctctatgataaattggcattgaagaagctgagtgtagataggacaaagctctagcaacctcaagtgaaatccttaatcgatcatcccatgacagtgagattggaccatcgacatgaagatgatgataaagggccccatgtgaaatgaattcataaccaacaatggaacttctgtctcaaggcaacatcctaggagcttcaccacatttctatggttaatttgagaaagtattgcgacctcatttatgaattcacctatttctctttgaactataatctttgatttttttatggccacaacattcaggtctagaatccccttgaacacgactccatgccctccatctccgacttggcaagatctatcaaaattgtttgtggccttttggagctcctctaaggtaattatcattcgctcaccaaaatctgtgtttcttgatattaactgctgcagtagcaatccatgattttgcttaaagaacttttctttcagttttttctccctgcgttgcttgaccacacgtgctactaggggagtagcaagtaccagaataagaacaattgatccaccagaaactattagagctatgcttagccctgaaaaggaagatccatgaagaggcaaatctagtgaataaatttttgagatatgttggactaagaaagatctaagctataaattttggaatgattatcaaactaccatagactcgctatataaaccgagtttgtattatcatgcaaagataaggatacataaatttggtaagatatacttcatccgtctaaaaaaaaaaccgaatctaggactggatgtgacacattctagtacaatgaatttggataaatgtgtcacatccagtacattggtttcttatgggacggagggagtatgctctttagtgaattgtcacctgtcaaagaattcttggatgtgatgcatcccccctttttaaagggatccccatatccattttgacatcgacaatgaaatgacccatgcgtatttatgcagattccatagcatgaatgcgccggtctgcacactcatcaatgtctacataaacaatacaacttactgaaagtacacacctagaaaggagatctaaaacaatgttgagaaatcaagagatatattagctagttgtgcgtttctctggtagtgtggattatatataaaattttgaagctattaatttcagttttttagactattaataaattaaattgtttttgttcttgagtgcttaaaacaaatttatataacttttaactaaaaaatggtgcaaaagtatgtaatgtaaattgcttgtgcgaatatatgggggttaccaattattgtactcaattatgtatcaatctaaggaagtaacttgttttgttatacatatgtcgttatgttgaaacactcgtatttatctacataccttcgcatccgtttggttgagtagcgttgccctttaagccatctcggcaccgacagttatatcctccttgcgtgttagtgcaatcgccaaaacatggatatatatcgggagaatgacactcatcgatgtctagatatgcaaaattgtattggtcaggagagggaaaagtctgatcgttttagataatgaagaaggaaaagtctaggttggaaaattaattgtgattagaactaaagttatctttgcaaaacgaccacaaaaccatacttggaagaaaacatataaggaaatgcacaaatctacccttttcaaaaagggacaatatccacatatatggggccacttctagcatcatcggtcactattaggaatttcttttgtacgttggtaattataaatcttatagttcatttgtgtaagagtatatatgaaaaataaaatcatttgatggttgattgcacatgatttttaatatgattctttatataaacaatgatccatgtgaatgcaaagtttaaggacccgtgttcataacgtatacctttgcatccatcaatgatgtatggattgccttgataaccataagagtacttgcaccgatacccgttgtttgcccaagcatcagtgtcttggcaagagctatgggcactgcgacactcgggggcagatgaatttctaggacaataacttgtcgaattactgattacccattccagcaaggctgggagcgcttgcggatctctgtcggaatcaaaaataatgagatcgacattggaattaatgaaattggtatagttgaatccctggtccaccatgtagatatttaaaaagtttgcatcaccgtgaatctggatgagataggatgagtagcctaaaatgatgtttgtttgacaacaacaaatgcccgagcacgcacttatcccgaaaattgctgatgggatccttgggcagatgacactgcaggaggcgatcgggttgtcccctcccagcccccagacgtcgacctggctatcgtggcccatcaacactaggctactccccgactccgacaggaagaacggcccgccatctgggaggccaccgccccatgtcccgtttgcgcttccacggccatcgtactccagattgattcggccgctgttgatgcgcacggttccattggggatggagatgtcgagcacctgcaccgtgccatcaccgaggaacagcctgggcgggtggtatgagtggtcgcaggtgaggttgaagccgactgtgtggtagcagccgggctccaccccgaacgggtactcgatgctgatgttaccgcagctggtggtgcagctcttgattttcttcgcggttggcaccgcgggttcttccgccgcagccaccatcgcggccagcagctgcagaatcagcaactgaacatgcactctcctgctgcccactaccaccctgaccatctctgtatatactccctccattttaaaatggttgacaccgttgactttttagtacgcgtttgaccattcgtcttattcaaaaaatttaagtaattatttattcttttaatatcatttgattcattgttaaatatagtttcatgtacatatatagttttacgtatctcacaagttttttttaataagacgaacggttaaacatgtgttaaaaagtcaacggtgtcaaatattttgaaacggagggagtatgttttatcgcaacagattatgtatcgaacgttctatcaatgctgatcctgatatggatttgctggtttgtaattaatctctggtttgtaattaatctccggtgtaactaactatatatacagatgtactctagacgactgaagtagtccctatcgtgcggccgtgcctaactaacgaaattaactactagtatgtagtaagatgaatggattgtgtcgtcagtcaatgacaatcatatatacgttccattctacacggaggtctcagataatatatagtataatgatgatataaaggaaatataaatttgttaattatacttgggtgcgtatgcatcgtgtatcacgcagtgtctcggcatgcagcttgctgcttttgcttttcagcgagtgggtcatgtcgtctcctttaattccctctgtatggtcctgtttagttggtgaaactctatatgggcctgtttagttgatgaaataaaaatttttaggtgttacatcggacgtttgttcggatgtcggaagggatttttggacacgaatgaaaaaactaatttcataacttgcctagaaaccgcgagatgaatcttttaagcctaattaaacagtaattagcatatgtgggttactgtagcagtacttatggctaatcatgaattaattaggctcaaaagatccgtctcgcgatttatatgcaaactgtccaattagtttttctttttatctatatttaatgctctatacatgtgtccaaagattcgatgtaatgtttttgggaaaagtttggggaactaaacagcccctatggtgagaaattagtccatgtgaaatttcccacatgtacaacagcagtatgccagtatatatggcttcgtaagctggcttgaaacaacattaattggccgtacaagaaccaaacaaattggcagtaacaaagcctctctgcgcccatcaatggcaacatgaagatacgtacgtactctctagtcaacagcgtgtagagacttacagtagcggtacgaggaaacaaaggcgcaaatgtctcttttcccttgaagaaatgatcaaatgaatcaaggcaagcaaactctatacgttttcatttcagggtttcaaagcttaatcatcgccttcattttctatatatgtttatatcaacttttcttttacaaaaagagagtactgaaatcaaccgggtcagacacgcgctgctataccaaaaggattccaaagaattgcttgtgtgttgacgacgctaggatctttgatggcgtcaacaagaccccgatagaggtcgcttaattggggtattgccatggaaaaatggtgcgcgtgacgaacggccggtcggaggcattgtaatcgaagagatcttggacgagctgtgaatccggctgatgttgccaggcacatttcatgtgtgataccggcttcaagggcaacaacatccttaaatataatgaacgggtgggttcgaaaggtagggtttttggatggccctaccactaggctggctgccttctttcggatgggaagcaggccgggcctgatgggcgagctgttggaaatttggtcataattcgacatattttaattcaaaataacaagataataaatatgatatttacaatgggatttgatccagtgatagtggtgaatgtaatcaacatgagcatgcttaatgtagaataagcatcaacaatcacataataacataatgttgacattgggatgaacattaacagtaaaacttctaattgaaatattgtaagaatgttataccccaagaattgtcctccgctggagtttgaggcagtattgcctccgttggtgttgacgggagcctccttctccttgtatccagtgttgccgttgtctccagtgttcgacatattggtgaaggtgaagtagatgttgacgaacagtgagtagtcgcgccttgcactccccaaaaacctgatcgcccgcccgtccgtgcaaacgtcgcagcagcgcgtggtttcggaggcctactctcccaaagcgtgtgcacacactcgtcgggatgggattaccgtagcagcaacagcgttggaaaatggatgaaagtgtgtctcactgttctcgcgggagatcaaatccattctcattttataagaggaatggaagatgaaaagtaagagtcatggaataggaagaggaatagagcaactaattgtcatcaactagccatgaatcatcctccactacacaaccatcaaccaataatcaattaggagtaattgatgtaagttaccaatggaataggaagaggaatagagcaactaattgtcatcaactagccatgaaccatcctccactacacaaccatcaaccaataatcaattaggagtaattgatgtaagttaccaatggaataggaagaggaatagagcaactaattatcatcaactagccatgaaccatcctccactacacaaccatcaaccatccatcaattaggactaattgatataagttatcaattccctaatcaaatggattaattctcaaaactcttcatcccattgatatcccataaaagaatgaatacacatgaattactagcataatgagccttggaatttatttgatttaattgatttaaatggatcaattacccaattaaatctaacaatccccaccaaatttcaaggctcatgagaatgctctctattccatagcagcttttatataccagtgtttcggtgaagactgttaagttgaactttcacctagaaaaggagctacacctgaccacaactgaacaatggactatgccttgaattgtcagtcttgtgcagttaggtttcactcaattccataactgatactaggcaaccgttagtattccctcgggttggagcttataagtcatactccaggcctttcatgagtatctagagatcatccaaatctcatagactgtgactagcagtcgaactcatataggtgtgttccttctaagatgttctgcaggtcaacatctctgcttaatgaaagccactcggaacacattgaggcataaagccatgctaccatacagaatagaagagaagtacatcatgaaaatgagcccatttaagggtctcttctctcggttacacaatagtttatttcgccatccaaattcacgggatctccgatcacaatggacaggtttccactattgtgcaactctaagtgggtctcaagcccatttccctcgatgcactgtctatcacattacgtggtagccccttggtaaactgatctgccagatttttagctgtctggacatagtccagtgctatcactccggagtttttctgctttctgacagatttcagtcttctctttacatgcctagatgacttcatgttgtccttcgaactgttcaccttaataatcactgtttgattatcacagttcattagtatagctggcactggtttttcaaccaccggcaaatccattaggagttcacgaagccactcggcctttactgtggcagtatctagtgctgtcagttctgcttccattgttgacctcgttaagatggtctgcttgcaagacttccaggaaacagcgccacctccaagtgtgaacacatatccacttgtggcctttatctcatcagcatcagatatccagtttgagtcactatacccttccaatatttttgggtaaccagtatagtgaattccatagcttattgtaccctttagatagcgcatgaccctttccagagcttgacaatgatcatctcccggatttgaaacaaaccggctcagcttgctcacagcaaatgagatgtcaggcctcgttgcactagccaagtacatcaatgaaccaatgatttgggagtatctcaattgatcccttgctattcttccatttttccttaatagcacattggagtcataaggagttggagctggcttgcagtcactataaccaaagcgactcaaaaccttgtccacatagtgagattgcacgagtgtaatcccaccctcatctcctctcagtagcttaatgttaagaataacatcagccacttccaaatcctttatttcaaagcttttggacaaaaagtccttaacctcctcaatcacattgaggctggttccaaaaatcaatgtcatcgacatataaacacaagatcactccatctcccccaccatagcgatagtacacacatttgtcagcttcgttcacaacaaagccagcagatgtaagtgttgtgtcaaacttctcatgccattgcttaggtgcttgcttaaggccatataaggatttcaacagtttacacaccattccctcctgaccttctagtacatatccgtctggttgatccatgtagatctcctcttctagctctttgtttaggaaagctgtcttaacatccatctgatggacgagaagaccatgagagactgctagagcaagtagtactcgaatcgtggtcaagcgggcaactggtgagtaggtgtcgaaaaaaatcctcgccttctttttgggtataacccttggccacaagccttgccttatacttttcaattgtaccatcaggcctaagttttttcttgaaaacccatttgcatcctacaggtttgcacccatatggacgctcaacgacttcccaagtaccattagacataattgagtccatctcactgcgtaccgcttccttccaatagtcagcgtcaggagatgaatatgcctcttctatggttcttggagtgtcatccacgaggtatacaatgtagtcatctccaaaagactttgcagtcctttgtctcttactctttcgagttgctacaatgttaacctcctcaggattttcctcaggcgtttgatcattgtgttttatcggtgcaaggtgctcatggggtaaaacaggttcttgactagatgtgctaggtgtatttttcatgggaaattcattctaaaaaaatgtggcatctctggactcagtaattgtaccaacacgcatgtcgggtactccagagtttactattaagaacctatagcccatactgtggatagcataaccaaggaacacacagtctacggtctttggtccaattttacgctttttggctataggtacatttaccttggccaagcagccccatgtgcgtaggtatgagagatttaatttcttcctttcccattctttgaatagtgttacttccttatgcttcactggaattttatttaggacatgacaagcagtaaaaattgcctcaccccaccattccttggaaagtcccgcagtgtctaacatggcattcaccatctcagttagagtgcggttctttttttcggctacccctttgattggggtgaatagggaggcgttctctcatgaataattccaaactcttcgcaaaaggacgtaaactcattggaaaaatactctctacccctatcagacctcaaccgtttgattttcctttcaagttggttttctacctcagctttatagatcttaaagtaatgcaatgcctcatcctttgttttcaataggtacacatagcaatatctagtgcaatcatctatcagtgtcatgaaatatttctttccccctttagtcaacacgccgttcatttcgcacagatcggaatgaactagttctagtggtgccaaatttctcgcctcagatgccttgtgaggcttgcgaggttgtttcgattgaacacaagtatggcacttggaacctttgaccaaagtgaattttggaattaaactcatgttagccaagcgcgtcatacaactgaaattcacatgacaaagtcgcgaatgccacacattggactcatcattctcgctaatatggttcacaacattattattattattattattattattattattattattattattattattacacatgtcatccaaagaaaaacggaacagaccttcgctgtcataaccttttccaataaaagttccatatttagatacgacacatttattggattcaaacacaagtctaaaaccatctctacatagtagagagccgctaactagattcttctttattgaagggacatgctgcacattcttcagctgcacagtctttcccgaagtaaacttcagatcgaccgtaccaacaccatgaacagccgcaagcgactcgtttcccatcaacaaggaggaacctctcccgacctgataagaagaaaacagggaaatatcagcacacacatgaatattagcaccagtatcaacccaccaatcaggtgaatgaaaaacagagagaactgtaggtaaaaaattaccgtaccccgatgttcctccgccctcgctaataaccatgttggcagacttcttgtccttgcgatcaggacaattcttcgcccaatgcccaggcttatcgcacacaaagcagtcgcccttgccctttcccttgtctttcttcttaaaattggttgtagcctttggtttgacatcaggctagactttcttgttgttgttgttgtgggatgcgtgagggttcttcttttgcaccaaattggcgctagaatttccctcgatatttttgccccagttgtcctttgctctcgccttctcctcaacacccaaagagccaatgagatcagtaacattaaactcttgcctcttgtgttttagagaaatagtaaagtccgaccaagaaggtggcaatttggcaataatgccacccgccacaaacttgtccggcaactcacagttgttgttctcaagttcctttgccagcatctgaatctcatgagcctgttccactacagaacggtcatcgaccatcttgtagtcatagaactgctccatgacatacagctcgctgccggcgtcggaaactctgaacttggcctcaagtgcatcccacatgtccttccctaaaggcatgtgaatgtacacgtccactatattgtcagcgagtacactgatcaatgctccacggaacaggcaatccgaagcctcgaacttagcctcctcctcaggagagagaggcggttcacttcgtttgccccgtgaaacatagaagcattgcatcgctgtcaaccatagtagtgcacgtgctttccatctcttataattagaaccatcaaaagcatgtggtttcagtgttgcagcaaagccaactactgaaaatgacctatcaggtttttggattgttggaaatttggtcataattcggcatattttaatccaaaataacaagataataaacatgatatttacaatgggatttgatccagtgatagtggtgaatgtaatcaacatgagcatgcttaatatagaataagcatcaacaatcacataataacacaatgttgacattgcgatgaacattaacagtaaaacttctaattgaaataatgtaagaaggttataccccaagaatggtcctccgctggagtttgaggcagtattgcctccgttggtattgacgggagcctccgtctccttgtatccagtgttgccgttgtctccagtgttcgacatattggtgaatgtgaagtagatgttgacgaacagtgagtagtcgcgccttgcgctccccaaaaacctgatcgcccgcccgtccgtgcaaacgtcgcagcagcgcgtggtttcggaggcctactctcccaacgcgtgtgcacacactcgtcgggatgggattaccgtagcaacaacaacattggaaaatggatgaaagtgtgtctgactgttctcgcgggagatcaaat

SEQ ID NO: 68522 - DNA, 11780 bp, Oryza sativa
aacaccttatattctgcttctgctactagaaagtagaaatatttccatttctcaaaacagctaaatgaaaaaacaatatgaacatttcgctgtgaagggaagtaaaacgaacaatccttttagcatatgaagtggagtagagcaccatggagttgtccatttagattagataagctgtctaacaggccttgtgtagaaaggacttccattaattattttggtctccctagctaatttgtgctttacatagagtcaaagattgcaattcaagtaaacatcattctaagcaagataaacaaaaaaaagagttgttctccatcactttcatgcattttcctgttaaatttaagctcatgtgtatatattaagatggttaacgtgtcaatcagatagcggttaattttatgctccacttcaaaacaaaacacatgtgttcttaggaggaaaatgcatcaccctacaggtctacaaagaaggtttgtgatcagctggaactctctaatcattgttataaaaaagaagaaagaaatccactttacatctcaaactttcactatgttttttcagttggtacttcctttaccggtgaaaatattggcggatggcaaaaacagtatagcaacgagctcaatcccttctttaatgcaatgatacgcagcttacctatgtgtttgagaaaaaaaaattagctcaagtaaggcactggaagaggcaatcaactgaaagaagtagaattgacagttcacatgaagaaaccagaattggtccaaaggttcatgtaaattcgcccctaaactgtcttaaatttggcccaaaactgcgcttaaattcaggctgcaaatgctattaattcagcccataagtgttgttaaatttagcccagaagtagaaatatacttcgcctaaaagtttgggtcaatatgcccaaaaattgcgagtagaatggcccaaagagttggcgtaaaataaacctaggggttcgtatcaattaggcccaaaagttgaacgtaaattaggcccaaataggagatgtttggaccaaaacatctggtaaattcagcctgaaggttaacatacagtcgggctacatctgggcgtaaattgggccctcaagttttaattaaatttggcctaaatgcaaccctaaattcagccaaatagtgagctaaatttcggcccgaaaattaagaccatagtatgcctaattttgttctaaatatgcaggtgaattttgctcagaatcgcgcgtaaatttgggctaattcggtccaaacgtattcattggcggcttcgccttcacctctaccggccggtgcgccattgattctccaccccttctctgcttctcctgttctccagtcctcctcttggttggtaatttgatggcacaagcgcaagtgcgcaacaccatcacaaactcactattacagaaacgattttttttcgaacgagtgtcccttaaggttgcaaggtactctttcatctgtgttcccgccaattcatgtacaagggaaagcagattcgacatcccctgcaattatacagcttttgcggtttcagctcatgcattaattgtgtgtagtattaattttctttctcatgggcataatacgatcgaaatgtagcaggtcagcatgtggcacgtacattttcaaaagcagttttaatggattggttgctacctgcagggcaagtatgtagatggttgcttctctttatgctcatctagctatatgttaagatcacctcttcattcttcaccacctcatgatgatgaaggaaatactcatggttgcaagagttatacacttgtggggttggagttagttgttggaaaaggacagacaactgagctgaaatcaagcagcaaatgcttatctttcgaagccaaatgtcaactggattatgtttcctggaaagattaatttgcaccacattagcaaagtattgttggacattcttctatcagggacacaattctgagcaaggactataagtctgtggaactatgcttcttactgaacgagatcatatatggatttgagtacacagtttcgactaaggacccttgcactttgaaaattccaagcaaaagatgtctatccaaattactgttcccagagttggatttcaaatccattttcagattccattaaagaaactaaatccatatgctgacatgctgttgtgtgtaccccgcatgaatgaatttctgttgttatgcagttttagtgtaatatgtggtttggtttgtgtagttctttgagtccatatatatgtatatagttggatgctatttttttccctattattttcctatgcgtggacaacccatgttcatattctgtcagtttccagatcacttttgtgcaaacttcacaatcttgatgtattggtaccatctctcacagtctctatgtcgtatgtgcgacaataaaatttcttgtgtcatatctgtggatggaagtatctataatggacataagagtatagtttctctatacgttttctctactaacaattaatagcatatgaatgaagaccattccttcctgtactgccttggaaaatcctttaagaaaaagcaaagcaagtctctcttctttatgtgtagtatttgattaactagcaccatgcccaagacactatatatatactcccttgcagggaaagttgtagattgtcctgatcagggccctgtttggaagattagctcaaggctaattttgagagctaatgtttagtcataaattggtaggctaaacattagcctagggtggtatgtttggatccatggactaattcaaggctaaaaggtggagagagagtagaaagagaggagagagaaggagagaaagagctgtttttttatggtccccacacaaaattagccccattagcaccccttggaggggctaatgttttgaagggggctaattcacattagctcaaaattagcccacctatttggatccttgagggctaatttgaggctaaaagatgagggctaaacattagcccatggaatcaaacagggcccagctatggtatgcaagaaatctcaaccaaatgttctccaaatgttcatggtcattcattgtaggcattatgcagagagtaggcttggaagacacccggaatggaagttacaccacctgtttggctgtgctgactggatggttatatatggcctaagcgtcttgtctaggattaacagggagtgtcccgaccattcctgtggctgcggaagacagtattctacggtggtattagtgaaatgaagtgagggagaaaggaagacgataggtttcagcagtaattgattatagatctatacttggggaagctgaagaaccgatcgattgggctctatacggaagctgaagaactcattctgagatgatgtattttagagtattatttatggcaaaatagtgatgatacaatttgtattaaaaaatatacccctaattgtagttaattcgggtttactaatagcagtctcattccaatagttgtttattaaaagtgcacaaacggttgtttctttatagtatgatcgattaatgcgatgtacacaacagtattgctaattcgtgtgcgcgccccagcaacatcatctgcgcttcctcccccacgccttttttcccgttgtttcccttttttttcccgcttttttccgattatttatttaatcttttagcacacgtgttttttcaaatattttgagttgaaagtttttaaattttaacttgaaaatttctaaatcttaacttaaaaattttcaaatttggacttgaaagttttcaaatccgagtagaaagttttcaaatcttgagttaaaagatttcaaatctgagttgaaagttttcaaatctcgagttgaaagttttcaaatatgggttgaaaattttcaaatttgagatgaaaaattgaaagttttcaaaatttgacttaaaaaattcaaatttcgatttaaacgttttcatatatgggtttaaaattttcaaaatttggcttcagatatagattttattttcaatttgttagttaaaaaaatctcacgggaagaataaagtcttatctactaccgtcattatctcatgctgtcgttatctaagactaatactagtctaaccaccttatcccagcaaaaacgcgcgttggcagcgcatacgcgccaactagcgatcccccgtacacaatcaactcacaatgtccttgctatgcttatgttgtaaaaaaaaacaaccatctctaggctctgagatgatctagtgcggcatgagtccaaaccactggatccgaatgtgccagccattgttgcctgatctagcattcctaggtgatctcatttctatctctggcctctcttcttttacaatgcaactaggaaggtagcccgcgtattcgcgcgggtatggacggtagactatgtttgaaaacttataaaggtgaaattttaattggaacttataaaagatcattttgtttatttggattatttgagcatatttagaaaaaaatattaagtaattggaatattttctctaattaaagacactcgatttttattgcatcggctcaaactattcttatttacgtagtgtacgtttaatttagctatacatgtttcaaaacatgtcatggtgcgactccatgttattgaattatttcttttccttttggcaaattaaatatgaatttttttcagatactattgatttaatttagctatgcatgtttgtagaatttttcataatgatatataatgtcactttcttttcataattttttcaagccaaataatagtctacaggtgtattaatttctaatttgtgattaattctaattcgtgattttaatcataagtaacataatgacacaaatagaacgtataatttggtccaatagaaaaaataacttccttaaaagagaaatagagaggaggtatgtacgtttgtatggtttgcacgcacgctgcttgcattggaagaggggacatctaaagaatgagaaaaaatcgatctaatccaatgactggacctattaattttagtgaaatcaaaggctagtagttatttttctcggattttctaagattttctctaatttattggagtgccacatggtgttatcggagcatttatatgagtgtcatgtggtggcttaggagcgtttatagaaatttttatggacttttactatataataatagaatgattggatatcgtcgaaatatatttgtagaattatttaagttgacatataatatatgttatcaacttttttaaataaaagaatagaataacatatatcttgaattaaataagatatgttactattaaaattgaaattaggaaagggaaggggagatgaggggagacagggagtacgtacaggaggagaacgtagaggagctccggaggggaacgtagaggaggtggggaccggtgtggagaggaggattttattttttttatttgatctaatggttggtaatattgggcctaccaatttaaaggaaaatcaacggttagatttagactgccacttggcaacttaggagcgtttgtaggaagtttaatggacttttagtattgtcgacgggggatacgctggtacaaggatctacgtaatacgacatcaagcagacagaaaacagagattatactggttcaggccccttgataggtaatagccctaatccagttgatatgggattatatgatggaaatcatagattacaaagggaacagtggaattcgatggtaccggcgagatcgtaatcgagctggttcgactagatctcccggcgacttggctcctgtagactccgacttcgtaggctgtggtggatgtgttggctatgagattcgatgccttaggtcctctcggggggtcccttttatatcgcaggtcaggcggtttccaagtagaactcggagacatcagaccctgcacgatacagtgacgacccagtcctgtccgagtaggactccttccatctatgaactccgtgatgaatttccttaatgtatgtagaaaacgtccgtatacgcgcaggtataccgtaccgatatgtgacgtatatcgaagggtagagggtataccttacccgtaaccctgacagtagccccttacttctgcttaaatgaactcgtgtaaccgatcacgacttctgatgtcgaggttgttgtcgttctcggtgtgaggaccgtagatatagggagtaatcgacaacaccatgtgaagctcaacggtcatgagtgaatttaaattgaagtccgaaaaactgccgcgcgtaacggaccaagaaatttccggcgaccatctctctcctttccttggaattcgcaccatcggaaatgcgtctatttaaggggattttggggatccattttgaagtctgcctgttgtaaaaaaactcttcagcctccaagcgttcttcgttttctccggctccgcacaaaccctagtctgcttatctcggtctcttctccggcgatctccggcggcaatggacctcgacaagtccacttccactagtgcgtccctgaagaagttgcaagaggagggcgctctcctcggtcgcgggaccatggagagggaaccaggaggtactgaacctgaacctgttctaggccgtatggttgcggttgaggactatattctctgtggtattctcccccggccttctgagtttctcctgctcgttttgaatttctacggtctttctttgctccatttgaaccccaattccatcgccttcctcagtatcttttcgcatctttgtgaggcctacattggggtagagccgtttctcgacctctttcgcttctactacgagttgcgtcggatagaatccaccagggtatctggatgcgttggtttccgactttgggatggcctgaagttgcgctatatccccttccagtgcccttcttctcgtagcaagtggcaggcgaggtggttctatcttcagatagaggattcagatccaatctttgttgttcctgaggaacaaccagacaagattccgtcttggaccgccaaacccgtcttgaccccttctcttcagtccttcattgatgccatcgatgacctccgagtacggggtttgtcggggtatgaagtcgctgccgacttcattggtaggcggatccagccactccaggctcgagcccacccagcctttgactattctgggccggaggacgcgacccgggtttctcctcggggtatttttcttgtatttaatttgacttccttatgtgcatgtttctcctgacttaccgaattctggttctcggtctacaggtatgaacagcgaaaccgtggagcgtcgcgtcggccaattgatgatcagtggcctgacaacggcgagcaatgtccccgtccccctttgcgagaaggagaaggctgagcgtgaagttgcaatcaacgtgagtgtattcgacgacccttttatttttgctcctggatcgcataatgacttcatgcggtgcaggctctcctctgaccgacgtcattggactgctcgtggaccaccaggcggcggcctcgttgaaggagggcgtctcccaggaggcatctgacatggccattgctgctgctgccacgaccagtggcagccatgtcccgaggaaggggaggaaattcacctccgtgctcggcagccgtcgaaaagcatcctccccatcggtaagtctcttgggttgttaattacgtagtcgaaggtgtcaccctcacgttgtactcggtttacttaggccttggatgcgtctccgccacctccacgacgacagaggctggtgacacttagcgagaagtaagtggacgaaatttgaggtccttcccttgattgaattctggcgacttgtcttgagggccagtcatggtaatcttttgtaggtcggcgcgggcgaaggcggcgcaagacgggtccggcgggaactccagcgcgtctcctgcggtggcctcgacagatgtcgtggtcgtgcctaggagccgtgaggtgacgcccagcggccctgttagcgatcttgtgcccgttcgaggcccgcctgctgacgtcctcacctggggggagctccatgtcgagatggggcgcatcctcgaggccggtgctcgcggcataagtcgcgagattgcggaggcgagggtggcggcgtcgtcggcaaacgagcgtgccgacaagctggtgcatgacctggcggaggttcgtgaggacctccagaaaatgagggaactagtggccggcaatgagcgacaacagcggggactcgagaaccgcatgtcggaactcgagaacaacctgtcagagatccgtggctcgttgcgggtcacctacaccggcctgcaccaactcgccggggaatgtggtgttgcgaccaccatcccggtgaaccccgacgagttctcgctgatgacttcgctcacagaactggccacggcgatggaggcgataccctccaagcatgcggccaggattggggaggagatgtccaacgggatttacaccggggtgtgtcacgtcctcgcgtgcgtaaggttggcgcaccctgaacttgatctccagcggatcttggattagggagcgaccaacgacgcgcgtaagggcgtgatggaagaagttggcgatctgggagagtctgttctcccactttttgaagagtaggacttcagttcccttgtactctctaatcagtcatgctttgtaaaacttttgttggctccaactgcctttgtgtgtgtagtcatcaccttaattttctttagcattttgatcccgagtactttgtttgtcgtttgtagagatgtcgatgtcgaggatgtccagcagcgcgggcaacctgagttgccagtgatcgttccggcacttgcgttcgagccacatgtgtcgcaggacgatgtagatcaaaatttgcccgtggaaacgggcatggcgacgacttccttaggttggtcatctttgttttcatctcctttactcttccgtctggattgacttgatttgctgtgttctcgaaagagaagagcagcttgacttagtcgtttccatgctgagcagatcttgagagtgcgcttgctgaccaagatcgtcgcatccaatattggaagacgaaatttgaggtagcggaactcaagaggactatgctagatgtgaagaaggagcaggccatggaaacactccggggtcgcgaggtatggttcaactcgtacctgaagagttgatgcacgtccatgacaagagtctgtagggagctccgagtaccccgtggggatcccgaggagtcggcggccggatacatctcgtggctgaatggggcctgcacccagctcgaaggcatcggcaagcgtattgatgaggctcttaagcaggagtgccgtcgatcgagccgatatgccggatggcatgtattggcttgcatacgagatcatcgcccgcagctacacctcgagtttctccacgaagggttttctcgttcttggagaactcggacggagatagatcacctggcaaagtcaatggcgccgctggcagagaaggtgttccagtctatggactggcgttggccttcctggtagtctctgttccctgtgacaaatatcttagggaaaagtgtaataggatttttacggaattgtaggaagtacttgtgaaatagaaaagaaaactatcttaactaagctttcttactctggacgtagtgtgtaagagtgtcttctcacttcgcgactccaatcagtcgtttgagttatacactctccctagcccccagccttgtcatcggagaattcttctcggaagataaggctcttggacctttgacctgcctcggttgaacaagcactgatcctagcccccagctgtgaagttggaaaattaatttccgattacacggcttggttaatacacacggtgagaactcttacacgaccagatcttacatggtctttcgtctctacaggatccgacaaggccttatcggctctgggcgtccccagctgaagatcccttaggttcctcggaggccttgtcaagacggcgtaacgggacatgaggataggtttcaacgctaggtgtcatctgggttagggaacattgggaaggaacactttgattgtaatctgtacatgaaaataggctttattgaaactgtaagatgtcttgcaagtatggatactattgacttatacatagaatttacgtaattaatcaatgttccaggaatttgccaactcgccaccgtcgccgtctgcaattttgaatgcgcctggccgcaagacttttgtgatcgtgtacggtccttcccatttgggtgagagcttgtttcgccctgcttggctttgaacccatcggaggacgtagtcgccgatcgaaagcgtgcgtgctcagatgtgcttttcgtggtaacggcgaagggcctgttggtagctggctgctcggacggcaactcgttcgcgatgttcctcgagtagattcacatcgtcgtttcgctgctcctcctgatcctcatcggaatacttctgtactcgtgtactttgatgtcttagctcggtggagagcacggcctctgagccgtacacgaggaagaagggtgtttccttgttatacgttgtcggtgtggtacgcactgcccatagtactgatgggagttcttcgacccacttcttgtcatgtgacatgagcctgtcgtagacgcgggtcttgattccttgtagtactatgccgtttgccctctcgacctgtccgttgctttgagggtgagaaactgaggcgaagcagatcttgactctcagcccgatacagtaatcctggaagtcggcgctgatgaactgggagccgttgtcggttatgatgcggtgtggcagtccatatctgcaaaatatccctttgatgaatttgatggcgttgtcggccttgatttcccccgtcggtgtcgcttcgatccacttagtgaatttgtcgatcgccacgaataggaacctgtagccgccctgtcctcgtgggaatggtccgagcatgtcaagcccccagcacgagaatggccaagtaagagggatagtctggagcgcttgcgctagtagctttgtgtgtttactgtgaaattgacaggctttacaccgctgaaccatgtcgcaagcgtctttgagggcggttggccagaaaaaaccttgtcggaaagctttttcgaccaatgtgcgaccggctgcatgtgatccgcagatcccttcatgtatgtcgaggaggagatgtctgccgtcgtcggacgagacgcatttaagaagtaccccgtttggcgctttcttgtatagatcgttgtcgatcatatagtagatttttgctttacgggttattttctcggcttctgcgtcgtcctcgggcaactcttcgctgcctatgaatttaatctgtggggtgcgctagtcgtctgtggtcttgatatcggcaacggcgcgctctgcctctgtagcccccgagctgatgttggggacgactgggctatcttcgccgcttgcctccttcactaatggctttgtcaggacgtctagaaaagtgccgggttcgagtggttctcgtctggacgcacgctgtgctagattatccggctcgatgttgtccttccggtatacgtgtcggaccttgatcccatcgaaccttttttccagcttcctaacctctgcgagatacttggataactcggggttagagcacttgtaatctttgtgcacctgcttcgcgactagttcggaatcccctttcacgaccagtt

SEQ ID NO: 68523 - DNA, 6102 bp, Oryza sativa
  unsure (1)..(6102): unsure at all n locations
cttaagttttgtttctgtttttctacgaaaacatcaccccgtcgtaacttgatgttccatcctcgcaggacctcgtttgccttcaagcgcccctagcttcggagcagtgcgacctacagcaccggtttcgcacggtacagttcagcccagatattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacacttaggagcagccagaggtcacacctgtacaggcaggacgggttggccgtgccgtacccccggaccgactcacgtactctcaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaataacttatgctcacgacaacacactttcggcgcttcacggtagtgtcagatccagtagcgcgcacagtccacaacagcacacatgaaaagcggcagctcgagtgatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctctttatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattatattttaccagtcttggagattttaatcttgtatagttttcaatataaaaagatttgataactattgatatttatacaaaaatatagagcacagtataaaatcgccctaccctagggcggcaagggggccgcctgcaaaattccatgccccccctcgccgcccatttgcaggcggccccccgcacagtataaaatcgccctagcggagggcggcaagggggccgcctgcaaatttcgttgacggccgtcgcccgagagcgaacagccggctgccacgtcattttcgccgccctctgggagggcgatttttcccagagagcggtaggcgactacttccgtcaatttttaaaatggaaaattatttttgtaaaacttttaataaaaaaaattctagtcctactgtactagttacccgtggaagcccgatagttttgcacccgggcctcgtcgtctcgtcgtggtcctttcctctcagaagtttgggccaagccgaggcctaaatcgttcttgtttggaagcccggtagcccggtattgataggcccaaccatgtacagaacaagagtacaagactaacaagagacttgggcccgtttgattgtttgtctggcgttaattttcgcgaactgctaaacaatgtttcatacaaaactttgtatgcataatttatttaaaagattaataaaaattctatctgttagcttctaatatctattttcgcgaactgctaaacaatgtttcatgcaaaactttgtatgcataatttgtttaaaagatttaataaaaattctatctgttagcttctaatattttctttttataaagttaatactcattaaacacctaaaatttaatatacaagcataatatttattagtaatcctaaaatttacatacaagcatgctacatcaattcattataagcacacaaacctttccatacaagcatacattaattatatctacaatttatttcattctaaaactaaacatacacatgctaaatcattattttaataatattttaatccaaatcatttttctattatctaacatatatcccgcagtaaaacacgggacaacttaataattaatcatgcactaatcgtttcacgatcagctcgctaacacaatcgaacatttcgcagctctttactttccttcggcccaattgacagataaaaaaaattggcccagtgcggtctgaatgattacacaagtgcgcccagaaggcaaattctacacatgactacgtcgctctacgtgtacgcctttgctcttagtacacggaacgtgagccttgcggcggaagtagaagaagaacatcattaagaccaaatcaggatgagcagtgaacaaaaaatatgttcaaaaaaaatccacataaaccctcgcttccgaaaaaacccgcatcgccgcgcggagcaaagcagagagggggaggaagccgccgccgccgccgccgccgccgtcgcacggggggatggagtcgacgccgaagccggaggacgggagggagctctacgcgctgctccacctctcgccggacgccttcggggaggaaattcggcgggcttaccgccagtacgcgcaaatctaccaccccgacaagtaccaggacccccaggtacagggcgctgctccgcttcctccccccatggccccatctccgcgtcgcaactttcaattcgatcggctcgaagtgctggctggcttagggttgcgcgccacgcttagctccgtgatagattttactgatgaaacgccgatcgattgactcgtcaggtagttgcgagctgtattgggattcggttggagtagttagttttcaccggtttgatcgggtagtgcccggctaggattggtagttgattggtctcgacactgaccttgctgcgcttgtttccagtgaatttttcacaagtttgcattgagagacggagtagagatcaaggggaagatctgggcaatgtatgataactaagggtccacttagtgctcatgggagatcattaggagaatcagtaaacatataagatgataatgggaaatgctgataatttctaattactgcttgtgccaaattgcacacatatctggtctgtttgaactggctatatatcatttgcaccagtattatggtctgcaaagagattaacgtttggtagtaggcattgctctagtgccatgggaatcggagagataccaatatgctaaattcgtctgcatttcttgcttagagaagctgcatatctgaatagcggcaaacatgttcatttacttcatttacaaccatgttcgatggaacaatccctgatgcttttttttggttcagaatgaaagttagggagggatgtgacactaaagtaccagccttatttaaaagagagcgttatacttttgtgaaccgatttatgaagattattaagattaatctagtgagtaatcttgacgttaagtccaatcttcagcttcttcatgcttcacagatgcattcagatgtttatagtgcaccatttgattctccaggctccccattttaaacagtaatttgtcctaagatagattcctgcttctggtataatctatattttgttgaactaggaataaccctttgttttacattgatgagttttttttctgaactgactagtatcctccattttcatatgtgtttgtctagatgaaggatgtggcaactgaaaacttccaacgaatacgtgatgcatatgagatactatcagatgagaacaagaggcagatatatgacatctatggtatggaaggtttaaattctggcctggaacttggccccaagctaaacaaaccagaggaaatcaaagaacagttggaacggctgaagcggcgcaaggaagaagagaaatttttagcccatgctcgacccactggctcaataattgctaatttttccgtgccacagtatttagatggctatggaatcatgagagggtacataatgctttccattatattttgtgtcttctttttttctgcagccacgtgcaatattgaagctgttcacatagagtgaagcaatcacctagtttgatatctctcgaactaattagtaattctgtactcactgagctcatttattaatttgtatgcttatcggtattgtatgtaccgctccacattcttcagcatgttttggtgatggcaacagttattcagcaaatggaaatgtttttttagtgaaaatattagtagtgcttccttagaaatttgcacttgttgtttcctttccggctttaccagttcccacccttttatcttatgtcaatcctgagtgcttagaaacacctaggttggagttactacctccagcttgcaagtacaatttacagactatcatgttggccaaatttcgttgatcgcggcaattgcctgcttgtgaaaaagctccccaaagctctggctttagttctgaaaggattataagctgattttgatgtatgcatttttttttaagaattctcagtaaggctaaatcagtatattgtactgttcccatgaactaggatggcagtttaccaatttatttataacctgtagacatatttatcaagtacccttttgtatttcaattcagcttgatacttcccatattcttctgtagctccattatttaattatttgatttgaaaatgggcagcatgggaatgtccagtgaagttcagttgccagtgtccaagaaaaatactgttgttgttggtggaaatttggttgtcaatggcacagatggaactggtgcagcaagcgctgtgctgcgtcaccagttgtcttctgtggcatcagtagagtttatggctacagctggactacgttcccttattagcgtacaaacatttcggtaagaacatgccattttgttttacttctattgctacttgcttgcatattgcaaattataattccttgatcgttatgcactccagtcaaatttcaccacattcgacagcaacatctggacttgctctttctttgagagatggatctatcaatctatcaaatgcctggactcgccaactatctgacaatattgttgggaatgtatgtccctttattcttgatgctcttttcagttttctgatacactgcttatttcctatacacaactaagtaactaataggctagcaacttagcaattcaaaaacatggtaacatggatagattaacatataaaaagagcacggataatatgtgtacaatctgtgatgtcaaacgccgttgctgaaaaaattactcgagttctattcccaccctacatggaaccatgaaactgatacctgtttattttcaatatttgcagagcctcctaggctccctgctaattaaggctgcatagtttttaggaaaatagcacatcttttagtgccccccacccccatctttccaaacatgacttttggctccatgtttaattcatgtatagaacaacttgtcaactgttcattttacatttgatgcatattatagacactatacatctctttctggataagttacaagaatttttcaaatggcataaatccaaaatgagttttatgtttgctctcactgatttatgctctactaaggctgtgttcgcatgcaccttttcccatcccctctccctcgttttccgcgcgcacgcttttcaaactgctaaacgatgtgtttttttgcaaaaagtttctatacgaaagttgcttgagtngcagtgcaattcaatggccac

SEQ ID NO: 68524 - DNA, 25927 bp, Oryza sativa
aaaatcgtctcgcggtttcccggcgagttctgaaattagttttttcattcgtgtccgaaaaccccttccaacatccgatcaaacgtccgatgtgacacccaaaattttcttttccccaactaaacacagcaaggtttaaccatgcaccacttagcaatacaattattacaatctattaaaagcacattaacataacatacaacaaagtaaataaataaaataataggaacccctacactaacatgttacaagtcagctgtaaacacatgtgaaaaagagaagagaagagaagagaagagaagagaaggaaaacaatctatatattggtagccagttgtagcacagactctaatactgtacagactctaataacacgtgagtgtataagaggtgagaccatatattaatggtgtaatatatgattatagctaacttagctattagatcagctataaatgaattggagctaatagttggttatattattaaacttactctcatatgctttccctttctcagctccagctcattcgctattcgaagaaaaaaaaaactaccaccaaaatacgcaaaaaataataccagtactagatctcgactaatcccgcgtcacgaacttgctaatcagtcaataaacctaatcaggagacaccaaaccaccgaaaaaaaaaggagagaaataataatattcgcgcatccatcacgaccccaactcgtcctcaatcgcggccacccgccgacccagcgacgacagcgcagggaagaagggaggacgcgacgcgacacgagcgcgagaggaaagcggaggagatcgaggagaaactccatttccccccccctcgccttctccgatttccctcgcgtggaatccccttggactcctccccctcccgccgccgcgcgagccgggcacggcgagcggcgccgccctgcccccgccgatctgctctgccttctcctcaggttcgccgtcttgttggattcgcctttttttgcgttcgtttcgggcgccgtcagatccccgcgccgtgtttggtgagcgtgagctaacggaatggcacggccagatctcgtgggggggatccgaggcggtcggcggatgctagatctggggcggggagctgtacgatcgccgccgcgttagatctggtcccgttgctcgcgccggattccgctgcttttgttgttcaaattgttttggtttcgagctttacctttgcgggctattgggttggatgctccgtgatgcttcgaagctacgggagaatgttagtgatgatgcttttttggatcttatggacgaattttatacaggggcttgcaccgaggaggaggaggaggagagagctgagcagaacaagctagattctcaaggaagggcgccatgaagaaagtattcgatcaaacagtccgggacctgtacgtgattcacctgccatcttatcgtataccgtgtgcagttcgagctccgttcgtttgcttgatacaatatatttctgtcgtaatttaatctgttctggtctttgtttttgcagaaaaagagaggtgaacaagaaggtcctcaaggtgcctggtatagaacaaaaggtaacagagatctctgctgctccctcacgcaaaagcatgtgttaagcatgatagttactgaatttaatggattgctcgcctttcaattttcatgaagcataatcagtgacatcagacttattccattttgctcgatggcctcatacagattcttgatgccacaagcaacgagccatggggcccacatggatcactcttggcagaaatcgcccaagcaacacaaaattagtatgttttcttcttgggcttttgttatttgatcacctttgtaacaaacaaaacctaattttcccggtgccaatgccctttgcgtgcttgcagccatgagtaccagatggtcatgaatgttgtgtggaagaggatcaatgacactggtaaaaattggcggcatgtttataaggtgtgttttcttatttgcttttaccccttaaccttcagtgttctctccttttatggatgtaagtggaaatagccacagcaatatgtagggcagtttattctgatgctatactatgcttgatatgtagggattgattgtcctggattacttggttgctcatggtacagagcgagttattgatgacataagggaacattcttatcagatatcggtattgctggaaatctattttctgtttcatatactccatgtagtttctgcctcaagtttcgtcagtatcttagttgcttgatgctcattaactttgttattataattgcagacactagctgatttccagtatatcgattcgagtgggagagatcaaggtagcaatgtacggcggaaatcccagagccttgttagtttagttaatgacaaagagaggatacaggaagttaggcagaaagcacttgctaccagggacaagtgagtgtgcttgcttttcgttatattggtacattgtgttttgtggacatgcatattctctgttttattgactacttttatgtgttcatctgaagataccggagtgcattcgccaccagtggaacacacaggagcccaggtggctatgacaatgaccgctatgaaggaagctatggcagtaggtatgataacagaaatggctacgggggagaaagagagtatggatatagggatgatgacagatatggtgttgctggaactactcccaatcgggaaggagatcgttattctagggattctaatgagcagcgctacagcagagatagagaagatgagtacaaaggaagtcatagcaaccatgaatatgcagaaggatcaggtcgcaggagctatggacgagatagggattcatatggggatgatgaagcttattcatcccggtccgtttcattgtttttttctggatttaaatttttacacgttcatatagcagtcaataagcagcctataagattgttatttcattaagttgctaatattcacttggttatttatggttctttatggaccctaacttacatacatttttccatcacagtggccggcaaagcaatgctgacggacctactcaggatgagaggtaaatgatggagaaatgctaagttcataacatattaacttgtcttatttgagcaatttatcttatgttctgtacctccttcggtaggcccatggagcggaagccttctaaccagcagattgcttcaccaccgccaaactatgaagatgtcacaagagatacacaggataataatcatgatggacggtatgtattttatgttataatgtttgatcagtagacatgacaacgatctctgatttctgaactaccgttcaatatcagaaatggagggactgtgcctgtgccagttgctgcagcaaaggtgtcttcacctccaagaacaagtgtacccccaggtcaggtgaatggtgtacatgataatactgtggaagacgtacctgcaccaccacctactcatcctgaagttaatgggtttgacgagtttgatcctcgtggatcagtaccaggtatattttcctccttttttgacacattgcattgcatatgaaccaaaagcccacattaatagaaagcatcacacaatattattttctgatacatttatgaagagaactgtagaaggaatgacccctattctggcattatactagtatcaatatcttttggtagtaattgagtactgattttttttttcaatatttgcatcccatgtcagatacctcacctccagtgaacccctcacaagccgtgaatagcttggaaatggatttattcggaccagatcctattaattcgttggctttggtatctgtgcctcagccaactgccagcccaaatgttgagccatcagcaaatccaggatttgagagtaacagttttatgggcatgccaccggcttctactggattcaatgaggtacgcgtctattgaacataaggccattcacgatactaatctcatgttctaatggtggcatggatctgttatactgaattgtagttctatgattttgtgggcttgaataattgcacgcgacaaagtgacacacactataggacaaaactttatttaaatcatgttgtttcttaaatgtatttaaacagcagcagtagtggtcacagaattgtggtcagtacaaactttttgaattaacatcaagatacttgttttggtgatgggatggttgtgttgttctatgtttatttgattggaatttgccttgtctggtagttaaatccaaccacctgttcatcttatccttttggattttgaccttgcaggcctttgatgcaactaatccttttggggatcctacgcctttcaaggctgttcatgaagaaactcctgcagtttctcagacaaatgctgcacctgctggttctttccatgctactgaacctgctgcagatgcaaatcctttccagcctgcttcagcagcaagctttggttttggagacactcttggcgacctctcttttggatcgaatgctgcacccgggcagcaagatatttttgtgcccacctcatcacattcagaggtaccacctgcaaacccatctgtgcaccctgaacaggcagtcccatcttatgtctcctcccaggcacctcagcctgcagctgctggtccacaaactcatgctgctcccgcttcatttgcttctcaagcacctcccacttcatttgcttctcaagcacctcaagcaggggcaccctatcctcaggctgcctccacatttcctcattcacaagcatctcatcctgcagccactaatccatctacaatccctcagaatgttgccacaccatttgctcctttacaaatgcctcaacctgtaccatcaggccaatcaaactattttatgcaaccagttccagggactggcattaatggcatgtctggggctccttcacagaatggagcaccatcctacatcccttcacaggcttctcaatttgcagctccaacaaatctacagccctctcagccaaccttccccccacaaactgccatggcagcttcacaggcaacatcaatttctcgaggggcatctcagcctcttgcagtgccgaattcaatgccttctggtgtgaactttccattacaatcaagttcatcagctccccctgaaacaatcctttcagccttgcaagttagtcagtctgagccagtgaagaaatttgagtccaaatctacagtttgggctgatacattgagccgaggtttagtcaatctggacatctctggacgtaagtggcttctctctggctgtcttctacacttgtacttttgtacttttgtgatctgacgtaatcttatgtctgttttacagcaaaggctaatccgcacgctgatattggagttgacttcgattcaatcaatcgcaaggagaaaaggcaagaaaagaaagtctctcaagctcctgtggtatctacgatcactatgggcaaagccatgggaactggctccggcatcggtcgggcaggtgcgagtgccatggcacctccagccaacccaatgggtgcaagcaggggcattggcatgggtatgggcgctgctggttccggttacggtggtggaatgggaatgaaccggccaatgggcatgggaatgggaatgaaccaacaaatgggtatgggaatggggatgaaccaacaggccatgggaatggggatgaaccaacaggccatgggaatggggatgaaccaacaaccaatgggaatgaacatgggcatggggatgaaccagggtatgggaatgaacatgcggcctcctatgggaatgggtccaggtagtggatataatccaatgggtaccggatacggagggcagcaaccatatggtgggtacaggtgagattatactgtacaatgcgatactcagtgaggggttgagaaacagtttaggaggcgtttggattttggtcacctggattttctttatgtatggtttcttttgttttgggtggggggggggggttataatttttcatcactattcttttcctatccatgttggatattgtatctactaaatatatgacatgtgaacgggggcaatgctacaactactgtgttgtgttggatgcaaagccttaatactataatcatcaatgtagctgtataattctctataggatgtttttttttcagtaaacattgtgattgtttcagcgttcttgctggcttgacaataaaaaggctgtaccattttgttcaagctatcttcctttctttttatgtcgtcacattttgaggtgcagacctgcagtttttgtgtcagatgtcacccgtcagtctgcaaatagtagtatatttttgctcgtccgaactttggaactacaggaatggcccatctctactgtcgcctcttttctgttctgatgcgtggtcacacaagccactgttgacacagcaactttgtatctccattattgacacagcaactttgtatctgaccataatgaaacgaagaattttgtgagttctttttatttggctgggattcttacaaaaactgcaacctaaccagttaagtacttgaatcttaagtcgaatcttgaagtttgtaaaacgtgtcccaggagcagcaattgtcgcatgtcatttaaccagctgtatgtgaggttcaggtcatcaggtggcatcaaaacgtgtatgcattggcgcatgcacggtcgagaatttataagtcattttgactttgctcacgctactagcgtcctagctacaaaatctcgtggccaaggtttccgtttcttcttttgagaatcccgcggtcaccacaagccgacgcctctaaagtcaaaactggttaaatatcgagctttgtacgccaacgagttgcagtaacctctgcgtgataatattggcttaatcacttccatcgattacctttcagcttatagccgtaaccaaaaattaaattttaaaatttagtttcgatgttgattttaggagttttcatcttagtttttttttttaattttctctgttttaaaataaaccaacctttatacatctatatcaaaattcatatataaaagtcggtttatttttggaacatatgaagtattatttgccttttaaattgctaataacatatttataaaagttttattcataaattatttttaagttgttaataagccgttagagcttataatcagcaaaagtgaaagtgattcttgtacacttatgtctcattacccaagtataagaacacaggtcagtcatccaccctagtcaaaatcaagactccgacccttgcatcatggaggcctaaagcttaacgaaatggccatggcaccattctttcggaagcagagaaaaagctccggttgagctgtatcgctagtactaccatatttgtgatgcaagtttgacctaaaaacgcagggtcccttgcttgctctggaaaaagaaatcagaagacgattgcagacggtgtttgaactcaaaaaatcaaaatgattggccctgaaaaagtctgaccacccacagttaagaggaacacaaattgttaactgttgcttgcactgaaggacattgagcagtgaattcaccaggggttttaacctacaggtttgcagcaagcgtaatcttggtaataggttgtaacagcatattctaatgactaattagtcggccaataataattccaccagatacaaatgtctgcaaaactctgaatactagtacagtgcattttgtgaggtgcaatgcacactatagaatctgaatctctagacagagcacagcattgttttcagtttttgtacagtgattcagagttgctgacatacagtacagtacagtacattgccctgggctcagaaaacgagcaggattgcttcttcggatgaactgtgcatctttgccctcaaactgcagcaaactcgattgcaatgttggcgtgaatgcatgtgcgaatgctcttggtttgtaggtgtcgcgagatccacgaatgccggtggtctctgcgtgctctaatggcgatacgacgcctctcgcttggattagctgcattctcgctgtgccccttttcctccttttcttgcttccttcgtctctccgagtgactcatcctgctttagctttaacccataataaacttgtcatctggcttgcattgcccatggtggtttaaccagggttcacgctacgtgtgttgacattttgcagatcactgcagcattgggaactgtgtcccgttattagttctatgatcactgttaattactcgtgattccggtaattaggcttgactgaagcataaatccttcagatcaaaggccatttcttgggaacttgctggttctttgtctgttccctctgttagctttgtttgcaaaatgcaaaccctttattcacatcatccaacgtgccagagttcgatcattctagtaatttgagaacaaaattttaaaaaaccacattttacagccataatcttcggatgcaaaagttggcttttgacgctgtccggcagagcgcatactatactaattaagccaatgcatgcttggttttcttagcttagttttgtctgaatatttcctgtgatgttgagagcattttgtgcagagagcatgtagctctcgcttcgttgacactcgccatcgtcgtgcctagtgttcacattcctccttcctctcactctaagcttctgacagcaccaagtgattacagtttgatttgcttcggaaccaattctgaactttgcagtgcagcatcgacggtgcccttattactagcttataaaaaggaggcacatgatgcattgcaacctagagtccagtccatgaacgatcatatctacctgcactgcattcctctgtgctcgactctcctgtatcttcctttctctgaatctctgattcatctgatgttcattcattcattcgtctgctgctgcactgcactctgatgcagtaactgctgcttattctgatcctgcaatgcttctgctgaattctgcatgtatcagctcaatctgaagagttaattacgttgtttctggcgtttcatttcctgaaggtaatagcaaacaatttctctgaacttcatagtaacatgccactaagtatctttttttttcttttttttttgttctcgtgtcttgtactagcagtcatcaggctacaactagctagctgcatatacaaataacctaaggcaagtcatatacaggttgcttgtgtgttctgaatcatgtaatccactttactgaattcttactgcatctcttagattcagagtaagtaattcatcgtgtagcttatatactcatcaagtcaaaagtagtactagtagagatttctaatacatttcatctcacacagttgatcgttgaacgcttttttttttctctctttcagttgatttcccgccacaaagtgcacactagtagagacgttgcgaaagaatttaaaccgatcgatcaggcggggtggcgcgagcgagttcccgccaccaccatgggcgtcacccgcgcgcacatcgtgaagaatgacgcactggaggggatgctgggcgagttcgtcggcggcggcaagggcggcgggaaggcggggcgcgcggcggcgaggcactcgtcgcggctggtcgcggcgctgacgtgcctccagctcgcgttcgccatctacgccaccttcctactctactacatgagccccgccgtggacctccgcgccaagccggacttcgcgtgggcgacgcgcatcgcgcagcactggaagcagctcatggcgcagcccgacggcggcggcggcggcatggcggtgtcgccggaggaggtgtgcgagcacgagagcatcgacttcgagcagaagaagtcgacggacgccgtgatgatccgcctcaagcgcgagctctacgacgaggtccgcgacttccagcgccggagcttcggcgccgagacgctgccggagctcctccggatgcgctcgcggtggagcgccgccgccgccgccgccggcaatcagccgcgggtgacggtgatcctgaaccacttcaagcggcggacgctgtgcgcgcagctggacacgctccggcggcagacggtgccgttccaccgcgcctgggtgctcgccttcgggagcccgaacgaggcggcgctccgccggatcgtcggcagctacaacgactcccgcatcagcttcgtctcctccggccacgacttcaagtactacggccgcttccagatggcgctgcagtcggagtccgacttcgtctacgtcctcgacgacgacatgatcccgggcgcccgcatgctcgagatcctcacccatgtcgccggcaccgacaagtaccgcaacgccgtgctcggcagcatcggccgcatcctccccttccgccagaaggacttcaccttcccgagctaccgcaagttccgctccaaggaggccggcctctacctccccgacccggcgtacgacatcgccgtcgaccgcatcgtgcaggtggacttcctctcgagctcgtggttcctcgccgccgacctcgtcaaggcgctcttcatcgaggtccccttcaccttcatgaccggcgaggatctccacctgagctaccagctgcagaagtacatgggcgccgggtcgttcgtgctccccgtcgacgccggcgacaaggagacgtggggggacagcgagcaccgcctcgcgtacgtggcggagacgacggtgatcttcaaggacatcgtgcaggtgcgggacgagcagtggtggcgcgcgctcacctccggctacgtcacgcagtgggcggcgatgcacccacagaaggtggacgcgctcttctacgcgcactcgctcggcgaggtccgcgcgctggcgccgctgctggagcggttccgcaccaccgccgggaggaaggcctacctcgtcgtctccggcggcggccactgcccctgcgaggaggcggcggcggtgctcaagtggcccaaggttgtgtgcaaggagaggcgcttcaagatcttcgacctcgccgtcggcgcgctctccggcccctcccactccgacgtgcccgtcctccacgccgtctactccagcatgcgcggcatcgtccgcatgcacaacccgagcgtcatcgtcgccgtcgccgacgtcgactccaagatcaaggacgccctccgcatggccgccgacgccgccgtcaaccgcaccgccctcgtcctcctcccccgcaactccatctccaaggttctctggatggccaacctccgccccacctcactgcccagtaagcttcttctacctcaaagctctaatccgccattgttgcattacatcaaagctctaaccattcgggaaagtgaattcatacctcgaggggatatcccctggtttcgtgaatacacctaaatagtcatcaaaaaatatataaaaaaaattagcaacataaattaatatgaaatatatcactccataaacacataagtttaaattcaacttctataagttataacaaaaataatagatatagttgcgaatgtgcgataactattttcagtttaatttgttatctttgttgcaatttatagaagttaaatttggtcttgcatgtttgtggaatgatatatttaatattaatctatgttatcaattttttttattttttttataacaatctagatgacatgcaaaccacgagtgtatcgagggatgaaaatccagatcctaaccaatccatggatttcacgcagactggaacaggatgcggatctcggtgaacatcatcacgcagaaccgggccaagtcgctgcggcggctgctggcgtcgctgcgggacgcctactacgtcggcgacgaggtgccgatcagcttcaacatggacagccgcgtggacgcggcgacgctgaacgtcgtcaacgccttcgactggccgcacggcggcaagacgctgcggcggaggatcatccagggcgggctgatccgcgccgtgagcgagagctggtacccggcgaccgacgacgactacggcctcctcctcgaggacgacatcgaggtctccccctactactacctctggatcaagtacgccctcctcgcctaccgctacgacccccaggtctctctccctgagctctcctccatctccctctacacgccgcgcctcgtcgaggtcgtcaaggagcggccgcgctggaacgccaccgcgttcttcggccgcagcaagaaccaccaccccaacaccccctatcttcaccagcttccctgcagctggggcgccgtcttcttccccaagcactggcgcgagttctacgcgtacatggcggcgaggttcaccgaggatgccaagcagaatccagttcagatacctcggtcccgcaccaatggctggcaggcgtcttggaagaagttcctcatcgacatgatgtacctgcgtggctacgtcgcgctctacccgaacttccccgaccagagcagcttctccaccaaccacatggagcccggcgcgcacatcagcgccaagggcaacgtcgtcaagcacgacaagagggacttcgaggtgccgctcgtcgccgacgacttctcgccgctgctccccgccgggaggatgccgccggcgtccaagctccccgtgctcaacctcttcaaccagccggtctccttcaaggcgctcaaggccgccggcgccaagctccgccaggacgtcatcggctgcgccgccacgcagctcgtcgccgtcgaccacgtcaccggcctcccaaagaactgcaccgccttctgatcccaagaaattgaaattgcatatatatattttgcattgaatttcttcgatgcatgaacacgttataaacgatctgatgacccatacgttgttttaccattcgtgatttttattcttttgctcacgatctctacactgtatttagctgtggtttacatgtctcgtttatttcggttttctttgtatcatttagcagtgaaactgaagggagttgcagagcattttcgcgctctgtacgatggtctgtaaagggctaaagatgtagccaaaagtggcttctctttgttattgttcttgattttcaccatagattcatcattcatggaaagtacgctgctacctcaataagaactgttctagttgtatagtcttcaattcctctgtttgtgtacaatgatcttcaattcacaacaggttcatgcagagtacattgatttcagagagagagagaagcaatcttgagatggttctaggacagtaaatttgtgaaggaacgacagcaatttcccaccattttgggcctagcaattctgctatgcttgatgtttcatactactacttgcttagacaggagctccagtatccaaatagcagctgatccactctctgcttttaattgtaaattttactgaatgtcataaatcttcgggtgaacaaagtacagaaacagtaggagtatgactctgctcatcgaataatcgctactagcaatccatcttgagatttcaaccgtggagaagaaatggtgagaggaattaaagatggaaaagagaaacagagcgcctcagttttagccttcaggagagtaatgccgacttgcagagagctgcatatgatttagtcgctgctcccctctcctgcccggtcgcccacgtggacgccatcggccatttaggcatttaccaatctggtgatctgccggacctcatcgccggtccgccggccgctggcgtcttcactggtcatcgccggccgcgtccgggcctcacctagtcacctcccttcggccttggaccaacagcccaacaggcaattccttcgagaaggctaattcgcgactggtggcgtgcggagaggagggcggtggacggcgcggtttctttttttttttttcggtttacagtttcctttttttttctgtttcatctttccgtatcgccctttgaatcgtaggaataaaaaaacggaggaataggaaaaatataggattctgacaggaatgtaagtgtaaaacagaggattgcaaaacacagaaaaaacataggaattatcgtttgattggaccatagttaaaatacaggaatcggatgagagagatagactcaaaggatttttaccaagaggttggacctcttgctaagtttcctctaaaaccaatatgcaacaagccattccataggaattttgtaggatttggaaaacttcaacctttgaatcaaagggctacatgggaaaatttcctgtaagatttcaatcctatgaaattccttcataattcctttgattcaaaggggccatagtattttcgccttttttaatacgtatttatagaactttgtatacatacacatacaaactttatatacgcgtatacaaactttatatacacgtatataaactttgtatatacgtatacaaagtttgtatatgtgtatattttgggtttttatccgtacgcactcaaacttagtatatgcatatacaaagtttatatacacgtatacaaagtttgtataagtgtgttttttagacttttttatacatacgaacacaaactttgtatacatatgtatatttttatacattaaagtgtgtatgtatatacaatatacatacatataaattttgtatttacgtatacaaaatttatatgtatgtatatagtatatgcatacgtatatacactagtacttcctccgtttcacaatgtaagtcattctagcatttgccatattcatattgatgttaatgaatctagataggggagtggattctaatccctcgaggggatatcccctcgtatacctttttctttcaaattcgatgtaaatagttatgaaaaaatctgaaaaaaattgacaatgtagagtataatgatacctactagtgcaccaaaattcaagttcaaatttgaactacacatcgagaaacaaaaaagacaaatttagatataaacagtacgctactattcatatgctgaatttgtcttttttatatctcgacgtgtgagttgagtttggacttaagattttgtggagttgtatatatatgttgtatgaatgttgtcaaatttttccagaatttttcataaccgtttaaatggtttttaagcaaacgaggaaacatcgcttcgagggattagaatagtttcccatctagatagatatatatgtctagattcattaccatcaatatgaatgtggcaaatactagaatgacttacattgtgaaacagagggagtatataggagaagagagactagagggggccagctgatcgcgcacgtgcgcggccgcgcgactagccgcggatcagcagccccctaatgcagaagcggattcaacgtgggtgcctgcagggggacttgagtctcactacacccacaagacctatggataccccctcagcacccttttcgattttttcaccatggatgataaaccaaaggtctctagatggctagaggttgaaaaaactgcgtaattgagcccccccaatttttttcccggatccgcccatgccccaatgccttggcctcctctcacttctcctctttttttctaattcttgatttgatttgatttgatttagtgtaagaactccaatatttctattaaaagttttgaatcactgtataactagcatgtaacatgttaggccacgtagattacatggctagaattattatatttttctcacataatagcatatatattttcacattttattaataaaatatattaaatggtaacataattttaagttctgtactaacttgatcagattaacaaatgtgtaataacttaattatatttctatatagactctagattcctcttccaatattccttcttttttaatttgaagtttcgttatttataaattttattcctatatgtactctaaacccttatttcaatatttattatttttaaattccgaatttcagttatttataaattttatttctatatggactctagattcatattccttattttttttaattccgaacttttgttatttataaattatacttctatatggattctaaactctttttttcaatattccttatttttaattcttaattttagttatttctaaattgtattcatatatggtctctagactccttttccaatattccttattttaatattcctcaaccactcgcagagaactccggtgggatcgctaccacgccggtaattggaccaggtgtgtagttgtaccttgaccactcgtaaagaactcgtagaggtggtgggatcgctaccacgcaggtactcggaccaggtctctagtcataccttgatcactcgtagagaacttttagaggtggtgggatcgctaccacgctggtactcggaccaagtgtgtagtcgtacctcaactactcgtggagaactcttagaggtggtgggatcgctaccatgtggctactcagaccaggtgtgtagtcatagctcaactactcatggagaactcgtagaggtgttgggatcgctttttaaaccacgcctgtactcggaccaggtgtatagtcatacatcaaccattcgcaggagcgcttgagttgattattacatgtgcttttcatgtggccaacatgacatcacatacctaacttataagcatgtcagatgtccattcgcaatcatgccgggtgatcaagctgacaatgctcgcgaggagattgtatgtagcaaccttttcacaaataaactgggtcgtgaccggcactaaatgtgagataggccgccggtatttgttggtaggtttggtccgacaagtccacgtttgttcgagaacgttctcgacaacggggtgtaatcgacctctggctattagagtgctcgatcattcctaaaaaatattttctataagacaaaatatatagcatagaaagctgagtacatactcagaaaattgtataaatcttctagtattgcaacatatataacatagaaagccgagtacatactcagaaaattgtataaatcttctagtattgtcaggatgtaatgagcatatttggattaagaatcgggtattatgtataccgtaaacaagcgtcatatatacaaaaagaatagagtaagccctcagtattaaatggtaatcggcctaatatagggagcatttgcacaatagatattgtataaaaatatgttatatgtaaacataataaattattgatatgaaaataggtatggtaaattgtatatataaaatattatgtatctttgtagatatatgccgaatatatatttgaaatttttagattaattgaaatcaattagtctactaattacctttttggacacatactacagtctacaggtaatatgcgtgtctgtctcctggatgtccatgtgcacgtttctggtaagtgaccaccaaacaagcacgttggttttgtcctttaccgaataggtgcatggatcgggtcatacggtgtattcgcagttacagtagtagactcgtaggtatgtgtcgacagagtagattgtgattacggtatttgcatgatatgagtatcgttcgtgctaacgtagaagcgaaattgagataaaagagatatagacaagtatttttatataggtttgggctccttgattgtcaggtaatagctctactcctgtcgatcgaagccggtgttgctcttattcatcaggatcatatgagcacaatatttgggtctaacctacctagtcgtcgtcgacgtggcagcatggaacaccacatgtagtagacgacagggtagtcttcttacttgaatattaactagacgaggttagaggatagctctagatccctcatgtcggcctctgtgactccagattgggtctatctaggcatgtccctcatgtttgtgtttgttggcatatattcgtgtgtgtcccctcttcttctaggggatcttgtatttatacccacgaatatcccttttttcaagtagaactaggaagatacatatggatatgatccgaataatccttgtagtttccaacttgaagtagtttccttccttatctagaacacctttcgtatatgaggtatgatttggtataagactagttatatggtgggcctcaccgagaccaatccaagatcattaagcatgccttatccataacacacaatatgcattagttgttgtcgtgttcgacttgatgatagatgggaggatgcaagcgcacgacaagtttgcaggggagatcaacatagtactctgtactcgactctgattgctcgagagtgccgatgtccgtccaatgtgaagggcagtcttcccgaggtttaggttgttgagtcttggtttgcgttgatttgaaagtaatcagcccgggtgaactcttgtggtcgacgatatcgaaccgttgttagtcaatcttggtagatggaaattgttggtggcgacgttatctagtcgggtcatatttcccagagcccaagccgttgaagtatctctcgtcgaaaaaaccacactagcaatgtcttgacaaagtttaagacaacgaggatcccgctccattgaagagaacgcgctccgattgggtcgtatctcctaaagccgaagtcatcagaaagttcgccacttgaaacccatctcgtcaaaaacttgaagcaccaagtcccctacctagtgctccactatcgagggtggatatcccgaccacagtatttatacagtatggatatccctacctggtgttaggttatacgtgagattgaggtaaaagagacgggagacagatattttcatacaggtttgggtcccttaactaaccggtaatagccttactcatattggccaaaaccagtgttgcctttatatataaatatcatacgagtacactatttgggatgatttaatctagtctttgtcggcttggcggcatggagctctcacacgtaggcgacggctggtgtagtattcgttctcggatctcgaatatgaactcggcgagattggaggtagcgctagatccctcatgtcgacctttgtggctccaaattgggtttgtctaggcttgccttccattggtctagatttgtattggcttctgttggcgtgtccccctcctcctaggggtcttgtatttatactctcggatgtctccttgtccaagtaaaactagggagataagtatgtatatgatccttgtccaaatagaactaggaagataagtatatatacgatccgagtaatccttaagtgcccgagtagaagtttgttttttcttctttatccggaacaccttccgtatatgaagcataattccgtataagatttagtatatggtgggccccgccaaccccaacctaagattattgagtatgcattatctataacactcattcctagaggctagatggaggaggctgccccccagtaccacgtggccctccccgaggggagtcaggcccgaggtggggcggcagccactccttcttagagactagatggaggaggctgccccccaataccacgtggccctcccccgaggggagtcaggtccgaagtgggacggcggtcaccccctcatgtgactaggggtcgggctcccccgaccccctcagcaggtcgccacgtgcggtgggttaggtggccaccttcgagcgctcacctacccacattaatggtgacctgagcagacgcgccacgccgcatttaatgtggcgtgcaccgcgcgctaatttggtctgtgactggtcgaatgaccgacaggacccggggtgtcaggcgtactattgcatgggtcagggggcgtgcaccctgtcttgtcccatcagtcatgatgacgagaggtcttaacctctcatcctggccagagttggtccgtccgccctggtcaattggggattccgtttcccggcgcaaatagggacccagaagtctccacccattaatagcagctgacatgggcgcccctcgtgtcaggcagcaagatttgacaggccccatcatcaagatgacgtgcgcttgcttcccaagtcaagagacaaacaggcatttaatgcaaaacacttctccaccggagctaggtttttgggcccatgtggtaaccccttgagatataaaaggaggtccaggcctagaaaaagggaggagggatcgaggacgatccattggacactctagagcagtctctagccacggatgatcaacaccacattttactccaacaaagagatcttataatccttcactcaaggagcatagcacaggagtagggtattacgcttcttagcggcccgaacctatataaatccttttggtctcatcatctttgaggggctcgaccccctcaacacaaacactgcttcgctcaccgaatcctcaaatctcacccgctgcctccggctgaacttacaaaggagggtctcatgaccttccgctagagaggatcactcctcgacaaaaccaactagcaatttctcctctagatgggttcaatccagcaccagatacacaatgcaacatgaaatccgagccaagttggttgaaatatagggattgcgaagaacaagaaaacaacaggtcaactggtacctgggtagaggattatatacgccggcggtagctcagccacatcgtagccggcctcctccacaacttgaagccacaccaacgaattggattcgcgcagatcggcacagccgggcgatcgatcggcggactagaggcgatctatcgtatcgtaggacgtccgacgctatcgatgagatcaataggcccaataggcccattgccgtgaggcacccgcacctctttgctcagtttgtgcgagttttctttgttctgttttggccatgaactcttcaagtttgtctaattctgatcctctacttctaaaccgtttaatgatgagcaatgaacgatgggagaaagaaacagagcgactctgtttctagtcttcaggtcagaaggagagtaaggcagatttgcagagagttgaacatgatattgcgaattgtgacgggctgatgatgtacttagtacattttcatggacatggcaggcccaagttttattaccactagcagccgaacaatatctaaagaggatttgattcgttattgtattcatgactcctcttaaatctactgtagtttcttctcaagcagttgagccccgtgaaaaatcactcatactaaggtggagtactagaacacaagatgaagatttgaatgttcatcatccgcacacggtacatctatggtgtggctgtgggtagtaagacgataaataatctccattctgaaccctcgtttgtcagaattagtttgcattatgttctttcttttgtctttatattattgtactgatccggcacaacagtagatttcccattcataatctgcacgacagtacagcaatgttcaagtgcccactggtccagcacattattaggtgcccaactgcccagcagaagccgcaaattgagttgtcagtaatcagcagtagcgcatagttataccagaggtagccagatcacaagaagaaagaaaaagttcagagcataaaggaatatatctcctcaaattggatgatcacaacttgtacagagggaggcaccaccaaccaacaaggcaggagaaacagaaaaaaggcatatagagatatataattaattgctacaaagtaattgctagtatagaaaccaaataacacttatcaatccctagacatagatgaactgcaaaaagaatttttcggagttcagtacatcaagctccaatataaactatgatggatgtcccccctgagtagctactagcaagaagaaacttctaattagcaaaccaacaaactccacttcctcatcaccccccttaaaaaaaacacatctcattttcctcctcctaattgactgactgactagctgcaaagttttcctctctaaatctgtctccctctgctgctggtttagctctccttctcacctacctaattttgcaagcaactgcaaatctgcaatgcaacaaccactgtgattcatctatttctcctgccctcctcctctctctctctctcacccacctctatacaaaacaaaaaatcatctttttaaggggaaccaattaatcaatagacaaaaaggaaaaaaataaaaccccaagaaaagccctagtgaactaacgccagtatgaccccggcgatcgatccatggattgatgatgatgctgatgctgatgctgatggaaaccaatgcagagcgggtggtgatcgatgatggatgatggcttcaggagggcaatgctgctgatgatcacactgctgtccatgtccatgtccatggtgatggtgatgacgaggaagacgacgcactgacgactgaagcaagcatgcatgcatacatactaacatgtatacatatatagctaagggggactgagaccgacgaccaaccgtcctccgacgacgccgccgccgccgccgggagattaatcccggcggcggatgtactgcaggaggtcgcaggacgggtcggcggtccgggttgccttctggcgcatctccaccaccttcttgtgggagttggaatggatggacggcatgaaggtggggctcgccgccgggcggtactccgggaagaggcggccggacttgtagcggacgccgcacgcgttgcagagcgtcttggggccgagcgggcccgcgcgccactgcggcgtcttctcgatctggcaatgcgtgcaccgccgcacggtgcccggcgggagcgcgagcgcgccgccttcctcgtagtcggcgtccgccgcgtcggcgtcggcctcggcgtcagaggcggcggccggagcggccggcttcttggccttcttcttcttcttcatcggcggcgggtgcgggttggactcggcaatgctctcgggatccgagtgcgacgaggtggacgagtacattggcgtcggcaccaggatggtggtctccgtcgccgccggcgcgccgcggacagccgggaacgcggacggcctagaccgtttgctgcgcgcgcgcgccgggatgacgagcacgggcggctccgggcgcggcgacacgggcgcggaccacgcgcggccgctgccggagaacgactccgacgaggaggacgccgacgaggaggacgacgaggaggagcccccattggttgccacgttgaagccgctgtgctccagcacggagatggggctggagctgcggaacagcgcctcctccgccttgtccggcagcacgacgccggcgttcgccgtcagcgccgacgccttgatcggcgccgcgcagttgacgcccggaaaactcggctcgtgcgggatggttccatcgtcgaacagccccgacagccactccagctgcgccatgtccatgtccagctcatcacactgcaaacgacaaccattgccacgtcagatcagtcacatttcctctacagctgcattgcagcagcctgctaattttgtcgttactagctgttcatgttcatggtcagtagtactactgctagtaccaccatgacatcataatttcttccatccactactactgtgtaaatctactgtaaatcaatcatcattagcggttggaggaaggggcccaggtttaatttcggttgcttaaagcggagaaaagggttactgctatgctaggactgtttgtaccacgttgggtttagtactagcatagtatagttgttgggcaggctaactacccaaagtaaatgggccccaaaaaggccgaaaccgccgtaaaaatccaaccaaacggaagcaaaaaactcccatcacgatggcacgccgacgcccgtccaccgacacggccatcgcctgacccaactaccccattcacacacgacgcgcgcgccgcgtggcgtggagcgggcgccaacgcctaattggcgcccagctgttttgaacttgaaccgctcgaccgacgccgacgccgacgccgacgccggcagcggcaatatcgtccgaattcctctaaatcggccgtacgctcaaccacggggaggtggtgggggagggggaacttaccgggccaatgtgggcgtccttgcggtcgaacacctcggcgccgagcgcgccggccgcgtcgaacagcgccgacgcgtcgtccttcgcgggggccggcggcggggggagcgccatcatctgcggcggcggtggcggcgccgccgccatggtggcgtggccgccgatgatgcgcgaggacagcgggctccctggcgccggcgcgtcgagcaggagcacgtcggcggccgactcctccttggggaagtcgagcaggtcgtcgatgtggtcgaagaggtcgccgcaggtcgcctccaggaggctctgctcccgcagcatgtcctccacgaatccaacgcccgccattgctgctgctaccaaatcacaatctgttcaccgtataaatacagaggggagagaatgaagaaacgcgtgtcaataatgcctcatctcgagatcaatgtttggatatgcatgcattaaacaaggcagtatccacaataataagaaagcaaattaaagcaacacggatttattcacctatgataaaattaatcaattccaaggatatgatccacctatatcaataataagataaaattcgtataaatggttacacaacacaccactgccagaaatggatagatgacgaggcgttactaatctatccctactactaccagaagaagtgcaaatctatctctctgagctgtaaatcaaaagctgcaggagggagatttttttttcttctctttcaaagtgacggcaggagcgggctccatatgtatgcggtgcatgatgacgcgcttccgtgggtgggccccacccacccccagccatgtgaccccgcatgtgacgggtgaattttcttttctttattctgaagcaaggctatacaatacagatggcgtactactctacccagggaagaaaattaatatacactcactccgtatataaaataaaaataataaaaaaataataaaagtaaaaaagaaagaaaaaatctgggcgtttgtttgattgattcaccaccaaggactccatccctatgcgtacgagtagtaaaagtcaaagcttgccagcacaaggaatttgtcaaaagggcggggggattagctgacgtggaggcgccctattggtccggacgcgtcactggcgtgccactggacaaagcagccgcctccctcggtaaaagcagctaattattgccgagtcctcgggtgaaaacaccgaggaattcatcaaatttttttctcgcatcaatcgcggccattcccacaggaggagggagcagtacggatcatgcaaaggcgaatcttgccatggcggcaatggaaggaatctttttggttttttttttccctttttgttgttgtttttactgcttgcttgccggcgtattgcctctcagaatttgcacattttttctcactgtccccaaatgtttccagataatccagactgtaaaaaaaagtactacaaaatcagggggacgcggttgaaaaagcttggaataatagcagtagtaccgacgtgtgaaccctgataatcccatccaatttttccatgactttctatccatctagtagccggaagcttccctttagtaattttactctcgatttttttgaattgatttgaaaattttgaaatcttcaaattgagaaagagtccaaatcggaggcttccgagtttcgtcatcctcctatattcctcccctttcgtcttccttccggggaagatgaatgaagcaatgaacgtgcaaaaaaacacgcatggcaatgaattaagctggcgacgcggcgaaatacggccgcgcgccaccgggaagccaacttaaaatgcaaagcccctttgaattcccgatcatttcttgccatttttttgaatttgaagaaagcggcggcggctgattttgcgggggggggggggggggggg

SEQ ID NO: 68525 - DNA, 6179 bp, Oryza sativa
tttcgcaatatggccgacaacgtctttgtttctcacgacttcgccgagagggaaggaggagacaactgtgaccctgtgggcttggaagtagtggcgtagctttcgtgatgtcatgattaccgcgtagagcagtttttggatctgtggatatcgtgtctttgcgtcgtagagagcttcgctgacgtagtagactggccattgcaccttctctctctcgacaacaatgacagtgctaacggaatatggcgtggcggcaatatagagaaataattcttcattaggttggggagcaacaagtacagggggatttgctaggtagcgcttgagtgcaatgaatgcctcttcggcttcctgtgtccatacaaatttgtcttgcttcttcagcagagcgaagaatggttgtcctcgctctcccatcctagcgacgaacctgcttagtgccgccatgcttccggttagcttctgtacttccttgagtcttgtgggcgacttcatgttgttgattgccttgatcttctcgggatttgcttctattcctctgccagagacgaggaaaccgagcagcttgcccaatggtactccgaacgtgcacttctctggattgagcatgaggcgatatcttcggaggctgtcgaacgtttcccgcagattgtcaatcaatgagtcgcttgtcttggtcttgacaacaatgtcatcgacgtaggcctcgacattgtttccaagttggtcgctaattgagccctggaccgtgcgctggaaggtgtttcctgcggttatcagtccgaacggcatcttaacgtagcagaataccccgaacggcgtgatgaatgctgtcttctcctcatcctctttcaccatgctgatttggtggtagccggagtaagcgtcgagaaagctcaacaactcacaaccggctgttgagtccaccagttggtctattcgaggaagggggaagtgatccttgggacacgccttgttgaggtcggtgaaatcgacgcacattctccatttcccgttggccttccacaccatgactagattggctagccactctggatggagtacctctctgatgaaaccagctttgagaagtttgttgagctcttctcgtatggcttgttttcaatctggtgcaaatctccgcagtttttgctttattggcttggcgtcgggtcgcaccatgagtttgtgctcaatcacctcccaagggacccccggcatgtcggacggctgccaagcgaacacgttagcattgtcgcggaggaaggtgatgagcgtgagttcctattctcgcctagtgatgccccgatcttgacggtcttgtcggggttggcactggagagtggaacgatcttgattgcgccgtccggtttcggcgtcttgtttggtttgctcactttcttgggtggctcagctgtggcgggtgggctgggcgtgtgctcgaccatgtcgaggctccgcttgtcgcattgcactgctagcttagcgttcccttgaatagtgattgttcccttcggtcctggcatcttgaggacttgatacgcgtagtgagatgtggccatgaacttcgcgagtgcagttctcccaatgatggcattgtatgctgtatcgaattcagcgacatcaaaggtgatctgctccgttcggaagttatttgcttggccgaaagtcacaggcaacgtaattttgtccaatggtttggacgatgactggggagtgattctattgaagggttgatcggtgggatctccatcgcttcgtgggatccccatcgcgtccaaagtgctggcgaagagaagtttgattgagctgccgccgtcaatcagaactcacgcggcattgatattccgaatagtgggttcgaccacgatcggatatcgccctgggatgacggcagtcttgggatggtcttcttctgagaattctatcttctgttgagaccacttcatcttgggtgcagccccctgccacgtcgaacagacttcacgttccactttcttgtattctcgctttgaggagtacgccgtggaacctccgaagatgtgcgagacatggagatcggagtctgggtatgctgagtccgattcctgagtagccgcctcagtgtccttctcgaccacacgtactcgcttgcctttttccgatgccatgtgttttgcgagcgactttttgaagacgaggcaaacttccagagagtgtctgtccgacttgtgtatagggcaccatgctttcttcgcgtcgctaccttgtgggtctgggcgcttgggagggtccgcgtattctgctgcaagaacttccgcttgagctttccttttcccattcttgcgattgttcttcttgcttgactcaggtgcgtccttggctggtttcttctctcctctggtcttcggcttgttgttcttgcgtctcaatgcatcgtccgcgtgggcgcatcaatcgacaatctcgaataatctccgagtagtcgtgatgcgcctcgttgccaactcctaggtagtatagcgatctctgacaccggacttgaaagctcggattgcagaagcgtcggtgatttcggggattgtatttctacactcattaaagcgctgaacataatccctcaaggattcacccgggttctgtgtcaacgcatgaaggtcatcttcgatcgcgtggcgcttgtaagttccttggaagttggcgacgaactgctgccacaggtctgcccacgaagaaatcgagtagggcgggagatgcatcagccatgaacgcgtagagcctttcaatgcagttggcaaataattcaccaacgcgttgtcgtctgctccggcagcgtagagtaccatggagtagacctgaaggaattcttctgggtcggtactcccatcgtacttctctattgctcctggtcggaatctctcaggccatcggacatcgcgcagcgaacgactgaaagctctacacccagcgcagggggcggtgggttgtcggcgatcgtacatcctccgtggatgtctatctgattataaggatgaggaagatgatgacgatgacgatgggtcacctggttccggtgtacgattacgaggacgtcggccgggttctcgagaatcctgtcgtcgccccccgttgttgtcccggcgctgatctccatcgttgtcgtcattatggtggcgtcctcgactagcatggcccggcacccgccgttcacgatcgttttgatcgtggtggttgtggcggttatcgcggtcttcgtcttcgctcgagcggcctcctcgttcttcgttattgtgacgtcgtgaagagacgcgatgtcgggaacggttcctgttgtgtcgtgcacgtcgcgcctctcggcggccattcaggtgatcgcggagatcgccggtgccgcgaggtggaggggtggctcgatgaggcgattcccgctgttcagggttttcgccattagcaccaccagttggtggctgttccgggtgcgctgcagcggcggcctcttcgaacgcgttgctgaggttggtcactgattcccgtagccgttctgtccaccgtgcgagatcgtcgttcagaatgggatcgtagagggtttccctcagtattgcgttgacggccctgatgtgctgggctggtgtagtcacttgattttccgcttccgcattagcgcgcgctgacgtgctggtcccgtcgatagccaatacctcgcgtggcgtacttgttgacgatgagccatagtcttcgagcaagtgtagaactgacggctcgtgaggatcgatgtcgattaccccaacgaatcgatccgagatcagtgtcgctccttgttccttgtctgcatctctaagagagatacgtgactgctggaccttaggaggcggcgtcttcgtggcgctgagaaagaccttgcagcttcagaggtcgtgattctttgtcttgtgaataggacaatagataacacgagttggagaagtacgctgaattccacgctctttgcaggcacgaatttcggcgtgtacgttgtgaaaaacccagcaggcttgcaaggtgtgttttctggttttatggataggacaccaggaccttgtcacctcggaagttatcctcgtcgggccgtgattcttgtcgaaaagacaaggtttggccgcactaggatccttcttgggctcggatatcgtcgacgttccgttctccgcttcggcgggaggatccttcgacatggagtcgtcctgggttgaagccactgcgttctcgcttccgatcattgatggaccagccgagatcggcaccgtggtgtaaaccgggaagacgatttcgccgacttgagtccacaccagcattgttgaagcaggaactccttggttgaggttggtgttgactctgttgtcgacgaagctggatgacatagtagtagaaccttgagtaccaagttcccctacctggcatgccactatcgacaggggatacccgtagaccggatatagagggtattagggtacgctggtacgaggatctacgtaatacgacatcaagcagacagaaaacagagattatactggttcaggccccttgataggtaatagccctaatccagttgatatgggattatatgatggaaatcacagattacaaagggaacagtggaactcgatggtaccggcgagatcataatcgagctggttcgactagatctcccggcgacttggctcctgtagactccgacttcgtaggctgtggtggatgtgttggctatgagattcgatgccttaagtcttttcggggggtcccttttatatcgtaggtcaggcggtttccaagtagaactcggagacatcggaccctgcacgatacagtgacgacccagtcctgtccgagtaggactccttccatctgtgaactccgtgatgaatttccttaatgtatgtagaaaacgtccgtatacacgcaggtataccataccgatatgtgacgtatatcgaaaggtagagggtataccatacccgtaaccctgacaagtatataataggaaaatcaacggttagatttagactgccacttggcaacttaggaacgtttgtaagaggagaccgtggggttaagaatgtttgtaggaagtttaatagatttttagtatataatagatagatagatagataccaagacaccatgtaatgacagtcattgataaatcagttcgttgtgtcaccttacccccactgcattgcagttgaatcttctaggatgtgtgtggatgctagaatattcaaatataccataataaagttacttctgatttatcttttgttggtgttcattagtttgtacttacttaatcttattttacagtgtatttgtgaactaaccgttgtgagaacgattttgggcaattttttaataattgaccgaaatgatatttcattattaaaaaaaatacaaagccctgctttatttcaaaaattgtattgaacataaaaaattattccacaaaagttaggagatcaaaactaatccctaatacctgttatggtgtcaaccaaggattataaagaaaattaagccactacacctaaccactgagaggagatatataacaagataccggcccattgccatttgctagtctacatgatctgaccactgaggagctgatcacatagagtcacacatactagaccagacggatcaaacagatgacctgaggtattaggatggagtcatggaggagatcacagaagaagttaatgtggactatatatggaaggatgattattcccggtcacatcccttggttgaagaaacttttggccaaattcagacactgcatgctatattcagatggaagtaatttataatcttgacatgaagcaagtctagtttaattagttagtcacataaaacattgtcatttaaattattatctttgctttccaggtagcaaataatttatttaggcttgggagccatcaataagctaggcgttcagtagcatcaaggatattgaaggctaaggtctgccacaggccacagcctatgggacctgaggcctgaggttattgtgaaggtctcagtaaattcccttggtacttaacaaagtacaattgcttgctagtcttagcttgtgtaaggaccaatgtttccctagtgaaactgtttcccaaaagaaaaaaaaatcttgaagcatcatttattcaaaaatacacattttgcag

SEQ ID NO: 68526 - DNA, 25943 bp, Oryza sativa
catataacgtaaaagttgcagttttgtgataatttttcacgataatgttgcagcaaattgatagttttgtcactaaagttgcagtctgaaatttactctttaaaatctatacctgcaaaattatttttcgatcgctaataaatattatggcttatagcctaactactttttttttcttttgttgctggttaggcgtctccaaggggtgttcatcacaggccaccagacgtaccgaactcacctgtctgtagttaataagacgacgaacttgccggccagtcgtcaccaccgccaagatcgctggcttgctgaattttagctgatggcgacaagaattaactcaaccactccccattcacatcgagcagagccttgagcagcaaaccagatttaatttgctttactgatcagatgtgtttgtatatgttcaggttcagagacgtttacagctcaatcatggagtgtttggccgtttattatacggctctgaattttcactgtctcaaccacaagcttcaaactgtttcaaagaataacatgtcgaaataaaggatactgatctctctggtcacaaaaaaattgtgcccttttaatgttgcgaagatgttttcgtcactgatccatatcacaccgcattactattaagtttcaaccaaaatacaaattatcgagtagattgctaaaacggattatttgctccatgttttgggaaaaaataaaaaaaaagtcttctgttatattatttagaccacttgtatttaaattaattattgtttatttaccaaaatatttaatttatctccataactaaataaataatctttagtaatagtcagctcaatatttgttttgaattgagcttggtttggagtcaaatcaatatgtatgacctttgtgcatcaaatgtaaatattttaaaaaataatactcgaagtttttttaaaacgttttttttgggaggcaacgatcccattcattctccatgattgcaaccaactacaaaccagtcatgcacgctagcccattcagcccactacatatttgcatagccatttggctgaactccctacttctcaaggcatagctacttccgcattagctcggcttctcaatcctatatgtgtaccgatgtttgcactttgcagctcaatcttggagtgttcggttgtttatacagttttaaatttcaatgtttagatatcagccaaataacaacttgtggaaataaagtgaaactctctctggttataaaaaggcccaatcaatttaatttagacgttggtatggtatttaaaacatattttttcccactattttgtgtcagtattagcaagctttagtaaaatcataacattagtgtaaaagtaggtttcgtatcaaatcaatatcaatatgtgactttcgtatctactaaccattgggcattagcccattcaggcattcagctcagtacatatataatgctttcttgcatatttgactatctaaatcatgtgaatcctggtctaatggtggctaattttatagtggaattttagtaaagaaccaccttgcgataatgtttgcttttacctttttatccaacccaatcgatgcccaatatgcatttgcaccatttgctatccaccaccattctcttgctagtctcctaaaggcctatgccaatgtcaagcaccatgctaaaaaaggtgtctccaactgacttggcaactgtgtggcattgatcatgccttgagagctggacaagcaacaaaagaagcgagataaatgagtgaatagggaaacacatgtggtcattaataggatagaaaggcaagtatgtaaaaccactctccaacaatgaagaattgggtcagggcaaggtcaatagaagagtcagggccataactagaaatcagaggcccccggtgcgaatatacatattgggtcctaaaatttgaaagccatggtggccgatggcgggtagtcataatcatgcacggtgcacactgtcatggctggcggcatatagtcgtaggcacatagaagtcagaaacaaaaaggggcaattgcaaatttaccactgttttgaatcgttattgcaaaactgtcactagataattgaaaaaatgccactggaactgccattcgagtggcatccttgcaaaattgaaaaaaccagtggcaaatttgcaaatgccccaaacaaaaaccagcaagtgtggcggcggttgggagcatgttcatttgtgacgtctgttcgtgcccattgcctagccttatgtagcgttaattgtttgaaaaaaggggtaaatttgtagtggtgatgggaatcagaggagccaagaaggcgagtaagtgcagtgtgcggtgcatgttggtttgatcaaacgaggtaatgagagaatttagcttgttgtttggactttatcatggatgctagaatagcttgttgggctttttcatacttgcaatagtgtttattagattggataactaattagtactagtacttatagatttgggagccctaaattttgaagaccttgaacagatttacgctttacacgaaaaacgtccagggtcttccggctagctccacaaggtgatgaactagacaacctaggttcgaagcctcaccccttctaattatttgatattaggtccttctctaatattcacgtcttttagatttacgctttatacatatggatgtacggccttgagaagagtaagcaactatctttaaagcatacctgttagctgcattgttaccttgcattcttttttctattgagcacgtgtataactagtgactaatcatttctacttattttcttaatctccgttctctaacttatcactaaaggagaggtgattgtactactgtcggttaatgtacatgctcttatttgaattactagtgcatatatctttccatgtttagtttttcatcgagaaataacaatcagttctaagatttgctcttgaaataacttctatttgctataaaattgtctccacttctttcttaaataactttgatttgctacgaagttatcttggattgcttcaattagctcttagagtaaattgattttgctctccaagatccaatatattacatgttactgaacaaaggttacccttgatgtagaaaaacaatcgaaaacacatgggatcacgtggaatggccaagagaaacaaagatatgcatttcttacaaaaatgagtttcacgccacagctgcacatggtaaaaccgaattttacatgcaaagtttgtaatcatgtgctaactatattggtaccactagttcaaactctcaaaatttaaagttcgaccgatttgtttctttatggtggaacccatctatctgagccaaagtcctagatttaatataggccatcgtatttttcaaaacgaatattatgaggtaaaaaaaaagaactatcattgaccgggccagggctcacaatatcaattgtttttttgcgaaaaccgctcgtttttttatgaaatcgccggcgaacggtttgtgaaaacagatcaattattttagcttggcgttgaccgaaagtcattggtttaatcaatttttggacagttttttgggtaaactgggtaagaacccttttttcctaaaaacttaaataaatctaccataaacatgcaatggtgaaactggctagtgccactagtttgtgaaaaaatggtttagatccaatagcaaaatatctcagcacaaatcttagcacgggatccacgggccaaaaagaaatttaacagtcctgagaactgcccacaactagctagaaaaaaaaaagcggccgtaaccttgacttgtgagagcactgagcaaaaaaagagagagagagagagagagatggtgaggagaggactgaggccgtaactttgacttgtgagagcactgagcaaaaaaaaaaaagagatggtgaggagaggactgaaacaaaagaggcgcttttttttttttcaggtcgtgtcgcccgcgtgttctccgctgctggagatggcaagcaagggaagacctctcgcactcgcagtcgctgccaaaatggaagcaagcacacccctctcgctgccactgccactgccactgccaagcaaacagcgcggcgccacagtagcagtagccaccacgcacgcacgcgtcggtgcgtgttccccccccccccccctcccccccgcgacaaattcctcctcgcctttcccctcctcctccctctcctcgccgccgatccgccgccgccgccgcagccggtgagtgatcccctttccttcctctgttgccttaccgaattccgcgccgtgggacgattcgatcgacggatcgatcggtggttgggtgggtactgggtactagggttggggtcagcgccgaggggttgcggattggttggggtacatgtatgttggtggtggtggtacccgtggtttacctcgtgcttggctccggcgcgtggagcggcggcgctgactttcggtgaatcgcgatgccccccgattcggtggggtggtgtggtttgtatggggattttgagtttttttgtttttgttttgggggtttggtttggcgtgaaattggggcgaataggtgtgtgattctcgcggagtagccgctcctgggtaagaaatgggcgagtttttgtggtgatccgtgatcgtgagaatttgttgataaatttgcggtgtgttttactgttgaaaaacccttgctttgagaatgcctagcatttttagcttgtctcagactgtcagacatgatgtctatatggtggtgctattcgcaagcggaagcatttctgatttatgtgtaatcagtttggttactggactagacaatgctgccctcccagttataagttgtaacatactagtgcttaccaacaaccagtatatctctgtgctgctaaatggaaattgagatgacacccaatgttttaaacaaataaaggccagtatagcattctatttccaggaattatttaggcttggctctgcaatgtatttccttccagcctacttggtgcatgaggtcatgaaatatggtcttcaaattgaattatagatgaattgtgatgctgatattccttgtttttcttttcctttttcttcacagggatcttccgtcggatagtatggtattgtgctggacacactgttgactttcgtctctatgattatctctgataccgatcggagcattgcacctcttccttcgatcaatgggcattgtgaaggtagcaagttgtgcgcctacagaagagcgggcttacagctgtggagacgaggacattacacaagaggagaaaatgctgcttcagagatttcctattcatgaatccgatgactatgaacatgaagaggtcaattgtgagcttgcaaagtctggagatcagatctgtagtgtcccttatgggctttatgatttgcctgaattgaatgatattctttctttggagacatggaacttatgtctaacagaagatgatagattccgtctagcagcctatctcccagacatggaccaacatgatttctttgtaacaatgaaggagctgtttagtggcagtgacctgttctttgggagtccagtgaagagcttcttccacagattgaatggtgggttttattctccagaagtttcccaggctagagaattactgatgatctttgaaagacgaagatattatcattttctgaagtcccatcatgatggcatgattttcaagtttgcatccatggacaaggtaggaggacgatgtggggcgagtactggtcttcagggtaaggttaacagttggaatgacagaagacatgaagatcccctcacaggtgttgacataagcggttctcctttcaatagaagtctatcaattgccaatgaggttaaagatgcaacccttccacctttgaagcgaaccaaacgtatggatgggacagtaaccactcattgttcagccaagcgcaagggaatagtctacagagacaaatcaatggaaatgagctcattgaagagtcctgtctttcatgttcctggtgagcttactacatgtattagattgcccaaaggtgtgctgaaaataaagaccgattgtgcttccctcattgatcacaatgaaggaattcatcgtacaccagaaccgatgctagcagaccaactgggaatacaggtctccagcttaccttgcgcttctgcactggatgttcatggttttgcgatgaattcagcttattactaccacataaacacaagcaagagtactttgagaaatctacatgtgcgtccctaccaaagagaaggcacacttgatacttaccctcactcagttgaaagtccgtttggagtgcaaattatggttccagaggagcttaaaaggggttactattctcgaatgccgaattccttccatcagtcaacaaccaaacatagtccggaatattgcaatgaagcaccccacgagaagaaccttttgaagaactttggtcaacaaaatgccgtaattcctgaaagttctcctgatccatttacaaggaatactgattgtcatcaaacaaatggatacatgacgcatggtctgaaaactgctgaaagtatttctgaggtgttgacccttggtacagacaccgctggcccttacaaacacctattggagcagtctgaaacaatgcgttacccagaaggattgaagctgaagactcctgccagccagtcagttacagaagttgaagaaggtcataggtaccctttcacatacaaaaggaggaagctgcagaagaggcttgaccttgttgatcctgtcaagaaatcaactatggtggattcagagcctctgagcgcactggctagcgtggcaaatgtaaaaatcaaaggcaatcaagctttgaagattggcagctgagaacaaggatagctgaacatagaaattggagcatggcttatgaacatctagctaacatagtaaataaaatgttctcttttgttttgggttctggttcgaagtcaggtggagtgcattcattgttaaatttgatagtagacaaaatgacatgaatctctagtgcaaagcattcagattctctgctttctatcatgcacatccctccctgaatacctcgtcttccagatgagccgcagtttacttagatatatacattgtgttaatgtttttcttttaaaatagtgctgttgacttgcaatgtacttcctccgtttcatcatactaaaaagccattttagctttgtaccaagtcaaatattttcaagattgatcatgtttatagaaaaatatagcatcatttaaaaaaaccctatatatatacccatttgaattaggtatatactcaatttcaacaatggtgcccgggcaccatggagcaccaaacaaatttactatatatatatatatataatgatgatttaatgaaactaatttgatattgtagatgttaccatattttcatataaacatgatcaaatttatatatatatatatatatatatatatatatatatatatatatatatatatatatatatatatatattgatgatttaatgaaactaatttgatattgtagatgttaccatattttcatataaacatgatcaaatttaaataggtttgacttaggataagcctaactctgtactaatgaaagttctgcacataaaatgtgtacaattttccactcatacagtagtatagaaaaaccagtagctagtgataaatgtttctttttctccagctttatctgatctcagccatccgatgcgcatccaacggctcacgttaatcacaagctttcaaatattcaaataaagccttctcccctccacgcggcgagaaaaaaaaaaagaagataaaaatggcgccgccgcctcacctcctcccgctcctcctcggccgcctcgtcgtctccggcgacctccgccggagccccgcccacctccgccgcatcgtcccgctcctcccttcccacccccacctcgccgccgccctgtgcgccgtccatttcccgctcttcccctcctcctccgccaccttcctccacaacatcctcatccgcgcctccgcctcctccgcgtccccgcgcctctccttcgccgccttctcctccctcctccggtgcgggctcgtccctgacaggttcaccttgccgcccctcctcggttcggcgggtaagctcccggccttcccgcgcacgggcgcgcaggtgcacgcgcaggccgtccggcgcgggttcttggcggatgtcttcgtcgtcaacgcgctcctcgcgatgtacggcgcgctccgggacgcggcgtcgatgcgggaggtgttcgggtcgtgcgccggggtcgcggacgtggtgtcgtggaacacggtgatcggtggctacgtgaagtgcggggagatggagagtgccaagagggtgttcgacgaaatgccacggaggaatggggtgtcctggagcaccatggtggggggctatgccgcggccggggagctggatgtggcaagggagatgttcgatcggatgccagctattgggaggaatgtcgtgacatggaactccatggtgacaggattcgcgcgccacgggctgctgccgttagcgaggaagatgttcgatgagatgccagtcaggaatctggtgtcatggaatgcaatgctccggggttattcagtgaacagcgacatggatggcgcgagggagttgttcgatgtcatgccagagaaggatgtggtttcctggacatgcatgatttcagggtatgctcaggctggacgctatcaggatacccttgagctgtttcgcgcaatgcagactgagagcaatgtacagccgaatgaggtgaccatggtgagtgtgctttcagcatgcgcaaatttaacagcactggaagaaggaagatgggtccatgccttcatcgacaagcacaaaatggtgctcaacaacgagtacaatcttggtgctgctcttattgacatgtatgccaagtgcgggagaactgacattgctgtcaaaattttcaactccctggaccgaaagaacgtctcggcctggaacgcgctcatcaccaggttggcaatgaacggcaatgctcgggattccgtagacgcattcgaacagatgaagagaacgggtgaaaagccgaacgacataacgtttgtcggtgtgctcacagcttgttcccacggtgggctggtggatgaaggtcgacggtgcttccagagcatggcgtctacctgcggagtgcagccggaggtgaagcactatggttgcatggttgacatgttaggccgagcagggcttcttgaagaggcagaggagttgatccggagcatgccgatggcacccgatgtcatggttttcggcgctctactgggtgcctgtcgaatgcacaagagatttgatgtggctgaaagagttcagagtgagatccatagcctcaatctcaacgcccagcagtctggctgccatgttttgatttctgacatttatgctgctgctggtaaatggttcgatgttctggaggcgaggcaagttgtgcagaggtctggcatcaggaaatggacacgataggtttaagattcttgcagaagcctgatattgactttacgcttttgagcaatggaagtggtggcactggtgggtatattgcttaatgcttacaagttatcggaaatgtggttagaacatcacaactcataagccccagatagcaaaatactatgctcgttatgcttcagagctgattgaaattgccataacgccaaagatggattatgtcacagcatctgtctttacaggccaaaacttaaaattcatcagaatttattcagttggtcttgtttccttgaccatcaatttccttgagcatcaaaacataggcaaaacttatttaaatcatcagaattttttcagcggtcgtgtttccttgacccttatagaagatccaatgacaatatgctatacgtgcataagcgtagacataatcccacttcatggtcttcgagactcgtctgttagcagtgtttgttactctctgtttcatattgtaatttgttttgattttttttctagtcaagctttttaaatttaaccaattttatggaaaaatagtttcattaaatctaacattgaataattgtaatgatatgtttattttgtgttatagatgctactatgttttttctactatgtgatttataatatgatgaagaggaagtataaaatttagctgatgtgaatatgaacgaggaccgagtgttatgttgttttttggtttttgtcaggtacctactagtcctaattgtgtttttgtcaggtaatccggagtgagctgctctgaagaaacagtcgattgtttgctctgaagaaaaagttgattgttattgctaacagaaaacagatatatttaattgttatcgtgagctgaagaaattttcatcaggtgctccaaggataccaaagaaatcagctgcaaggattggacgccaacgggcaatcgccaacaaacaccagagcgagcaaaccaccaacaaagcacagtataaattgccaagggcattcgctgcaaggaactcctcccgttgctgttgatcaatttgatcagcgtgacaagatctcccattcacactacgcaatcatatgtttctgtaactgtaaattgcaaagctggtgctcgaaggtggaattgaggcagaagaatattcgcaaaattaattgatacatctaacttgcagaggaaaaaatagacaactcatgaggacactaatataatactcatatttagcaatataattaacgtacgcagttcgagaacccatagcacaatctagccccatgcattgcaggctaggtaaaggtaaagcaaatcgcacaaaataaaccgaaccgacccaacaacgcgatgttcaaaaggtaaaacagataagctagctccaatgctccatggtgtactttcgctgcgaaggatttgacgaggggaaaaaaaaggaaacccgcttagtcgacctcctccatcttgctctcgccggcgtcgtcctcgagcggcggcatgtcggtgtcggcctccgccgtctcgtcctcgtcgatgctcaggccgagcttgagcatgcggtggatcctgctgccgaaggtgttggggtcgtcgaggctgaagccggaggtgaggagggccgtctcgaagaggagcaagacgaggtccttgacggacttgtcgttcttgtcggcgtcggcgcgcttgcggagctcctccatgatggcgttctccgggttgatctccatcgtcttcttgctcgacatgtacccggccatgctcgagtccctcagcgcctgggccttcatgatcctctccatgttggccgtccagccatactcgccggtgacgaggcagcacggggagtccaccacacggtccgagaccaccaccttctcgaccttgtctccgagcacctccttgatgaccttgcagagaccctcgaatttctccttgagctcctccttccgcttcttctcgtcctcgctctcatcaagcttgagtccctccttggtggcagagacgagcttcttgccctcaaactccttgagctggccaacagcatactcgtcgatggcatcaaccatgtagaggacctcgtaacccttcttcttcagcttctccaagaagggggagttctccacggccttcttgctctcgccggtgatgtagtatatgtcgttctggccttccttcatcctcgtcacgtaatccttgaggctggtcagctcatcgccgctcttggtggagtggtacctcaggagctcggcaatcttgtttctgttggtggagtcctcgtggataccgagcttgaggttcttggagaaggcttcatagaacttgttgtagtcttccttgttctcagcaatctcgaagaagagctcaacgcacttcttgacaaggttcttcctgatgaccttgagaatcttgttctgctgcagcatctcacgggagatgttgaggggaagatcctcggagtcaacaatgcccttgacaaagctcagccactcagggatcagctcctcacagttgtccatgatgaagactcggcggacgtagagcttgatgttgttgagcttcttcctcgtatcaaagaggtcgaatggtgccctcttgggaacaaagagaacagctttgaattccagctgaccctccacagagaagtgcttgacagcaagatgctcctcccagtcgtttgtcagggacttgtagaaagcagcatactcctccttagtgatctcctcaggcttcctcatccagataggcttctgtttgttgaccagggaccactcatgagaaacctccttgatcttcttctttttcttctccttttcttccttctcttcatcaacatcctcaaccttgccctcctcagcatccttcttctcttcctcatcttcatcatcagaaatttccttctcagtggtcttctcagtccatagagagatagggtagctgataaactcagagtgcttcttgatcaggtccttgaggcggcgctcttcaaggtattccaactgcaggaagcatgagcaagttgtcaataacaaatgaacacattagagccaggacaccttatagcacatttcacagttcaacttaggagttcaggtgattctaaaaattcacaacagtagaacagtaatacttgttactaattaattcatagtactccctccgtttcacaatgtaagtcattttaacatttcctatattcatattaatgttaatgaatctagatagagagatatgtctaaactcattaatatcactatgaatatgggaaatgctagaatgacttacattgtgaaacggaggaagtattagacaaccacacgcaatcaaactgacacaaaaccagacccaaagaaaaaaaatgcatacacaatcagtttatgagctcaacaataagcttatagatcctaagtacatgtgtaacatgattactcataacatccaaggcagaaacatactaacataattttcacagcaggagttcgaaatgttaaggcatctatctagattatcacaatgtcaacagtgtgtgaaatatgttcattctgttcaatcaattcaccaaatgcccctacatagagacattttttatgtcttaaacagaccgattaagcacctggctcaagcatgcctatggtgaaaacttgaggcacatcaacatgttctttctaaaagtggctataaaatcaagtaccaacaatattcgtaataatcctacgaggacagaattactagttgatgcatttatcaatagcaagccacattcatgaactataagggcattcagcaatacaagcagcacaaattgaacaagaattcaatgaaattctgttagtacctgatcatccttgaggtagagggtgatcttagtacccctcccaagctgctccccagatgtgtcacgtgtgacagtgaaggacccaccagcctgagactcccacacatactgctcgtcatcgttgtgcttggtggtcacaactactctctcggcaacaaggtaggcagagtagaatccaacaccgaactgaccaatcatggacacatcagcaccagcagccagtgcctccataaactccttagtccctgacctggcaatggtacccaggttgttcacaagatctgacttggtcataccaataccactgtcaatgatcgacagtgtgttggaggccttgtcaggaacaatatggatgaacagctctggctgagcatccagcttgctcttgtccgtcaagctctcgaacctgatcttgtccaacgcctgcagaacacaaaagcataagataagtggccggttttgtatgaaagcagctagcaattccaattcactatccgacaataatttaataatgtttccacaccaaaagttcagctatccccatctattctcacagctcaatcttgacaccaaatgggacatctctaccctgcccaaatttagcaactccaaagatttcaggatttaccacatttttggcaggatagagaaccagaccaatcctcagttcataggggcaattttaacaatgaatcagcagagtaaagcactggttgggtgtttttgttccatagggtcaattttaacaatgaatcagcaaagtaaagcactggttgggtgtttttgtttcatagaggcaattttaacaatgaatcagcaaaataaagcactagtcgggtgtttttgtcttatatatggtcaaaccctcctatcaatttagaatgtgacataactagcaaaataaatgacaaataaatgataactagcaaaataacaaccctctatgtttataggggatatgttttacaacatttaaacatcaacactcaaagcatgtgagacttttcagatgcgactttatcagagcaatcgtaaataatgctacgagattaattagcagaacaacgacagataatgctgcctatgcctgcagttatgtttataacattctaatcagcagcaaaattcaggactcttaacaaaattaaggaccgcatgatccacagattattacactaacaaaattaagtactgcgagcatgatccacagattgatacactgagaaacgtaattaacgtcggaatcgaaacataatcttaaaaaatggggagtgaaacaccacatcgcagatttatgttgggatgatgtctcagtaaccagtaaccagtgctgcagtgcaaactccctcacacacccacacacataacaacacacacgagtcagctcgaaccagattgggtgaacaaaccgatctaccaatcggaccaaaaaaaagcccttctaacgcgcgcgcgtgcagatctgaaccagtaaaccgagggcacttacatcggaggagttggagatgagctcgcggaggaagatctccttgttggagtagaacgtgttgatgatgagcgacagcagctggttgatctccgcctggaaggcgaacgtctccgtctccgaggccatggcgctgcggcggcggcggaggccggaagcttccggaggacgacgacttggaggctagggttagggctttaggagagggagctcgcgtggcgtgtgcgattcgattggagaaagatggggaagaagggggcgatatataagggggagatgggggttctcgaacgttctaccaggggctcgaaccagcgggggagttgggagatggacgacttgacgagtcgtcgggcccacatgtcagtcggttggttatggtttttatattttggaaggttctggaggagtggagaggcttggagtcggtttaaattaagaaaaccatcatctctatggtctagtactgtatgggaatagtgaatactataattcttgtaaggggcaattataaatttaccactgctttaaatcgttattgtaaaactgccactgaaaaattacaaaaatatcactaaaactgtcattcgaatagcatctttgcaaaatagaaaaaatcgcaaattagatgcaagaaggttcaacttaattacaggatgaattttggaaggttcaactgcacatcgcagattagatgcaagaaggttctggaagcgaatgaagacttgtggtctttatctttagggttatgttatttggttaaggttggaagcctttcctcgtaacacgcaaaacaaaacaacctattgacacgattaattaagtatcaattaaaaaacttatatatatatatatatatacatattaatatgatttttaaaacaatatttttataaaacttcatagaaacaaattacgtttgatagtttgagaaatgtgcgtgtgacaaatgagttattgaagttggaatagtattgcaaagaacacggcctaggttcgttggtcagcaaaactaatttggaaccaaacatttagtacaatctagaaactatcaaattggaaattggcaatgccaatgatttggttgcaaaccaaaaccacatgtgcactattcaactactaaaagtattttggtaggacatgttttggcatatcaacaaaataatttagccaattgcaacacacggggacacagacaaccaaacgagatcagaatgcagacgtggtaatatatcaattcaaattcatgaacaaaaacttatatttcaatgtatggacttgcagaattgcacaaacgcaaaaggaaacaaaaaaaggggcaaggaattgtgctttgcttcactgcttggcaattggcaaggcgacggaatcaatcccggggaccataggctgaagggccagaaaagagggcacaagatgtcaagcttgttccgacttccgagaggaacttcgtacaacaaaatggaagtatatacgcctatcatgtacacatggatctatgaggtatatacagcacatactctgcctgttctaaaataagctaatttttatacataaaattaaacatagcatgtgtagattcgtgtgaaaaggttaatttatgagggtgtttagatccagaggtgtaaaactttagcgtgtcatatcggatgttatatagggtgtcgcatgtggtatttggacactaataaaaaactaattacagaatccgttagcaaaccacgagatgaatttattaagcataattaatatgtcattaacaaatgtttactgtagcaccacattatcaaataatggagcaattaggcttaaaagattcgtctcgtaaattagttacaatctatgcaattagttatttttctaagactatgtttaatactttatgtaggtgttcaaatgtttgatgtgatatggtgtaaaatttttgtgtaggatttaaacagggccttattctaaaatggagggagtaaaatggtgaaattttctgttgtactttgttagtgtcatcggtcagctcgggcgttgacctagtaatatgggaactgtggtgtgtaattccttcgaaatgaagctggtcacttcatctctccagtccatggctctgcaagtctcgcaagtcgttagatttgtttggtccttcatctgctttgcattcagattcagtcagcccaaacttactagaatcctgatgatcatcagtgtcaccactttgggatgtgaaaaatggtagtttctgtccaatgtgtggtgaaggagggagtgctgcaagattaatcaagaaaacaagggattacaaagcatggaattaagtatggtttaatgatgtggataggaccgtttggtgtccaaaattttgagggtatcaactaaacatatccagaacaaagatgatacttggggtacaaattaaagtcctcggtaataatatatcttctctggatgtctcccagtttcaacttgaatctgtttgcagtagaagtgccttcctcgctatgctgttctatactactccctccgtcccataatataagattttgagtttttacttgcactgtttgaccactcgtcttatttaaaaaaatttggaattattatttattttttttgacttactttattatccaaagtactttaagcgcaacttttcattttttatatttgcacaaattttttgaataagacgagtggtcaaacagtgtaagcaaaaacttaaaatctcttatattataggacgaagggagtatatgttacccatattactccatcaaaattcacctggtattgcaagttaataatcacagcagtcacaacctacaattgtggaaatcgttatttggtgagcatatgtgacattttgctacaaaggtaatttttcatgcgataaatttaacactgaacatcaaatcatatatttatattcgtaggccacaactaggctgcattatccaataaaagaaacaataacactctcaaccatcaaatactagtatatgagcaaagatgctgtacacatatgaaacttttggaatactacacagaaaccaaatgtgcggcttcattttaagcttatatattttgagtttttacttacaatgcttgaccattcgtcttatttaaatttattttacaaatataaaaaacaaaaagttatgcttaaagtactgtagataataaagtaagtcacaaataaaataaataataattttaaatttttttaataaaacgagtggttaaacattgaaagcaaaaactcaaaatcccttatattatgagatggagggagtacttattagtcaaaatttaaattttcaattttaaatttgaaattgattttaaagtttttttttatcaaagtttatttttagcatttacttttaattcgttaaaaacacgcatataaaagttttattcacaaatgactttttctttgcagatatgccgatgggcacccttatcatcgactcatcgtagtattagaatttattagagaaaacaaattgcggtaaaagaagggtaagatggacggcgtcagctatatttcccaagtctaaaacgtccagccgtcagctattacgcaatcaccaggagacggacggcgtttataaaccttcctccgtgcatagaatcgtcgtcccttccctccgagtgccgtacggccgctgccgccttctggaacattcgcttgcctccgccaaaaaaaaaaaaaaaaaatccctcctcccctctcccctcgagtggggcgcagccgcctcgctcgtcttccttcctcctccaccgccgcgcgtgcgcgagtgcgcagccgccatcgccgtgcgcttctctgcctcccgatctgcggtgcgaccggtgtgatcgcggagcggcggccgacgagaaggatttttttgagggaggggggcgagtggtgcgacgccgctgacctccttcaattccacctgccccaatctcggttgggaatcgaatcgaaaggtattcccatcccctcctgcttggctgagccatacggggctctgattgattcatatttgactcatattaagcatccagttttattctggatttttttttggcgcgtggtgtagtactactggagtagcaacttgtgtcccaaaataaaattgagggtttagccgccccctgctcattagatgcagtggccttatactttcatattgatatagcaagatagggtagtaattttttttcttccctgtcttgttgataacttcttggtaggtgccactatgatcttctgttataacatcatcatactatgaaattagtttgatggcataacgtgtttttttttcttatcaggaataagatggaagagaagagaatagctcggatttcggtcacttggagaggcagacagctcgatgtcgatgcagacccgagctgtacggtgaaggaattcgggcaacttttgcaggatttgactagtgttaacccagagacattgaagcttattgttccgcagtctacaaacaaaggctccaagctgatcacaccgttttccgaccctcattcagttttgacattgaaagaagctgctattagtgatgtaagatgcacaagagttgtacttgctcagcaatatgttgctacgttatggatattataatggagaatggaataatttatattcaatcattgtttgctacaggggaagcctattagaatgatgggtgtttttaatgatgaaatcgaggaagtatcggacaatggcaaaagaacagatctacggataattggatttgaggaggaagaacaacggctgaggcaacgaacatcaggcaggccccaagttccactcaaacttccacagggccaatacatcttctgtgattttcggacacttcacttacctgggattgaggttagttagcctctactccctacgtgctttctgaaatctataagaaacagttcatgtaggcatgtcaatccgccccttccatactccacatatcatttgtctcctcacggattatcataaaccttagcgcgcacattttcctctgaagtctgaactcttgcaatttcctgcttgaattaggatgcaagcagcgcacgaagtgttccatttgaacagtatgcacactataaattgtggattaaatagtttgaaggaattggaccattgtgcagtttgcactggtttctgtccaaaactttgtgaaaagacaacgttaaacaatgtggtgtgctcattttatttatcatagttaacaccttctcatttcatgacatgacttcactataataattataatgaaatcagtatatgtatgaaatgaatgggttcactatgacaattgtaatgaaatcagtatatgattcctgtaacttgctatagattatatatagtacattagatttgaacactagacattattttcatatatacctcattctttcgtaaaaaaaatacatgcatgctagtagaaaaacagatatacctgatttgtatgataacaaataggccaatcacaacatcttgaactatcgagttttgcttacgtgccttttgtttgatgccagttgaatcccccaccttcagaagctctgaaaagaatgcacatgctagcatgtgacccaggcataattgcgatcatgaacaaggtagcaatattttcaagtggtgtttctgttttttatgtttgtgtacattcgttattttacagttatcctgttggccttttcagcatagatggcgagtgggaatcatgactgaaatggcaccagtagggtatgtaggcgtcagtccaaaatgcattctaggcttcaataaggttagtataactgtataagctttttactactgcacatatggatacttgtcacacaacaatttctgaggttatatcatcatgtcttcctcattgttaatacagaacatgggagaggaaatatcccttcgcctacgaactgatgacttgaaaggatttaggaaatatgaaagtatcaagagaactctactccatgaacttgtatgcctccttggttttctgctttcatgaaatggagatttcttatgcagatcttccgtttgtcctctgtaatcatgcctattgtatattaaacttgcacttggtgatttcaggcacacatggtgcactccgagcatgatgcaaatttttttgctcttaataagcaggtgattttttttcctagacaatcctttcatgattggctactgtctctttatgtttttgagttaatctgttctttaatacaatgtcaatttcagttgaatgatgaagcagcttccttggactggaccaagtcaagaggtcatgtgctgagtggtcgcaaaatcttcgattcctatgaagacgaatttgttctggagccagacagtgttgttgttggccacaaacttggaggaggatccagttcactggcaagtgctcgtgtgttgtctgggtctgctgcttataagcgttttttgaatgcatcagcggatttagagagttctaaagacagcgttactatacctggaaatgaaattcttgtgcctaacacaaaatttgagcctgatccagatgatgttggtcaagatttttctcaggacaacactaaggtggagccagacccagatgataatgatgacatgaacgtggatgtagggactggggcatcttggtcctcagtttctagatcatttacagaacaagataccatcagtcactcagagcctgaccctgatgatattcaccagcaaagcactgctggttgcctagaacctgaccctgatgattcctcaaatgttgatattcttagccaggagttgacgattgatgggaagcagaatggagaacctgatcctgacgataatggtactagcaaatttattcccgaacctgtaaacaagatggaagtagagactgaattgggaagtaacttcgcagttcagaattctgaacctgatcctgatgattcctcaaatgctattctgaataagaagctgggaactgacaggtctgatgaaactacatgcgaagctgttgtagaagaatgtgtaaacaagatggaagtggagactgaacagagcagaaactcgacaatgtcaaaatctgagcctgatcctgatgatcatgctgctaattcaaacatcagtgagctccagaggatcgaagaaccagtggcagccctctgtgcacgccttcagaaggccattgaaatgcttcgctcacaagcaacacctacagaggcaacttctgctcttcaaacactctttaagatcatcaagaatgtgatagagcacccacatgatatcaagtacaggagactgcgtaaggtatgcttggctgttcttatgctcttttattaggttcaattggtccactaaaaaaattcttacttactaatcctcatttttcaaatatgcagtccaatccacagttccaaaggagtgtggcgaactacaaaggtatctatttgctttatagactcccctctttttttttcttcaggtcttcaaaaatcaactgtaactaacttcctcatttttttcgcctccctgaaaacagctgcaatggaggtccttgaactgattggtttctgtgaggatgtcgtctcggatgagattggtcgtgcagagacttacttggtattgaaaaggaacgatcctggcttgctgtggcttgcaaaggcctctcttgaagtttccatggcctgaattgtttcaccaagcaatctcctattgcttctgtatacctgtaaatcattttcattactgttgtggggatgctcatatgctgctcttaggcaaatgatgtagtatggtcttcctacacgatgattgtttgtatatggaaacaccaaaatggtctatactgtctgtcaacacacttcatgatttctcatcaaatatacaaactatagataaattacctggcaaaatggacacatcttcccttttgtgtggactctgatagaaattgattccagatgctcacaaatgccagccaaccgtatccacgaataaagtctcgactagacggtgtattccattatcatcacaaagatgttaattttggaactgaagtatataaaaccaaatttaatcaccaaaggtctaatgtttgggaactgatttttttttaaaaaatcaaatcttaaatctttgccctttttgttctgtattgggcctttccaacctcgatcccaacaaattccgggctgtaaattcggtgggcttggtgtctaacaacagcagaaggcccacatgcgtcccatcgcaatatcccatcggccgctcgctttcgacgcgtagcggcagtaacacacactctctcccttccgatcgtcgccggcggccatcggcggcgctagggttcatcgggttacgcaggacaaactgcgtaggcgaggcgcgggggaatctcgcgatggaggcggccgtcgcttccaccggctccggcctgcgctgctcgcccaatccgatgcctaagcagcagcacgagcggcgaagtgctcgggtgggcttcgtctcccagccgcgacctcgcgctgtccgctgcgagcggtcgccccatccggatgctcgagcctacgcggcggtggcggtgggggtggtggcgaaggggcgtgaggttgggggcgtcggggtggagagaaggaggctcgcggtgttcgtttccggtgggggatccaacttccgggcgatccacgacgccgctctgggtggggaggtgaatggtgatgtggttgcgttggttaccgataaaccaggtgacgatgacgacgatgctttgcttccttgagctctttgggtggcgatgtgggtggaattgttgggatttattggggatttttgatgtggcttgcaggctgtggaggagcggagcatgcgaggggtaatgggataccggtggttgtgttcccgaagtcgaagtctgctccagagggggtttctattgatgagttgttgaatgctctgaggttgggttggttgctttgatctcaccttcaggctttgacattcgatgttctagctttagtagttcatctgttaggttttagataagtggatttgtagaaaaaaatggtcgatatgagatttttcacacttgcctttagtcttgtttgcaaaatgcatacatgatacattgctgtgtgctgataaaagttttctaatccatttatctgtcttatgtgtgcgagtagcgtttaaatgattttaaacgaagatgaattggtaactatttaaatgattttagtgtttacttattgaatgtgtgccactaccttgttttgccagatgaactttgatatcagttttatgctctgggttgacgtttagtccggaacctgttggagtgtgttcttcatcagttgtacagtgtgcccacacagtcagtcagattagcttccattttgttattgcctagctgatatactgtaatgtaccactgttgattttttcacgaatagccactgcatgttttacggtgtttgtagttcccacttcacttatatcctcttctacaagactggcttgcctactgcggatatttgttttggtcacttgcaataggtctcaagattctcaatctatccttaatttcttatgtgaaacagggaactcagggtagacttcattctacttgctggttacctgaaacttatacctgttgagctagttcaggaatatccaaaatccattttgaatattcacccttcactactcccagcatttggaggcaaaggttattatggtttgaaggtgcataaagcagtcatcgcatcaggggccaggtacttcacaatctctctatcacccatcacaagcaactgctgtgcagtttgcatatctactcaatgctatttccatggaaagcaatatcttggcaatcaatttgagctgatacctcacattgtagaagaaaattaaatcttgattattaacttaattggagaatgatctttgtttgtactctaactgttaagtgtcaactatacacaggtattcgggtccaactgtgcactttgtggatgagcactatgacacaggaaggactctagcccaaagggttgtacctgtgctagccaatgatactccagagcaattggctgcaagagtccttcatgaggtaacatatcttatgctccgctaagatttctttgatgatacatggctatgacatattcacttagctgcaactgaaattgatgatacacgttcttttgctcatttattaaccttatttttcaggaacatcaggtttatgttgaggcagttgctgccctatgtgatgaccgaattgtgtggagagaagatggtgttccacttattagaagtcatacaaaccctgacgagtacacttaactcatagtactacctcaaggattgctgcgcagcatgcacgtaatgaggcttctagaatgcctgcattgttttttcccaaggcatgaaggtcactcgtactaattgagataaataacttgtctggtgctgttactgaaacaaaatatcttgtgccgttcaactcaccgcttgttgtgtgactttgctccaacaatgacatgcgcataggccgatacttagaaacctcagtgtttgctggtgtgacttgcggaagcatactggttgctgcatgcaccaagttttttttttttttgtgtgtgtgacagagcggggtggggtgggggggagggggtccattgtaccctttagtcttggaattgttgtaatcggctgaagtcaagtcgatcaaagagggagtaaaaactggtcagatcacacaggttttcaatgtgtaatctgattaccatgcttcccatatgttccatccttgtttggtctgaaggtgttaatatttaacccaactgaagttttctttgagattttaaaagttctcttgcaaatttcagtatgcgagagggatagaagaaggggatggtgcaaatgacagccattcttagagaaccctctccgacagaaaggttcctgccaactcttcctccattttgtttttaggtactacatttttgtattgagtttgggttagatgattcttgaagcaattaaggttgtttcttgtgttgagggctgcaggaat

SEQ ID NO: 68527 - DNA, 4656 bp, Oryza sativa
  unsure (1)..(4656): unsure at all n locations
tttccggggtttttcgggggggtttaaaagcggggggaattccaagggtttttgggcagccgccgcgtacggcggcagggagacgtgctcgccggtgcacaggttgcagacgtaatactccgacgagctggcctggaacagcagcgtgagcccgttgcacggcttggtggtgagcacgacaaggtcgtcctcggcgggaaggttgcccacggtgacgagctcgcgcgccgccgatgagcccgatccgtccgacgctagcttgcaggtgtaaaagacggcggtggcgaagcccccggccgccgccggcgcgaagaagacgatctccgggcggccgtcgtcggtggccgtcctgagagcgcggcgcacgcggacgaagtggtcgaaggtgagcgcggcgcgccacgcccggcagaccgcgcggaggcgaacgacggcggccgccgggacgcgcgcgaggatgtggccgacgaccaggtcgtccggcaacaccggatgatcagcgtgccgaggcctcttgcacggcggccgaggcggcgtcgaagcttcttcggattctgccatgatcgatcgtgtgtcagatgagatgaatatgattttgatcgtgctaggaaaaaggaggcacaggccctttttatcgatacaaattaaggtgaagtgcaacatcgtgtaccagtccgactcggattggtagttctaataagaaataagttcaccggagatcactcgacttaatagagagatttttgaggtcccttgatcgcaaaatcagaaatatgtatctcttaactcaaacaaaccgtgtactcaaggtcgtatggcagtacatatgggtggttttgttaacatagtattctagtcagaaaaaaaattaaaaaaaatacatgaggctcacatatcagctgcacattttttttcttatcttttcttctcctgctcttctcttttctccacgacgggccggcataagaaccaggtcaatgccgatgacgtcgtgtcgtgcccgacgaggaggaagttggtgaccacgtcacggaggctctcgttgctgtgctcgccgctcgcagcgaagcgcaacaggaagtcgtcactgcgcgccaacccggccaccactctctccctgcgctccccgacgatccgctcggcgaagccgtggatcgtggcgagcacctcctgcaaccgcctcttgggctccatgttgaacagcctcttgaagcaccaccgcgacttgaccggcgacatgaaccggtccatcacggcgttctgcgcgtcgttgaacgcgcgcatgaactccgcgctctggggcgaggccatgctttcctcgcgcgaggcatgccgggtcctcgtcgaaggcgacatggcagatgttgtcgaacgcaaagcactccagcacgtcctgcacgtccagcatccggccgtcgcgctccgcccgctccagcagcggcagcagcctctcgacgacctcgaacctgacggtgtcgaccacaaagttcctcaacgagcgcttgttgaacttgtagctggcggccttctgctgccacagccactgctcgccgtcggagttgaagatgccatggccgaggaagtccacgagcatggacacggcgagctcgcccttggggtagttaccgaagttagtctttagcgtatactcgacattggccgggttggcggtgatgacgccgccggtgaggccgagcgccttgaacgacatggtgtgcgtggggctccgcttcatgacttttggtgtacgagaactggtggtgcgccatcgatcgccacggcagagtgtggggacgagtcttcggagttggcccatggtggcgacgacagcggtggtccaaccgttgggcgcagcggcataaagcatgcacaagagtggctcatattggttcaacagcggtcgggcggcatcgtctccctcctctcccgcgggacagtctaggctggcggcagcgagctgagaagctcattggcgatggcctcctcgagccagccctcggcagcgccaagccagctagtcgcccgaaaatggcgctcccccttcttctacaccaccggttccccctctcccaccagcgcgacgcgtggagaggacgggagagggagagttggtcgacgggagatggccagatgggggaggggaaaggcggccggctgctgccgtgctcaccctccgccgctctgcccgccactcgtcgaccgctgccgcgctcgcttgccgccagcctnccgcatccgtgctcgccatcgtcgctccgctctccgccggagagaagagaagagaaagagaagaaaagaaaagaaaacaaaaatgtgcagctgatatgtaggttccacgtatttttttcaaattttttttctgactaggatgcaacgtcagtgaaatcacccatatatactacgataggactttgagtgcacggtttatgagagtttaggggtagatatttctgattttatggttaagggaccttaaaaaatctcgctgttaagttgaggaacctattgtgaacttactcttccaaataaaaggtcacagatcgatttaattaggcctgcacgtataatgcgggccaaacttggttcatgctcatgcgggccaaatcttgcagaaaaatgatattggcccagcctgcattgggcatgcccgctaataatacgtattcttcacatgattacgtatttttatctttacgcctttgatcttagttcacggaaacgttatcctcgcggacggcgtccctccctccttggccgcccaccgacgacaaggagtaccccgcggatccggcagacctgtcccccgccgccaacgactcagacggtggccacatcaacctcttctctgcccgcggcggctccggcggtgttgccgacttcgcggcgctcgcctccgccgacggtgggaggggcaccgccagggagtgggagcctcccgcgaaccctaaactgatattatgataaggtttggttaaatttagtaacaagcccaaaccttctatacaaggctaaaccgactttgtaaataaggttggccaaaccgaccttcagcataatgacgagccaatcttagctatagagtagaccgactaacaaactctagagttcgagttcagtttagatatttaccatattttcttggttgaaaccaggatttctagtgtcctattggattttaagaccaactgaacgtggagaagaccttgtaaacacaataccaccccttctataaacagactggggcaaggccaatcgtaaaaaccactaatcaaacgttaaaatcaatcaactacccctacccttgtattctacatctcccttcttctactagctacctgtatctcacgtcatttcatcctcaaccccctaattgctcgttgtctctctcactgctggagaaagggtctttaaccccggttcataatcccctgtagtgcaggttatgcaaacggaagcacgaatccgagactaaagatacaacatactggcacatgcgagtatataacatactggcacacgttcaccttgacgggtctctcacatgtgtttgtttgacaatatctacctcccatgcggcaatgtttgtttgacaatatctacctcccatgcggcagtgtgtctccgagtgctgttgtgggttacacacaacatgcttaaggtgtggtggcgtgttttgatgccaacagtaagactaatttaaaattcgaaataaaaacatttccctagccattaatctcaccgtcattctcttctcctagcgaagtcgagtgatcaggagaggcgacggggctaccggcgccatggccggagaacatagaatttttttcattttaatatttacagaaatattataccagcgaaaatatttacagaaatagatctgccgccaaagtgtatggcagcaaggtgacgtggcacatggcgccccgtgcgcattttgcgctgaggtcccttgctagttgctaccctctgcaagggcggcaagggggtgaaatgcaattttcgccacatgcaaaatttgcatgcccactcagcagcctccagcacttggtcacacacgtcactctaccaccctcggggagggctgcagagcctatttctgtaaatattttcgccggtataatatttatgtaaatactaaaacaaaaaaaaattacaaaatgaaaaaaattcggaaaacgtacgtgccgctaatgggccggagagtgcgggaactagcagcgaattagggcccaattagatgtcttgtgttgggttaggcccacttgaacgaacagtcaggctgaatcctagccgcacgtctccatccaacggcagtcatggacgagaaacgagtgggggtcagagatttcttttccgaccgagctgtactgggcattcctctgggaacctcatgagaagggcctatcttggtactctccgggcccacctgtcggtgtcacacctcgacgttggcgcgcagataaaattggaaaactagagggggttagcgcgaaaaacaccttcgctttccccaatctctctcccggtcggcgaaccctctcgacggcggcggcggaggaggagccatgggaggccacggcgggctgaacatcctgccgcagaagcggggaacgtctacaactttgacaaccgcgagaaggtcgccccgaccag

SEQ ID NO: 68528 - DNA, 5703 bp, Oryza sativa
cccttttcgccggctggggagctttgcccctgcgcacacttgtcacgctcacgcactgaacaagcgaagcagccacacccacccacgcacgcacaaacagacgcagacagacacacacggtcatcacacacgcgcgcagctacaaaaacgcaccaaccgcaaccggcgagcgcgcgacgcgagtcgagagacgggagagcagtgcagtgcagtgcagtgccgcctcgtcttccttccctccctcctcatactctctctcctcccggtcttctcctcccccgcccaaagcggagcgcggcggttatatatatatatatatatacagcacttcctcctccttcctcgccgcacgtcgccctccgacttcgcctcgtcagccgtcgtcaccgcccccacccggtgagctccatcgccaatctcatcctctctctctctctctctgcttccagttccttcattctgtgtgcctaattgggtggccggatccatgcggaattccgagctcactcggtgtgctgctgttcttgcatgtatcggtgtttggggattgatctgggtgcgggagctgtaggggagtgaattgcgtttttcggcagtttcttttcttctttttgggggagtccttactggtaggattgattagctcgtgttatttcggtgaaaatgttttttttccctttttcaaggatattcagaattagtccgttcttgttcctgatgaacatacggccgttttagttacaatgctgttgatcccaattggaacggggagattagtcaaatctatctggcctcgcttggattagaggtgtagatttcataatcagttttggcctggtctcttttattgctctgaatttttttcaggttcagaccaacaaaaaaaaaaggcattgcattatggttgcagtgttgtgtactgcctctttgacttgttttggattgatgcatttctttatatcagatgcaaattaacggtcgagttagacaatttttttatagtaaggagttcttggagattcttctccttccagggccatgatactaatacagtagtagtatcttccatatgactgcaatttgtcagaccagattacccggagaaagaaaaaaaaacaaagatgtagttctgtctgagtagaacaacttgctcaacactctcttaaacttgatcacctgtctgaccatgaatgaggccatgcataatgatctatacttaggagtaccacatggataaattatttattgcttctagcaatcattttcttttttaaaaaaacgttgttctatggatctcaaattcaattgtagtcaaccatgatccatccatttttaggcatcttgaaatgaccttcttctttgtgttcttcctctagtcactgaaaggagtttttttttaatatatatatatatatatatatatatatatatatatataattttttcgttcttgttttgttcagtggattgcaccggagatcggaatgggcggcttcgcctaccccttcacgccgtcgccggcgtggtcgcgggacgccgtgttcgctggctcgccgtgggccgcaggcggcgtctcctccctcgccgacgctttggtgagctacggtgccgtcgacgacgaggaggccgcgttcctcggcaagaccgccgcgtcgtctcccagtacggcgaggctgcacgagcagcagcagctgctgctggaggctgagctgctgcgccacggcgacggcctcggcttcgccgcgatggacgacgacggcggcgccgcgatgctcggcgcgctggagccgtgcgccatgccgctcaccgacagcggcggccccccggtcatctgcagcagcagctccaacgacagcagcgggagcgagcactccgccgccatgcctgcaggaggcggcttcctcgtcggagagcagcagcagcacgtgccgccggcggcctacgccgcgggaggtgtactcccgtccatggccgcgggagaagaaacgccgcagagcttcggctttggcagcctcttcaatggcgatctcctgcaggaggcgaccgtgagcaagtatcatcatcatcagcagcagcagcagctgggcgttgtgccttcgtcgcagccgcatcatctgaatgtgagtaacaagaaccctgaattgaatctgacatttacatgtaaaagcatcattcatcgccagtggtaacattttagggcttgtttagttggcaaaaatttttgcccatgcatatcacatcggatatacggatacacatttgaagtattaaacgtagtctaataacgaaacaaattacaaattccgcgaggaaacttttcccgtaagacgaatttattaagcctaattaatccgtcattagcaaatgtttactgtagcaccacattgtcaaatcatggtgcaattaggcttaaaagattagtctagcaatttctgtaattggttttgtttttttagtctacatttaatacttcatgtatgtgtccaaacattcgatgtgacagcgtgaaaaattttgtttgagaactaaacatgcccttaatgtcttggaattgcaggatgacatcgatttcaacactggaaaattgatgtcttttgcttctggacagcagcacgttacccccagcattgacagcctgcagatcgaccagaaggtgaggatgagctcaataaaatgttttgtcttttttgttttatgcgacatgcttgacctcaattcttctaagtagatctgcatgttaagtcaatatatagtgccgatttatcgctatctaaataaagcagcacagcacggtacagtattagttagctaaaggctgagatagaatcggaccctgatacttcagtttacctaacaacctgagctgcaatttttttcaggaattcagcagtggcctgcaccacctcaatctctcctcgctgatttctggaccactcgcatcattcaatgcaacacagagccatagacaggttcttgtccttccttgtccatcttgatttgccaatcttttagtaaatcagtcgaattcctctgcaatatctgatgtcctgaaaacctgagcaagaactgttgtgcatacagcctgctgaagcttgcggtggcaaaaatggcggcgccgctccatttgtgaacctatctgaggtgctaccaaagggcaatgggagtggtagtgctgggaatggagcacccaagcctcgtgtcagggctcgccgaggccaggccaccgatccccacagcatcgcagagagggtgagtgggttcatgtgattcttgttctgcttgaattccagtggttagttcagctagaagaactgtagaacaacggattacagcagactgtttgactctgtggtgatctcctgtttgtagctccggagggagaagatctctgacaggatgaaggatttacaggagcttgtcccaaactcaaacaaggtagtctacttactgccatgcttctttattaccagataatgctagattagtagtacctcgttgagatgcttgtgatctgagatgacaatttgtttttctgttgtgcagactaacaaggcatccatgctcgatgagatcatcgactatgtgaaatttctccaattacaagtcaaggtttgcgtgccaccacaaccgctcgttttcacagctatgtttgtttcaattgacaagctattttctgcttctgtactaatgccattgctgtcctttgaaggtccttagcatgagcaggcttggagcggccgaagccgttgtccctcttctgacagaaacacaaaccgaggtaaaccaacaaaatcaattcacaataacattctaacttgtttaccactgctgatgcaatcaggtcaaagaacaggaagcggttaatcctgttaatcacaatgcactcactgaaactgttgatgcagagccccgggtttctcctgtccccaagatcatcatcaggagaaaggcaggcaggagcaggagcagtaacaggagggctccccggcgatcagccggagctcctggacggcggcgccatgttcgagcaggaggtggtgaagctgatggaggacaacatgacgacggcgatgcagtacctgcagagcaaggggctctgcctcatgccggtggcgctggcgtcggcgatatcggcacagaaggggacgtcctcggccgccgtccgaccggagaagaagaagaacggtgatggcgatggcggcggcgacgaggaggacgtgaagggagagtttgacgcaccgaggaggcctcctgtcggccggccgaaggagatgaggtccagagtctaagctagaacctctgctttgttcaggagagatggagcttaatttagatcctaacactttgctacttatatgtttattattatgaaattttaattgcaagttgcaactggtgatctcgaactacattttgccggtgattagaaaattgttatatggaggttagttattaaatcatatataattatattttgtattgttgcggtccttgcggacaatgccattcagtaccttgatatttgatctatatagttcacaaatttttgtaaattatgtctttactcatgctggttatgatttgttccgagtttggtgagacatattggatgaagtgccaaaattatatatatttatgaaatcttcgtgaccaaccatcatgattcttttgtgcagtactccatttgttcctattataagatgtttcggcctttccatcttttgtctaacattcatatgaatttgggtatgtatatatgaaacataaatacatggacggtcaaatgtttaacgctacgtttcacaattttcacgcagttgaactcaatttcaggaagacggcatggttgtagctagtaaactgaactcgaactcaatttcatatcaactttgaggcacaacacaaggcataatcgtatcaactatcaaaagaatagtgtgatccgtttcaaacgatgttcagatcgctcgaattttggcaggattggttccttcatggatcgagaaattactcgaattacgatcagagattggttgcctagttcttcctcgacagcagccgcgcccggagctcggcggcgtcgacgtcgccgaagcgattctcggggacccagcagccggtcttgggatccctcatccagaagatctccttcgacgccgccgccgccgccgcaccgccggcgccaccctccgccgccgagatcctcgccgccatcgaggagccgcgctgctgcaactctgccgccgccgccgccgcgtagccccggcggctgcaacacacaataacagatcacgtcatcagtgacctcgcagaatgccttccagaatccaagaaaccaagcaagaacgaacgatccaagaacccatccaagatcatatacccagttacccacccgagcgagagcagttgtccggcggcgacggcggaacgcggcattgcgctgctcctcttctgtgtcggagagagagcgagagagagacgcggcggcgagaggtgtcaggagaagagtggttgtctctgcctccggcgcggcgcggcgcgaggtgcaggtccaatatataggaggcggatgcggcgctagggtttcctcggcgccgccagtgcgcgccgcgcgcgatgagaggcgagccgagcgcgcgccgccgccgccgccgcgggggcgcgccacgcgcctcccaattttttcgcgttgccagcaacgaa

SEQ ID NO: 68529 - DNA, 26690 bp, Oryza sativa
cagtagtccatgcaattgtatttctatatggactctactctcctcttctgatattccttattttttaattccgaatttcagctatttgtaaattgtatttctatatggactctagtcccctcttctaatattccttatttttaattccgaatttcagctatttgtaaattgtatttctatatggactctgttttttctttttctccgattaatgtgagaatttctaggccatgagagcgaacgtggaggctcctttttctattcctttaatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtctcctcttctaatattccttattttttaattccgaatttcagctatttgtaaattgtatttctatatggactctagtcccctcttctaatattccttatttttaattccgaatttcagctatttgtaaattgtatttctatatggactctgttttttctttttctccgattaatgtgagaatttctaggccatgagagcgaacgtggaggctcctttttctattcctttaattatataatagataatactttaccactatttaccgataaatattagcacacttacttaaagttgaaacgattaaattttttcacaccttaacaagcataaggaaatcttaccatatttataagtcaatggcgtgcgagatttagtttgctggaaaaaaaatattgccatgactgtatctataaacaaacaactgctaatgtgatcaaacccgtctaaccttagacgtgacaaaactgtggtaaaacgtggctgacaacctaagggcatccacaatgtagtctaaaactagtccataagcaataaaatatttcattcagctacctcaccatattgtggaactagtccatagcaagaaaatagcaaaagctacctataagctataagcatatgtgttgctcatatagaataaaatatgttatttgtctctattttctctctcctcctaatactagttgctatctatatacattgataataatagttatagtctatatatgtgggtcccatttatatggactacttttgctatatgcattgttgttgccgtaagcacaacctactgctgtattgttgcgtaacgcgtacagcaaagcgcaagtggagaccatgcatcgatgcagagatgcatgcagctagcccatgtcgagaaacaggataaagaaaaggggaattgcgagatggcaaacgcccaaaacgggcagcttgttgcctggagaggaagagtgctggagagtagtagagcattgagcattgcagaacgtgggtgcaagtacaagcccactttacttttaagtttttttttttttaccaacgctgcatgttacccctcatggatggatgataatgccctttctggtttcatcagtacaatgtacagtacagtactagctctagtttgggatgatcacctactttatttgttcagcacccgtagtagttgtataatctatgctactagttgtatccaatgcccatccattcaagtgatggcatccaaataatacaatagcgagaacctatcatccaacaaataagcgaaacgacatatttaccaacgacaaataatttataaataaaacttttatatacgtgttcctaacgatataaaagcaaaggctaaaaaataaagttcgagatataaaagcaaaggctaaaaaaataaactttgattaaaaaactcaaattcaactccaaatttaatattgagaattcaaagctgataaatataagtataagtgtgaggccgtagtataatctaatctaatctaatcaacctgtttgttctctcactgcagttgggtcccacaacacagcaagggcgagtgagtgagcgagtggtgcggcggcacgcagcgacgacgaaccaggaaacgaagcaacgcaacggtggacagctcacgcgcggtggggggcagcgtggtcggcggcacgtgacaccccccgcccgcggcttggcttgtcgtgaacccagccagccatgtgagtagtgatcaccgggggctctacgccgtcgattccgaatccgatgggcgtgatcagacggcagagagaggggaggaggggggcaattcagcgcggggatcacgcatgcgttcacgcgtcggtgtctgtttggattctgaacaagaagaacaacagtgggtcgattttcagtgacgcgctgctgggttgtgaagtcgacaaatgaggttcctcctctctatcgtactccagccgttccataaaaaaatctagaattagatgtttgattcataatattaatatgtgttacattcggtgatagtacatctattatctcgatgctgctagctacgagtactagtttcatactgaaattttctctttaaaaattgttccattctaaaccaacctctttacactgtaataataattagtttatttatttttactctgaagtaggttataaaaagaaatagattattcattaatttataaatttcagctgtggggtctttaataattaatattgatagcgagtcggttaacaaattcagcatggttaacaaatttcatcttcagaacatactgtttatttgccaaatcagctctggatgttggtatagcaatctgacgataaacccaccttttttctgaaccatgatgaaccgatccaaccagctgacctgacatcagtttcatagtgaggtcctacaacatcccggtctgttcatcaatgagcagttcccaatttgacagcatgtagccaagctactgctaccagtactgtcctcttcgtaagtctttccaccatttttaatggctgacgacggtggtaaaatatattttaccactagtacttaagatagtagtgattcattggattccaaaagaaaaataaacggtttgaatcaatttatgttaccaatagagaacattatagttgtcggtaagaaattcccatgcatctaccaacctcatcttttctcttatgcatatacttatcagttaaaatttaaattttcaaccttaaatttatagttgattttaggattttttttattgaagtttatctttcagcctttgcttttagatcgctaagaacacatatataaaagttttattcttaaattatctttgtttgtaaatatgttgtcaaacaatggggccgtatatactccctctgtcccattataagtacagccataagtttccgtgcctaatgttcaaccgtccgtcttatttgaaaattatgaaaaaaatttaaaagttaagtcacgcataaaatactatttatattttaccatctaataacaataaaaatactaatcataaaaatatttcaaataagaagaatgatcaaagttaggtgctaaaaccctgtcacgccccgaactagtcccgaccagcactagcccgtgacgctccaaattaacctgttaatcgataccagtcccaggaaacagtgctgatatcacagggagacagaatatcacagcaacagaggtctctttattatagagtagatgtacagtcatgttgggctgcggacagatcccgagctcacaactgcatcacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccatgggaagtaagtgtttaatgcaggcttcaaggaaaggctggtgtttttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaacttttcaaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctattcgaacagtttgttaacctctgcagagggggtacactttacccacatgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaaatgcaagagcaggaaaccgtacacccggtacgttccccgatccgcggttttggaaaattcatttagttcgcaagcaccgacccaggtgtcgggttttccaagtcttttgtaaaactccagttttacccaagttgttaaacagattttaagtttgaaggcgtccgtcgatactcgcacagggtgcacgaatatcgagacgcaactagatggttacaaggggacaagatatagcaattaacaaaggaaggatcaaatgcgacaaattaggtaggtccgccaatctgccttgcagacgggacaaacagattaagtgcgatcctatcaatgcataatattttgcaagggatataattaaatttcaaatataggctcaagatattcaaaggtggcttgccttgctcgagatctggagcttgatcctcaaaatcctcgcactgcgggtcttcgggctccgaaactacacgcaaaacgggacaactcaacaaacggcaaaaataaagccctattaatgacctctaagcgtgcaattagatagatctcgagatttgagaaattttggaagttgaacggagtcaaacggatttacggttgggaagatattgaatttctaagattattggatttttgatctaaaggaaaaaggattaaattaaatcctttttgaaaaagaaaagaaagagggaggagaagtagacttccctcgggcggctagggcgtggcccgagagaagaagcgcggctcggccgagctaatgggccggccggcccaagaggacccggcccagagcgcgcgcgggaggggaggagagagggggccggtggaccgggctcaccacgcgcggtcccgggtgggacccgcttgtcagcggctcggctcaccgtgcggagggagtacgcggctcatgcgcgcgggcgggggagggacgcggtgcacgcgcgcggacgcgagagccgcgccctgcgcccctccgcttctcccccgctcagctccgctccgcctcgctcgcgcgccgcgcgctctagcgcgtaagccgcccgcgccgagccaagtccaaacccacaactgtatttattttgcgacggagggtgtatctccttagaggatcacatccagacttttgctgcgcaatgagcgcagcaacatgagcaagcaaatgtcaactccttttttccacaggtcttcgactagcacaatcgacatgagtacatacattgacacaaagtgaatgacaggtggagctatcatattcttcatacacgctggcgaggggggcccacacgacagtggcagcaaagctagtgcaggagcattggcttgcaaggaaggaaacaaagagaaaaaagacaggggagagagacgcagaagaattccttgaaagcacactatactatcatccaatcgatcgatcgattgatcaggtgatgggctacccatatgcacatcacagttcctgtacacagtacatcccccctttctgtttctctcagcatataattgtttcagtttctatgggccaccaaataataattcctctttgttttatactagctgggaattttcaggccactgatcacagtgttcagtacaccaccctgatcaacagtttaggaacaaaacatactcattagagtaatttgaaacacaagaacgccaaaaaatgattgtttatgaaaaccgattaattaattgaaaccctgattacttatgtgtatacttatttcatcagcagacagaatgttgacctatgaactgcaatgtgcgatctatctatgtgacaattagcaataataataataataataataataataataataataataataataataataataataataataataataataataataataataataataataataataataataataataataataataataataataataataataataataataataataataataacaataatcacagttcagtacacaatcctgatcaaatggtttagaaacagaacatactaattaacttgaaacataagaatgccaaaattgattgttatgacaagtgattaattgaagccctgatgattactcaagtgtacattttcttacatcagcggacacaacagttgacctatgaactgcaatgtgcaatctatctaagtgacaactatgaataataataataataaaaccaatggtgcaatgtgtttggagagggaggcatatggagcttagatatagccatcagtgcatcgctttcatgacggtggaatattggtataggttaggtgcagagacttggacgctaacacggtggaattgataaaaattttcaagctaatcatatagttttacaactggtcgaactatattaggtacagcttttggatggtagtagcatatacatagcttcctctatttcgacggctaagctgaaccaacttagtacggcacatgctacactcttttgcgtactaaggttggatagggtgagactatcaagaataaaaagactccttttgaatccttgaattttacagaaatttcaaatggattagttcaattccaaaaaaaaaaaaaattctataaattcctccattcaaggaatgcaaaagttagatgaattctgccaataaattttttaattaatatactagaagagcatatttttcactttgtttttaattttatattataatatactttttatattgtttttgtattggtacaatgtacatgggagaaaagcaagcaagctgcttagtttaattaggagtacacagtactatgctcttttgtgacctgtgagctgtcttgtaatactgacctggcgtcgcctcatgaatccgacgtgccactggccagcatctctgcggccagctggcacaagctgacaagctgtagccatcgccacgtaggatgggtaccacgacaaaaaatgacttgcattgctttttgcaagtgtttgtttagtcgccactactgtcgttgcaacttcttaatcacccctactttgtgtaccaatgtatgtatatatgcatacacgccccaagatggagtacattaattactagtttcatgtcacaatccaaagtaattatattttgggtacatacagagaaattaattgatttggaagctaacctctacttacatgttttgatggatacgtgtgtaatgtaaggcccttttaattcttttttttttgaaggtagtactatagtgttttgccgtgctggtaatcttgcttctaagatacgtcgttgcatcattattatggcaaatatataatagtaattctactgttttagcagctgcataattaggtgatgggatttgtcaattggatgctggaattgcatgctcaaccatcaaacaaatggtttagtttaaaaaacgtaaagtaaaagggaaatgaaaagatgggaaaaaataaaggaaattaaacatgggatcacgttggttgcatgtgcgccaaagactaagctccgtattctagaccaagtgatgactaactaatttttatagtttatgagcgtgcaaagatgtggagaatctgaattattctttttaattttttttgcaagtggggaatctctagtctttatgtccattttatcactttggaaaatggaaagaaaaataagacaacatcggtcataccgtactacttttgttctcctaaaaaagaaaggaaaacttcaaagtatgtatcactgcacatatgatcgaaaaaagaccaatttataaaagaagaaaaaaaaaacagaaacaatcactggtattggaccaaatagcacataaaattcagttaggggagcccactaaggagcatttgcaacaaacttttcatagaagaatatatgtaaacaatatagtatatactaatatgtagctctcccatattattgttgggatttctctctacagtttgcattgttagttagggagtgaacatcttcctctttttagctagtccaaataccttccttgcattggtattttccctttttactcgtccaaagcaacaatttccaatgggttattcatatcataagattaacttgattgcatataaatttcttcacggcaacgtaaatttatgaacatgattcaattaatttctatcagagtgtagtattttcaacatgatataaattaatttactaggtttttataattctgcatttttttgttgaaaattatggaggccatatgggaaagggtgacgatggagttgtcggtgatatggggtatggcagacagggaggagtatatactactgctacacaaagtcacaaaactacaccgaataaatcaaattatttcttcagtagcagcagcagcaaacagctcatcaggtgttggtgatacctatgttccgggcaccgatgcggccgtcggccaccgacacggcgactccaccggctgcagccggtgtccggcaccggcgatcgccggtgagcccagccatcttctttcttctacactgacagactagactaggattcgtctttgcctcgggattcccaccaaagcagagatgtcaaaatggtcccggtcaaactgccctacccaaccacattattgaaaattgctaatttaatcgttaacaaatcgtaaaataaataccaaaaccaagtggatcccagtaaacaatgctttgaacatgcaaattaacaactcctatgtgtctacatctcatgctaatgtgcaataacatgagaagctgctcctaagattgaacagattttgacaaaggtgagatctttcgaattttgaaacatttttcacgggcaaaacacagatcaaccaatcagaacgtcagtattagaggctattcactacttggaagctgttaacagtttttcacacttgacacggtatcagcagtcaaaaaattttcaatgagccactgtccatgtgcaagtattcctttttcttgttacaaaaataattatgaccgatctgaatcttaatggtgcaatgtgtgtggtttgtgcagggcataattctgggtcctaaagggagataaatgatgttaaaattcgttgagtcacatgcattatgaacagatctatccatgcatctgccttattggtgtggtgtggaggatgatgagggctctacatgcatatgcatatgcatcccatgtgacatgttcttcagcttccatccaatccaactatctcccagtcctcctcaccccacaccatccactcaacaacagcaaaaatcttttttcaatttcctcaatgagatcagcacagcaggctcaaccaaagaaacaattatcagcaatgatccaacaaccatacagttcagaaaagggggtaaccaggttggtgccaaacatcataaaggccacagcccacactaccaccccctcttgttaacacacaaacagtctcagggtgccattgtttagtatacaagcattgttgttgtagatgtatcagcaattaatgaaggtgttgataaggaaacataagagcataaatgcatgctgaaatttcaacctccaaattaagctagaagagttcatcaggaaaatgacagtaaatacatttaccactttacagtgcagatccatgatacagaccagtggaaatatgaaccggcacaatgaaaccacagcacttccttctgaatatctgatatcttcaggtacactagtcataagattgttacagaacataactgaatatgctccaccaagggggaaaagggggatatcatcatatattgagaacaacaataaataatgttggaagctgtatggtttgtttccttcttcaggctacttctcaggagctctgagtgaaggaatgatgtcatggttactacttcaaaacaatacatagcaattatatgccatacaatgtactgtccagtctccactatacagctactatacatgtgaagtgaatgagctcgcacatcactgtagtatctacatgtttcaattgctctactctgatcgtatacacttcaaatcttgggtaatagcttcaagtgtgaagctgtgtctcagtttctctgttctgatcatatacactacatcttgggtactagcttcatcataaagttgtatcgcactccttttgctatcttaggttctggccacttagcatcttctggtacatggatgcatttgtatcctagatttttgtacagacgcagcgcagcaatgttgtttacatcacaatgtaatgccatggatcggcaaccccaactctttgctcgctcctctgcttctgcaacaagcattttagcgattcctttacgacgttcttcctttcggactgcaacatttgctatatatgcaatacctgttctgcatgtttcaaacaaatctggatgatgtcaggcggcaaagtactagctcgtgtgttatattaaccctccaaaaatataataatggacaatcttctacagtttatacagagtgaggcaaatgaaaacaaggcttcacatatctgagcatttcatcagtgcaaaagaatagcacaaccaatgtttttgttgactttgtatccaaccaaaaacaacttattccatacatgccacagtgctgcagcttcatttagaccgcataaggtgttagaagaggttgtggcagtgttgagatggatgtcataagaggtgccatgctctataatgcagtgcaataaatattagaaaactgccacaagaaacgaactcagagaatatccttttatgttatcttgtatatgacatttcacatctggtgagattaaaggccacacagggcagcctttttggcagtgttttcatgatgatctgttggctaatttggaaggaaagaaacgcaagagtattcgaacaaagagacaaaaaccctgctcagttggttgaggatatcaaagaggaaataatcatctggaagtctgcaggtctcttttcacattgtgagaagtagaactgtttttcagccttagggctttttattttccctttctcgtggggtaaggttttgcctcacaacacgttcgacaacttcttgtcgatgtacccttgtatgtttgtaatttgttttcttccaatcttaatgaaatttggtcagccattccttcggccaacccggcgaaaaaaaaaagaaggctgtggcacaaatacaatgcgcgttctatcctaattcaacaagacggtttaatccctaactatgatagacttcgttgattgaactggatgttcattttaacccaggcaagttgcactgcatttaaatgtatttctccaaaaaatataataaaacacatgtttttcctctatgtttccaatcaagttgaaattcaaatttgctcactgtttacaaatattttcttgaaatagtcaacaatgaacaagaaattcatgatatttattgcattttcttcaaaattctgtaggtaggctgagccctcttgtttcacacagttctttcatcttgtacaagtaaagctaggtgagagtcacccaaggaaaggaaagagacatctccaaataaattccaaggcaacaaatggtgccctaggtggacagtcaatacaggaaaagagagtgcgcatgaagttgtgtttgtctagctgtagataactgtatctccctttggatcttagtcaaagaacaaaaaggaaggacagcaaacagaaaagtgtatgggggcacatacaagttataaccataaacgggagctgaagcaactcatgtcgaagcatcaggacaatatatagcttttttctttagaaacttacaaggtgagaatgacatggactatggtagttacaaaaaggataaacagtatagagaaaaaacatgtgatggtaaaattcaatgcgatgaggtacagatcatgataaattaaaacctagcattaagttaactatgcattcctggagaaaaaatggagcacaacattttatgtattatgcccaagattgtagttttcttagttttgattgattcaaaccaattgtgcttaagacttatattacatcttggcaccagtgatcaaaagactgaggatggtgaaaaccaaaaagatgatactgctatgtgcaaagcttgggagaaaattaagatgccacggataggaaatttgttgcaacaaaaaggttttatatgacgattgagttgccgggtcctatgcagatttactatgcatgctgctagtggagtttcactctttttaatttaatagttctttctgtatttcagaaattccaacgaaatataagtgcaacaaggcttaggtggctgttaacaaccaaatttggtaacatcggtgtcaggaaagaagattggatcaaagcgaagtcggaagcggagatcgagttcggaaacagagcaggaatcggccggagtccagatcggctacggttaggatcggctaggtctgagtcgggctaagtaagccggtacagccgattccgacaatatgacttgtacacgacatcgggttcaagttaatgtagttcaagatgattgccacgcacggatagagtcctgggaaggcaattgtatctattaattaggatatcttatgtaaattccttatagataaatataggcaaaagtctgccgcaaagacttatggtatcttaagagtttgttagagataatagtcatgtccggtatgggcatatcttgtaattctcgggcataaatagaccccgagccctatgtaatttaacaacacacgttcaatacaatctcggcgtatcgctaccctttttgctttagttttgtttcgacgagttcttgctttcgggttgagctgcatcgatttcgatcttcaacaagaggtaaaattcgttatgacggattgcgttcttaggattagtgcttccatctttatgatactctaatcccgtttatgtaattcgtcgagttatcatatgtcttacataatctctagcaatatcatcatctaacctgccatcggttaacttctgttaatagagggtagccgattaggttaaatattgatgttgatctagattatatgagatatctaccattctatgaaacttctagcggcttgattgtctagatatcgttattcttttcatacttaatgctgcatcagttgagtttgatctattaagtcgtgcttagaatatcgatctctagcctgccttctagttgccgattagaatagcatcggagtttcagctgatcgtatctgatttaactatatttattctatatgcctcattgatatgttaaatctgccctttatatcaagatattgctgtatctaaatatgttaggcctttgtttgatacattattcttgctttaatatcctggtatggagtagtatcggagtattagccgatacatgctagatttatctgatcggctatgctataaacatatatagtcctgttattgatatatatttcgatctaagtgatttatactgtctcggcatgatgaccgatctatcccaatcacttgatttaagtatacatcgatataaggagtatatatcattaatatctacagccgatcgagtagatttagttcttttttacttattcatgaccgccgatcgatacacagatgacatcggctcaaagataaatgatatgtcatcggcatctagccgattggctatcatttatagatttaaccacggcttctttgcttctatttcttgttgattacaggatcaaatcaactggcacgctaacacatccgaaggcgagctttggacctgcactggagttaagcagacctcccaggccacatgttttctatcaacagtggcatagttcagaaattctattcccgactccaatggtaaagagaaacgctttcctttagtaattattatcatgcaagaaacacttgtctgttatgagagaagggaaccattactttgtatacttaaatactctctccccattttatgggaaggaatcatatcataatttatcactgttctagacacaagtagtttaagacaaaacatatttggcatttgagttttgcatgcacctcatatttagcaaaatgtatatgaattgaaaaatgggaactcaggtgttcccccatttatgcaattagtataaaataatatgttattgtttttatggcattgcatagtcaagtgtagtcttcaaggctccaattgcacaataaatttaagttattaactagcatgtttttttaatatgacctgtgttaatctgttattgactagcacatatccttcagagatggaaaggcattacaacaaattatcaattttttgtagcttggtatgaactgttagaaattcccaagccaataaagtaagcttcaaatgtaatgggacgaataattacttggctgagggataccaaaaaaaaaaggaacatcaatgtcaggacaaaaaggaaacaacaccataagtagaatggatatggtaaacaggctttggaaaagtgagtgaatgcatttaaggtgcaaagaataagcaaaccatttatatcttgcagttgcatatgtgtatatgtgttagcaatcttataaggtgtttgaagaaaataaaggtataccttctctgcttgagaggccctcttctgggaagatagtctgccaccgtgtctactgtaagaatgccagctatggaggccttactgagaccgtgtttttcttggaagtcagcatctcttaaatctccacattcaatgctgatacttctactaagcgaattactgttaacggcgacaaggcaagttctcatgcagccaggtggaaccgaaaaaccggataggagggcaatgtaacgatcaatacgtagaacaaggtccagtggaaaagtgtaatctggaaagaacgagctgcaatgagtatcagctacttcccagcaatcctctagccgcgcatctcgaaccaggatgtctgggctcaaagatggcaacaattcaaccgccgggctggcacagcaaactcctgaaaacaaagtagacattctcatgggcacatgccaaccatgtgaaataaacccagataaatttacagttagctcatacaagaccaacatataaaacactgaatgtttagtgtagtaagttcaaattatcgcgatatattcattttgaggtagcatggtaccctttctaatgacaacactctaagccaaatgccccagttggagcaaggtattcaccaaatactaattcagtcgatttgctaaacgacactcccatcctttggggagaaccaaaccgattgcgtgctgtcaaattaatcttccccggataatccaatactacccaattgtaaagaggattacgattataacctcaattacttatcaatgccaagaaaattggagcggtagataagacctgcagcgggtttggtggcgaaggacgggcagcggtggtgccggacggcgactgcggcggatcggcggacggggtagagaggagaagcggaggcggacgacgtcggagagcgagccaagcttatcgccggcggcatcatggcctccctccccccgcctcggctcctccgctccttcgctgtctctctcctccgatttttaatctactactgtttgcccccacactttccgccttccaaactcgtttacgtaaaataaaattacgccttattagggtgtagcccacggcccacctttccgtcttcgaaaagagtttacgtaaaattaaagtgcgccttgtgaactgtgcagcaactaacaaggcagtggattccggaggcgagcgagagagggagagaggaggggtgggagcgggggcggcgcggcggcggcggtggatggcgatggcgggcggcggggggctcaaccggtcgtcgtcgagggggcagctgccgccgcaggagcttctcgacgatctctgcaggtagcccccatcccaaaccctcgatcccatccatctcgcgagtttcttctcggcttttgctcagatcaaaccccccggaaaaaaactgaatcgaatcgccggtggaaacggaaaaatcgcagccgcttcgtgctcaacgtgcccaaggaggatttggagtcgttcgagcggatcctgttcttgctggagcaggcgcactggttctacgaggacaactccgtcgagcacaacccctccctcaagtcgctctccttcaaggacttcactacgctcagtaagctccggccgaactccaccttggattcatcggtggcgcttccgccgttggtttgatcgctgacaccgttattgttgttgtggtggtgtatgtgtgcagtgttcaatagctgtgctgcgctcaggccataccgcgcgcaccttgatgacatttacaaggatttcactcactataagttccgtgtccctgtctgcggcgccatcatcctcgatgacacctacgagaaggtaactacacccctaccccgatcaccttgtaccatattactttctacctagattaagtttagctgagtagctgcttatgttgcacaatgtgtgggtgtggcagcttggaaacaatgctaaagtaattctggtattttgtctgttgctgcaaataccttgtagatggtttattgtatagtcgcttcaatgcgtatagtttcaagctctatactgcaatgcactaggcacaaataaaaattacatctttggatctttaacccttgtagacctcaattcgcgcattctttttcactttgtcatcacatactcacaccccaagtttcattcactttttctccttctgtgcagtgcttgcttgtgaagggatggaagtctagcgccagctggagttttcctcgtggaaagaggagtaaagatgaagaagatcatacatgtgctgttagagaagtaaacttctgggctgaatcgatgttgttctttgcagttttatcaattaaattagacttataaaggatagaaatttgtataagtcactgaacaatagttttacatttctctagatcatcaagatgcttttttctacaattcaaatatcaaagttctagatattctaccatgctccaacacttactgttttcatttagtgtttgcattttaatccattgcatacaccatttgttgtttcttctctaaaaatgaattgcattgcctatctcatgtttaaaaaggaacaaaaaaagcttagcattggttagctaaatattgtcagctggtcctgtgcataattttttttaaagacatgcagtgatcacgtcttagctttcgtgaactagtttccatgttttgcacttccctttgcttattgcattactagtctatgtaagtgacatttatttacataacaatgcaggttctagaggaaactgggtgtgatgtttcgaagcttttaaaattggaagattatattgaagtttcaatgtggcagcaaagagtccgcctttatattataactggtgttaagggggatactgtttttgcgcctcaaactaagaaggagatcagtgtacgcaaatgttcagtgtttttatcatatttctttttgctcaactacattcagaatattttggactcgctatctgaaaacgaaaaggggaattgcgtgacatgattgcaaaatgatacaatatgactttgattgtttgattaatggccataatccttcgtgtgtgcttagcttatagtaaggaatagctcctttccgattaacaagctgttctacagatttttttttccataatgatctgctaaatttcaactcagttgagaagagactcaatttgaagcattctgtaatcactttattgttacttaactgacaagttagtacatgttcagccacatatttttgcttgctgactgaggtactttatctttttatgctggtgtatgaatcacttgcaatgctagctgtcttgtgtggttgtgtttactaccttgtgtctacttgaagactgtagttactgtaactacaatttattgtttttttcgttgtagtttatccattgacccttttgagttttgaacctctctttggttaaagagagttaaataggcattactgagtcgtgatcctctgaaattgacaggagatctcatggcacaacatcgatgaactccttcctgctggtgatgacgcaatatctcgtggagtgaatgggatgaagctctatatggtcgcaccatttttgcagtcagtacctttttgacccactttagtttttttttcttggtgcagacagtcatcatgagcatgttggtttaatggcttctaaaatatttaacccgcatccacatttcctgagtgtgaatttgtttctacattgtttaattcctttacattttacttcttcatccaggggtctaaaagcctggatagccacacatcgtcacccacagtatcagaaatcagacacgtctgctagaggtttcttctgatcctccctttgcccatttatgttaggacctaaaaatgttaaattatttgtcaattatttttagcagttctgcttcaagtttcgcttgttgttttctaagttaatctgcagaagtagttctcaactgagcaaaatatcagctagtacataattaaagcaggtctgatcctggcatagtcatgaactcatggctatacttatgatcaacttttagtacatagtgtgtgtagtaccattggtgaacctggtgcaatgtactcctagtatgtaatttgtgataaaattggtgaacctctggtgctacatataccgtttgcctctataattgtgataacatctatggtaccacacatcatttgacaggtactgtgtggaaagcgaagaattcctcaactggagcggcgcctgttgagaaccccgttattactagaacaggatctgacccacaaactcttgacagccgcccaggtaaaagcttccgaaacttcaggttcgacacagcgagtatcctgcagtccatggaagcttccttcctacgtacctaggagcctgacaaagcatcaccccatgtgtgtatgcttgatgtgtatagactatgtaagccaagggcgtgtcttctgttgttaactcagctttttcttcacttttctagttgtatctgtaatcctgaatgcaacagatgcttctaccattgtgataatatccctacatttcgtgcacatgaatgttttttcttctgtccattcagatttgtgtttgaaatgttgctcaaaatggagtaagaattcctctgcattttgcatgatcttgttccgttattcttacattgtggttgagaactgagaactgataagcatccttccttagacaatgtagcgggctgtgcatggcccgaatgtgtagaattatgatgggcctagccttttgagtacggagtttgggccgatccaaccatttgtagtgatgggccgtgggccttggcgacaagcgaagctgaatgggctttgttcttttgctatctgtggagacgagtgatgcgccgatgacgtgtgcggagcgtgtggccaggcatcttctccttcacgctttcgctgtaccaccaccaccgctgctagtgctcgcgcgctctcctgctgctgctagaagcttctggaatctggagccgagccgatgccatggcggcgctcgtgcggcccgccgtgctgcccgtctgcgccatgacgggcggcggcggtaacgacaagcggtcgccgccgcagcagcggtcgtggtggggcgggaacaagcagagattgccgcaccagccgcggcggcagccgggcgggaatggtggccgaggaggaggaggaggggcgctggaccaggtgctcggagtgctccgccgcgacggcgagttcctccaggcggcagccggcgcccccctccgcgacatcttctggctccgcttcctcgagaagaagaagcagcagcggcggcggaagcaaccaaaacctaaacccaaacctccggagcagcagcagcagcaagaggaagcggcggcggctatccaagccccatccttcccacctccctcctaccagccaggtttgtcgccgcgcggcagagaagcatctcgattgggctccgttgcgcacgcattgttcctgttgctgatggggattctcccaattggtaggattatcatgcctggatcttatgactgctgatttcgaagccctgaagctgtatatcggctactcgaagcatgcaatcgagcagcaatttctcaaaggcaagcggcaacctcagcatcagcaaactcctaaaccaaaactccagcaacagcagcagcagcagaagaagaagcagcagcaacaagagcagcagaatcagacacttcaacctccggccttccctcccccatcgtaccctccaggttgcttacaccaagcagtgcccaattagctgttgcttaatcatttaagtttcatcgattgcattattaacttgttttatgatttttgctagggctgtcttgtatggagctgatgatggctgatatcgaagctctcaagttgtacatcaactactatgtagccattctcaccactcctctaccccagcattacgatccggagatactgtcccgttacttcacctcgcgtcctcatattctcgcatttcgcaccattcaggtaaaagctgtaattactgttcatctttgctcttactaagcttcaactgataaatctaatagttcagtgtgccatgcttctgtatctgtagataatcttcgcatttgtctcggctgcagtaaagatgcaaatttctaaaagaacaaacttgatcacagatgccacctacagctgtaatagcaccggaagcaaaggtttcaatgcttcacaatacatggttggccagcttctcaaagagacatttctagatcttgggcctacttttgttaaaggtcaggttttcaggttcgatagctttaagccatggtagtggccactcggttcggattaatgttgacttgcttgtcttctgtgtgcagttggacagtccctctcaacaaggcctgatatcacaggctcggagatttctgaggttaggtaaaattactgcaggatacaataacatttctgcatttctttaattgcttcatcatcttcagaagtgttttgttgatcattaaacaatctccatagtctttctcaaaattaactggcgcacaccccaatcataggcactcgccgagttacatgaaaaggttcctcccttcccgagaaaagatgcaatgaagattattgagggagaatttgagctccctgtatcacacattttcagttacatttctgatgagcctgttgctgcagcttcctttggacaggtaatcatatcttgcaaaacttttcccgttcttttttaaatattagagacaggagctttgtagtttctgattaagccttattatatttttctgtactatctctttcaatttttctgttatgctcagtgtactcttgtttgttgtactttaggtttatcagggacgtacagttgatggtgctcttgtggccataaaggttcaacggcctaaccttcttccttcagtattgagggacatttatattctacggcttggggtacgtatgcaactatatctccattaaatatataagctcatctgtttttgagtgtttttaattctgccaagtgctaatgcccacatcttgttcatagaagatatatacaccataggttcttcgcctactgtttgacaaaaaagaaagttcatcttctgatcctcagcatgagcataatacctgatgccttctattttgttgtccctaaacaagctttaccgtttccctgattttgtgtttaattaagagtgttaatgtgactatgataacctgtgctgacacaagaaacattgtacagtactttctttcaatacagatggaccttgtctcatttaagtttatctgtatttagattaaatgttcttgcacttcattttatttctttattttgcttacaaaattatagcattgcagcatttttccactatagtcctagcaacttgatgtcttttctaccatatatgtttcagctttcttttgtgaggaaggtagcaaagaggaaaagcaacattgccctctatgctgatgagttgggtaaaggtttggttggcgagttggactacaatattgaagctgctaatgctaccaaattcctggtgctttggtcttgtctcctacctatactttactaacatatgcctattcctgttttggcgttttatctcataatttgtacttctgtaggaatatcattccagatattcatttatgctggttccaaaggttctcaagcaacttacgaggagaagagttttgacaatggagtgggtatctggtgaaaatcccacagatttgctttccttatctaaaggaatttcatcagaaattgctgaatcgtcagagaagcagaagatcgaagcaacagcccgtcttcttgacctggtatttatgttcgtcacaagttatttctaaattatctgcttcatttgtaaaaagatgagcaccataaataaattaatccacaacaatcagtgctcccgggtagcaaatatttggaattgaagtcgtgctcagtgaatagggcttttttgtcagttagaaactgcagtttacatggttctttgcaatattgtgtttgtttcagaaacacgcagcttaattttataaatatctatcacttcaatattgatgttcttttctctctgctgtggtagaaatataaacattataacaacaattactacatttcaataaacatttttcccctctggacaaaatgttttaacatcttgttaattactatgatgataaggtcaacaaaggtgtcgaagcatcattagtgcagctcctcgagactggtttgttgcatgctgatcctcatcctgggaatttgcgttatacacctgaaggtcgtgtcgggttagtgttaatttatctttttatgtacgctctataagaaaatgtcttcttactataatcagcagaatcatgttatacagtgggtctgatgtttttgtaatggttttcctctgtcattctccctttgagcaatagtaacaccttcctaattatgttaggtttcttgattttggtttgctttgtatgatggagaagaaacatcagcatgctatgcttgcaagtatcgttcacatagtaaatggagattgggcttctcttgtttatgatttgactgcaatggatgttgttccaccaagaactaatctacgccgagtgacaatggtaattcatcaaaatgcagaatatttatttatttatggttattacaagatggaaaaaaacaaaggttcttatctcatactccctccgtcccaaaatataagggattttggatggatgggacacatcctagttttacaaatctggaaagggagcttgtagtgtaatttagtttgttattccattattatttttaatgtttgttgattggtaggacttggaggatgcgttgggtgaggtgacctttgaagatggaattccagatatcaagtttagcagggtgtgtagctttccctctttaagttcagttataaactgcggcatgtctctctctttatcggcatcttcctgaactgttaaaaacatcctttaggtgcttggaaaaatatggtctgtggcatttaaataccacttccgtatgccgccgtactacacgctcgtcctgaggtcacttgcctctttggaaggttagtttgtttagatgaaattcagtactgaactagctcaattataagtatgtgttgcttttttgtttctgacttgtacatatttgagcatgtgtttttttttggaggcttaccagcgtccccttttgtgtaatctgtagggctggccattgcagcagatggaacttttaaaacatttcaagcagcatatccatatgttgtgcggaagcttctatcggataattcagttgcaacaaggagactcttgcatcaggtattattattttacctcatttgtttacctgtatagtatatatgttaagttgatttaattaattgattcacttttcttatattttgtgcaacctggacaatatgtgctctttgaaacagtcaactcacccattttcgtttgtacgagatgtacagaaatcctgcaataaaatttgaaattctgagttttgttagttcacgatatcaaacgtcaaacacccaagggaaatggcatcgatgataatagagttctgacaccaattattaatacacaggctattttcaacaaaaggaaagagtttcagtggaacaagattacagtatttctaaaattagcatcagcaaggtcagttctctagttctgagcagaattgtgtgtaaacatcatgtttttttcactaaactgtatgaacagaatttcttctactatgatgcttacttgcttagttttcacgagatgcatctgatgatgttttcgtatgtgaaggggtaacttcaggtataatactggcgttttgcctgagaggaagggtttggatgttgcaaaacttgtagagatcagtgatgcatcttcttcactccatcttaaccgtgctacaccagaaagagcactacatactgcaaatctgtgcttgcggcttttactatcgaaggagagcattgtgataaggagacttgtaatgacagcggtatgtacttttccttgtttcccctctttacctgaatcgactggcccttttggctggatttctgaacgcataaaacacactaaactagaaatcaactgagctcaccatacttcctgttgcacagaacgcgaagtcacttgctcgtgacctgatctccaaagatgcatcgatttaccgggtgctcttaagtcgggtacttgccgatgtcatcttccagtggatggtgaaggcaactggttttaaacgagccggacagctcgagcctcacccacgcgtgacagcaggaaagaacgatgaagacctggggctgtccaaagaagcaccagccttggtgacattccagacagcagtaagagatcgcaggctgaaggtgatattctccaagttcgtcagggacataagagaggaccccatcctgatggtcagagtgagctggaacatgtttgctatctcggtggtctccgctgcaattggcgttcaccgtttcatcgtcgtcttgtcggaggaatttctgtctacattaccaccgcctgtgcctccgccgcggctagttcagattcagagcatatgaagagcagcaactatgccttggtgcatgaagtaacttttttactgggtatcccgtagctgtatataaacgttttcaggagcagaatcagccatcctgtagctgacagtagctcgatcagagttctccatggctagttctccgtaaatttgtcttctactattacaggcttcctttgaaaagggaattttgtgggaattaaactgatttttgtgaaagtactgtaaaattcttgtcatcgtgtcgcaaaggagcgaaaaagcttactaactcgtaacgactgaaggctgagatcgtgtacaggctaaacatttgcacacaaagcgaaaagtctaattaacacatgattagttaagtattaaataatataaatttaaaacccatatatttatttgtttttaaaaaaaacttgtatgtggaattttttttaaaacgcgcgcgcgcacacagtttataatagttcggtagagaaagtaaccgtagaaactgggccttagccaattgggccgataaatgggccgtgcgagcgtcgtgtaccggtcgacgagacagaagcagctgatgcgccttgtgacctgacctgacagagagagcaggtggagctgtgtgtgtgtgtccgtgtgatccagagcgggagggaggaggaagcggagggggatggtggggggaaga

SEQ ID NO: 68530 - DNA, 57258 bp, Oryza sativa
ggactctcatttccttttctaattttggattttattttatttttatttctaattttgattaatcggggtatgggggttcttatatggaaacttctttcaatattgcttgtttttaattccgaatttcaactatttttaaattgtattcctacttggactctcccttccttttctaattttggatttattttatttttattttgaattttgattaatctcgtattgggttcttacatggaaatatctttcaatattgcttatttttaattccaaatttcatctatttttaaattgtatttctacttggactctctttttttcctaattttagattttattttatttttatttcgaattttgattaatctcgtattgggttcttatatggaaacttcttttaatattgcttatttttaattccgaatttcagctacttttagattgtatttctacttggactctccttttcttttttttctttttctctgattaatgagggaatttctaacccccacagcgaacgtggtgcctccttttaaagttgttttaatcatataatagatagattcagctatttctaaattgtatttctatatggactctgccttttctttttctccgattaatgtgagaatttctagaccatgagagcgaaggtggaggcttctttttctattcctttaataatataatagatacgtgtactcctatactgctaaattaaaacgatgtgctaatgatatttagtactactcacgtagaacattctggaaagtcaggaaagtatcccgtgctctgtaaagttactttagttaaaggatgtgaacgggggtgccagcagttgataattagcgcttagcggccgtgttgcacatgtaaaaagggattagtaatatctgatatgatctgagccccctggtgaacttgtgcatgggtgcagaagttctgcgcatacagcccattggtggctttattgcaaggcagggttgttgaggatttgcataaataatagattgaacccaagctaggcgttctgaaggaagtagatttcatgataaaaactcttcatgtttcttagcagaaggtaccaaataattcaaaggtgcaataatgcgcattggaggatcaattaagctaaacgaacaaaatttagaatacacttttttttaataatttacgcttatatatggggaggaattgtataaatatacgtgtgtcatagatcgatcacgcgggtgcgctcacaaatccgcaccgcggtgtgagcgtctccacttcaagtgtatatttctactattattttccatgcatgtatataaacatgaattattaaaaaaagtatattctaaaaaaataaactgcactactataattaggagtataaagaaagaaaaaatgtgatcatattgcacgcccatatatttctgagtcccttttttccgtgtaaaagatcctccattttgatgtccgcttgtagtgtaactgtgtaagccatattctgaactagaggtagtataattagagcagtaaacatgccaagaaactaggcgtcaaaaatgaagaaatgcaatatacagtgccgtctgcaatccggactgcatggggtctaacaaagactattgtcttcatcgaagcccctgttgagctgagctgtggtgctgtttctacaggaagaaatgcataacggaatgacggtcacagggggacacagaggactagaggagcttcctagaaatgtaactgtaaatgcagtagaacttcttaagaattcagtaaatcatcgtcatcggcgtgtgcccaatgcaagaaataattccttgtcgtctgccttctgtccacactccatccgtcgatgcctgatgatgtagagcattcgagccaccgaataaatggcttaatctctgataaattaatcagcatggatgctaactagtcatcagtgggtatgatctacaatgcgatgcaatgatgggcactaataccccacaaattaagccgagtcttttcagtactttttttgccatagtggaattactctaccagagcatcaccggccgataatgaattgaagttgccagaattccatgggaaacgcggtgctaaggactacagagtttgaagagaaacttaaccatcgcaatcttccaccgaactgcttactcatattcgatcatcgatatgttttcctgtttgctgatcgatcagaacttcagaagaccacattatatccgaagcttctgaatctgcaagggatgagtagccaaacccgacatggccatgctcacagctccatgaaaactacatctgctcgaatctactaactcatgtcgcttcagcaagcaactagatcagagaaagagatggttccgatcatgacatgtacggtggatgcaacctagctcgtcaaatgtacgcccaccgatcgagttgccggttatgtagcacgatcgatcgacgcgagctatcaatcaattcaaccgggcacatgctctgggccacctgcagagtgtaagattgtgcctgaacttattctaaactgctgttcttgatcaggcctcgacatgagcctcgccgtgttgctcgatctcgcatggcccctctgacggagctagggtccagagttttgagttatttccaagaggaaaaatccatggcgaagtgtgggggttcagaatattagtgtagcttagtacgcagcaatgggatgatgacaagcgccggaggagggagaggggtgctccatgatttcattctgcagcttagtagttgcttgctttatcgagattgatagaggcacgtggcagaataagcctatttgctttgggatttccgtcttttgaagctgattagctacgaattgtgcatgtattatcatcatcctgacatcctttgctacgctacgcatgattaccgatcacatcttcggtacttgatcaggaatatatgtaacagatattttcacgcgagtagcacaagctggttgagaagggatttgaaaattccaggatagttcagccattcttgacagaatcacagaatcacgctttgtatcgtgtactgtatagctgaagaatgaggacccgacccacatgtgagcagcttcgactgactcttttgccatgtctgattcagtgaactttggggcagtccacatccaatagatttggtcgaggctctggcggttctggactacattgcgtccaattcagactctcttttttttttttcgacatggtccaattaagacttctgcgtacataaaagctgattaaagaaaaacttgtatcaactttttaagagaaagcccatagcagttaaaaagcccgttgaacccaacacctaagcagcccatatgctcacaccaaggccttaaaacaatagtcccatattacaaagctgggtataagttcactttcactccctaaaatataggtttaatgtgtttcttatccctcaaccgtaataccatatatcttgaccctaactattaaaactagtataatttgactctctcaacaatattaacggcaattttcgatgaccaagacacccacatggcaacccaattatcaaatacacttttaaaagagtagggcccacatgtcatcccaacactctatcccttctctacccactctctctccccatatcgtcttctcagcagtagcaatgcgttagcggggaggcggggcattggcaatagagcggcggtgacggaggaactccagggaggtgtggcatggtgcgccggctaagggcgaagggagtcccctttgccacctccaacttcccattttccctcctctcttgccctcccgactcatgcgttcctaggcagtggccgacccatgcatagctctaggcggtggcggtgagtcgagacctggagccacctgggagtcaggaggtgtgacaccacgtggtggccatgagcgcagcttggcaagcacaccctgaacgccctgggagccaaatcctggatgatgacgacgcccaggagagcctcttcatcgagcatgtcgcggcggcgtgcgtgggagcatgagatggcgccacggggagagcccgatcggtgctcattgcaatcgtccctctctgacgtcatcgctaaggagaggagacaaaagtaccttccccacggcaaaagctggtgtgaaagggagcctacgtgttgcatgccagggtgggagagagaagaggagcgctcactgccagccgccgctgctcccgttcttcgtcccgccgttgatccttctcgtcgtcccgtcactgctcccgcttgtagtcccaccgcgaccgccgccgctgtggagaagagggacaagaggagacagccatgggaggaagggccaaagggggaagagagagagagagagaagggggaaagagaggaatggggaagaacggaaggggagtgagaatgatatgcgggtctcacatgctgactcagttggatagaccaagctaattagccacatcaatgaaagccaccgtcaatactgtcgagagaatcaaattgtacctgttttaatagttggagggagatgaatcatattagacatatattgaaggagttgaactggacttattcccaaagctggccaaccacatagtcctacgcaactaatgggcttaccgggccatcaattttatcaccctaaccatccccattttgcaatgtaaaaacgcaatgtcatatgctgtgctaggaatgaggaatctatccatcaataccttccactccgtattctatcccaataagtcgctctgataaattaagttcccacttcaaaaagatataacaattaattaaatggatcttattgtcatgacgatcgatcatactaagaatatatgttaattaaaacatgcctttggaaataccaatgactctttagtttttagctttggtttcccttaaaactaaataaagtcagtgttgtggataatgaaatacagttgtcggactgagaggatacaaacaatcaatggaataccgattaatcataattatatggaaatttggtcttgacagatatatggtttcccatttacttcacttgttaattgatttacatattaaataaattatataaataaattattaaatgatttttaaagttctaaaagaaaatcagggcgtgacacccatttatctacactactattgatgcaaaaaaaacacactggcctaggagatctgcttagctccagtgcatgtccaagattttaatgagatgcgggcgtgccagtcagtttgatcatgcagctgacaagatatgtaaacagcagatcggctgacaagccaatggagtaatatcagccgatagccgatattagtcgatgctgattctagccgatgtcgatagggttttaagcaatcagctatatgttcaatgtagacaatgatataaagacaatcgtctgatgataataagatataaaaataatataatccaatagaaatcaatcggctaataataatatgataggataagtactgatccgatggttaaagcatatacatcggctaaaagtccgatgccataaaatccaatcgatttagataaacagtgagacctttgttgcaatcggctaaatccaacttgtatgtaatctttgtaagccgatgcaacgtccagataacttatcggctagtaccgcgataaaacactaggtcggacctaaccgatgcagcatgagattatatatgataatctaatacttgatgagccgatagatctgtctaatgtgatggatataacaagtctatttataacagcattgtgattgtagagatatatcggctaagacagaagatcagacataaccaagacagtcccaactaaactgatgcttttctaaacacaatgcaattagagatagaattgagatataaggtaggcaaatatatcaaccaaactagagtgatccaagagatcgaagcgatacagctttgaacaacaccaatgtagctgatagattcaccagggccgatggaacgtaagacttaccccttcgtcggagatcgaactgaatcgatgcaggcccgcgtcaagtgccaaattccgccggttgataagtaaaacctcagaaaagaaggtagcgatgcgccgagagtagtattgatcgagagatcaattacaataaccccgggtgtatatatgtatacccatgggtagatactaatccttgtaggataagaaagaaactttcctaaagataaaaggaaaacataaagtccttatcgaacactaaacatacttccctaaagataaaaggaaactaatagactattcttaattaatagataaattgacatgccgcatcctccttgaactcggtcacttctagataaacttcatttagtagattaattttcataaccgaatctactaagaatccgactattggcgacttgataattcccatcggccgattccatggctctgaagtcgatactgactctaggccgatgatgactttggagcttaccaaatttcactattaacaactactacataaagtgtttttacattctcggccaaaacctattttcgcagtcgaatggcagcccgccttcccacaagtgtctacgaaaatagagattatcgtaggtccatccagccgcatgggtgaatcgattatccaacatgaccggttaagacggccaactgcgataatgttttttgggtgaaaaaataaaatcaaaatatccccaaatcccttctcctctcacaaaccctagctctagatccagatccaaaagttcatcacgacaacaacagaatccattaatccattacttgaaattgaaattgaaacagaaccaaaaaccaaatgcgaacaaacataaacttcatccacatccacaaacatgaactccatccacaaacaaacataaaacaaatgaagatctggccacctccaccgtcttcttcgccgccggatccggccgacgccaccaccatcgtgcggatgcgccacctccactgccatcgccgccaccgagacaggctgaagagagaggcacgatgcgaccctcttcactactccccgcccctcccaaggtcaccgcactagatctgttgatggcaacggggtgcctgatcttccgtcaagtagagaaaactatcaatttggtggaaacttgacacattatcgtgcttctgatcaacactatccgaaccctataattgcagcaccacgtcttctctggttatcaaccatgtcgaaaccgattgaccttgttgctgcaaattgaaaacataagcaagaacaagaaaggttgcaacacaaatgcagatgattgattaataactcgaagttggggttccacaaatcaatgaacgacgaaactggaatggtataaataatctaagtaaacccaaccctaacttgatagtggctacaatatatataggttctaaggtcgaccaaggaggcaaggacacctggatgcatccttatttgattccaacacgatacacggcccaacagcccaaaagacggtgatgcaacacccgtacatattctagacgccacgtgtttcaacaattccatttgactttgaaggaatgatgtgagaccaggtccattggaaaggcggtcttgttacctttccatacataggtagaacgtcgaagatggagtccgaatgtgacttgtgcgacattttttgcacagactgctcagggagcccgaggtagactcgaacatggtatgatttgggcctccatattgacttgaatgcccttgatgatcttgtccatcttctagcttctctccttgttcttctccatagttcctaatcataataaaattattaggtaacaatctttcctaaaaatcacatgaagaagtacttaggaacaagctcacctataaatgcaattgtcgggtgtgagctctagtgattggaccttgtacgaaaacatgagaagtattttgcgtatccaaaggagtaatgtcctcatcatccatcctcatgtggctgcgctcaacctccctgccgcctcctctttgccatgccatcgccggatccacccctctcaaggccagtcagcggtgggtctacaagagaggcaaagaaatcgtcgtcgatccgttgcctccatgctcagtcaccatcggagcggagggggaaaggtgatgggagagcaggagaaggaaggctgaccttcgccgccctctgccattgcacgctgagagagagagagagagagagagagagagagaggacgggatagctagagagagggaggtggagagagggtgtcagtggctcggtgcgggtcattgcacaataagaggtccacttgcgataatacattaccgcagactggccttgaaccgccccccaggggagcgattttttgcatgcggggtcagttatggtccatttatagcctgggggaggcctcgtatggaaaaatcaaatctgtagttgtgctaatacccgattaatttcaaggctctttttatccagcaaattgattccctgatcctttccataaagaaaatcgttttccattaccttatgatgaaaagaatccattttgatcatatttgttgctacctgctacgagtacatcaatagtacaatcatcaactacaaatgccacacatataaagttactcgctgactagttggcatccatgaagaaataaaatctgcacaaacattgaaactttttcaaattggacacccatgaatgaatgtatgattatggtgaccaaatactccaagtgacctttacaacaaatgagcttgttcatctcagtttggtcctcacttctcagctgagaatcccgtttatgtacctacacaagattagcacaattgcataaactagaagacaatcctctttaataaatattgacttcttccttatttgtggttccaaatgattgttagcctatgtggtgaaagctttctagctgaaattgtttaatcttgtacacgttttggcccttctaaaaggcttccgtgtactaagggcctgtttggcacagctccagctccagcttttttggagctaaagcccagccaaatagtttctgctccacctaaaatgggagcggagctaggtgaagcgctctcatagaatgaactagagaggtgtagttgggtttaggcagctccacaactccactccatactcaactcctgaagctaaattttgggagttggagctctacaaaacaggccctaagaaagcttgtgtaaaacgttatgttgtgtaacactgattacctagggttaatggtagttagtaagttaaagatgtcacggctcaagctgctactgtactaatcatttgtggtaagtagttaatcatatacgtttaagcattctccttggaaagtacaaggagcaaatgaagtaattggatgaagtaatcaggaggcgtgccattacggcgccccaacgtctagttttcttatatacttatcaatcagtctttgaacaaccgctcccatttggatatgactcatgaggaccaattagctccattggtcattcttcatccaatggctatggttcctttatctctattttgtctttttggtatcagatggctgccgctcaattgcttacatggatgaacctagctagtacgaattggtgttggcgtttcacttagagagaatgggacaatcgacatcaaaatgccaaaaatttaaggataaacccgttactttagagcatatatatgatgtattatcccatagatagtagttatcatgcaccatttatcatttgttttttcttcggtacctcgactaattaccggttattctgctagatatgtaacggcattgaatatatatccctatttagacatgtcggttttagtatgcagtttcactaatacgacaaatctttgtcgtatgtgaaatcaaaacgccagatttctaaaagcttaaatccgcgggtagttaacattcagtatttttatagtttaattcttgatacttctgaagataacaaattctaaatttgtgatgacaataagattaacctgtttaaatactttggtgaacattggccggactcttgaaacagccgtccatcctattgatgcattacagcattgcttatggtatcttgatcagtactactggattaaatgctcaaggactgtagccaaatcaaccatggtggtagacacacactcaacgttcatattcatgcctggcatgggatgtacactagagtgctttgcatggcatgcagatacagccatatacctttgctcaatgcctatcctactggcagctcattgccactactgatatgaattttatattgacaacacccttttgtctgccagctcacctcttcaaacgttgcatgcacttggtgtacacaacctcctgggctatacggacagcttaaaagagacctggaaggttataatctagctctatttgtgaccattggatcacttcacagatgaacggctgatgcattccctcttctcctatataaagagaggactcaggtctccatcacactattctatccccttattgactttctctcaatcgacctcattctgtctttcctagaaaatcctccacccacaatcaaaaatctatgcttccaacctcaaagaacaagttgatggcggctgcaggtaactccttcctcaaccaagatccgacgatgatgggatctgggatgccgcatatgtactttgcaagctctagccatggcaccggtgcccactaccaaagtcctggtggtgctcccatcaccatggcagtcccggacatggggtttcttgttgcagggataggcatagctccatctagctttgtgatgccagagggggccctagcagctagctatagcgccatggctaccgttccagtaggggttgttgttcctcaacagcagtcgtcacgatttgggggcaacaatggtaaccctgggtcgttcaaaggagcatggacaaggcaagaagatgagtaagtaatagatcaatcgacttctagtgagattttatttttctcactaacaagattttttatatctatgtgttaacttgttttcagagttctcaaacaaatggtgatactccatggagatcgtaagtgggcaacgattgcaaagagcctcccaggtcggatcgggaagcagtgtcgcgaaagatggaccaatcatttgcgcccagacatcaaggttttactcttaacttcttgattcctatattattatgtagatctaagggggtttcttcatccatgtgattttgaggggtgatttctttttagatttacattaaaatcatgctaagcagtattctagcatagggattatcgaaataattcattttgttgcggttgttgtgtatgctaatcttaatgttctaggcaccgagtaatccaaagcctccgttttatatgatgtttttaggactagaaaatcagtagatcttgggctacaagatcaaagattcagactcatcatgtccctgcaggaaaaaaaaacaaaggcaaatctgtccaaaattgtacctacttcaattaatgcgtattacattttataaggttaaatctcttcttgatttataactacggagtaaacaacaacagtgttatacaacaccctgcatgaatatggtagccgttaatgatcatatatagatatatttttctatccttaataaatgtactgcttagatttaaattattccaactatctaccgatcttagaaggttcgagggcatattttcttgtgttgtgtcgccgattgcgtggatgaaattagtattcaaaaactgtacaatttatactgcagaaggacgtctggactgaggaggacgacaggatgctgatcgaagcacacaagacttatgggaaccgttggtcagtaatcgcaagatgcctccctggccggtcggagaatgctgtcaagaaccattggaacgcgactaagcggagcctgaagtcgaagcgtcggatgaagaagaagagcgtgcaagtggtgaattcaccgccggggcagctctccccccttgaagagtacatccgcagccagtacccgtcggccgttgagaccacaccgccgccaccggccgtgcctgcaccgccttccgacgtcattgtgcacggtgccggatcggtcagcgcaggtccaaccgttgccacacaggagcccaccggcaccaacccatcggaaatggggatctaccttggcctgggtaacccggctggaccgaccacccagcagctagcggcgatgaacctgaacatgtcactggcgccggacctcaacgcctacaacgatcagcgagaggggtactacctcccgttcgtcccgcagggcaacctgcactatgggatgcatgtgccggcaccgccggtgcagcagcagcagcagcaagggattagcgttgatcagggcctgcattcttcttgcctgagcctgtaccacccgttcccgggaacccacccggttagcctggatttcggttgccaatccagcaaccatgccaacgcaggtggctactacagtgaagctggcccaagcagcggcagtggcagcggcgaccctgacgacgtcgacgtcatccagatggcctccaggcagttcctgatgccgtccgaggctgaggtcactctcgacctgaccaggttcaagtgaggttcgcagtgccagtgccaatgccatatcaccgctcggttaataaatttatcttttgttttagcagctcctgttacctttctccaagtacaatgcatacctgactgtatgactgcagtgcgcgtttaagcttttcttgtatttctgtttggtacattcggtgatcattcgagctttgcattgtccatgtggtgtactggtgtgggaactttaacttgttgtactagtaccttttatgcatggatcaatgtgtggatttcatagttttccccctaaaattagtactcctattcctcgaaaagatgcttttaattttgtagtttactactgttgaggtattggagcgtggaaagtggtagcacctggtacgtctactccatgtactacagtctttgcttgcttccgcggatggtgcgcagctatctgggctttaaatgttggctcgcagacaaaaagagcgcaagagtttgacgtgcagcaaagctgttcagttcctctccccgaaccactcaaacggctgcctgcgcgcgtgatgcgccagccaaggatgcatgcattgcatgcagctagctgcctcggcgtacttcactgctggaagtagcccgggaataaaggcgaataattgtagtaccttaattaactattattactactctgctactggagttaagttgtaacatttgtcgtattaacttcaagtgccaaatgtgtcattcagcatctttcacaccaatacaccatggtagtaaccagtaggcagtagccagccactccatagtccatgacaccgtctgattccgaactctgactgatatgacagatttttcctgagttcagtgcaatgtcctatgtgggaggcccaaaccacgtggggacggcccaatccttgccggaaagttggtttcacgggaaacgggcctcctgaatcggccctaaatgtatcttaactgggccgaagcccgatcctttagatcagatgcttcaatttcgaaacaagttcattctagatacctcaatttgtcgccaaatatgatccttagtcttgaaaaccggatacaacacatccttcaacttatcaaaccgtgcaatcgaggtccctcgatagtatttatctccggttttgactgacgtggtgcctatgtggatcgtttgaccaggtcttcgtccgacgtgcgctggcgtggcgcttacgtggcaatgtgatccaaatataataataaaaccatggggcccacatgtcagtttcacacaaaataataaaatatagtggatcccatgtgaccccacatatcatctctatcctctctgtttctccctacttatctgtttctcccttcttcggccggcagagcaggggcggtggtgccgttgtggtcggagcaagccggcggcaagaaggccccctctccctccttgcccaacgatgacgactacgagagccgcgcaccgccacctcatcaggagatgacgaggatggagatgagatagcggagagggaggatgcggggaggccgacgagtgtggcggagaggcctcccggcgctcaccgccaagctcaaggccgtcggcgccgccgtcgcgctcgagtaatcccgagcagaagaaggggttcgcccttttttttggttcctattcattatccttagatcgaagatgctacgcttgtggatgccttgatttgtttggattgaaattagatgcaattggggcaactgagctgggatgaaggtcttgattgcattgttgtagcttgcctagttactgatttatcatgttgcctagttaccgccttctgcagcagcgccgaggctggacagcatgcatccgcgcgccatgctaagcgccggcggcaagagcgggtttctcgtggcggccatcggagagaagggcgatgatcgacaggaaggagctaggcgacctcgtgtcccctcccgacatccttcctccctcctcgagctccttggcctaccagcgagcgcgcgtaagagagagatgtcttgtggccgctcttctctatctggggcccattcccagcgtaagggagacgaagagaggggagaggaggaagaagatgaggggtgagtagactagcatgtggggtccatgtggtccccatcattttttattagtttgtgtgtgaaactggcatgtgagtcccattggttttattattttttcggatcaaactgccacgtaagtgtcacgtcaacgccactttagatgaagaccgagtcaaactagccacgtcagccaaaaccgctgtaaaccaccgagggatctcatttgcaccggttttgatagttgaggatctgttatatctggttttctggttgaaggatgaaaatcggattcattgacaagttaagggacttcagatgaacttattccttcaatttcgtcggcatcgtgagtcatgatgttgctgttggacatgctggcatgtaggcccaataaattaggccttaccgtcagaaatggcccatatgcccttttgatctcctttccttcgtactaggcctttttggttcatcaaagatggcagggagatttctaaaagtaatactatatgacagagggatgaaaggtgcttcgttctacacacgtagatacgtttaaggttggcgacgacgcttgcggagagtttttgggagtaccttgaaatgaatgggcgcatgttgatggtgtgtttgcaagtgtgccttttatgcagtaattgagaaaagaaaaggttataatcctttgaatgttgatatagtgttttgctttttcttttttttttacgaccactacatgaatagacaactcatgttgtatttgtatgcccatttgcatgctgatggtgttcatctccctttccggctagtgcaatccgaggaattatacccagctgcgcagatacaatggatttgcgtgcaatcgcccactggtttagccatttgggtcgtcctaccgaggaactcagactgcctctgactgggaggcatgtgctggtgacgcggtctcgacgaatacatgttgcccagtgcacctgccgggatgatctggacaaaatggtggtctagctagttcatatctagttggacttggaccggttctttgaacgtaaggaacggcgaaattgtgtctaacacgtctagattctagaagcagcctacttaatttgaaccttccttaacccttcctgtagtagttggcatgttagtcagttagataagctgtaaaaatgcggttgtatagcttcagtacaatgatctttggctgaatgctgtttttttcctctatggtctaccttatcggttttgtgatgtccggattagtcgctggaatttcttcctttttttttctctgttgatgagggggtaattgattgttcttccaaatctgtcatgtgcaagtattacataaacagctcggtcgttacttttagttgcatactctaactcatgtccatatataccaagtccgctcaaatcttctattaggacatggtcagcttaagtctcaaaagatggcctgagccacatcctcttgatttgattcatcaccaggattacatttatagagcattgctgtaactaggtatataaacatatataaaaaatactactatctgattaggaaataatttttcctttgaaacaattcgtagtacatcaaacattatcaatatcggacacataatccattgaaacatatttacagagcattatatacatcatcagtactctaattgaaatatatgatcctagatcattttcccgttaccatctagtaatcaaatctaaaccaaaatgtctcccaataaaacatttactcgaactgaaagatgaacgcgaccactaccctacagaaataaatcataaatgtattaaatgtatcatcaaccttgaaagactgcaaaattcagggtccggcggcatccatccgccactatttccgccgctcagcttcgcctggacgaagcagagtcaccgtcaccggccatccgccgtacccagtagtcggccaagaacgtcttggcggcgtcgaggctggggaagtagggcggctcgaggaacatctgcgccagggggtccatctcctccgccggcgagaacagcgcgcggttggtcgacgactccgcggtgcccatcaccgccgccacgagctgccggtacgcgaagaagaacctcctcaccgccgcctccacggcctggaacgcctgcagcagctccaccttgccggcctcctcgccctcgccgcgccgccggctgtggaacagcctcatggctgcctcctgcaccctcggcccgccgttggggtccacctcgacgccaagcacacatggcacacgcttcttgaggtccctcgtggcgttagcgacgtgcagcagcgccctggagcggaagcaggaggacgcgtcggagcccggtgccgcccgtattgcgagctggctcttgagccgcaggaagtcgtccgggtccatcagcaggtgcaggtcctcgacgtcggcgagcagcttccagacgcgttccaggatccagcagtcgctcgccgcggcctcccagtttcttgcttcgatccggttgtttaggcgggtgagaagctgtgaggccgcgcacagccaggactcgagtatctggtggatagtgaacagcgcctcgttctccttgttgcggtagccggtcttgggctccggcgcgatcttcgccttgagggcgtgcagctcgtgcggcctcacgacgcggtcgtactcgagcaccggcttgccggcgaggttgggctcgccgaggccgagggtgaacacgcagccctgcatctggctctcgatggcgtacttgatcctggccgccacggtctcggacttgtcccaagcggcgagccgcgggagcaggctggcctcgctgacctggcacaccaccgcggcggcgctaccgggaatcttccacacctcagacgcgctccgctcccgcgggagcacgcctttggacgcgctcagctcggccagcggcgggcactgctcgccctcgcagagcgcggccaccagctccacctcccttgccgcgagcgcctccagccgccgcgcgagctcgcggcggctggcgtagccccgcgggtcggagagcgcgacggagatgaagcggaaggtgatctccagcgcctgcagcgccggcttgacgaggccctcgtcggcccactccggacagcacctatccttccacagccttgcgagctccggaagccgcaggtactgctcgtactcctcgaccgccgtatcgtcctgcaccctcagaggcgcagccaccgcccccgacgacgacgaggaggacgcgcgctgcttatcttccggccgcaccggcgatacaggggacagcttgggcgttgccatctccgcgctccagttgagttgaactctccctcgatatgatcagcgtctagtttgaattttccaactgtatactccctccagttatcgatcgctaatcctcgcttgtctttgagtttggcctcgagaattagcagatgagtcgtctttatatactgctgcgctaggtggaagtggagtattacagctgtacaaggggagcgtgccagcatggcgtgtgggccacgctgctgcagcgtgattcgaaattcaattttggaaaccgcgggtgggccgggccctgtgcctgtggctggcgttcgcagagaaaggcaataaataatcgtgcaaagtgagaaaagaaagagatcttgagcttatccggatgaaggagaggtgacctctagttgtgtgaactgtgaacggcggatgcgctcgtggcctcgtgatgtccaggtcgtcgtgaatcgcgatgttctcttgcgttggggcagctcacgccgacgttgtattcgatgtaatgcttaacgcggacatctctatccgttgcgcacttgcgttgcccaccctaggtaggccggcacgaacgaggttcgctgaatggataaacggcgtctctgtttctctcgctagtctcgtaaaagaatactatcaaatgaaaacttcgttcgcttgccctactttgcttgtggtttatacttgtggatgattctatattggaatactagttcccgaagcgaacggcgcagcatgtatgatgattttgggtcggcaatatcgtcaatgaacgacgtcgtagctctgttattttcctatatgttattccatatcgtgagcgtacgtaactttcatcgaaaggcttttgcagtttcgccccgcccggctttcggtagtgatagatatctaggataggcagttgacctcaactgagttttccctcttcggtttatttagcaccaaacgttcttgtcaaccaattttgtaatatgtagtgagcgtttaaagttgtctttctgagctttctccttatcttctcgggttgttgagcacgtaagaatacaaatacaaccaatctagactgcatgctatggccttctttacactatactcaaaacgactgtgtgataccacttatagacggggtcgacagttctaaaccataaattaagcacggtcggtggaaataatcccatatgcactacacaattactacttcacttactgtgaactttcggttatactgacgcctaagtatctctctcctaattatctcagcaaaaaagttgtcttgtcgtaacgcactaaaccaagcccaagtaggcagcagctcgtgtagtcgtgtgtctattggctagtgcgaaacaaccggatcaatttcagtagggcgtcgcaatgcaatgctgatacgacgtgcacctagcccatcacccacgctcaaattccaccgtcacccacgctcaaattccaccagcgggtcgatcgccgccgcgaccgaaaattcagcggtcgtggcgtggatttgccggacgaccgcccgcccggccgtccgcgagcgctgccgaactttgacggcgtacgcgccgagacaccgcgcggccctgctccccagcctcctactagtcagaaccggcagtagccgaagcaaccaagaaggttgggtggatatgcgtaatgcgttgatttgggagggaagcgccgtgttttgccatgtgtcgccttgctattcgcggtgcttatcgctcgagtggattttcatattggttgacctagtatattccacgacgacctgtgctgtttagttagtggcgtaaattaattcaattttggaggattggtattttcgcgataagtacgaatgcgtttttttttttaagttgaccggaggaatgggaggttgagaataggtttttgtgcatatccaggagagatggagatcgatacaggctagctggggacgggttgaggctttttagctgaagaagacgtgctcgtacgcgagatgaaaagcatgtaaggtcggcagattacctgcctaagttaccctgtgcgacagagcatatgacgtgcaccgactgattttgttcagttacgcaacgtttcagtatacataactgtgcatgcgagttcaaatgattacctcaaacgtatagagacatcatatggtatttgttttcaagggattagtttactcaatgaaggaaacgggcatgcgaaaaattcagatcggtttctctctgactccgagagtactcgcctctcaacccatgaaccgcgaacagccgctacaactgcattgtggataacattgacccctctttataccgagggtggtgcatgatcccaactggcaacgagcgtgctcgtgcatgtgcatgaacccgccattaaaacccgtcacggtcgtttcgtcgagggccataattcgtgcatcaacggctgggctccggcgcgtgagtcgtgacgtctgggaagggaggccgggtccatgccgatacggggccaagattatggccaccaataacatctcatcatgatttccggataagagcttacgaaggtagtagtagctgaccagccggcctccgacgcctcccttccttgccgcctgcgcgctagtacgaataacgaatggacaaggacgaccggccggtaaacgtccacgacccgatccgagtatctgaccaatccgtcaccaggattagctcgttaagtttctaggcggacaagactttcacgcaaacgcacgtccgtcgctgtcgtgaaaaagagctctcgatctcccaagaaaaccgatccgatcgcggccccggtgtcccgtacgtcgatcactcgatcaccgatcgagggcgacgtgtctaggctgaggggagacagggacgccccgccacgagcgaggaggcgcgcgcctcgccggttaacccgctgttgccggacgcgacgcacgccggcacacgcgggtgacagctagcggttggcgagcgttctcacgagtttaccccggtccgcgactccgagggtgcgtgctgtgcatgagccgatgcgcgtcggctgcacagcgcagcgtagtggtgcggtgtgaccgactggcgtacttgtgctggcgacggcggcaactggggttgggattggattgcgccggtgcaaacgcgacattcgttttctccgttccgtcccctagccgacgcgccttctcgtgatgcgggatctgggtcggacgaaggaaagaaggctaacgacagaagttcggcggtgtgtgtgtggggcacaagggctttcagttttcggcgttccagataaggggaggcctcgtcgcacatggcgtgccgcacgggccgcggcgcactacgggattagacgaggcccatcatgtgcgatgcccagctcggccatatgctgcgagggggcatcggtcatcggtgcgcgccggctgagatgaccaagccgacgagctggcaaccgtttcaccgtacatggcagctcatgatcttatctggtttgatttgaagactagtccaattcgcacggtactgtattgcgtagggtactatgaaaatcattggtttatgcttccaagcagacattacgtcgagtatctacccttagtttcagacatcactgaagccatttttactacaccaaggttcacaatttcgtttagggtcaaaatacaagcccattgatatgaagaatttcgataaaggattttataaaaccaagtggttccgggagcttcgaattacggaagaaattcaaatagaattgtgcaccctagctcaagctaaaaagtcaggtttgagcctagtcccaacctaaaagaccaagccgaagctaagtccaaacacctttttttttaataagttcactttgagtcccttaactagtgatcaaatctaattcgtatccttaaaccacaatatcttgacctccaactattaaaaccggtgtaacttgactccctcgacgattttggagggtggtttcgctgacgtggtgttgacatgatcttcgtcctacgtggtgttgacatgacgcttatgtggtcaccacatggcgctacgtatgacgaggaccaagtcaacaccgccatatagtcgccacgtcagtaaaaggtgattacctttgatgttgtatgccacatgctcacgtgactaaggcgttgtgtttgcacctaaatgacaaagtttgggacgtgcaatacaccctgcctctaaacatttttctaagaactttttttttctaaacctgtttatataggttggaagcatctaagattaatttaaacatcgagatttctaagtccaaacaaatagtcatgaaaatgtttgaaaatatttttgagctttagtaatagtgtcatcgttggcttaaaaaaatacaactcaaaaatcaacatgaaaagaagatacaaagagtaaaaaatctactaagcagtaaaatggatcatattttatagtttactggtaatgaggaaaaaacagtttataaatagataatttctcaaatcaaatagttcaagagagtaaaattaactattatttccttctatgaataactagcaaaactgcccgtgcattgccacggaaagaaaaaaaagagaaaattgaattacaacatattaaattataattaaatgaaatacaaattttctggaatattttgggtattttttaagtaggtaggtatataattaaattaatttacaagtaaaataagtgtgagaaataaaatgatatggttggatttaattttcattaaattctccatattaattacactttttgaaattttcttggaatttactgagcttaattgctaattttgataatacaaacatcatttaagcatttatttaaataaaaatcattctttctctatgagccattttcagcctatttttttcttcagcctgcaagcgaccaaagtctacataatatccccacactcctcacttgccgtgcgggccgtaaccaaaaatgtgttggaccatcggcccacgtgtggcccaaatggtgcggtccggtgatgtaggccagcccaacgctcgatcaatccgagccgtttgttttgatggatggctcagatcagttccaatcaatcaaaaccctaaccctaaccctccctctccccctccccgatcggctcagccatcccccatcccccctcccaccgccggccgcctccccgcacgacgcggcctctccccctcccctcaccggcgccgactctcccttcacccctccagcggcgccgcttcccttcccctcccttctccactccggcggcgccactccctctccccctctccctcctgtctcgctggcaaggcgcggcgacagcggggtacggcggtgataacgcacggtgacactcgtccctccccctctccctttccctctcctcattgcctcaatgcccgtccctccctctcggtgatgacgccttctccaccctcaagatccggcgacgtcgacggcgacgacgatgtcgtcagcctccgcgggtggatctgtcggtggtggcggctaccgcttgcggatctggcagcgacagctccctccgtcgcctctcttcttcctctggcgacggtggtggcgtcggcggtggtcgtggatgaatccggcagtagtggcgacggccgaggggatccgacgacgccccgtggtcggattcggtggcgacgacggcgttggtggcttctcggtgatgtttttatttttcttccctttttttttctcaatcgcttgttgtccgattgaattttgtatgaattttttttttgctttttttttgccttattatgatgcaaccggatttgattttttttcaccttttttttttttttgccctttttcacggacggacgacggaaacaccttttaatttttagacgatggaaacaccttttaattttttaaatagtagagatgtagttgacagagttgccaggcctataaaaacacgattccaactggcccaacggtcttccctagccaactggcccacggcccacggcccactagcagcacatctgatgctcatctttgtaacctaggtcacatagccaacttgacagttgacactcgggcccgcgagcccccgactcgcccgccgccggccgccaggccgatgtccgacgacgctccagcctcctgcgctcctcacctcctgttcgtgcttgcttgacgtcgacgctggcctggcctcgctcggtcctgaccgagcctcgaggagacgtcgccgccgaccgccggggctgacctctcctccgattgcccgacgcccgctccagcgctcctactccatctccggcctccgactcccagccacaggggcgcaggcggctgatccccaggctgctatccgcggcggcggcggcgcgtgcggcacaactcgccatttcgaagggagtagccgctctttgatgagcgggcgaatgggtacaggtatgaacccgtacactgtaaccgtctcactgagaggagggagcgcatcgtctgccgtcgtaactataacggcacggtcatgccgttggcaaatcctgatcgttccttttctttggacgattaggatttagaaggatccaaataccaggcctgcaagttcattcaagcccactaaccaatcggctggtgcggcaatataggcgccgcaaccttctgacgcgagagaagtcccgatgcttttttttatcgatttcactttccccatcttcatctctcacctctgtctctctctccacgcatctctcaatcactgcaaagcaggagcgccgattcagtggcttcaaccataaatttttgctgccaataacagcaataagctccctgatattacccaggtttgcttcccatcatttttgtcaattaatttggctcctgttgctagcagcaatcagtcctggaagcattggcaacagtacgcagctatggttgctgtaatcagagaagtcaagcacgcatgcatgagcagaaaatggaagagacgaagctagagggtttgggactgattccagaatcatcggccaattcaatttcagtagcttgtgctttagaaatcttccgttgtgaagacattagatgacttgtctctggtagttggagcatgtggttgtgttcaatagataaatcatgcaaggtgtaaagaccagaatccctatctaaggtaattcccattcgggcatcacaacctgttcttgtctcagctcggggaagttttgtcaagtgatctctcttgtcctgtgctcggtagccctgattggaacatacaaatctacatgatgtaactaccttgtcaattttacttgtgttctcatacttcttcctagcattgaatcctacttgacctccatagaatacccaaaagttccaagcctcatcagcacaactaaaattcatgcctattcgaggtatccaagaaggtgtgttatttgtgctgcaaaacatggcatcgcttcttattttaccaaacatgattaatgtaagatatgaaatgaaatggtcggactggatttagatggtacatatggaactatgaatcagatcctgatatggcactcacaagtttgatgactcagaaggagcaggtttttcttgcagcgattgctttcgtactagcgtctgatctccctcaatctcattgcttcaatcaattgtaatattgttttaatcataggagaactaattatatgtattacagatgaagatgataatatgacttacttatttggagtctctgttgttgttggggtacctcgatcttcagaattatccagtgaagacatttctttaactcagatcttgcttgcatatactttggcctcttgaaactctcgatcaagagatggcatcagaccctttggagagaaaggtgaaaactgatttctataggtttctatcctctaaaatgaatgggtgaaattggcgccaagttatctgcttgccgcgcgccatttctctcgcgtcagaaggttgcaacgcctatattgccacaccagccgattggttagtgggctgaaatggacttgcaggcctggtatttggatccttctaaatcctaatcgtccaaagaaaaggaacgatcaggatttgccaacggcatggccgtgccgttatagttacgacggcagacgtgccgttatagttacgacggcagacgatgcgcttccgggggacccatacccgcgaagcattaagcggtccccaaaattttcaacgcgccctttcacactttcgtgtcgttcccgcgcgagggtgggaaaccctttggcgggcttggctctcgcgccactctccaccaccgcgccctttttcttgtcgcccacctctcgccccatcccccacaaacaattcctccccaatttccctcccaaatctctcccgcctccgatcccacagtctctctctctctctctctctctctctctcgatgccgacgcttcgcagcgccacagcgagcgcgtcaacggcgggcacggcctcgccgacggcaatcgccaccccacgaagcgccaagcggcgcctcacgagccctcgccgagccgcagggtcacccgacgcgtctcagttcacatccccccacaaatcccccaatgtcggaatcgtaagtcccccacctcccctcgatctctagtgcaggactatgcagatgctggcgtgctgctgctgctgctgcatattacctggtattctgttgcaatgaggagcaattgctcgatcttgcaggttggcaccccgaagctgctctcggcgtcgcccaggtcatctaggaagcggctttacggcgacttcgtcgcggccgagaagcccaagtggaatcctcgaggcaagtctccagaatcccatttcagtagggctcagagttctgattgggatctgacgaaagaattcatctgttctgcagatcccgctcagatgcaggtggtcaaggaggcgcttcacgtggctacggtgccctcttgcggattggtctgccgagatgatgagcagagtcgcgtgcttgagttctgcaagggttgcgtggagcaggagcgttcagggagcctgtatgtgtgcgggtgccctggtacagggaagaccttgtcgattaacaaggttaaggagagcgtggcgcgttgggcagacgaggtaaattcaatttctcatggttctgtaagattcctgaaataggagtgtgtagttgttgatatggttgtttgtcctcgtagaccggaatggagacacctgatgccttatcgatcaattgtacaagcctagcaaagacgcatgaaatttttagtaaggtatttactgttgcctaattattgactcgatatatctatgcaatgctgacaggcactgacaagttcttgatgcagatacttgcgaagtttcagactcggaagaaggcaacctgcaaactgtcaccacttcagcaacttcaaaccatgttttcccacaaggaatcagccccaagaaggatgttgtaaggactgcttgagcccagtacccatcctcacaacctggcctttttcgtgccatttagttcctggcatcacaattttcatattactgctcctctgtaggttggtcgttgtggatgagatggactacttaataacaagagaccgggctgtgctacatgatcttttcatgcttacgacttaccaattctcaagatgcatactgataggttagatgtcaaaggatgcttcttgtacttttgtaattatgttaatatcaaaatactgttttgccaatcgacaattggtgctattttttcaggtattgcaaatgctatagacctagcggatcggtttcttccaaagcttgagtccttaaattgtaagcatttaccaaatactagcaagaaaagtgttaacataaattgtatgaaagaaattaacatgtctttggcattataacactaatttacaggcaaaccacttgttgtgactttccgtgcttattccaaggatcaaatatctgacataattaagcataggctgaaggtaattcgtttatcatgtgaccaactgtggctcgtgcacatctgtgttcaattacttgacttaaataggttgcttaccttttgtgatactacacataggttctcgagtatgatgtttttgaaccactggcccttgaattttgtgctagggtaagtccaattactacccaagtactcatttgtagctagttcattttgaaatatgtcagttcacaaggcagcataggtattttttttgttaaggagaacatcatggtgcagttagcatgaaattgacgtgttcacttattaacaatgtttgcttaatattcttataccagaaagtcgctgcagcctctggagacatgagaaaagctcttggtgtttgcaggtaacccacttctcttgcagtgacaactattacgtttttgcactaacatgttgttccatcataaggtaagccagtccataacttaatttttatttattccaggagcgctgtagaggtttttgaagcaaggttacaagagtcttctgatcaagaatttggacttgtaagtcatgccgtcttttgatagcttttttttttcttttgagggaaatcatcttttgataggtaacatgtataaccaacaaagtggttcctgtaaaggaaatcacctttgttcatgtctacattgatgtaagtcaagttcacagtagttgcttcaactgtaaagcttccttgcggttgggtccatctgtgtctctttgcctgacttcttctggccggtagtcggtagaccactagaacatgattctagtgtagtacttaccaccaaacagaaatttgtatgtgcatgactgttgtactactaaacaagcgattgacagtgtatttcatgcttttagttgcctggatctaacgctggtcgccaaaataaatttatcttttgtttggatgatgaaacattgccacattgtatttctttcacaagatcagtaatttactttcctgttccagtgtcctgttgtctaatataagtattacaggtgacatttgaccacatggacattgctttgtcaaaggctttcaagtcacctgtagtagatagcattctctgtcttccccaacatcagcaggtaaattcagatttaccatctcctgttcccctcgattctttttccaaatttgctgtattcattttcctcgaatgacattccgcagatggtattgtgtgcattggcaaatacttttcatcattgcaagaaaaaggcaacgactctaggagaggtaatattcaatatttattcacagacattctgatagatcacgctcgttagccacatgttgtaatattctaaccaatctattttaatgcccttttgcagctcaataaatcatacatagaaatttgtagatcaacccaagtcccagcagttggaatgcttgaattttcaaacatgtgcatggttttgagtgatcaggtatgcaaacatgaagtaaggccaatccaaagaaatggaaagaaattcaaaacatatcaagtatttatggaatttacattgtagggattcatgaagcttgggcaatccaaagaagataagctcaggagagtgatgcttcaaattgacagttcagatatcacttttgcatttaaggtatggataaagtggttctgactattgtaaattcttcgcatcattgtatgttttgtttccagatgtactcattagcctaattcatactacagggtaaccggttctttcagaaatgtttggagcaccaaaaattttagttagtcactcaattcagcaacgacgtctatacacagtttgcattgtatcttataccaagtgccagcaaatcaaaagcaataatgcccaaaagttcaggtgaaattctatctctattactgtaccagtcactttcatactgcagcatgttatccaaaaaaacatttcatactgtaccagtcactttctcagcatcgagactactacaactttatgaactatacttagatctttttccttgtttcaggattttgcattctattggatcaaaccaacgtaaattttgaccccgtcctcaatgtttatcaatatttatgatttatggcgaaaccctttgctgagaaaactgtacatgcgggatgagttatgattgtttttcttacagttcttctgaaagattcctaactgtatttgtaattctaaaaggtagttgattgtagttctgatttttccccctagtcttattttccttcaacacagtctacattgattatgatttaatccattgacataaaagataatttatgacggttgagatctgtaatgcagacctctctctctctctctctcttttactttaccaaaggttatgtataatttcactttatttataatcaagctacaaggctcgaagcactttatttgttctgtatgcagttttatctcagacctggaaaaaataattctgttacttaggctggctatataaatgggcctggaagtgctattgacaattgggcttctgtgggctctttcttgggcacattttcttctctccttttccctgcaaaaactataggttggcttacctgggcaaggaggttgcaaggatatgcacacatttgtatcggaccgagttaaaatgcacctatgtttttcttcgacagtgacggatcgagtagatactagccaagtacccatgtgttgcaacatattattaaaaataaattatgttgtgcatgtcatttaaaattcaatataactctaaaaagttgagttttttttcatcgagatgaaataaagcaatagatgacacctcgtgtgttgtttctgagcaactataaacattaaaaattggatttcgttgctatttcagaaggaaattatgtcatgctaataatagtaataagcaaatgcaatctaaatagtagcttaggtttgatggcggtttagaaacattatcaaatagacaaatagaagaacaacactgcaacagaaagacaatgttgttcagggcctaatactacaaagacaaggctgatatttgataggctcctcaatcagctaaaacaattctcttgatgtggctaagcgtgagtattaatctatactccattatatatataagatagacccattatattctaaagcttataatataaactcacatgatcattaactagcaattattgtattttaaagtttatacacataacaagtcatagatgctgtgttagtatgtgttaacgaccaaatttggtaatatcattatcggaaacggagattagatcaaggtggagtcgaaggcggagattgatctgagaacagagcaagaatcggctgaaatccagatcggctacgattaggatcggctgggtctgagtcggactaggtgagctgatgcagccgattctgacagtataatctggtgtatgacattgggttgaattgaggtgcttcaagatgattgccgcatatggatagagtcatgagaaggcaattgtatctattaattaggatgttttatgtaacttccttagagatatgtttgggcaaaagtctgccgcaatgacttatggtatcttagagtttgttagagatagtggtcgtgttcggtatagacatatcttgtaattctcgggtataaatagaccccgagccctatgtaatttttaacatacacgttcaatacaatttcggcgcatcgccacctttttgctttagttttacttcgacgagtttttgctttcgggttgagctgcatcggtttcgatcttcaacaagaggtaaaacttgttatgacggcttgtgttctcgggattagtgcttccatctttatgacactaatcttgtctgtataattcgtcaagttattatatatcttatataatctttggcaatatcgtcatctaacctacaatcggttaacatctgttgatagaaggcagccgattaggttaaatagcgacgttgtcttagattatataagatatctaccactttataaaacatccagcggcttgattgtctagatattgctcttcttttcatacttaatgctgcatcagttgagtttgatctattaagtcgtgcttagaatatcaatctctagcctgtactctggttgccgattagggtagtatcggagtttcagccgatcttatttgatttaaccatattcgatctatatgcttcaatgacatgttaaatccgtcctttgtgtcaagatatcgtcgcaatctaaatatattaagcttctgtttaatacattatacctgttttaatatcttgatatagagtagtatcggagtattagccgatacacgctagatctatctgatcggctatgctataaacatatataatcctgttattaatatatatttcgatctaagtgatttatactgtcttggcatggtgaccgatctatcccaatcacttgatttaagtatatattaatataagaactatatatcattaatatctacagccgatcgaatagatttagttccttaccacctatttataaccgccgatcgattcatatatgacatcggctcaaagataaatgatatgtcatcggtacctagccgatcggctatcatttatagatttaaccacgaattctgtctctatttcttgttgattacatgatcaaatcaactggcacgctcatacattcgaaggcgagctttggacctgcactggagttaagcagatctcccaggcatcgtgttttctatcaacagtatgttatagggctcaacatataagcatattaaatcatcaggtctgttcagattgtaaccaaaataaaccttaccaaaatttggcattcttatgtatttaccaaatttggcaacaaactaaatgtagacatttttatttaactttgtaaaaaaaagggtatggttgaaaatattatcaatctgaacagccccatcatttcataatattttaacatatatttatctatcatttttatgatatttatcatacatttattcattcgtgtatttatagcaaaacatattataccatctggtaaatacaactgtgaaatattatcagtggatagtaacacgtatgtagaagtacttaagatcacgcccccgtacgtttgatgtgggatgttagtgcttgcaagattaccgtacatgaaactaacaaaacaattaatccaatagccaaaacaacacaagcatacaaggatgtcaaagttgggtgaataggtggtgaacagattgtgtagctgatgccttatttattgctataaccccaattcttaccatattaatgaagaaaaaattataaagaaataaatatcattggagtatattcgcccatgatctatagctgttcgtagctttgccagagcccttgtagtggagacgtcagcaccggcgctgtctacaggccaacgatgacgtactgtgatagaacggtggtggggtgagaactagagaagaggacagagctggcgaatgtcgaccgggctatacgtgatgtgtgcaagtttgggtttttgtgatcgattttacctggacattgacgatgtagatgtaggcatccaagggacgggtgagttttggacaatgctgtactatatacgacaatgttatagtacgatcgcaattacagttgatgggctattacaagagtaggatggcatggccccccctcctctcctcacaagacgaatcactgtaccaaactcagtcagcaagagttcttccacagatttttttttctagaaaatgtcccaatgaatttcagagagaaatttgcatatatgagtaaaaaaattgtttcactagaataccatcacttagttttgataaaatatcatggtcaaacagaggttgtttgctagaataccaacgtggacgacattatctttggatcttcttcatcctccctataacataggagtgaaaacgggtcgagttcggtcggatctcacccttcccatatcctaacccacattttataatcggaatcgattcagacacggatagtgctgagtacagatacaaactcggataatgtcgggcaaaaatacggaacgaatacgtaccaaaatggatatgtacactatcggttatgaatatttattcagatatcaagttgaagcaacaatcttatatatcacatagacaataaccattcaataatttcatatatccacgatacgattatattatgccattaggaccttaggaaataaatagggtgcaatacctcacaattgaaaatcattttatatatgacatacagttgagaatattaggtcattaagcacaatatatctcacagttgagtcacaatatcagtatatcatcccatacaagctatcagtaggcatcattcaggaccacaggggcatagactaataaacatcatttaagttatcaccaattcatcataacaatagtacctcatagtagaaccaatacatagtaccaaaaggtgccttgcaaaaacataatacgggtagtatccgtatatttatccgggtaataccaggattttttttaccggataattcgtatccgtcagatactacgttcccgaacccaatcctatatccgccaaaaagacccgtactcggatccgatgtccctgaaaagtctcgggtacccgaatttgtcccgaaataatgtggccggacgggcgacgagaaataccgccccgttttcacccttactataacatcggaagatcctagctctggcctttggccatgctcactccaggccatggcggtgccaagggcctcagagagctactcttggacgaggggcggggtggtctcccatttccctgtgcctggaggaccatacttccctccggtcatccctacatagttagaggtcgggatgtggttggcaccgtcaccgttcgggcctccggggagaacttagccaatggcggcggagcacaaacctggggagcacttgggggactcgatgctctactcagtgacacaggcacacagcgtgcgatgcgtcgggagagagcaactgcgtaaaccattttacaagggtgtcaagcgtctccgatgccacctccattctcgccaccatgatgatctggtaaaaaaggtggctagggttcaggagtaggcgatctgtttggtggaatggaggagatcgggaggaggaagtagggtttttgaaatttctcgtggtccaagaatcagtgtgcgcagtggcgagcagttaacggcggcgatggagcatggtgacctctgacgagctcttccgctattcatacaaacgcgagaagtacgcaaggcaaggagaacaacatgaacacgacctagaagaacacgagctatgggctagcaagatcgagtgtcgctgccgtcgacgcaaccagagcatgatgcggccggtggtggcctcttctagcgttggagagaggaagaagaatatttaagggtaattccgttcacgaagcaaacaaccacctgtttaattgtggcatttctggcgaagcctatttaaatgatggcattctaatgaagctaggttttttaagtggcacatgcaaaattctcaaatttcataacacaaaacaatacttcctccgtccaagatcaagaatataagtactattgatgctgaatcacgccgccacaccttgagcacgttatgtgcaaactacagcagcacccagagacgcgctgccacgagaaggaagatgatgccgaacgagcactccgagggacccagtcagggtgaacacgtatcgatttgtcctagactcggtaggccaattagggcatcctctaacactatagcaagaaggagattaaaatagacttgggataggtaacaagaaggagagagaaatataatatagaggataaggataatagattgatttagaatataaaggatatgatatgtacatctaaagtttttattaggagattaaaattgaggtacggatggttgtaatggcttggaatgagcaagtacattgagaagtcttcgtattttagaacaagctttgaacttagatgtgcttatattaaggttagagatggttgtaattacttgagatgagcatgtagattgagaagtcctcgtattatatgtgctttatattcttgggcggaaagaaattatggaaaacccataaaagtagcataaaactttagtattgtaaccgatgacacataatccatatattattgctgtatagttttacaagaccccattgaagatgatttttttaaaaaaaaattcaaaatataagacaagtatattttttaaattattaattacttgattaaggctattagttttagtcttcactattaaaaaaaatattgtaccagatgtgttggaattaattgggatttactaagggtgaaggttttatgaaaaagataagccataaaacctatgattatgtcatataatataagtcataacaatcggtgtctttaacttaggtcataaaatatattacctccgttctaaattttagatatattataagatatacttactctgttctaaaataaattaacctcgtacatgatgcgatatacgagtttatatctcgtatgagattaatttattttgggaccgacggactagatattagtgtgaaatttgcacagacgaaaaggaaatactagtagccaatagaagaagccacaggtgcgctagtttaagttgggcgtggatggggaaagcaatagatgcggccagtccatttcatcaggacgcagtgtcgcaagttccaaagaggcccaccaccggattggattggccgagaccatcatcaccgccatgatcaccagctagattcattcatttgattccgcctagtcgagcttgacgtggtacggcgccttcaattggagatgacggccactgtgatcctgattgatccccagctacagaaatacagtatcatatcttaccctctcgcaatacagatcttgaaccccactagagtacatagctggaagaaaaaaaaatgctacgagtagcaaaaactcttcttcacaacgcagcgaagtggatggttgttgcttttccaaaaggacaaagctttgcttttgaaccacccgccttttccaggttttccaaaacttaaaaaaaatgcacggaggcccctgatggcatgatctctcctccttttgcaaaaaaggcccggtgaaaaatatccaaaaaactcaaaggtcaaaatgccacacatttgtttaccgaggctgagtggcgcaccacaccagaacgaacgtttctttaagcaccgtgcgcgttatactacaccgaagaacaaagatcgagagcacagcttagcttattattagtagcaaaccgcgaatgcgatggttcagcagcagaatcggccactatccttgacaaactctcccataatcatgcccgtcatgattggctcgaacgcccgatcacttgtttggcacgttgctacgtacttcgtactagtttttcgagatttgtacgcttgcttcaacgggcacagtggcatggctcccgagttccccatgccagttagtagcggcaatgcatttgcacgcgcagcctcgccgtcgcggcgtatggttggtggcgacctcgcgatcccagcgcccatgcggccagcgcttcttgggcccggcgtggcgtgggcgcggcgcggcgcggctcggctcgcgcgcgcaagcgaagccatcgcggaatagcgcgtccacagcgaaaaccactggattggtgagcgggattcgatgccaccacccacccgatcggcgcgcgaagccgtcggtcgctgttgcgggcggcatgggcgggtggcgcccgcgtgaacggcacgagggaaccgggcgctcccaccacaccacacgaatgtttgtccatgcacgcagcgggcgcatggatgcaggggctctgtcagggaccccatgccacacgtgaaacggatcctcctcctctcctctcctctgaactgtcctggctggctgctgctttcacgtcaggcgccagttgcgtttgagccgctcgatcggaaagctggaaggtgagcccgagctacggtcgggggaaaccttatccaccgatgggccctttatcctgtattaattcgatccttctaatccggcagattttgctctgtttaatcataccgaaactccatccagggcgcttggaatttcgttctcgtcttcgtcttacccgtccatgactcgatcaaatcgcgcctaccgcctagcgactcatgcatggttgggtccagggcaattcagcgtggagagctcatcagcctgcatctgcaagcccggacctatgccatttgatgattagtgctaggttggtgcttgccctttggagccgtgtgcatcatgggcaggtgtcccctaagctgactgacctgatactaccccgtttctctaccggcaccatcattgggtacctggaaaaaggacgctgaaaccctggagtccaaacactcaaaaccacaccatttttttggttcttgcttttggtacactactgctgctagtacgatttctacaacatttcctactcttttgtaattattctcagtccagcacacctgttaggtatagtcatttgcaattagggcagtccacagatgcgtctgagattgtgttcaaacccttgattatactataggtttatccgtgaatagtttgttagtcaaaagattcggggtgtgattattggtctcccttaagatggcatgcctagatcagtccaaagtaccaggactgataataatattagtaggccaaatctagcctaattcttctaattgagaacatgctgaaccttgtctggagtgaaattacttgattaacagtcgttcttcaggagtagttgtagtacatgactaggtcatttcttaactaagaagcgatataacatcccaattagtgagttggagtatatttctgagccgatcatcatggccccagatgtccttgtatcttttggcgaggcgcacttttaagctaaagattgggacttgctctaacagaaaaattgacacatcctcttttggaatcttttcccactggaacggcttaaagactactactggtcttgttggtagatgaagactgaacctgatggctgcaatgaaaagaataagaggaaaacaagcaatatgagtcacgcgtatgaatcattttactgcatcaatcgctgacatcatgacatcgccgaactggtgctactgtgctagtactccaacaaacgggccacaatgtgagtcagataagacggcccagttagtgttgtcaaccgctaagaagaggctcttggtaaaaagagaacaaaaaactggggccacacccattcttgcaccaaaagctcaaaacattctccgttaattttgtgattgaattgacagcggctgttaaatgtcaaaattaggctgctgtcataccaaacaccaagtcccaaagctcctctatacatcggccccgatcactgtcacttcatttggatccccattagctcttgcttcctgggggttggttctcatggcaggatatatctcactctcctcaatcaaatcctgctgctacttggctgtacacaggccatggcatgtatcccccgctcttgacatatactccgtccgtcccaaaataagtatagttttacactatttatctccaacgtttgaccgttcgtcttatgtgaaaattttttatgattattattttatttgttattagatgataaaatatgaatagtactttttgtgtgactattttttaaaaaaaatttataaatttttcaaataagacagacggtcaaacgttggacacggattttcactgctgtacttgttttaagacggaggtagcgtgcgaacagatgatccaagtgtactcgatttgggctacacgctgaattgcgttgcttcacagcttaagagttcagacttcagtgggcataaatattttctcaatcagctgcagggatcagataccttggaggattcgggacgttatatgataaccactattgttatccaggcgtggcagcaggcaaacaaacatccatcagcttttgcaaattattttcttccgtgcaaaaacagtgttttcaacctttccagttttcccacggatgacaacttccacatcaagcgagacgttaataattaggagatcgaactctcttttgttgcgaatatttggagtttttctcgtcgacgatgacccaatattcggcacattcttctaccagtcactaatttcctttcattttcttcattcctcctcttttctccaaaacaaatcgcctcgtggattgataggaaatgcgttttcacgctgcccagttgctaattagggcacgtacaaagatagagtcgtatataagctctacgttatttagagactagcatcctacaacagttagagacaatatggtctctaatcattaatgtatcaaaataacttttcttacttttatttcctttctttcatcaccatgcaacaaaatttgctctagtaaatgctaagagtcgactctgagccgttgtcatgcataacaaccatactcctttctctttcctccatgtcaccaaatttacttgcatggcaataaagagagaccactaataaacaccgttgtacatgcccttagccaatgatgccaacacatgtaacgcacacgtatcagtaaatcttcaccgcgatctgtaaagaaggatgggccgacacacacaccagccagcacggcggccctgccatgatggccgccggattatcgccggcggatacgagaggcaggggatcgtggagtggcctatctccccctgctttggtgcgccggtgcaccctaaaacgagcacagccaccggcctgatgcaacctgatgactggccggccgtgcgtccatcgcccggcgccctacctgtggtggagccaacaacgagctagcagctggtttagttttcgtgtgtgggcacgtatcgatctcgtcactttactactactttggcgtagcggtataccctaccagccactattggtgctacccaaagacgacccaggtagtagaaagatttggagtatacaactagaggtggcagtggccagccagggcatgcagtggaggtgacatgttgttgtccggtgagtgcaagcaatgatccatggtctaggccatggcagcatcgggatcccccagaggcagacaagagggggacaggcgatggtagtggccggagctggtggcgtgtatgtacacactcgccattgctgatactatcatggtatgtggccgtcggcattggcattgctgcgccccgatcgaatgcagcttgcaacttgcaaagcatacgtagcgagatcgctaaccacagatgaggcgaggtactgatcgagcagccgagcaggcaagaaggcaggcatgcgtgcattggccatctttgttgctaatgcgtggtggtgtcttctcagtgtgcgccactcactctcgctggctcgctagtgcatcgtgcaatgcgtcgttgtaggtttgtagccggagcggcagcagcgcgtgacatgtttggtttttttgcatgaaacgcgtatcggcttgggccaggtgaggatgagatctaggcggctccagaagccttttttgagggtgcattactgagatactgctgcatggtgcaacggagaaacaaacaaatctgcaccaggattaccagcctttggtgtgaagtcaagtcacccggatcaaagtgatatttggatgggtgtggaggggcactggttcatgtaaaatggtcacctctctggtgtacacggaataattgcatgggtcgattggccatgactttttattcgtgttaaccataccccatatggtttttgtgatgtcgttgtttgtctgtcagatcatgtttattgcgtactactatacagtacatgtcatgctgctgaaagaaacacagaaatatttggtctgatcatctggttcccaaggggaccttttcaagcctaatcgatctccgaaggttggtggagtgtccccataggaaatggttgaaaatacggagaaagttatctcaagcaagtcaagtcatcaaagagagagagagagagatggttatcaaataattagaaataaaataaacgcgttgagaattaaacgcgagaccgtagggttaaaactatacacctcttaacactgcaatatcaaatacatgacacacaatccgtaatatttaggctttattttttaaaacaataggcttcaaaattttcctttggaggtaccaagaaaagaatcctcaactgtttttactgctcttcacatctcaacatctcaggcacggctagtactcccaatccgcctacgtgtgggcgagagagattgtagccagggtttgcaaaaccgccggtaactgcgcggttaccgcgctcgcttaccgtgggatacggtaaaacaaaaaccgcggcaacctccttaaattcaaataaatttaaaaaataatttaaaattttgataaattttgcacggttgcgtacgattttccacggttaccgtgcttattgccggggtgtggtaaccacgtccctggcagttggggaaaccctgattatagcaccagaggaaggccaagcgataacgcacgggagggggagcgagcgatctcgcttagaaggaggcccacttttttctattattttagggatcaattttggtcatctcttggaaacaagtgtatatattttaaatccttaaatcttcattagaaattcttaaatccctctattttaaaatataagatgttgttatagcaacattgtaaaatggatgggtagaatattggacaacttttttaggtatgagttaagtttgggcgtctggctacctatataggagtggaccatgagttatttttttcaaaaaaaaaaacgtatatagtcctgtcggatactacaaccctatccggctaccttacccgtgaccatgactccgtgagttttattttgggtacatggcaaaggcgacggcaattggctgctggctgagacatgcacagtaagcatgcatgcgcatgcgtacatgcatgtacccatcgtccatgtaactcgtgcacccaagggtaccccactactcctattttgtagtaagctgggtactcgtatttaaatccggtccgatccgttcgttgacttttggagcccgtaaaacttttccttctgaccgtatattggtatactgcatgtgctaattagttccacgctaaaattggaagtttgaagaaaaaaagttagaagtttatgtgtataggaaagttttgatgtgatggaaaagttagaagtttgaagaaaaaagttaggaactaaacaagcacagtagtaatacctattcgccagatagtgtttagttgcaggtctagaatagatcaatgcacaaaaatatacaccggtcattctaatttctcccgcaaaagagacgttacatatgcaaacaagctattgacccgcgtccaaaagtgtaaggacacacctgaattgaaacaccggagagatctatcacatcagtagttgccccccatgtgtgtccggctacggtccgtcggccttgcatcagacaccatagcatgcggccggccgtgtgccggggtgcgactgtgcataccgaaaccgatcgaagatgacttgcgcgcaggggaggctgcgcacggttcaaacttcaaggggtgaactaaggccgccgccccgcgatatggccgtcctctggctggccaaggccgcgtatctcacacgatccgcgaggaccgcagagcagagagttcgtccgcgtccttgtttgatccgtctcgtggcctcagaaaccgcgaagcgcacatagcgcaccacgagcgccgccgcctttgtcgcggtctcgaccggcttgtttaatcctattagttcgttacaactgcatgtgcacgagcacgacaccgatcgatctcagcaggggatcgagttcgtacggaatttggtatttctagattataaattgtatcgctagtaaacaaacttattaggtgggtgttatttagagaaacgcccagggttttttggctagctccacaatcggtgatgggttagatgatctggattcaaagcctcaccccttctaattatttgatattaggtcatttattaatattcgtgtttttttaggtaggtgtaatttagcatatgaacttgcaaattgctcgttttgatgcacaaacttatcgacgtgcaaactaaggcaatgaaaaacactttataactaatttctctaattaagttgcattctgaataggatattatgcatacgcttaatcagtaaaatggctccgtagatcggtaaaatgaatagagttcgtgtttttggttgttggctccgatccgattcattttagctccaattctttttaggatattagcccttcatttcgttcatgtctgccttggcgtatgataatgctatgtaagtttgaatttttctctccttctaccaattgaaatagtagagctaccgcttgtttaaaaaacatatactcaatggataagttatgttaagtgtacagagaaaaagtatataaaataaaaggaagatgcaatgtataaaaataatggataaaagcaaataaataaaaaaactatatgtaaaggttatttacacatgaacatctctcgtgttctttgattatgcatgtgacatcttaatcaaactctatattagtatgattagtcataatatatcgttttagacttgatccgcatagacgcactagacaagttcataatgagcattttacaagtttgtgtactagtaagtttgtgtactagtaccatggattaccgaatatcactagaatcagggtgtgtttagttcacactaaaattaaaaatttaattgaaattggaacgatgtgacggaaaagttagaagtttgtgtgtgtagattagttttaatgtgatgaaaaagttaaaagtttaaagaaaaagttgggaactaaaccaggcctcagtagtgcatgcatgttcagaaagggaatttgattcgctgaaacatcttggtcgcggccccggttttttatttacgagaaacaaaaattgcagtgcaagtagtcaactcctgttgtgtaacggccatctggtgatctccctcgtgcatggtcaactattccgcgtcagttggtcgatagatttcgattccaacggattagtaatgtcgtcaagaaatagtactacagggctgagtcagtaatgcctaatgaagaaacgaaaatagctgatgggatctcgtcgctacataattaaatgagaaaattccctatatacccctgaaaatttactcaatcctttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaactttttttacaataaatctttttttattttaatgaaataatgttttattttcaaaaattcataacaaatatttagtaatttattccttattggttttcacaactcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaggggcgtagaagggattgggtgaaattacatgggtatatagggaattggccctaattaaatcggaaatgtcaccatagtcacgttactatatggggaaaaattaaagtcattgttgatcatctcattaatgcgctgaacttaactggttaattaagcttcaaggctcaaatacatatattctggccggtgattcatcagttgactcacgattagaattagcataagatagttcccagttgggttacatactctgctccgtccgttccaacgttcgaaaaatgcaatagaaatcggcctttgctgctcccagctgccctcattttttaaccaagttttaatgaaccagtatcgtatatacaatcttattaaattacagttagggaggaataagaatcatcgctatatttatctgtcaaatctgcatgtaccaaattaacactgcaatactgcaactcactgagatcgaactgagaaataaggagatacatattcacgtattttctagttttattttgggtatactatacgctctcgtatgatggcatgcgtagatccaccaaaactgtgaagcaaccgcacgtgttaggaattatagtatatctaaaggatgtatgaataaaattacacaagcgtgatccttcgccacctactgccgtgcaatacccttaaaccaaggaagctgaccgccagaaataatttttcaaagcatatagaatcccattcaacatttccccgttgcttgcaactacaaattctccggctaacctgcaaaacattttcaaattaaggagccgttcttgctggtgcaagacagtcctaggcaagtggccttaattaattcgtcaaacatgttacaaattaatcaaacactaactcatgtttgtttctaatacaatatactctgaacagtacagatgcgtttaccaaccgtttggattgttcagtcgagcggcgccacctcttttttttttcctctcacttgttgacagtattgtacattgtacactagtgtaagaggagaaggttttaggtggccaaactggtcagtactttccatcgtttttgttccaagcacttagtacggactacggagtatatggatattgctgtacgtgcgagtgatatatgttagcaacttgacatgtaccaggactaaaactaacacctgggcttccaagttgaagctaagcctgggaagtcacgttggtaggaaagcgaggctcaaaatcggattcgccggccgcgcgcaccacatttcatcggatctcgcgttgcatcgaccgatcggttcccgcgttcccaaggaaatcgctcgatcgtcggcaactctcgctgcccgcgcgtccaagcaaaccacgcaccgtcgtgcgtgcgcgcgcgcacatcgcgtacacacgaaagctgtgttctcttctctcgagagctagcgatcgagagtagtacgagtacgtcaatactagtagactgtatcgtgtgcagggagcgaaaaagtcttcgctgctactaggggttggcgccgaatctgtgaggttatcgcagtccatgactagacaaatgtacgggcagtcagaacagtggcccacaataatggagctctgcttgcaaacatatgaaaacccgcattttttttcccttcacggaggatgttaaaatcactctatttgctgcaattttacagtagagaagatcgtggccaagtggtcggagtagaacaactacgctgaaagtagtgctccgtaatactccgtaggagctattgctcgatggatctgctcgattgccaaacagaaaaagacaccacaagccacccgtgtgcatctacatgacatgatgattaagtttcgttgcttaattacgcagactagctaggcctttcggatatcgatcgactgattggactggcagcgccaaaagtccactctttaatcattaagagccggattaaactgcaaaacctggccgggtgtgtagcacttagagcacccgcaatgataaagtaaggtgctctctataaaacatgtacatctcagcaatagactcgattaatagtaaaccaccttaatagtatgtccacattggtatctatagctctctcatacattgcctcgtttttctctatagactatctctaagttaatagatagctttgctctctctcttcatttaataccttctaagtaggaaaatatgctgacatggatctcttgtagagagcctatagataaccattgtgggtactcttacaagtcgggcaagtatataatcttactaatataccagatctaatccaatccactagttaaagcaaaggtggttactttccttactttttgtttggttggatcaatcagctcgctacatatcgattaatatatcggcggtctccactcactacaatatacaactgcatttgccacccgtagctagctagctataggtctatataaattctcccagcttgcctataaatgtttgtttagcagctggttaatggaccaaattgcatgtgcttagacaagtaaacatgtatttgacttagtatttaacgactaatagcgggtcgatatgattcctcatttgaattaattttaaggtacacataggagagaggattataagggtctatctgacaacgtttcaattcctaaaattaacttcaaggattgggtttgaagtgtagttatagagcagcctaaccccgctccgatccaattcttcatttcatttcatttcattttgtgagggtacttccgcccgctcgaccccctttttgggtgtaactaaaattgttcggttggactttaactaaaaaaaaggtggagttaaagctctgttaaatataccctaagtttgtgctagtttgcagtttcggcctgggtgagcataattgctagaaactgaatatttcaggccgtaaattcgatcatcacttctaagtaaccaagtttaatagaagtaattcgcccataagccttggttgaccgaaacagaattaattaaaattattatttacaagcctgttaagtagcattgcttctttctcaataatataagttgcacatattttcatattcaacccttaaaatatttaaccaacaattattctaatgtaaattaaattttattaacaaaaagtagttggattgatatttaaatgtactttcccgtcactacactggccaaggtcacctgtgacgggctcaaatcctcatctttgacggcttcgcgcatggtcagtgatcagtggtcactggtgagtccaatcacctttgacgggtggccggccgtcacaggtgacacccacctttgacgggcaagttactagaaggctgtcagaggtgttggtctccactagcctagggcgagttaggacccgtcacaggtgacttatctctgacggccctttaaataaaggccgtcagaggttgtggtctccgtagttagaagctgtcacagatgatctacctgtgacggccccaaaagtaaaggcccgtcacaggtaggtcacctctgacgggccttacttgctagtccgttacaggttagattacctttgacggatttttgttccgacccgtcaccgatgagttaattctaacaaaaaaaataaatgctaaatattagctagcctcaggatttgctagccatgccctctgaaacacagatacatcacagatatattccagtcacagatccatcacagatacatcaccccccaatataacatcacagatccatctcaaacatcacagatccccaacaacacatatatgcagttcaaatgccacaattttgcacagcaaattcacaccccttgaaagccacaatttcggtcgttgctcatagaaccgcatatatacttaccaaatggattaaagccataatgtcatcgacctccacaacttgtcaataaggaaaaaaaaaggagaaaatagatgaatagtacaacgtaaatcgtagttgatcaaatgtgatgacaatttagtaaactaccataaatattgcacatatgaaagtaaattacattgcactccataaaaacataattttttacatcgcaaggaattataaaaacatcttttttacatcacaataaattagctagccaagttcatgagtctatttgacatgaaaacgtcctttcttgttcattatttctgcaagaatgaaggcgcacacttcgcctctgatagcggggggggggggggggggttgatgggtgagatcttgaagccagctctacctttctgtttaataaataagaggttaattagcatgttttgaatagcaatgtaggtattgaaatgagctttttctctattagcaacaacctcagggtcgaaatctttcacctctcttagaagtgttgacatgttgtggcacacgtggaaaccacattggtctccgatctgttgtgcgcatgcaaacttggtgtcatgataaagttcgtccttgccctccctgtgtctaccacccttttctacatatgggccacaagccatatttaaggccttggtgatttcactgaaatcataatctttggacttattggagttaaggtaggtaaccctactccacttaggtacgatgactaggagaatccaatgttgcctgcgcagtggttatgtagcgttagtactaagaaccttaacttcaaaaatagtatacacgaagggtattggcctcttactcttggttgtgtgcgcacatgatgtactccttgtcttgatgggcccataaacaccggttgacatagtcaaccatctcagtgaagctctgttgtaaattaacctcgttcaccatggatggatcaaggaatccaacctgattaccaaggcgacgactctcgatccaacacaaccttaaaacatttacgtattagaactaatttaattaggagatatagtccaatcatatcacaagtatagaaggtatgcacttacaaggtgtagcattttagaagaccagtgtccaacttccggatcctgaaaaggtcgaagaggtcatcaaagcccatagttatataggcaggcgacaataggaacggctggtggtcgtgatgtccaactatggatgactccctcattttccgcttggcattgcttagctctatgtattgcttatgtagctctcggcaagcaatacccatcacggctaacacattgtcctctaccaatggcatgcctagctcaaattgggctggcgccctcacgaccttccccgctttgctcaccggcatcgacgtcgcagccttgcccctttttggctccggcgccaactccccgaccttccccttgccgcgttcacgcttcttgtctttgacaagtggtggggagctatcggcctttcttgtggtctttattggagccaagctttgagttatatctgccaagtccatatcagctccaccaggagaatgaggtactgataatgccggtccacaaggagcctcaattgatagcttagacttgggaggtgtaagctccgtcggttgacttggacgaggagtcatcttcacaactatgtcttctttgggccattgtatgaacgtcttgcgtgcatcgcccaaagtcatgatttcatcattggggggcacgggcagtggatagcctgaccaggtgtcctttactgtatcgatggacaccttggcatacctagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattgaaacgtgtaaaggtttttttattagatatggatcggataacaacaattacctcgatgtggtccactgcagctagtggtgcgatcgggagaccaggggccggcacctctgtggatgcacaactactcctatgctgtgacggactcgggtcgtgttgtgcacgaggagttggatgcataacaggtgttgtgactcggggtatattcatgtcggcgaggaccttattaaccctttcttccacccttgcattcatgctagcttctagttcttgaatgacctcaaccttaagttcggccttcaaacgagcgtccctctcttgcttggagactttccgtttcctgtattgggagctgtactgagggagtccatgcttccagggcacatcgctaccaattccccgagtccgaccaggatattctttggttccgagcgcctttgtgaggatgtcatcttcgcgcctcttcggcgcggactcaacctcgctttgtgaagcttgttcagcaaccaagcccaactagaaaagaaaatagtcgtttatacgaacttgtactttatacgaacggaaattagttaggttaagtagtgaactcaccagttcctgatagacgacggcatcacttttgttctcaaatgtgacagagccatccgggttgaccttaccccttgcccgcgcccagttgcgagctctttgttcagggatgtgtgaaaacggggcagggacattcgctgctgcagcggctgcatcttcatgggcccatattgcctccttgccgatgtaccctgcggtgcccagccgatgcgggtgctcattccgctgttgcagtaggcgatgtgcctcgcttgattctctaaactcttgggtgttcttgagagagcagaattcctcccacaccgcttcggttatttgagggtattcatcgaacggcgtatgattgccgggcgggttgacaaactcggtgaagagcttagacttccaattcttccaagctttgcccatcttttggaatgccttccgcttgagcctatcctttgcttcagccggaaatgtgaaccatttctccattgctgtccaagctcgctctttctcggcttctgtgaccttcccgatatctttatggaggatcccgaagttctcacgtgccgctagcccgcagcagttagaccatcttccaatgacagtcctaggcgccgtgggcctaccactagcgtcaatctctcttataacttgcactgtggtcggccatatattttgtgaccggggatttctgctagacctacttgcacttgtcgcgcccgacatcaacgtatgttgttcctgcggcaattctgcagcacaaacagaaggcaatatttgctaaggggtgctagctaaaatttatgtggtcatgtggtgaaaatttatcctataaattaccatgaatttcgggttgttcgaccgccgttgtcgaaggatgaccttcggcaactgtccccgtggctgggtttgcttcttcctggatcctcgcaggtgttggggtgggcgggtttgcgccgggcgttgccatggtctaatttttgcgaaaaagcttataaatttcctaccattatactaaatagcattagatccaatgtaatacggggtatactatgaaagatatggcctcagttttgctcagaaatatgcatcaattacaatcatttgcatgaagggataaaaagaggaaatcataacatcaaaagagcaagtgcagaaaatttgttcttatgcataaaaaaagaacaagtgtagatactctgttcttatccataaagaacaagtgtagaggtatataaccactgaatcaatcatgcaaatttaaaaaacagcagcagcaagggtacagatagaatgttattgacataaaacagcagcagcaggagtatatataccacaggggtagcaacagcagggggaaattcacataaacagcagggtgaacaagtagccacagtaagaccaatagcacggcaaagatagtccacaggggcagcaacaacaggggcaaattaactaaaacagcatgtctagatagtctcctcttatcaatccagaagaaaagagcaagtgcagaaaatctgttcttatgcataaaaaaagaacaagtgtagatactctgttcttatccataaagaacaagtgtagaggtatataaccatgcaaatttaaaaaacagcccacaataagggtacagataaactgttcttattgagcaattcatcacttattgagccacagcaggggcaaaaagaagaatagataaaaaaatgacagagtgtagataatttgtccttattgagcaattcatcactggccatttaacaaggaatacattgggcagcagaagcaggggcaaagataatccacagggacagcaacagcataaaacaaggaacaggtgtattaacaagtagcccacaataacagcagtagcaggggtgtagataaaaaaggagacagtactactaacttcatgtaaacagcaattcatccattcaattcaagcaagtgtagataataaaacagcccacaatcatttatgtggcagcagcagcaagggtatatatatcatgtatataaacaacaattcatgcaattgacctattcatagacaaaaagggtatataaatcaacaagtttagctacattaaactagctaagattcatgctaagatccactgcagcaaaattcatgtaagatcctctattgatgctaagattcactgcaccaaaaaaggaggaatgggggagggtggcggcgtacttggagaagcggcatacttggagacggcggtgcaggccgtagtcgtccaaggcggcggcggagaggcagcggcgaagaggtcgatgtggtcggcggtggtcggggatcccggcgtcgtggatcccggcgtccgggaggtcggggtcggggaggtcggggaagtcgatggacggacggcggagaggacgaccggcggtgagggcggcggtggagagggcggtggagagggcggagatggcggcagagagacggcggcggtcgagagagtggcggcgaggaggcggtggagaggtcgaggcggcggtggagagggcggcggcgaggagggcggtggagaggtcgagcggcggtggaaaggtcggcggtgaggaggacggtggagaggtcgaggcggcggtggagaggaggacggcggatctggatcgagagagagagaggcgaggcggcggtcgagtgagtgagtgagagtgggtgccggatctggatcgatctagaagatgtccaaccctaggtcaaccctagtcaaactcacctgtgacgggcccaacactatgggccgtcacaggtgaggtcacctgtgacggccccacagatagagcccgtcacaggtgagtttgcctacagtaattttattttattttatttcacttagttcttttattttccttaacatatttccacatacactatatatttttgttatacttaattattttatttcactaacagtagtaattgcacttcattattatactaattttattattttatttccaatggttatacttgcttaattattttatttcacttctagtgggtgcttcacttaattattttatttgactatttcataagcaatatactattgatcattgcgaacatattagagtcatacagataacagacatgtacacaaaaactacgtacatatattacaaaaataatccttcctcatggtcgacacgtgcatattgaacttcatcttcttcttcctcctcttctagaggtatttcttgacctatgccgtggacgtgctggttgtaatcatcctcgtctgcaatattttccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacctatcgacaacgaaacaatgggactttgaacttcaagtaatctagctccaatatttgctcaactctaccatagtattgatcacgacgaccaccgtcactagcagtctcgatgcgtaacccactgttctgcactgtgcatttgctgtcttgctttaccgtgtgaaaggtgtatccatttatgtcatatccttaccaggtggtggcactccattcaggaccctgtgacaaccacttaagtgtttcactagacaagttctgcaacctggcaattcggttcttcagccactcgttgaaagaagacatgtgcttgtttctgacccaactctctgatcggcctaggttctcccgtcggagaactgcaaggtgttcgtcaacgtacggcaccacctcagtcatatgctgcaatactgtgaaatgagctttatcgtacaccttccgatccaacctaatagtctttcttccaacagtaccaacaccatcaagcctcccttcgtgatgagatcgtggtaatccaattgaagatgtttctgacatgtagtccacacaaaaatcgatgacctcttcggtggtgtaactctcgatgatactccctcggggtgtgaacggttccgtacataacccttaaggatccccaggtacctttcgcaaggatacatttgcgtcatgaatgctggaccacagcactttgtttgcctcacaaggtgcaccggaagatgttccattatgtcaaagaaagttggaggaaagtacatctcaagatgacataaggttctcacaagttctgcctgtagttcatctagtccctcgggatcaatgatcttctggccaattgcatggaagaaggaacacaaccgctggatcgtgtgtcgcaccttaggaggcaaaatattccttattgcaacgggcaacagctgtgtgataagaacgtggcaatcatgcgacttcattcctaccaacttaagatcttgcagtgaaatgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgagcgaacacccatatcttccagatcttgtcgggcgttgagaccatcctttgtagtacctgggttaagcagtaatcccattaaactctcgcatacattcttctcgacatgcatcaaatctatgcagtggtgaacttcaagatccttccagtatggtagtctccaaaatattgacttctttttcaacatgctcctctcttttgtcttttgtttttccaca

SEQ ID NO: 68531 - DNA, 4184 bp, Oryza sativa
caagctagttggtatagtggttttacccaagaggctgtttggcgccgaaaatgttttttttttgtctttgttgtgttcagggtgaaggattgattcatgctacaagaaggaatttgtctcaaggtggagtttgttgagttgtgatccaaattcatttgcacttaataaaggccagcttctgtcgtagtggagcggaggctgaagctgacccattgggttgtgtacctggggacgcccgggggtgtaccttttagggttccactatacacacaccttttgtaagccgtcgtgcggcgttgtaacctcatcccgatatagtgaagatattttactggctggcaccagtggtattttctctcctgctttgagagggttttccacattaaatctcgtgtcttctgtgattgatctattgttttttatcgtttgtttgcctattatttcttaacagtaatacactgctagagtaataaaagtcttgtctaggtgcatctttctgccaatcctaaccgagattagtcagatttttgtgatctgaaaatggtcacacatccaagtcaagctttcgcagaaataactactgtttcaatataactacttgctctgttctttttttacatgagcggtccgcggaccacaggagtttcgaggtcagttcttcttttcgattctatagaacaacagtacaaaactactaatggtgctaaactctacatttaaccacctgttaattcagataccaataatcttctctatcatatttccctttcttccacatgtttctacgtaatactaacatcacactattatccatcgtctaaggagaccatcttcacatatcttctagctcctttctgtccaagagttcatatcagagattgtttgacttatcagcggaataagcaaaacggtatatttacaaataaaaagcaatttgtgaataaaacttttatgtatttgttcttagcgatgtaaaaacaaaggctgaaaaataaacttcgataaaaaaaaccttaaaatttacttcaaatttaaggttaaaaatttaaattttgactgataaatataagcataagcgaaaagataaatccattactctagagtttaaatatggacatacatgcagattcaaacctaaaagtgagttttttttatacggagggaatggttcgcagttgagggtgtgtaaatggtatatgcatgatgtcaaagctaatatgcactcttaaaaactcaggtaaaattcatcacgagaaatataaggtaatatcaacctgagaagtgaatttgttaataaaaaagccaaaaacgaagtattagactcaaatatatatatatacacgtgtaatatatcaatctttttcatttctttttcctaatcacatcacatgacttgaacaccaaagaattaacccccgtgtccggccggccatggaggaagactgcaagtgcattgaccgggcaaaggtggcccagccacacgccatcattaccaacggttaccatgcaggggcagtttggtcattcgccgcgcacgccgcgccttctccggactccggagcacacaagaaaaaagaatctacccttcagaataaaatcgttttcgggatcggcagccgcgctctagttatcgttatcttttccttcgttaaactattaaaacatgtacaatagtagattattagctggttataaatatattttaatataataaaagataagagagaagagcagcggactatagatttatagccagctgtaacacagacttcaagacacaatatgtgtatgacagatatgaccatatactaatagtatagtaagcaaatattgtataaattgactattaaattggctatagatgaattaaagctagtaattgcctacactattaaacttgctcttaacccgacgaatctgccctactgccgtactagctaattgcaatcggatttacgttaatccaactttcggctaaacctaattaaaaccgcatgcgcggatagagttaggcgacgctgatgctgctaatctcagaactggaaaaaaggttaaagtggttatgtcttatgtgtgacgtcgctgtctggagttcttgtgaaccttttctttgtgaatccctgctgtccagatgtgagagaatcaaacgatcaccagcttatcgaatcgcccgtatagaatcggtatacatctctcctttttagcggtagctatgcgtgtaataaaaaaaaagatctcccagaaatggacctattgggaacgaaaacaaaatgttacagtagttcagtgtaattggctaaagtaatactccatctgtcccgggttataggacatacttgttatttaactagatagtttttaactaataataccttttaagactaatctatacatgtagtcaccatatttaaaagataaaaacttttaaaataattcataataaaaaattctaaagtttgacctcacccttatctaaaacgacaagtagtatcagctcgaagggagtagtacggtttagcgtttattgtggctaagttaatcgataggattaggggtggatagcgaaccggctcggctcggctcgatctagctcgttaggataacgagctggctcggcttgactcattatcctaatgagctagaaacccagctcggctcggctcgtttgaaagctcgagctagctcgttaggctcgcgagccaaaccaacaagatagcaagggtgacagtggtctcgagcctgtgacgccttcttgcagctggcgctggttggggaagtgcggcggcggccctagcggctggcggcaccgagccacggcacatcggggaagtgcggcggcagtgacggcaatggccctagcggctggcgacgccgagccactgcacgtggctggggaagtgcggcggcgacggcggcggccctagcgactggcggcggcgcactgcggatgcggaacaacggaagggcatggtgaaggggatcgaggattggacgattcgctagagacagagagaaatgcggtgcgcctagggttttgttgttcagctgttgttttgggctgggcccttgctgttgtctattgcagtcctgactcgttaagactcgctcgtgagtcatctcgagctggctcgttatctctaacgagataaaatgctagcttggctcgttaggaaatcaaacgagccgagccgagctcgtcacgaggcgagcgagctaatgagccacgagcttactgtccaccatccactcctagataggataaatatgtgacgcataaaaaggcaaagaaaaggaaaaaagagaagcagatcgggtggtatcacctgatcgcttggttgcttcctcttggtccggatgagtatataatcaccaccaactcaccaaggccgcccagcgggacacttaactacttgttatctctgtttctcaatgacgtatgggtccagatgataaattattactaattgttatattaactctgttttttaatagatgacaccgttaacattttgccacacgtttgaccatttgtcttattgaaaaaactacgtaattataatttattttgttgtgagttgttttatcactcaaattactttaagcatgatttactcaatcagtcccagaatataaggatttttaaggtttaactagggtattaagaaagtatataaaaataaatgggagaatgttgtgataggttgagaagaaaatgttggtgaataagttttatattttgggataaaccttatgagctagaagttgttatattttaggatggagggagtatattttatacatttacataaaatttttaaataagatgaataaccaaacatatgtttagaagggtacgacagtcatttattaaaaaaagacaagtaaagggataaatagttaaagagtgaagtgcatgggcggtcattaaatttatagggatgtgtcatctaaatccctaaactcttaaaatacatatacaaatcctagaacttgtcatagtgtgttatctaggtcccaaatcaccacagtcctttcagaatcctacgtggtgctgatgtggcatgccacacggacatttaaaaaatttccttttcttttttcccctccttttcttctccttcttctccaagcagaagaaaggaagaaaaaaaaaaggacacgccacgttcacgtggcatgccaca

SEQ ID NO: 68532 - DNA, 8580 bp, Oryza sativa
ctcccagaatgctccgcatagaagagtgatgccctctccgcatccagctgaaccactgcctctttgacgatatcaaatccagactccaagatgacctccttgattctctccgtgtaattaccagatagaccgtccggtttgatcatcgccagcgtcctctccctctcgatagctacgcagctccagcatctgcccaaaatcaaacgccaaaacaacattgtacatcaaaatgtcacatgagaagaccttaacattgtacagccacttcttcagctgaatgcaccaccaaaaaacaaagcatccctgaacaaagacgtttcatttcatctcaatcacgcttagttaaaattacccatgtttacaaactacagtcgctgtatgtatccaagggatcctaattaagcgagagagcgatccagagtgggttgatgatgtgagcaggggggattaggacgaaatcttgctcagatctgtcgaagcaggcgtcaataacacaccaaatctagcatttctacggccaacgcatgctaagacgctataaacccaagacacctaggcaccgaggttcagtacggtacagtacagcacagcagctataaaccaagagcggtgagagcttggggcttacccgtggaggaagaggaagaggaggggcagcaagcagacggagagacagggcgccgccggcgaggtggcgccgcccatctccggcgaggcggaagcgccggagagaggagggagggagcttagcggtgggtctcccgtgttccttgtgctgatgcacgagtgttaattcgcttttggttttatcgcggttatcacggagcaggtttcacttaccgcggtacctgggaaatttggacaaaattggcattctattttcatcgaaactttgccaaaaataccacttcgtatttataacattaacatttaggagttaatttcactttgggccatgttttatggttaaaggttcactttagactactttttatctaatcttttcactttggatcggattaggtaactttatctttattgtacaataaaccaccccaaaccacattttcaattcttcgatgactttgatgaagttgttaacgacgtgccagcaaacttttgtacctatatgcatgccatacatttgtcaaaagaaacgctagacatcactagcgaaaagaattagggtggtccattatacaacaaaggtaaagttacctagtccaaagtgaaaggattgtgtacagggtggtccaaagtgaaactttggtaataaaatatggcacaaagtgcaattcactcatttagagttaattagaatgccactctcaactacggacttcgtccaaatgccactatcttctatttttgaaaaataaataggaattgtttttgtccctttgcttctatttttgcttgtattggtgccgttcatcgtcgacgcgctcacggctgagggctccaaggtcccctaccgttgcgtgctcctaacgggagcctccattgatattgttgtcgcagcaatgtactggatggagtcgctacgcgtacctcacgaagtgtgtgctcgccgtcacctaggccgtcgcggcatctgtggtcatgcggtcatgccacacgtgtcttccctttcccgtcactggctgctacccccgtccgtcgccagatgccctagagagaagagaaaattggacaactgacattgttggatatagcagtgaaacaatgacaagccgcccaacaacgatgacgatgcctctgtctggcggcgagcgcgcgcgaagaggaaggaggtgaggaggttgatagcgagcacgcggagaaagggagatgtggtgcgggagcaagccagggctccgagtccagctccatggtgccgggcctcgcctccacctccgcggctaccgccacggctcctagcccccacctctgcctctgcctccgagcccaacgctgtggcgcccacttcgccggcggcggcgacacagcgctcgccctcaccttctgtcgcatcgcagccgctgccgcttcatcgcccgccgcctcctcctctcctgcctcgccgactggcttgccagagaagagaagagaagagagagagaggaggatgaagggagtggagggggaagagtgagggtgctgatgtggcatgctaacatgtgggttctacactgactcagcagccacgtagaatgaaattagggtcaaaaccattgaaggatctagagtaaacggtttttataagttgagggatgtcatatatctggtttgtggctgagggacgattctgtgactcggtgacaagtagagggaccttgggtgtactttttccccaaaaaaatatcaccggtccatccctgcaaaaaaaaactcggcgcacccacgcaagcgggccggagattaacgggcctcccggacaggcccctcccccattaattccgtccggcccaacacagcccgccgtctccgttgcagtcccgtcccctcgccgccggacgcgacggcggccaccacagcatttttgatttccggattcctccccttctccgttccgtccatccatccatcccggaaatatccccaaaccctcgcctccccctcccccccgccgccgccggcgcggccgccagatctgcggccatggacgacgacggcggcgcgtccccgtcgtcctcgctctccccgtcccgctccccgtccccactccccgttgccgaccccgtcaccgtcgccgcggcgcccccgggccacctcgccctcgccatccccatccccaagcccggctcctcctctggaggtgggggagggggagggggaagggaggacgcctggagcgacggcgccacctccacgctgatcgacgcctggggggagcggttcgtcgcgctggggcgcggcagcctccgccacccgcagtggcaggaggtcgccgaggtcgtctcctcccgcgacggctactccaagcagcccaagtccgacgtccagtgcaagaaccgcatcgacacgctcaagaagaagtacaaggtcgagaaggccaagccggactcctcctggccctacttccaccgcctcgacaccctcctcgcccccgtgcacaagcccgcgggcgcctaccccgccgccgccgccgccggggccgcgggcgcgggcaattccggctccaactccgccgccgccgctaccgccgcccggagcaccgcgcccatggcgccgcgcgtcaacttcccgcagcgcacgcgcacgcagttcctcccctcttccggggtgaagcggaggatgccgtcgcctccccaggtatcagcgtcgtcggagtcgtccgacgggttcccgccggagccacctatggcggccgcgaatggcaagaggcggcgcgaggtggaggaggaggtgaacggtgcggacagcggccaccgcacgcagggcctgcgcgagctggcgcaggcgatccgccggttcggcgaggtgtatgagcgcgtggagttggcgaagcgggagcaggagctccggatggagcgcgaccgcctagaggccgcccgcgagctggaggaccagcgcgtccagttctttctcaagatgcagatggagctctccaaggccaacaatgctggcgcctctgctgccgctgccgcagtgggtgccgttgccaccgccattgctgctgccgatggcaatggcacgaggagaaccgctatggccactgatgtcggtaccagcagcaatcaccatgttcggtaccgcttccaggacagcaggcactgccatgctgccccgcagcagccacaacaccagtacaacgagaacaatgccgccgaagccgccagaggtaccgggaatggtagcgataccgacaacaaagaagacgaggatgaggcagaggacgaggaggacgagagccagtaatggcacccggtttacatcttgaaagattcaagaattcgatttgtatgattgtatcagttaattggcattgccctggtggttagaattacctcccatttaggctgttctgggagcaacaaatgacatctgagtactagttagcgtcggtattagcaacaaggggtagcatagttatatggttatgtgcctgtgcctgtgggtgttgtgtaacttgtagctgcttgttcatgcttgtgatgctgtggtctgagctatgatgcaactgccatgtcctggcgaatactgcatcgattgtaacctgattgttatgtgacaaaatgttagccttattctgtgtctgttcttggaaatcaggagcattgtcctgaaccttgatagtgtggagacgtgccccatcagtgttcgatttttcgcttgctgagtaattcagagtagcttctgttatgacttatggttcctgaattgtaccttgccgttaacttggcatggtgaattggtggaattttgttacgacttatatgaatcccgaattgtaccttactgttaacttgtcatggtggaatttgagctggttatgttgcctgtgctctcttcacagggtaagctttctgcagaaatgtgcaagattccttcagacttcgagcagctgagcctgacagaacaattgtgggcacccaagtatgctttacaggcgtcatggaatggatgtagtgtaaagcatgtaacacttgagatgcttatgctgggataaaccagtagatccagatgctaatctaatcctcgcgcacttgatgcagatcgtgctggtgacctggttacgacaacagacgagatcagaagggcaagtgatgcttttgttgtcgccatggcgaatggcgagcctgtggtaggagcagcatatgcgatctagcagcagactcagaaaggtgtatgcaaccgtttgtgctatgaacgaagagagagagagagagaatgcagatttgcagtcaaatggtagtttagattaatgcaagtaacagccaaagttggtatcattgtatgcaagtttgattgaaaaagcaaataacagagaataccacatcacctttctttgtccattctattccgatatatgaaaaagagtgacctaaacataataaggaatatgagcatcatttaagtataactagcatgatggcccgcgcagattgcgcggctagcatcattatattttctctcatataatagcatatatattttctcattatattattaaaatatattacaatgacaacataattttaaattttacaataactttacaaaactactaatgtgtaatattcatattgtattttatatacgtgttagttattaattatttttaatatcaaattttagttatttgtaaattatatatatttctatatggactctagacttgtcttttaatatttctttttttaattctgattttttattatttctaattgtatttctatgtggactctaaactcatctttcaatattctttaatttttaatttcaaatttcagttacttctaaattgtattcctatattgactttaaactcttcttcccatgtttttttaatttcaaattttagttatttgtaaattgtatttttatacggactctaaacactaccttttattttattatgtttattctgaattttacttagttttaaattcctatatggactctatactctacttctaatatttcttattttttaattacgaatttttattttcttttcttaattgtatttctatatggactctatactctacttctaatattccttattttttaattccgaatttcaactatttctaaattgtatttatatatggactctagtctcctcttctaatattccttatttttaaattctgaatttcagctatttctaaattgtatttatatatggactctagtctcctcttctaatattccttatttttaaattctgaatttcagctatttctaaattgtatttctatatagactctagtctcctcttctaatattccttattttttaatttcgaatttcagctatttctaaattgtatttctatatggactctgttttttctttttctccgattaatgtgagaatttctcggccatgagagcgaacgtagatgctcctttttctattcctattaatgatataatagatagatttgacctagcttgcatgcatgtatttctaataaccttttatattggcatagtacaaaaacattatgagtgtaactttaataatgacgtagtaccaaaacattatgaatgtgtgcatcatgtaagtgtaaaaaacagctagtaaatatgattaaaagtcggaatgaaagtggggaaaaaaatggagacgcggggaatcgaaccccgtgcctctcgcatgcgaagcgagcgctctaccatatgagctacgtccccatcgattgaaatcatctatgagaaactataaagtgcttcatccgtttcgtattatgttagtttgatcaaattcataaaaaaaattagcaatataaaaataccaaattagttttatcaaatctaacattgcatatattttgataatatgtttgttttgtgttgaaaatcctaatatatacttcctctattttttaatagatgacgtcgttgactttttctttcatgcttgaccattcgtcttattcaaaaattttatacaaatgtataagatataaatcacatttaaagtactatgaatgataaaacaactcataaaataaattataattacgtaaattttttgaataagacgaatagtcaaacatgtgagaaaaagtcaacggtgtcatttataaaaaacggaggtagcatattttttataaatttgatcaaatctaaagaagttggactgagaaaaggtccaacgacttacaatatgaaatagagggagttcatatgccatttgatccggaggggtatgatcctagtaatggtactgatcctggtaattgttgagttgtgatccaaattcatttgcacttaataaaggccagcttctgccatagtggagcagaggcccgtcgccggtaggcttgggcgagagcacgtggatgatcaggaaactgaaattgttgataatgatgttcatgatacagttcaacactcacctcctgttttgcagccacaagatgaacctattgcacatcacataacaaagaggagtcgtggagctcctgtccgtcttattgaggaatatgatatggtttattatgcttttagttgtgccgaacaagtggagaatactcttgagccggctacatacactgaagctggtgtttctggtgatcgtgagaagtggatctcagctatgcaggaggagatgcagtctcttgagaagaatggcacatgggagcttgtgcacttgccaaaatagaagaagcatgtccgttgtaaatggatcttcaaaagaaatgagggtttatctctaagcgagcatccaaggtttaaggcaaggttagtagcaaaaggtttcagccaaattgctggtgttgattataatgatgtgttctctccagttgtaaagcatagttcaattcgcacatttttcagtattgttgctatgcatgatcttgagctagagccgttagatgttaagataatatttttacatggagagcttgaagaggagatatacatggaccagtcagaagggttcatagtacctggtaaggaggattatgtttgcaagttgaaaggatccttatatggtttgaaacagtctcctcgtcaatggtataaaaagtttgattcatttatattgtcacatggctttaagaggtctgaatttgatagctgtgtgtatatattaaatttgttaatggatcacctatatacttgctgttatatgttgatgatatgctgattgttgccaagagctaggaagaaatcactacattgaagaaacagttgagcagtgagtttgatatgaaggatcttggtgctgctaagaaaattctaggaatggaaattactagagacaaaaattcaggtttgttatttcttagtcaacaaagttacattaaaaaggtttttcagcattttaacatgcatgatgcaaagcctgttagtactcctattgcaccttattttaaattatcagctttgcaatgtgctagtactgatgaggatgtagaatacatatctagagttctatattctagtgttgttggttctttgatgtatgccatggtttgctcccgtcggatttatctcatgctatgagtttggttagtagatacatggctaatcctggtaaagaagactggaaagctgttcagtggattttcaggtacctcagaggcacagctgatgcttgcttgaagtttgacaggactaataaggggcttgttggatatgtggattcagattttgctgctgatttggataagagaaggtcactcacaggttatgtgtttactattggtagttgtgctgtaagttggaaggcaacattgcagcatattgttgcccagtctaccactgaaataaaatacatggctattgctgaagcatataaagaatccatttagctgaaaggattgtttactgagctttgtggagttgattcttgcattaacttgttttgtaacagttaaagtgccatatacctcactaaagatcatatgtttcatga

SEQ ID NO: 68533 - DNA, 2147 bp, Oryza sativa
  unsure (1)..(2147): unsure at all n locations
caaatgtgccatacctcatcttattgatcttttgtttggctctccaggcctgggcgtagcttatggtgtacttgaatttgttctcgatgtgcctaataattgattttggttcaaagccaatgttaccaacaacactgctgtacatattacttgccacaaaagctgaagtgatgtttcggtgatacttctccaccccttgtaagtagcacttgtgctcggtcacaatgctaactttccaataatcattccatttacccttatatgcatggacacgccacggacaatctttcttcatgcacctcacttcatacacataatttgttgacttgaccaccctaaactttctctgcaaggaaactgcccaatgcttcaccgcctccttcatctaatccttatgagcataccttgcaccctcaaatacctcgttctcgttatactcccaagggtacatgatcaccctctgatataacaagtcaagaaaagtcctcatttgcccaatcagtggccattacatcaccttcctcatcggatgatgcgtcgtcgtccgcttcctcattatccaatccttccctctccatttcatcaacaattataccgactctctccccctcatccgccatgcccatagcctgcttctcccttggttgattttcctcattttgcatcgatggtccaacaacatcccctgcattgataggaccctctacattttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctgaacaaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctgaattcatactattatattctatgctatggatctacacatatgtgctgtgtgctacagatgtgctaaaatatatggaactaaaactaagacgcaacatatatactcaaacataacatattagtacaaatgcaaaagatgtatgggagcatacctgtgatgaattgagcgaaccagcagggcttcgccgctccccttctgctgccctcccctctctctctctttcgttttttttggatttttagtgaatataatgaaatttcacagaggagggactgggctttataagggggaggcaaaaatcgccctcccccagggcggtaagggggcccnctccaaaaccccatgcnccctcgccacccatttgcaggccgtccccccgcacttcaacatgcgcaatacccgacggaccccacagcattctttctcttgaattcgctcgacagtcactcctatgcttaacagccagtcaatagctagacctttttttacacctcacctcggacctgcggggaatatcggcccctatttatccgggccggcctcagccctatcccctattagcacatacaacaatttacgcgctgcttccttatctttcgccaaactagacagacatatagctgcatagaacctatttccctatcttgcacgttccacactccccaaatatctcttggccacggatcgggttagattccttcttccccaaacacgtgtacactaacgggtttctggggctcctccgtatcgtacgttcacccccctcacctactccctaggaaggttcccacccccgtggtgttcccccgctcgtccccccctcccgttgggggaaaaaatctctattatacaacccccctcttgtcgtctaacaccacccccatctgtccacataattctctttgtacaccatcg

SEQ ID NO: 68534 - DNA, 958 bp, Oryza sativa
tgtcagtcactgagtcacactcacagtgccactgatccgccatgagctgggtcaagctgagctgcaggaggagtgcagataagagaatccgccttgctttcctcgccgcgcgcattctcgtcgtttcccaaggaagcttcctttcttttcttcttctccggtcagtcgcaatgtggcgggctctcgcggcggcggcggcggcggtggcggtggcggtggtcgtggcggcgcggccggcggcggcgactgacccctacgcgttcttcgactgggacgtcggctacgtcaccgcggcgccgctcggcgtcaagcagcaggcaaaactcgcctcaattattctcctcggtgttcttggctagctcttcgttctcgttgcaagtaaatgtgtaatgtgcactgactatggtttggttggtcgccggcaggtgataggcatcaacggcaagttcccgggaccaaccgtgaacatcagcaccaactggaacgtcgtcgtcaacgtgctcaacgacctcgacgagcccctcctcatcacctggtacgtacgtttatataatcccgtcttgcagcaagtgaataatgtgtctgtatatggacgaacgtatgcaggaatgggatccagcaccggaagaactgctggcaggacggggtgctgggcacaaactgccccatcccgtcgggctggaactggacgtacgagttccaggtgaaggaccagatcggcagcttcttctacttcccttccaccggcctccagcgcgccgccggcggctacggcggcgtcgtcgtcaacaaccgagacgtcatcgccgtccccttcggccgccccgacggcgacatcaccatcttcatcggcgactggtacaacaagaaccacacggtaatcaaatcaacacgaaatcaaccgcaatatgaaacattttggacaggtttttgattttgagaaggtgaaattttggat

SEQ ID NO: 68535 - DNA, 42559 bp, Oryza sativa
aaactatccgctccgttttcatccctagtggcgatgatgtgctggttgcactgttaacaaatgatgattttggcatcgttttcgctttgaacgctggcaggcggcggaggaagaccggctacaccagattcaaatgaaactaaaaaaaattgtataaataatataccagtcgacagtgaaacattcgtattgacatcgtcaatttaaagatatgccggtcaaatagtttggatgtgttcctaacggtagggcgtgcttgtgtctttatatgggtgagtgtacgcggttatcaacgtttgcgttcatattatgttttttttaagaaaaggaaaatgaataaactatactatattagtaatagtgttcgaatcagggtgaaccgttccagagccaaaaaatggaatatcaactattgtctcggagttaatgaaaattgtttcaaaacaatagaccctcgacaatattcgaacatcttttaattaaaaaaccagtttattttttaaaaaaattaatcgaaaaatcaaactgtcggtttgtgttccggtttttggcaaaccgagctgttcctgacggtaggcggtgcgtagtacgtatcgatcagcgctagcgcttgcgtttgcgtttgggtcggtcgctatcggagattggcggagcgtagctacctgaccgaccggatcagcagcagcagcacagcaaacacaagcacggtcgtagttgagccattcacgtcaaccccgcccaccaccaaccgccacgccaacgtccctttcctttccatcacgcaggcccaaacacatttcggcccaacaactcctcctccctggcccaaacagaatgggccgcacgcaatacagatccttgctaccgaactcacatgggccagccgcacgtaagtcgggccaaccaaaatgaaccgcatgcaggccaaaatccatggaataagtttacttttggtccctagttgaggtcatgtttaagttgcacatatccttcaaacacaataccaggtatcctcgacgccaactcttttggatcccattcaactcgtcccattcaactcttttgtataccgtcctacaatctcgggtataccggtattgcagttgagagacacgttatacaaattcaaactcgacgtaagatgaggtatctgaagtaaacttattgcaaatccctaccctcgaaagtattcatcccgttcttgggccgcaccaaaatgctggaaaccggcacgtttcctggcggcgcggcgcaggcggtggccgacggcgatcgcccgccgccgcgtggtttcggcggtgcccgaatcggcagatcgagctggagaaacgccgctccgtggccggcggtggagggcggctgcgatctatcaacgatcggtcaagcatttcaaggtgccaattcctccgcagattccccaattttcctttctcttctctcgccatatcgagtacacttccaccatcacagaataagttaatctagtgctggatatgatatattctagtactagatgtgatatattctatagaataagttaatctagtactagatgtgatgtgatatattctaagtgctgcgaatctaaacaggatgaaggtagtacatgctaagatgctagtgttgcccatttgctccaccaaattatttcatctatatcaactgggagaattttttttcctcatcaatacaacttcatctaccaaccgattcccagctgatgattgtccaaactcctgatgctgaagatgccaactggatcatccctaccagttccaccaagccaacaaatcaaagcaaagcgtcataccaagatgacaacatgcagcagcatcaccagcagatgcaaacggaaacaaaacagaacacaagaggccatgatcagaattttcaatttccaggaagaggcaagccaagccttgcaaaaggattaggtatccatccccatcctcaaccacattccagttcacaaatgtatacccttctctttatgtacatcaccacacaaaggagagaggagagctactagtacaatactgggagtataccaggtaaccaacaagaaggaaaaaaaaaataatagccaccctatcttaccccatttccccaactcttataccatccttctcccaaatacagattctttttcccttttacccccaccacacccaaattaatttacaccgttaaaatcccccttataccacacaaactatacccccgtcccgtcctcccgccacaaaaccaagaattcaactgacactactactttcaccaaattcacatctaggctttagcaaaacccatccttattggcgttgccaaacactagaaattgcagttacctaggctgcgggcgcgctggaaacgacttcacatgcctcatctgtggaggggttgaggagcggctcattgtctgcgagcgcagcagcatgtcgaccatggatgaagtctggtaggcctggattaggctctcgctgtctgtggagtcacctcgcgcagttgctctctgccatgagtgtgagctcaagccggagaggacataggcgcggcctgatgcttcgtacctttggcgattggccatcctttcttgcatctccttcagctcagcatccaatgcttggcacaaccgatcaccggattgtcctgatgttgaccccatgatcatcctccggcagtcttcgagtaaggaaacagcatgtgtcaggtcaccacgctcggcagacaaccttgcttcagccatgacttcagctgcatgaagacggttcttttgtcggtccacctcgattgacacgctttgtactgagacgaatgctggtctagagatcttgacttgcacatcagccatattgatagtctccttcatcagtggatctttgtagacacagccaactttgagaagtgctgtttcaccgtaacctgggggaacatttactgacataaggaaatccctctcctcttcggcatacatgtcaccaacatctatggagccattcctcttgtcatctgcaagtctgctagaatagcttcctgatctgatcgagccaaagtgtacatcagggtggaggctctccacctttacatgcaaatcctgtgcaacaacactcaagagtccaccaatacactgggcaaatgcatcttggatggcagcctctgtctctatgaatgaaaaggtgcccccggaggtttgtgagattgaatgcagcgagactgaatcatggtcagcaccaaatccaaagacatgaactggtacctgttgacaaccattactagtatatggcaggagtgagcagtactctggtgctgctttgtgtacaccagcggttggtgagactgtatatgtatcttgcccatctgatagtaggatgatgctgcacactggattcttggcctgtcgatcttcaatcactttggagcctttcctcaggccctcagcaatattggtcccaccatttgatgtcagtgaataaacagcttgcaagctttgctgacgaccagtctcagtcatccgacggagggggaagagtctacgtgcagatgatgagaaggcaattacagaaagccgatctgaggagccaaggttctgaatgacaaatcccatggctcttttcagcaatgcaagtttggtaccagccatgctcccactgacatcaagcactgtgatgagatcaacaggggctcgagttgtgcccaagctattgccatcttcaagtttgctgcttgtttgcaaagtctgagcaaggggtgcctttagatgaactaggactgtaaaatttctttctgaagtactttctggaacttcagtgaactcaggatatgtctttatttccactgttcttaaacacccctgctgcgagccttcatttgcttcagacagtgagtccaagggttcatcatcgttaaaaatactacggtcagtgtcaggcaacaacgatgtcatatgatgcagccgaccagaagaacgagcacggggaagtggtcgcagtatggtcatctgcccgccattttggtgcccattaactggattaatccttgcacttccttgaggaaattcaccaggcaagggacctcgaaatgggagttccttccacttggtgcggcaaactgggcaattgttgcttccatgcttaacatttgcagctatacaatggaagtgaaaggtatgtgagcactctgctgtgaatagagcatggccctgaccaggcttcattgtggtcaaacatatcgcacatgttttctggaagaaaaaagaaggtacagtgagattataaaatgaacagtggtcaaacatgaaacttgaagtggttagcatgcatgcttccatggtatacaatacatgcttatcagtgatgctgcaaagaaagcaaacgagcatctagagacagcaagattaaagggataattcatgaagatgatgctgtgataatctctaatcaggtactaaatactagcatacttagtttatttatatttattgaagcggtcattctataatatataatagagatattacgaataattaacaacacaaagcagcaacatcaagaatgccaaagaactaaagcataggcagaaacgtgtaggcatgtagttggacctttacacacttgtcgtcttctatttttcataaatattttttcacaatgatgaaaaagtccagagttttttttttatccccaaagagatattcatcccaaaccttggtcagacgccgtagtttcagactcttttttcagaacaaacttgctaagagaattgcaatacaatttgtctcggagaaaaaacatcaatcattagtcatgtggcaagttgcagtccatggtcaagctaattttacaaatggaagaaacaatctttagcattatcgagtgaggtaggtggcttaatccgaattagtcattgctgactaactaacacacctcaccctctataacagaagattaaatggttgaccagtgaccacccacagacatttgaaaaacacgactctaatagcgtgtccctgttcagtttcagtacactggtttggtataattagctaggctgctgcaattttaacatttgcaaactggcatcttctgaatataggttcattttgcaattttaacatttgcaaactggcaccttctgaatataggtttccttttgcaattctgggctcttaaagcgagacgggtggtgggctctgcagttttaagttggaacagcaagagaacgcagaagggatctgagaacagtgtggaacagtgtccactccaagctgttctgaaaagaggatgctatggctatggcactgacctcttctttatgcctcctccacgaaaaggagtgaagtgagaggaggctagaggaaagggcagagaaaagtgagtgatgaagaaaagaggtgtggactatggaggaggagagtagtagtatagtcagtagtgagagtggagctgcaagagagtagaggaggaccccatcgttaaagaaagacaaactcccccacttcatgattatattcctcctccaccattgccctctgcccatcttctcctgcatctccttttctcctcttgagctcctcttttttatcttctctctgtgtttgtgtgtgtgtgtgtgtgtgcgtgtgatgaaatcatgaaagcaaagctacttgcacagttgcatgcatcatgtgtggcaaaaaagaacatccatcacaggtgtacaacctgaatcagaacttgctacaataattactggaactgaaatcaaccgagcaggcataaatcgagagaaaaaaaaggaattaatttgtgacttttgtgtgcatatggatggatcttggctgtaattttgcttgcaaagttgcaagcttcttttctctttttttttatgcttcatacatagagatgtgaaggatgtgaaggagggactgtaccttgaaggatttgctgccggatttggagaggcgaagtccggcggaggtcggcgtcggggtggtcggcatgagcgcgccggcgcccttgaccctctgctccgccgtgggcgtggtgttggcgctggtcgccgccgacgacgaggacgccaccggcgacaccagcgccgccgtggacgacccggtggacggcgagtcgccgtcgtccagcgtcctgggcacgtagacgcagaggttgagccccagcgacatcttggccttcctccatctgctctccatcctcactctctctctcaactactgctactacctctaccacccctctccgatctgagctgagcttgagcttaagctacttgtaggtaggtgggtcgctggcaaccgccgccatggatgggaggaagcagcagagcacagagctagtaggagcttagtagattgggaaatcaagaaagagacgatgtaaagaaagaaatgaagagagaaaagaaagaggagtgtgtatcgatggctatttgacctcaactcccaagctccaccaaccaaccaagcaagctgaagagtgatgatgatgagtgacaagagagagagaagaagaacaagaagaggtgaggagagagagagagagagagagagagagagagagagagggagttgtgagtgagggagcagccttttaagaaagagaaaagcagcgagcgagcaaagcacagggcgcctatggcgagggggaaaaaagaaagaagaagggcttggaaagaaggagatgatggcgagcagtgaagaagtaagtggagacctcagctcagctcggctcaaagcccaacctgccaagctgtggcctgtggcctgtgggtggtggcgctgtacactggccactggcacagtatgtgtaagggaaaaaacacacaaaaaaactgtaattaagccaaaaaaaaagagaaagaagagtttcttgtgatttttcttgctcgattttttatttctttatttcttttttttttgtgagagaggctctactacttctttccgacaagcggagctagatctctggcttgctttgtctgcctatctgctgctgtctgcctcctctgcctctcaacttattttcgggtgtgttccgttttgtttccttctttttattctcccgatgattaaaggggaaaaaaagaggagtgtgtcaatttcttttgtttttttttgcctttcctgtttaattgctggtgcttttttttctcgtcactgatttcctcgtgtcgccgttgatgggcacaagcatttactgatataattggcgagttgctgtagtgtattcttaccactagttcattccaatgtcatttgttgggtatactagttacttacttccttggtctaaacaaacgaatataaaactgaatatgacatatcttagtataatgaatctgaacagacatatgtccgaatttattatattaggatgtgtcacattcattactaaattggttttttatgggacggatgaagtacaaatgatgcttttaatttatctaaaaaatcataaaggaaaaaaacctgtggtttaagtttgtattgcccttgcaggtgttaaacgaatgtttgatacatccagtccagggaagcagaatgacacctttatagagctgaaccttaaaacatgtcccaaaatagtatcccaagtccggaagtcccaaaccaggagcaaaaaagcaagggccagagagagagaagagatgaaggggagaaaaaaaaagaataagtgagcaaatagtcatagaaaagcaggctgtgactttatataaaggagggaatgagagcaaatgcatggagtatcagtagtaggagtaatctattgtggtgtgggcggtcacttttgcttgccctgctgtgatgtctgtgagtctgtccttgagcactgatgaggtcaactgcaactttgctggtactactcgtaaaagaatagtctactccatatttgagagcttaagatgctaattacaatttgcatgcattaaccagaagaaagcatgtgccattggtgttgtcatgaaaatgaggagcaacagtactggtgatttggattgtacaggcgaaacagtaacagcaaggctaatagtatagcccgctgtgggctaatagtccagggctaaagccaactactagtacaatagattgtctattgactgactgtatctcataatcaaacaattaattatgacatgcacatatcaatatatatgatcaagagtgaattgtattattgtagctatttgtgttgtgagataaactttgttcaccaaacaccaggatcatagcacagatcatactaaccaatttctctggagtactaaaagtacaaagcacgtgtttgttggcaagaagagctcgtgaggaaggagtggatttcctgtgctgattttcgtcaaacgatgtggcatcagagtttttcacggcacagttttcgctcacgatcgcgtggatggaagacgaagcacgcagaaggtgatgagatcgcgcacgaacggcggagatggatttgcacaccgctgggggaaggggatcgtgcgccgcggggtagccagttctcacgggatcgtctgaggacgtgcaggccccacaaacagcgtttttagcgccagggtcggctgcacacgaccgatactgcgtggagaaaaatgctaacgccggacgacaatttagtcgtccgcttcgttctctctcatctacataggaaattgatgatgtggtactattttgtagcccgcttagtcagctgttgtacctgcctgtaatggtatagtacatctccatgtactgtagagactggagagtacgtataggctgcaaagacgcagtaattaaatctgcttgcaatacgtaggggggtaggaccagagcagtgcattgcatgtctgcatctgcagctggcagcgtggaaacggacaaggccggaatatttagtttgttgccaaattttgggaactatataagaaatcctgccaaaattttgataagttgtcaaaattttaacaactatattaaaattttagtattaacaaaatttagtaaggtttttttcgcatgaaagtaaacgtaccctatgtatctcgacgcagcagcccagccgtgttgtgtttatgttaatcgtgttgtcaattcgacccctgatcaagccatggacccccgcccgctgcgtccgtgccgcatcgcaccgcacggtttacgatggataccgcaactgtagcggcgttgcgttgtcagagcggttacaaataatgaacggtaggagattcaacaggattaatttttcctgagctgaaggagagaagggaagagagatagaatgggcgggtgactaattagagcaagtttaatagtgtagtctattactagcttcaaatcatatatagctaatataatagtcaatttatataatagttgcttactatgctattaatacctggtcccacctgttatacacatattacattttggagtctgtgctgcagctggctacagatctgtagcccgctgctcttatctctcttcatttatctttttaaaatatatttatagctagcttatagcctgctattgtacctgctcttagccgtccagctatatgctcgacccgaggttgtggggcccgcagtaactagcgatggcagtgaataaccgaataagagctatcatcctcgcgcgtacgtcccatcgccctcactcgtagccaccgtcatcgcccacagctgtcctgtcgtcgtcgcccacctccgccacagccgacgtactcgtcctccgcggcatctagcgtcgcacgcatccctcctgccgtcctcgtccttcgcggatgtcgtcgtcatccacttccatccccccgtcctcgcccacatccgctcgtgttcgtcgtccttgtcctctgtgactaccgccatagcttgtgtccactagattgtgttgttgcccttcgcctacatcctctatggacgccgtcaccaccttcacatgcgtcttccgtggacgctgccgttgtcgcccggtgtccgctgcaacggtcgccatctcactcgccctcacccacgtctatgttgccccgtcctcactggcaagaaacgagaagaacgagaactccgagaaagaaagagaactctgaaaagagggaaaagatggtgggtccataaaacaataaaatatttatgatatagtaagtctatataatatatcttaactataatgctttaattcagatgatgtgtacacccattgcagccgatagtgggctttgttattgaccttgctctgagagagcaaaacaggcaggggcagcgcagcgcggtgacaatgtagtgcatgcagcgggcgtcctgtggatttttgcacatggtgggtggtgatggcctgggagtagggtttaacttatcgattttaaagtaaaaaactgttcctcaccggttggctaaaaaccggtaacttttaatcaatgtcatgaaaaaaaaacctattaatatagaccggttttcacaaaccaagagctaacggtttcacgaaagccgactaattctgtgcgaccgtacatcataaaaattggatataaacttatagctaatttattatacatgttaactcttaagttgacttagaacaactactccccccgttccataatataagggattctggagagatgcaacatattattatgtctagattcgttgtactgtgatatgttctgaaatcctttagttttacaattaaatttgctctaatatttaagggcaagagcatttaaatcccggtgggccaacactccatgcgatgttttcgggtgctttcacgacaccgtctatatattaacgcatgttagagcgtggaatctgccacagataattgaaaaaagcgccgtcgatcgtttcattggatctgaattagcgcacgcccccatctaccatatcatatcccaccgcattctttgaccttggcactgaacgaacgaatggaaggatggatgaaaccattaaagaagaagagaaaacgttgctttacgagcactgtactctatatatatgcgtgttgtgccgattaatctgttgcgccggtgcagcatgatcgatcacccaccggcacggcacagcatggcagccggcaaatctgatgattcctggatgtgcacgcaccaaaccagctaaaaaacaaacgcatacgtacgccacagatcgatgccgcggccgggtgtcggcagtgagcgagtgagtgaccagtagactagtgggtggcaatggcatgcatgtgacctgacctgagctgaatcaatcaaagtgagctcatactagtaccagctcataaactttgggtctgtttgcaaaacttctgacacgcagaactttttctcagaattataagcttcctccgacaatttaggtttttttcagattttaaaaaattgtaatggtgaaatttaaaaaatgaactgaaagtcagaaactaagaaatccagtgattcttataagctggctatcaaccagctgcttattagaatctaaaactcccccaacaaacactttgacaacggaggcggctggttatgtttattatggtgaaatctatttacatgagtgcaagctctatatttgatttgagtgtttgtgtgtatggttaactacttttatagtgatatggtaagcacccatcgataataacacatctattatgatttcgttcatcgataataaaatgcctatgataactttacaatttagacattatctcaggccttgtttttagttcctaattttttccaaaaacatcagatcgaatctttggacatatgcatagaacattaaatatagataaaatgaaaaactaattgcacagtttgcacgaaaatcgcgagacgaatctgttgagcctagttagtctataattagccataagtgctaagtaacttacatgtgctaatgacaaattaattaggcttaataaattcatctcgtggttttcaggtaagttataaaattagtttttttatttgtgttaaaaacctctttcaatatccagtcaaatgttcgatatgaaactaaaatattttttttcaggaactaaataaggaactaaataaggcctaaagttttgagaggtgccatgaggagggaggaggaaccccacacccacacatgtcaatccatgcaacagtggcgagattgtttgggcctggtttggtttgttgctcggtggctccactgcccaagctgagatgctgcctgtgcctcctgcctcttgcctgcctgacccatccattccatgcgcttttctttgaccctcgccatcaatccatgatgcctgcgcccacccactccatcaccctgcacatgtccaccatccatccatgcacctcactcactcatcgtcaacatgttcttccatcattttgtgcactaatcacctgcactttcagtactaccagtggttagtattttacatataatgcattggcaataatatgcaagaacaacaacttcttcagagatggagtagacaagaagcagcagatgctgcagtgcagtgtcctagatatgtcatgctggattgagccaagaggcgaataatctgggagagacgggtcaaagtgttgtagcatccatatgtagactgttcaaccagccacatgcagaggaggctggttggcttgagctgaatctggctcactttcttttactactgcttttgcctttggagtttggaacctgctgcaaaaactactacactcactggtctcgactggctctattcgaaaaagattggtctacggctctctcatgacttttgcttgatgatcagattttgctgtgcttaaactaagcagattctctgtgcttccgaagaccaaagtggtagcgactagcaacgaacgcagaagtgtaatgtaatgtaatgaaatgagaaaatgagcatgtgaaagtcttgttttgtttttgtccctaccacggcgatggagatcgcaatcgcaacggcaaattggcgaaatgtcccttaaaaggcgcaaggttttcttctgacggtggattggatgatccgtctctttcacagcgccaatcgagctgcccatttccagcacttgaccctaatttaagcaggcccagtgcggcaatagcaacagcaagaaatccatggatagattaattttaactcatcttaatcgtcacgtcatgtattctacgaaatcgttacaaaacagtcactgacatgtgagcctcgttagctgatacgactcgtccgaacccatatgtcagtgactgttcgcaacgatctctcttcgttgtcgattttaatttgcacccggtgtccctttcatcgttcagatataggatgttcttcttgttttttcatgtgcctatgtgcactagattagtgcaagagaacaaaagaggagtccagatggtggcatcctattcaacgattggccaccatgctaagcaagcaatagaggggttgggttggggtcgctattgaatcccgtgaaaggaggcggctctcgcttttgtgcgcttcttcttcttcttattcctccgtcgctcttttctcttttggagtctacgggttgcggtcagcgacggaaaccctgcacgccaccatctccaatttggcatcacgtactctctacaatactagtagtaattttactgctattaaatttgtatggtgaaatttcggtatagatcaatcagaaaaaaatttgttgtggaaacatgtttacatgtggcatctcataatttgcatggttttgaatatcggactgtaactatttgagaaggattttagctacgtgcttttatgtataaattagccgttatagctcaatttaaccgttacagttatttaaaaaggttaaccgttaaatgtctgaacccgctatttaaaaccatgataatttgccatcttgatctacatcatttagtgacttggagctacctcacttgttagtaagagagggaattataccttgtgtattgctaaaagttccgtttacatcagataaacatatgattttatcggaaaaaactaaacatctggctgtgtgtaatttgtactttctgtgacgttgtttggtccatccgttttagaaggttttctctcatccttggagagagaggtacattatatccccactacttgagaggtagaaaatttaaattggttaaattaattagaataaaaatatacagtcaataatattaatgtaaagaggtgtatatatattaccttatagtactatataggagttatctctttaagtaacaagaatgtatatacctccccaaatatagtagagaaaaatatgaaagctacttttatattccagcgacattatcctttttattatttagtactccctctgtttcaaaatgtttgacatcgttgatttttttagtacatgtttgactattcgtcttattcaaaaaatttaagtaattatttattcttttcatatcatttgatttattgttaaatatactttcatgtacatatgtagttttacatatttcaccaacttttttgaataagacgaacggtcaaatatatgctaaaaagttaacggtgtcaaacattttgaatcggaggaagtagtaactataaaaaaaacggggatattaaatacggagtataatgtacaggggaatgcaatcgttgtctgtctcaactctcaactctcaaccaagtaaaattggaatggttgtacagtgctagtcctcaagatgctcttaattcttgcctcccacatgcgccactagctagtgattgacttggatgtttttacctgatgcgcacgctacgaatatgcttaggtttattgcattattaggagggttaacagtaagttcaaagctcagactgtcgcccatttatcaaagagaataacactgctttattgctgggagtcactctctagaaaagaaaacggattaaaaattacctttcaaattcaggctccttttttactgaaaaaaaaacttctttcaaatcaccttgtcttttatgtttatcctaagtcaaaatatgcatatctttgactattaatcatttgaaatccatgtagtttaacaacatataaattatatacttaacaaaatacgaaagtatttctaatgatgaataaaaatataaatgttcaaatattaaaactataccattttataaaaattgatgatccaaaattaaaatgtttgaactagcacaaacctagaacgacagctaatttgaaacagagaaagaatgatgagtctgtctcaaccagggttcactttctcgtcggtaaccgcgcggtaaccgcggttaccgggcttaccgtggggggtcggtaacaaaaaccggcggtagggtttgggcaaattttgctcaaattcaaaaatttgaaaaataatccaaaaaaatcaaaaaaaatcatggatgtaaagcttgttttgtatgttgttatggtgaaaaaatttcatcaaaaagatgcaggtaaattcaaatttgagcgcaaaacctattgtgaattataaaaaagaaaaaagattaaatggaatgggccaagtatgcactgttcacgaggcccaataaggcccacaatgggaggaaaatatctttggaagcctctgcttcgtttctctggcgaatcctactgtttttcccctctctcgcgtagctgcgctcaggacccgaaggggcgacggcgtgcgcccgcgccagatccgccgcctccgcgccggcgaggccggttcccgcgcggtaagcggcggtaaccacgcggtacgcgacggtaaccgcctgggtcgacgggcaagaggtaatccctccgttttgaaggttttcgcgcggttaggagcggtaaccgtgcggttttgtatggttaccgtcggcttcgtaatctatgagacgatatacgtatgtgcggtaatcgtgtgaaaaccgtggtaaccgtccaccctaccgtggttaccgtggcttgaaccgtggtatggtattttttactgtgatatgcatggacatatttggggatttaggtcaatagaacatatttttaccaatatgcatgtgaaatacattgggaatatgagtttatttcggcatttggttgcccgtgcttggctaaaaccatgcatgtgaagtatatttgattgctttggtctatgtacatataggttaaattaaatacgtcatagtatggaagaatttggatgcatgcttaccagtgtacatataattacgtcgtattattgcataatgggaggtatgtttataattagcagtgataatttctcatgcatttgatacagggtggagatgttagatagtagggaccctgtgtgggagcacggggagaatatcccacctggatggcgctgtaagtattgccatacaaagaggggcggtggtggggcaacaagactaaagcaacacttggctgcaagagggaatggggttacatattgcaattcagtgcctccgaatgtccgtgagttcttctgccgtgagttggacaggataaaagatgcaggtgaccagcgtaagagtgatagcggaagaagggttgaagcagcaagggtcaactattatgacctaacaggtgatgccgacgaggaggaacaaatggaagcagccattgcagcctcacgacaagacgaaaactttaggagggatgttgaggagcgtggtggcacttatgagcatggcggtgggagtggatccgctcagccggaggcacggaaaggtagaagtaacccaattaccaatatgctacgaagggctacgtctcatagggagtcacctgctgtgagagattacaacctagcatctgccaaggcccctgtgcagccacgcattgacacaggattcttcacaaagaaggggaagcaagctaggcaagccattggtgagtcatgggcaaggttcttctttaccgccggcattcctggtagaaacgccgataatccatactttgtgagcgccgttcgggagacacaaaagtggggtacgtatgcatctattaaggaacttctttttttctaactcattgcgcactacttatttcatacgtcaattgtaggtgaaagtgtaccttctccaactggtaacgagatagatggaaaatatcttgattctacagagaaggatgtgaagaagcaatttgataggttcaagaaggattgggatgagtacggtgttactataatgtgtgattcttggacaggtccgacgagtatgtcggtcatcaattttctgatatactgcaatggaataatgtttttccacaagtccattgatgcgaccgggcaaagccaggatgctaactttgtgctgaaggtatgtatggttcatgcaacaaattacttcatcacctgttatcgtcagtgttaggggcatggactaatttttattatgttatctaccaatgcaggagataaggaaggtggtacgcgaaataggctcggagcatgttgttcaaattatcactgacaatggctctaactacaagaaggcgtgcagactactacggcaagaatacaagacaattgtgtggcaaccttgtgtggcacacacagttaacttgatgcttaaggaggttgggaaaatgccagaccacgaaatggtgattgagagtgctaggaaaatttgcagatggctatacaatcataacaagttgcatgctatgatggtcttagctataggtggtgaactggttaagtggaatgctacaaggttcggaacaaactacatgtttctccagagtttccttaggaagcgagatcttttcatgcaatggatggcttcctctgtcttcatgcaaagcaaatttagtgggactttggaaggtagatatgcacatgcatgtctatctagtctgtcttggtgggagaacttagaggcagtagtgagttctgtccaacctatgtactcattccttcggtttgctgacgaggacaagaaccccaatttgggtgaggtacttttgagatatcagttgctcaaaatggagtacgacagtctttttgcgaatcaaagggacaagtttgaagcatacatggagatcgtgaacagaaggatgcacgacctaaccaatgagactctcatcaatgccggtaaatattggtcataacataattcacatggcatattatgtaactcttacttaacctgtgccatgttttgtagctgccgcattgaaccctaggacgcactacgcgtattctccaagtgctactgtcttccaagacctccgacaggcattcgagtggatgacggatatcgatacggctgccgccgctttgttgaaggttgagatgtaccgacgtaagacgggtgaatttgggagggcactagcaagaaggatggccatagatgggaaaacttcacctggtatgtttctaatcatggaactatgatatatctaattgatcttgatgtattcagaattatgaaatgacatgttacttggcttttgcagcacaatggtggtctatgttcgcctcagacacgccgaatttgaagaagcttgcgttgcgtttggttggtcaatgttgctcctccagtggatgtgaaaggaattggagcacattcgcattcgtacatacgaaggtccgtaatagacttacccacaagaagctcaacaagctagtgtacgtgaactacaaccttcgccttcgaattcagcaagcaaatgcccaaattagggtggaggacgatgatccccttcaaagattagcggacctctcattctatgaaactaacaatcatatcagtgcctggatggactagtgttgatagcgatgaagagacccaaggaagcccagagtaccaagagtccaatgatagtagctcaagaactgaaacagatgacggcgacgacgatggtcaaggaggccaaggcactactaatgtgccctcctaggggtcacacccaacaatcagatcaccacagccccgttcaattcactggtgtgatataattcagttgcaatttcaaccttcatcttccaattcagtactggataattttcttgcaattttttgatttgcaggtgagggcgacttcactcatgctactcaggaccaggatcatggtgctccaagctctcaacgaactaccattgcaccgggagtccgacaacagcaacaattcagtgacatacaacaggatagctctagctcattcagtgcctctaactttgaaagtggctatccaacgtatgtgtacaaccatccccaagcttctgattatcctgttactacatgggtgtatgaatggcaagagcctcagtggtatgctcaattgtacgctcagtggcaaacaacatcatcatggacaggtcaaagttgggaggaatacaaggcggggttgctacattcacatggcttgatgctcatgtccacagaggagtacaatatggcatataatcaatggaatgcgtagctatgcatgtccttgtttatttcctttcattcgaactagaattgtaatcgtggacattatactgtggactctattgttattgtggactatattgttattctggactgtattgttattctggacctacatgtggatatcgttatgctttgaaatgtgagattgatgattgttattgttgttataatgttatgaattattgtattgatttgaactccacaatatagagtaggtcatgccgaatttttctgttgtataaccacatcttaattaactaaaatactcacattttagtttttttctattatttttttcatttttcttatttcagttccaacatatcgcggttaccgtcctcttatcgcggttaccgtaccaaaccgtgcggttaccgtgtctataccgtggattttgaattcaaaaatttggaaacgaaatttgtgcggtttttcgcggtaaccgcacggttaccgcggtaaccaccataccgcggggggtcggtaaccccccaaaacggtaaggtgaaccctggtctcaaccagatatatttatcaaagaattcagactagtatttatcaaagaaaacaatccaggtttattatttggagtcactatctagaaatgaagactggtacataagtttaggctgcgtattttgactggattaaattgaattagcttgttgtctcaaaccgatgcatgtattcatcaaagaatccacactagtatttattaaagaaaacaatcatggtttattacttggagtcactctctagaaatgaagactagcacttcatccatcccaaaatataaacatttaaaatattattttaaatagtgtcaagtcaaatatttttaattttaactattaatagaaaaaaataaaaaaattaatcatttaaaattgatgttactagatttatcattacaaattatcataatatgcaattttttatttaaaacatcttatttttatagatattgttagtcaaagtagcccctcgaagactgtgtcgaagtctaaaaatgcttatattttagaacagggagagtacttgtgttttgtttgactgaattaaattgaattagctagttaattgtctcacccgatgaatttgctccatctgtcaatgagttaattatctctttctacatcttctctctcaccgatagtcatatcctatgttggttttttcttctcaaggtgtggtctccatcctcttatctgcacactgtgtgcaggttttagcagtgtagctatcgctgtgtgtcgattccatctcgagctacagttgaagccataactttttttgatgcttgcatttactaagacgaattattgatcgatatggcgattaataacctggttaaacttcgttccagctagctcaatcctgaccacgacagggtgcctctcgatcaggcaagttcagctagctgccgactgatgtcgttttgataggattacaagtcgatcgcttgactcgttcagatcgacctgacgaccacacagtaattcgactagtcatgtggtcgtgtagtatttagggcggttggttttggctgattagctatacgcaaatagatttatttgattttctcaaaatcatgttctatacagaaagttttcatacgaatgtaccctttagcactttaaaaagtatattaacggtaaacgagaagtaaccaagatcaattaactctctacactattcacttgatcgtcgaaacggattatttgctatatgattcaaaacatacatttcttaaagaaaaaactttatgcctacctattaagtttgttttaaaatatttaatttatccctataatcactcaataatccgtttcaaactgagcctaagctcagctgagatcgaaagcagcaaggagaatcaccgccaagaacgccattgccatcagaagagcacgagattttagccctttctgagatggaatatatatatacaccaccggctctcgtggtaggggctcacccagtagtcgtcttcctcgatcttggacgatcgtagcgatccgtagagtagcttgtacgcaaacatattcggtctggaatttgtcatttgtacaagacaagcatgtgattatgaactccttgtatgcatgtgtgttgtattgtattgtctttaagaagaaaaaaaaatacatgtgccattctgatccataatcacttgcagcagaatacaatgctggtccattctgaaatattcagatatctgacgaacaactcactctttgccagaagaagaggttattgatgaagattgcgatcttctctagcacattctgatttactactaaagattgcaatctttttttacatagcagaccgtgatagattgatagtagtccgatactcagtggcggatctagaaaaaaatagtagtgggggctgaataaactacatcagcataaatcgaaccttcagtccccacatcctatggatctatggaaaaaaaaatttagtgggggcttaggggggtctccactgtcccggggtggtagtggggtctcgagacccctccgcccccattgtgaatccgccctgctgatacttactaattaatcctattactacctgcttaaaaatgggtagtgaaaagggaattgcagaaatgcagtgatccactggattggcgccggcaccagcgaagactaaagcttgaatgattgcaggcaagaacacacatcataaaaatggccagcaggttgccaaattgttgcatccgattcccaatttccaatggacgcatacatcacatcttcttttttctgtgcacttctttccttctgttcttgccttgatccatcctgggagagaataattctcatatgccaacaaatatcatgagagaatcctatggatgtccactgttcgattgtgccagtgctttatgtggtatctgactggcgtatgcttttcaggtggggtgttggtgatgttgcatttgcagttggagaatatatgtagtgtttttttttcatcataaagtgcatttctaacatacaaaatactataaacatataatctcctttcaaatatattagttcgaagccattgttctattagatgatagatacataaacctatgcctaatgatgatgtgcagctcatctccttgctttttgaagagttctgaatcatgtttaattcctttttaccagaagaatatagaattagtaccccactttatcagctaagtatgcttctctttttaacaagtgcatcctggacttcattaaaaaaaccagtcattgagtgagttaattggggccagaaccaaagataagatgccattacccgtgtgatgatgcagcatgtgcttgtcaggagaagagcttagccatgactcaactttgtagcgaccactaaataaaaattaggtattggtctggttagagactaatcagtgtgatgtgtaaagcaatatagtttgtcggacagtagcaaaatccctgacgttttctatttcaccaaacaactgtagaacggaagccaaagcagataaaaagttctgtttgatatactcagaatatatgccattagacatgggaacaatttcaaatatgcaactttgaccattatttttgaacatgaacatgcttgtaagaaatagataagtagtaaatcctccccgtttttaaattgccgtcactggtgactatcattgttttagctttgaccactaatttactcttaaaagataaaagtagtacgacagatacatgatttatgattatatttaagatgctttaattacaattcggtgacaaggtataattttttagcatttcagactttcttaaaataattttaaattcaaagtttgaaaattaataaatagtgcctaatgtcagttatttaaaaaataaaattttttaaactagttttcaagctaatttatgagcttatataatttttctgactgatctaattagttttcgagctagaacattgttgtcacaactcgcaaggtttgtaaaatttcacttcaaacagtttagaaaagttttccgagaattttacatgaaacatatagtttaggagcttggaaatcgtgaaatgaaaaatccaagataagaaaagaagagggctatagtactatattattattattattattggacagagaatgggtgaatggctagtcaaattatggatgaactgtcgtcgccttacagtaattacatgagctattggagttggggagcaaccacatactctgaatggagtcggcggtcaggacacaattagcagagtcagacagacagctaagagagaatatgagagataatgatgcattgatgctttgtccttttgcggtctggttactcaaagtgtgattaggtcgtgcattaacctctaagtggtgacataattaatggatggattatcaaaatgcaaaaactccaatcttatttttgacgactgcataaaagtaaaaaaagagatagaaccagtcagacaaaagtataactgagagatagtggcctggaaaactttggggaaatgagatggcgaggcccatatcatgtaagctcaaggtctggcctgccattcaggaggtaaggcctaatatagcccattgcatccatgccaatgcgagccgaggtcgtccttttttttgtttggggggggggggggggggggggcattcaggaagctttattaactcacagaaatagggttacaatcacgagctaagagctcggtaacaccctcaggcgcctggaagcgcaaacctacagactctttcgaacgtaacgcatagtgtatgagaccatgatcgagccactttattttcaaccctatctctccgacttaaaaaaattttcaatcctaactatatgtgtctaggttcgtagttacgagttgattttttatggaaagtagtactaattagagcagatcgaggaccatgaataacatgcagccctgctctagctttctgaattacgaagtatatgccagacctgagatttatcacacccagccgatcttagggctgcttctacgttagcacaatcggctccaaggatgaaaggccccttaactcactcatttaccaggcggatcccaccacggcaagccacctgcttctgcttcttcagccgatgcacagcctctgatcagcttccaagatgaaagcagtaactttccctcctgattgcgaaccacaatgcccacactcccttccttggtttgttgcacaaaagcaccatctacatttacctttacccatcctgggccacacatgacatgtcggagagaagggagagagagaggggggcaggaagaagaaagagatagaggatgacatgtgggtctcataattttttttagtgataaataggacccacatatatgtttttaactctaatgtcaccaaagtgccacatccgcagaccaagtcaacactgctacgtgaacaccacatcattgaacttgtcctccgaaaccatcgagggagtcaaattacaccggtattaatagttggagggtctagatatccggtcctgcggttcaaggatacgaatcagattccgtcactagttaagggactaacagtgaacttattcctttcctttttctgttagggccgtagtctaccagcctggtccggcccacctccaccctgggccgtgcctgggcttaggccacggcaacatagccgtcctacgttgaacccatgcaaactgacaaatctattctattttactttatttttttatttttcataaaaaaaaagatagccaaagctgaccatgagctccgccgcgccgccgatgcggaatcgcggatgcggtccacccgcagatctccgaccatcagcccaacccacggtttccccgccctccacaccccaacctcgtccgctccgtcgccgacgacgactgcctcctaccccatgtatataacccccgccactcctctcgatgttgaggtaaatcgagtgagtccgcaagtcgttcgcgattcttgatcgagatctgtcagggtgataaaggtaacggtctttcggctgtgtcttaggattagatccaactgtttctgtgcttggaacagttgcagagaaactgtagtttcttggatcagtttgtcgagtttgttttggtggatttagcatctcgttcttttgtttttttgtacaggtttagaacggtgctgagtttgttaatcttgggagaaaagggaaactgctctcgagtatggagatggtgttgccagtcgcgaacgcgactgctgcagcacttgcgcgggtttctgctatgttcaatgccccgcttgctcgtgctgttgtctttgggattcatatcgatggtaaatgatatttattttctccagcagctaagaaattctggagttgtatcgtgtttcatttaaattatgcgctatgcgctgattctgtgattttcagggcacttggtcgtcgaagggcttctcattgccgcaatactcttccagctctccaggaagagctacaagcctccaaagaagccactcactgagagggtgagctacactttgctcaataatttggaattagtagttttttctgttcctttccatttcttaatgcttcatcaattgtgttaatcaggtgttttttttttggctcaacaggaggttgatgagctctgtgatgagtggcaaccagagcctctctgcccacccatcaaggagggagctcggattgaggctcctacattagaaaggttcgtctcaattctcaagccccatcccctcccaacaaagtagacatttctaattagtccttcatgtcaccagtaaagtgttttatgtgcttcaccaaaggctctatgttgcaatgtacttctttctttcttttttttttaaaaaaaaaagattgcatgggttcagtttgtagccatttcatttagtaaggattagggaagtcggtatataagcattgttgtacacttatactatgatactatgacctagtgagcatggaatatgggtgttgatctccagagcttgttagttctagaattacaaccaaactatgatttagagttcacacaattatagctatggttccccactatctttgtaccaagaccgagaggattgaatactgatattctattgtttgatcagtgctgctggaccgcatacaattgttgatggaaaagaagttgtaaactttgcgtcagcaaactaccttggtttgattggcaatgaaaagatactcgtaagaacctcatgcttttgctaatattctttagtactcttttagaacatttgagtgatgtaaggaaattgcaggattcctgtattggttcggtggagaaatatggcgttggatcatgcggacctcgtggcttttatggaacgattggttcgtaatgttctgttacaacttatattcaatactttgtatcttgtggccaaaagcctaatgcaaattcaggggaggaacttagccattttgttgttttcagatgttcaccttgactgtgagactaaaattgcaaagttcctgggaacgcaagattcaatcttgtactcctatgggatatcaaccatcttcagtgtgattcctgccttttgtaagaaaggagatataattgtagcgtaagtgaacctttttcctcctgtttacaacaatttagtaacatattattcaacattttctaatgaattgagtcgtgccataccatctgatgtaaaatgaacatagatattttattgtagttctggaaattcgtagaattggtaatatggtatcatggacctcgctaatccttctgtgttattgacaaacctacttgaccttctagccatcatgcatttttgaaactcataatttcgaaatggtgaattctttttttttatgcgtgctttcagtccttatatatctcttttcattgttcatatttaaaattattagctagtttttgcatccagaaaaaaaataattcagtatggccacgttcttcataaaaataaatcttgatattcatatgcaatgcagtgatgagggtgttcattgggcagtacaaaatggtttgcagctttcaagaagcactgttgtttatttcaagcacaatgacatggcttcacttgcgagcactctggaaaaactaactcatggaaacaaacgtacagaaaagattaggcgctatattgttgtggaagctatttaccaggtttgtagcttactcatgaattcttttttgctgagaaatacattgactgaatttgtttctaaagtctgtctactgttctggatacagaattctggccaaattgcacccttggatgagatagttcgattgaaggagaaataccggtttcgtgttattttggaggagagtcattcttttggcgttcttggcaagtctggacgtggccttgctgaacattatggagttcctgtgagtgctccctctcatttcttttcatatatttccacaacagcgaatctgaaacaacaaataaagaactgggcaggcataatcagtggctcagtagacaaagtgcaatttgtattaagaaaatcttccttgttgactagcttagtttgctgcacaattgagttctactagttttctaagtattctttaccgattgcagattgaaaaaatagacattatcactgctggaatgggaaatgcattagctactgatggtggtttctgtacaggaagtatcagagtggttgatcatcaggtaggtgccacatcagatcgatagcatattgatgatggtatagaaatacctgcatcttcagtatttttaactggctgtactgttgtcatcttgcagcgtctaagcagctccggttatgttttctctgcctcgttaccaccatatcttgctagtgcagcaatttctgctgtggaccacctggaggagaacccatcggttcttgccaatctaagatcaaacatcactcttctgcataaaggtcactaattctcttggcacctttatttcttgcttccattaatttaccgaacatagtgcactggtaatatgttactaacctagtttataaaactgtgatgtacttactatgggctatagtcaaagtaccgaaaatacacaatgtttagcatccttacaagtattttgatgtacttgtgatatcaaaattttaggaaacgtctggcatatttcgctgtatatttgtccatccactcatcttttcatttgcatttgatgcgcagagttgtcagatgtacaggggcttgaaattgctagtaatatattgtcacctattgtcttcctcaaattgaagacatcaacaggttctgctgttgctgacctggagctccttgaggttatttcagagaaggtatttagtggtggattcaacaaattcgtgaaaagcacttgagatttgatttttggagttaagccaataatgtattttacgtaattgtaatttcacaggtattgaaggaagattcagtcttcattgcagcgacgaaacgatcgagtttggacaagtgtcgtcttccggttggaatccgcctattcgtatcagctggtcacactgaatctgatatcctcaaagtatctgaatccctgaaaagggttgcagcatcagtgctctagtgacaaactgacaaccttgcatctggcatgatgtgttctacagttacgtacaaatctgtatgctcgttgatctggctcaatttgctgtcgtgtctagcagaattacaaataaaattttgtaaaacagtttgaattaaaatatctggtagttttgttcttctatagtctctgtacatcggctgattcttcaacagtctgtcagttctggcattgttagcacattggtcaacaactcaacatatgcaattcattaattaatagaacaaggaaaaaaaagttcagcccagtaattcccgtgccatacaaagcccgtgaaatctctctgggagcggccatgcggatttgggccgatgcgtgtatgggattttcacacggagcatttcaattcccacaggaaaggtgaaattttcctccatttcgaagttcacacggagactcagatttgtctttttagtcatggctatttgcactgaacataacttactcctatctatcatgcggaaaacaatgatcaaatttaagaaccaagcagctttaaaaagccagagcccacatattagtagtaagaatgaagctagccgatttttttaaaatattcttttttttcttctcaattttacagaaaccgaggggaaaagaatatttcgaaaaaaccgaggggggtaataaataaatcaaagttgaactgttcaagccaacaagggcaaggcaggggggagtggggggactgtacctggacaccatgacgctgagcaagtgaggcaggtagtcaggttgtccgtcgtgtgtggttagcagatgttaaagttgacatttcgacaataatgttgtgcacgaaatgacgactgtgacaaagcattcctccatccaagtcgccatccaagggcagcagctgcatgggcctgggcgccgcgcccgccccaactcggtgctttaatctccttcctcctttctaggagtactccttcgtaaaaaaaaatctaaataagaatatgatatcttttaagacaataaatttgaatatgagataatatgaaattatccacgtagattcatcatcatccacatataaattaaaggatgtacattagtccggattttcatcctttaacaaatttagcagaatccctaattaatactcctagttatgctccctttcagcagcaatcaatcccaaatactactttctttagttagttgcaagagcagttgcaactttgcaagtgtaggtgatcatgaaacaaaagcagtttttttccaaaggcgtcacggggaagcaaatcttccgctgctttttctgcttgctgctctgctgctgcacggtgccgccagtcgtgcaggacggaggagggggggagagcggttgctttgcgagcagggtgcagaacgtgattggagccagaggctgcggttgggcttcgctttgctttcacccggttttaccggcagaaatgggcatcgatcaccggtacgacacgcgacgggatcctctgacgtactgccctctaactttgagaggatgacatgtgggacccacagctagcggacccacatgtcggccacccatgttagagggcagtacgttagaggagcagcttccgtaggacaccgggtgcggctacttgcgccaacagacggcccagaatccccaccacgccaccactcacagatctgccagccggtcaggcactcaggctgcttctgttcttcagttttaattcaacgcccaagattatgatactagtagtatctgaatctaaccactaccactaccaacagaacagccgcctcaatttttccaaatccatgagcaccactgcgccagtcaccattgaccatcacagcacatacattggatcatgggaagcatcgaaaaaaatgacaagtgaatcacactccagatggaaatatgcataggtgaactgcagcaattcacagaaattttctcatgtttttggattcaattttcatctgaacaagcctgctacgcactaagagagactaccctcttcttcagttcagccaaaaggtgatcaactgatcactgtatgtacatcggacaaactcgggtagaaagatatagctagctcccaaattccagccaattcaccagagctcgtcatggtcctaactcctactggacacaaacactaataatacgctactaccactgaaccctgccactaatccaagccaaaattcacagctagcagacgagtccttcgcctgaagaaaagctatctacacatggatggagttcatcatcatcctcgatcgaacgaactagcccatcaccgcggctcccccacggctcacgatccaaggatgccctgcaacacgaacaccgaacgatccaatcgttagcaaaaacacctcacattttctggggaatcatgaactgaaattacaaagtggagcaaaatttaaacgaaggaagagggttagtgcgtactcaggacttggtcggcggagaaccttctggagacgtccttgcagagcatgcggcgcatcaggtccttggcctccggcgagacggaggcgaacgcgcgcggcgggaagcggaggttgccgcggagcacgcactggaagacctccgcggcggtggcgccgtagaagggcagggtcccggagagcatcatgtagagcaccaccccggcgctccacacgtccaccttctcgccgtactccctcccggccaccacctccggcgccacgtagtagggcgtcccgaccagccccgtcatcggcctcccgtccccgaaccaccccgccgacccgaagtcgccgagcttgagcacgccgccgccgtcgaacaggaggttgtcgggcttcacgtcgcggtgcgctaccccgcggcggtggcaggacgcgagcgcggaggccagttgcgccacgaggtccgcggcctcgtgctccgggaggcggccgcgggaggagacgagggagaggaggtccccgcccgcgcagaggtcgaccacgaggtgcaccgcggcgtcgtcctcgaaggcggcgtggagcgcgacgacgtgcgggctggccccgggccccggcgccgacgcgacgaggtgcaccttgggctcctgctccgcgagcgcgaggtcgagcgcgtccgccgcctccgcctcccgcagcggcgccttgggcgtggacttgaccgcgaacgcctcccccgtggcgacggcgtagcagcggcggacggtgccgaagcggccgcgcccgatctcgtcgccgatgacgtactcctgcctcagcgcgagctcgccgccgctgctcatgctatctccgcgattctcttctccccccttcttctgtctccgctggtctccgacgccgcggccgcctcgcctataaatgcagccgggaaacgcagcggccaaggagacgaaatggaatatccgcctcgccttttttttctttggctcctagcgaacccttttcttttcttagagaatggtatttttaaaccgatctctaaacttaaccgggatataagtaatcattttaaattgagaacttagccacttaacaattcaatatgaaattagctcttataaaaatttaaactcaggattttggaaggctactcagggcattataatcactaggctacatactctttcgcacctagcggacctacctggtgatgtgtatcgtctcgtattttttccttctctattttccatttaattacgcattagcatagggattaataagctttattagttattactaccgactcatgatttaacaaggaaataaatttgagcaaaataaaaatgagatacgcatctccccagatggatattatctactaaaaaaaatctccccaagatggatgaagtgtattatgttgtcttactcctaataatgtctttcttttaaagtttggagatttgtatttatttgttgaggggattataaaacgggagcagtggacgggttgggtttggttgtttgggcaggccaatggatgttttttgttctaattttttgggataaacaagtgcagaaaccgatgtaagcacgggacaagtgtctgtatggtcggtggggcccaaagaacagcgaattattggggcccatgaaacgtggcctccttggagcgtgatgacgaggatactgtgccactacagtgtccgcatgttatacacatctgcagcgttggacctggccatctttccattctgcccatgattatattgctttttgaaagggaaaaaggtaaagaggagaggaaatggactaccgtctcttctttgtttaagctcaattaatcccccttggttttacaaactgtgatcaaacacaaagttcactattttttatttttattttttgcgaaacagtgaacaaatggtagcactgtctcgttgttggctcgtttaattttcagataggatcgttttgatcgcatcgagctcgagcgatccgatggcctcgtcgacgaatatatatggaattaatgccgccattttgttgttttgtggtgcggtgttgtcgtgattacgattaaacagcttatccatatttggtttttatgacgaacgaggagaggatatgtagggattatatatctgcatcttcatgcattccttgtgcgatcgacacctgatctgcatgcgtaatgaaaacctgccacgattggtacccgtctcgttcgttcttatcaactggactagccaacaaggcccacgacgaatgcatgcgtgcctaagcaggatttacgcatgcatgcaggcatgttgtataaatctttttaccgtagagagattgtctcgattaattacctggtctagatatttacgcggaaaaaaaaggcatcgaaatgtgttcagtggtgaaatgggccattggtattttttttttcttttggcacgagggagaaattaatatacggtcgatcgatcgcctgaagtcctgaactgtagcgtactccctccgaaaaaaaaataaattatgggtttccgtgtccaacgtttgaccgtgtgtcttatttaaaaaaaattatgaaaaaaattaaaaagacaagtcacgcataaagtattaatcatgttttatcatttaacaacaatgaaaatactaattataaaaaaattcatataagacggacagtcaaacgttagatacgaaaacacaaggttcgtcttttttttttatttggaacggagggagtacgcagataccagctgcagaaactcgatcgagaacttacgtcgctgcttcggaatcgccgtagaattccacctacggacgcgctcgatctactgtcagtatcaactgcgcatgcgacgtttcatcgttgatcgttcacgacgcaatgtgtacagtggcttaaaccaacgacaagtggatcgcgaacgctgctgctagcgaacagcccccgacagtgaagccgcgagcaagtcccaccaccgatcgatcgtttcatcgttcgttgcgtttccgccgttgaattgaccgcgcgcgcgggcgctgccgccgctgccgctgcttgacaagaatccgcgcgcgtgctgcactgcagccgcgcgcccacttggacgacgcggtgaatccggctgcgacttcttcccaattcccaactcccaagccggcaaaccgcgcgtttcgaacggacggcgacgacgacgaagctaagctagctccacgttttccaaactggacgcgccggcttcgcaaccggcaactcgatcgtatcgcgcttacttttctcgcattcgcagcctagctaccaacctaaaccgtatattctgcttcaattcagacgtcaacgaacacacagttccggaatctcatcgctcgatccatcgatcggctgcgcttgaacgatagtgagttagtgacagaaagctactactatatgataacaaaagcggaaagtgtgtatatatagatgtacatgcatgatgaatcaaacgaatcatgatcaccaacttgataacaaacgattattatcaaatttatcatgttaacaacgaaaaggcaggcaacggaaatggaccagctttttcatcagcagttgaggccaggaagaaaagaaatggaatatgggttggactctgcatttagaattgctctgcaaacctggctgtgggggctgaccaggcaagtggattaattgaaaaatattaattatttctatagttgcatctccatctccaatctcctcctctcgatcaaaggaccaaatacaaatgctcgtggttggttggtcactgactttagcttagatccaatgaccgcagtcttaattagctggcttgatatatcatttgtgctgtttttttttatctgggtgatagacacctcgcacctaattggaattgtttttacaccactaactaagggaggttatatatatctcatctcaacgtttattttatactggccatataggttagctagcgccatatctaatctaaattcattggctttagtttatatcaatgaatgaatgattctgacaaaaacaaatggtcgtgttcagtgtttgcgcatgatgcaagctgactccgatgaaatgtttgtttctgtacgcatgttgccgaagctagcaggctaggatcaaatctatatgtttgtttctgtacaagttgccaactactgtacgcattctacctcttgtaaattaactactttgtgcacataaacaagtgctccatacctccatacatatacgataaaaacatatatcactgtcaatctgtcatctattctgaagaggtaagccacatattttggaagtctagaatcgacgccggctgacactgcatgctgtgtataatattcttggagcatacataatacaatacgtgtacgtggaaagataaacaaaaatacacgtaaatatcgatcacaagttcacaaccaagttgttatccatatttcgacaagtacattatcccatatgtaaaaaaataaataaattaacttgcatgtttaaaatgatttatcacatattaatttaccatgttgattttttaaaatatttttataactatttgaatgacacgtaaacaacgaatgaatatacattccaggtagctgtacatcataaccggctattaaacaccaatcagttctggtcgtgctactcgtggttaatcagtcattcatttttcttgaatcgtaccaccgctcataataatgatatctttctaccacatcaacaattaaccggttattaccaatcagttcttggcgtacgtacgcgtggttaatgggttgactacgacattttgaaggtatggaaatgtggtgaaacattaattttttttacgctaactcttacacggacgacgagtcatcacgcgagatgagatgtggacgtgagaggaattgaaccgggcgcggccaggtgcaatcgcacgcatgcatgcacctgtgccgagtcgattggatgaacggcgcggtcgccatgtcatgggtgacgtacgccaccttcgatggacttcgaatgcaagaaatttacggcatgaatggaatgaaccaagaatgcacgcgcgcgtgcatgcttcttgattatgtcatcgacgacacaccacatactctatccggatctttggttattaattcctgcagctatctatctagcaatatatattttctgctatgtgtaccatataaattaagatcatctctctctcttaaaaaaacagtagtacgtgttcctgggctccttgcaaaaacagaagaagtacttcttccgtttcacaatgtaagtcattctagcatttccgacattcatattaatgttaatgaatctatacatatatatccatctagattcattaacatccatatgaatatgggtaatgctagaatgacttacattgtgaaacggaggaagtatattgttaataccggtcagggtcagcgacatatattgcctggtgaaatagtcgtgcaggtccttgggagaaatgaatcctacgagactaaaagtggataaattgatgtgtgttctgttttcataaatttgtcaattcatctgtaattttatactcccttcattctgaaatgtaaggcataaccacccttaacctaaagactaagaaaataattattatcatcttatagtttggatcatcctaacaaatacaatgcatgcatccaatagaattagagaacatgagagtggaggatttaaaaaagtactccctcctttcctaaatgtttgacgttgttgatttttttaacatgtttgaccgttcgtcttattcaaaaacttttgtgaatattattcaaaaacttgagtagtagtagtatatttaaccatgaatcaaatgatagaaaaagaattaataattacttaaattttttaaataagacaaacggtcaaatatatttaaaaaaatcaacggcgttaaatatttagggacggagggagtaataatttaatagagaaggggccatagttaattgtctatatgcatgtatgccttatagtattatggaacatctgaaaaagtggctgtgcaatggatggagtaagtatgttagttatcctaagacctaagcctatcatctactacgtgcatgcacgagaccactggtctggtctcgtatgattattttccgttcttgacagagcggcggcttcacgcaaccaattggagacggcaaaggccgtttgttgggcctcatcgattcgtccaaaatgggccaacacagataatcgtccgaaatgggctggccttcaagctcactggtgggctgggggagatgcacgtgatgggctggctcctcggctcgctcgctcccaccgaaccagtaaaacgccaaaaaaaaaaaaacagaaacggaaaaggctaatacgccattaaccacccggcgcccgcgccgcttaattccaaaaccctcctgataaaccaaacctggcgcggtacgcaccacaccatcgctacctcatcacgctcacgcgtctccctttctccgcactcctcttcgctctctctcgtgatctcgtctgatcagctccgcctccgcctcagaattcagaaatccccaaaccccaatgctgctgctgcctcgcagtcgcacggcgaatcggggataagcaccggaggagggatcggagatggaggcgccggggctcgtcgtcggatcggcgctgcgagccgcgcaaccgccaccgccacctcctctcccgcgctccccgcgtggcgctgcggatcgcctcctcatcttctcgcgggagcctcgacctcgactcgcccctctcacccggtgctactgttccaggtacttgcttgcttgcgaagttgcggttccactgcgctggcgctcacgcacccgcgcgcactcgtaacatgtggatgtgggtattcgtcaccgtggctttgtttgggcgtttgatcctcaaatcggtgtgtattccagggaggggaagggcaatgctcgcagcaaaccccatcgcgagggctccaattccgttcggtgtgtgctccgccgctcgtattatctctagattctttttttcagttttattttcactatttgacgcagcgagtggttaatttttgtgagtttgtctaggctgaacgtgaaagcaaacaatgaccaggtatgcattaaaacttcgaatctgtaacacgtttccccacatattttacctcatgtacctgcattctcttatggtttaagaggatcatgaatttagagctgatgtcgcaggaaacatatttggctgatgaacgacacgaaggggttgacatctgggagctattcagccaggctcagagaagtaataactacttttttttttttttaaatctgagcttaccattgaaccacaccagagcagtatcatttgatatttggcgtggcatgcttatggcacttttcaattagagtgaaccatttgcatcactttgttgtttgctaaaagaaaagcgttatctgttctgatggcttcaatttcacagatatcctacaccttaacaagcagcggcttgtggccatggaagagctcaagaaactgcaggatgaaaataaatcgcttctgcaggacatagaagtactggaaacagaaaggcaaggtgtggcggtgataccatcctaatgccaagatacttttgtgaattaactgtgaagatagaatgcgagatgtgtaacatcgagcaattcaatcctgtgtttgatgtgatacttctattttctctttatcattgttagcttaagagaataagaggtaaacgacagacctaaaatttgacgctgcattctccttttacatatttcaggtttttccatagaaatagcagaatcatcaaggttctctgagttgcttctgcgtatagatacaatgaccatttctggtatggttggcatgacagaagcgtctgatttaagaaagaaagttattgacaaccgatacatgatacatagcgtcttttctgatattcatcataaacaagatactgaactactttcagaattgagactctttctgcgtaaaccagcagagtatgtaccactacctcattacatctctcctccaggttccagctttactattgccatattatattcaaagatcctactgcattatacatacatctttcaatctgaataagcatgaaaaattgaaaatgcactacaattttttcgtatatatgccttctgcttatattttgtgctgtataattctaaaactgcatgttttctatatgatgcacaaactacctgtttaatctgagtttctgccatcataactgctacttacaaattttgcatagctacgttaatttaaattactgttttgcaggaaacctctacacgttgtgcacatctgcagtgaaatggatccaataacatcacgtggatcattagcaacctatgttactggattatcttccgcacttcaaagaaagggtaacttggtggaggtcatactgcccaagtatgcaatttctttgtgacaagcaagtgatcaccagtgaactaataattttgtccattttcaaatgtttgcaataattccaattatatttataaatggactaggcataaaaaagtgaacaatttcttgtgggttttcagcaacgtagagctataatacatactacaatgatcattattctaaaaggagagatgttttgtttttgataaatttgttggatttgggattgagctttgtatgtagtctgattttggttgtgtcatatttatgcctcaagtattgcaagcaaagctattgtgttaattgcactggtataacccaaaaacaggtatgctggcataaatgaagatgtaattcatttcctgaggaaagctgaagcagactatgaatcttattatggtggttgttggcataaaaacagaatatggacagggtaaatatatactcagtataacagaaatttcttactctgttgattatatcaagatcttaatttttaaaagtaattttatagagaatttcttgctgtgcgtgcttgctttagtcatgtttgctggtttctcctcctaatttaccttctttagtgcagtatatcaagtggtgttagtcttacactcatagaaccggtgcagctgtcatatttaccttctttagtgcagtatatcaagtggtgttagtcttacactcatagaaccggtgcagctgtcatattttgatcgcgatatgttacgtggctaccccgatgactttgagcggtatgtttttatgccatatggtatctgcttttgttttgattctattttgaataccgttgatcattagctctagcattttcagaagctcaacttctgatatatttgtgccatgctgtttatctgttgtatgtgacacacaaatgatatgtgcttactgcatgttttaacacatgatcctccattccccctttaagttgattgtatctattagacccttgctttgataccttgtttggtacataacaattcatgtgttgtattgagctagaaacagctgtatgtaatcgacaaaagggttatttaggcctgaaacaaactgatcggttatatagaccataactagcatatttgactacatttaacatctatgaatacattgttacagattttcctatttttcacgtgcatcattggattatattgtaaaatccggaaagcagccagatgttttgcatgtacataactgggaaactgctatagtggggcctctattctgggatatatttgctcaccaggtcagtcatgctatctcccaaagacattgttgtttcagtgtaaatgtttatacttcatacctcacaaattatttcttctgtcagatctcatgtttcttataatatatttttcactggtctcctagtattgccaagggttgattagtacatctcaaagcaaaacagggaacatatgcacactgttctacagacaggaaatcgatgtgaacattattattttctgcgtacagaaaaatacaccttcattccccctgtttatattgaacattgttgcacaaaagattcttcccagtctttagaacgactataaagtattagaaatgcagttgaattttttatatgctgcagaaaatcatctgagcattttgttattcctcatgtgaagtttttccttataagttgtattcaattttcagggacttgggaacactcggatattactgacatgtcaagacttgacttcgcaagtaaatatcatatatgcattatttgagttgctactggttaaccgtatttgatgttcttaattaaacaggctgatcacagttgctaaacataatctgttctaatatcaaatatctgaagaacaaaaaaatgaatccttatgatgcagtaaatcatatcttcaaattatctgtcgatcttttttgttggtgaaattgtttcattagaccttgaaattgagaaatagaagtacacatcaaatgttcactgttggttaccagttaccatatgggaaaggaacctatgccttctctgctatttcctttccttttctggcaatatctattagggacctatctgttattattagcagtattagctaattcatattttcagtgagtaccctattggaatatgtatgcaccattaccatcataagttcattcactctttcaggcatcgtgttgctcaaatttttaccaacaacacagcgaaatttggattgactagagattttcgtctttcaaatatctttaaactttaatggacatattaacaaaaataatcctatatgcagtgcctagaggttccaaatatgctggaattgtgcggacttgatcctcataaacttcatcgacctgatcgtctgcaggataatagcgaaacaaatcttgttaatgttctaaaggtcagccttcttaaaattttaggagttgatgccatgggttgagtactgtgacatatgacaattgaagactatgctattgtttttttctaaatttctttcatctttatatttaatccttcgttcatgacacttccatctttctataagaaactagttcaaagatgtgcttgaagaagatatcaaaatgctaaacagaagtaaattgtttcacacataatcctttgaatgataaatatgtgaagcttaattttgaataaggcaagcaccatggcaactgcaatcacttggcacttgcatatt

SEQ ID NO: 68536 - DNA, 719 bp, Oryza sativa
  unsure (1)..(719): unsure at all n locations
aaaaaagatcaaacttttgacagtataatccaatgcacgagatttcttatatctttcgtttgtttcccggctctttcttgtgtatatactgctccatccgttttatattataactagttaatcattttcttcaagttttattaagtttataaaaaatataacagcatttataacacaaaacacatgcattatcaaaatatatttaatgttacatctaatgaagctaatttgatgttgtagatgttgttaaatttttctgtaaattttaccaaatataaaatagtttgattaaagaaaaaaaattaaaatgacatataatatgaggtagtatcaaatttctcatgtgttggttggtttgtttcaggcagcagacccctcaccacaagatggggacgtcggcggcgggggtcgccgtcgtggggagccgggtggcggcggcaccaatgctgctcctcgacggagcagtcatgatctggccgtagagtggcgacgtgttttttctgcaaggaggtgactccgtcgtgtaggattgtttaggatcagggttcaggatcgtagcctgttttctctgttgatatgagtttgtcagtgtgccgcttgattgtgctgaaaaaattggtttcttttcatttttctttttacctcnttttgggttcttttagggtgggtagagagtgttcttttgngggttcgagcgattgtattacaanatacatgcg

SEQ ID NO: 68537 - DNA, 651 bp, Oryza sativa
atccgcgtcatccctagccctagccaactaccttaggacgggaaaaccgccccagcaagccgccgctccgccacagctcccatgtgcgcgcgttccgtcgcccccattcgcgcccaatgaataaaacggagcctcctgccacagctagagttagaacgcacagactttaggctttaggtacgatgatggagccacataaccttaatggaggaggagatcaaaccttatccgcgtcatccacctcattgctcttatccgatcaccattagtactccagctcgcctaggcatgtgctggtgatcttatccccatagtttgcttgcatcctaagcgaagccctcaacaaaatcctcatccctctcagccttcttctcgtatgcatttcatcgaacaccttgcgatcaccctctcaccaccgctagagatcaccattgtgaggctccccggccggagctggaggttggagggagtggaggaagagccgtgctgccgccgtcgccatgggggaagccgggtagccgctggacatcaagaaacgttgtcaagcaccttacgtcgccgtcgtttgcccctgtcctgcaccgcgtcgagctccacttcgccgcgtttcgccatctcgccgtctcgcggtacaccctcgcgcccgtagcg

SEQ ID NO: 68538 - DNA, 40204 bp, Oryza sativa
  unsure (1)..(40204): unsure at all n locations
ctaatcaattacctaaatccacactcccttttggaaattcgaatggaatcaagagccttttttgcattgcatggcgacctttgctccggagcaagcgctgctgctccaattctttttgctgggaattacgcgcgccaccaacctcagcttctacctccatcattctctgctttagttgtgaaagggcaaattaccttaaatataagtgcgagagtccctcacctcaatggttagtttttgggggtaggaaaggcccttttacgatcctacaattcgtatcagagtctggctagtttaacatctctgacccgatagacagtgtgtgaaggactgatggaccgtgggtgcctgcgggacccgtatacctgagggaccgtgatgaaatgatgaagtactgagggacaccaatgtatgaagggggagattgttgaatagtcccatatttggtgattgtggaccgtggtgaaacggtgaagtaaggactgagggacaccaatatatgaagaggaagattgtaaatagttatatattgattgtgaaagggtaaatgacctaagatataagtgtgagaacctctcatctcaatggttagcttttgggaatctgcaggccacatttgcgtcacactgcagcgaacgccctgatccctttccgcatttctgtggtgctgcatgctgggaaaaaaagagaaaaagtccgacggaagggcaacaagacacaccttcaccccagatatggtacggagtagagttcgaattggacggttatttgagttgaactggcaaaaaagtgagttatatattctgtgcactgataatgaatccgtattgaaatcattaattagattcacacgttgtatttataattctacattgactaataatgaagacttgctttgagtagaatattataaaaaaatccgaaaaagaatcccatattctaaaactggcttaacagtcctttttaaacatgcattcgggcaacacaaccaagatttgtaagatgtcaagttctgcttaggtaataatatctggtgatgttgatggtgtcacaatagaaattgccagtaaatttgttggataggattgttaaaattgtgaggtaaaaacgtcatatcacataggtttttttatttaaaataattgtgtgaagtgagtgtagctcaactggttagcatctttgtggtggaaccagcatacccggattcaaattctagatttgacacgagtgttcatatttacgactaattattatttcagtagtaggtgatatatccgtcaacaacgagacgtctatggtaacttcatcaatcttaaatattattcggtggtagacgacatactcattaacggcgagacatctctatgatgacttcgtcaatcttaaatatgcctattgtgaccgtttagtgatgagggaataaaactcatagcttattaggacaattttgttttgaagccaaaacatgccttatctaaaacattgcatttaaaacagtatttgatcatgtttgtttcattgtttgctaacataacttgtacacataaacgttgccaaacttacatactaggatttggccatgccaatctatttttttcgaantttgatacaaacgtaagtgctcgtttaaatgcgcgcacactcacctaagagcaaggttaatagtatagcccactactagctataattcatctataaccaatctaatagtcaattcatacaataattgattactatactattaatatatggtcccacctgtcatacgcacactgcatcttgtagtccgtgctgcagctagctacaaatatgtagcccgctgctattatctctcctcatttatgtccttaaaatatgtttgcagctgccttatagcatgctattgtacctgctgtaatacacacattatatttttacagcacatcagaaacagaactgatataccacgaacccagtgagtccagggacatttattacatggatgaaaagatgtgtcgtgcttagctgtgttcttcgtgaacaagaatgtacagtaaatgaaagtgaaataccttatgagcttggtataatatagtactgtgtacaacagcaacaatattttgttggagatcgattttctggtggatttgatctcttcaatattgaccagacaagcacctgaacagcgaattaagaatttaggacttcgattcagatgagagttccaacagttcaagagctgaatgtccatattgaaatacttaatcatgcatggtgtacaggtatataataaacggacccataatcatccataacatcgatcggtttaaagggaaaaaagctccccaactacttctaatgcaaccttggtgagcgaacccatggggccctaaatatagccatgatctggtatttcactacaatttctgcaattggcaacaagtactacatgcatggaacttttcctttaaaaacccaacgtttttatagccttgatttgctgaatatatgctgatgacaccatcaatttggaaccagcttgttttgtttattccttacttttcctcctcctgaatgacccccacagaatttatgcaggattattgtcaggcaggttgtacaaaaccaaagcgttcaaggaattttgtggagatgttagtattgcatttataccactcgagatgatacggagcatcacttgatgaacagcagcgaacaggtttgatttgcaccagaactcgaccttgcgaataaatacggcaataactctactggagtactggtctactctcatcttcagttttgttgcaaaagcatactctttcccttccaaaataaacaaatttagcacatgacacattttgacatatatataatacaaaatctacgatatatcacattaccaggttttgtttgttttaagacgaatgtattacgctacaagctcccagtcaagcatttactacatgctaggagaaacattaggatttccgtgtgtttatttaaaatgattttttttcatgtgtaggtatatttattttttcttttcacatccatattaatttatctgagattagctaaaaaatttaggcgtcataaggttttttgggacggatgtagaaaattttaggctctgtttttttccctgtaccgtgtaaactattatggcattgcattgggtagtagctgatccatttctagttgttttagatcatacgaattggttattgtattacttaatgacaatttaggctgtgttcttttacatgacttcgcagctcttcttcttcgttttccgcgcacgctttataaattactaaacggtacatgttttgcaaaaagtttctattgaaaagttgctttaaaaaattatattaatccatttttcaagtttttttatagctataacttaattaatcatgcgctaatctatcactccgttttgtgtacggaggggaggggttcccaacccctccaaaagaacacagccttagagcaggcacaatagcagactctaacacagctataaacatattttaagaagataaaagaggagagaggagcaacatgctgcatatttatagtcagctgcagcacgggctccaagacacacgggctccaagacacatgtgtgtatgacaagtggggccagatattaattgtgtactatatgttataggtaactttagctattaaattgactataaatgatttagagccagcagttaactatactattaaacttgctcttatgtgtcgagaaattctagcattttttctatctggtttggattatgaccgaggtttgaaattttaaagtgattttttttaaaaaaaaatagatttttaggtgagaagacgctgacttaatagcaggtacaataacaagctataaaccagctataaatatattttaaagggataaaggaagaggtagaagagcagtgggctacagatctgtagccagctttagactccaagacgtaatgtgtgtatgacaggtgggaccaggtattgatagtatagtaagcaactattgtacgaattggctattacattgtctatagatgatttagagctagttgtgggttatactattaaacttgctctaatagtaaaaaaatcaaactcttaagtttaaatcggctgtgagcatgtcttcttgtgtcggcgttctaccttatacaagttgaccacatcggaggttctaggggaaaacggttttattattctctcaccctctcgctcagtcgcaaagaggtggctagagtagagtttggtgtcggttgttagggttagattttggacgatcttggctatagttcctttattcgcttagcagcgatcagtcatgcttagtagcgaccggttcggtgatagatttctcccgagtatatatttggtgttattggtgcgtgaatggtggttattttttctttgtttttctgtttacgacctttagagttataatcttttttttacactatcaatataaactttacactgttcggtaaaaagtcgttaaaaaatcggctttgaggcttaacttaatcgtgtgccggtgggtgggacccggtttcagtcccctcaccaacccaaagatggcaagattcaaccttgcaccagctcagtacaagcaccagctcagtacgcgaagtaagcctgacacacacagcgagggaatagccgagtaaccacgggaaacaacggggttctgaccttgtagggtggagtaaccacgtgacaggggctaagacttttgagaagccagcagtaacttcatctcctagccatatcgctcttttttttaagggtgtgtttagttaacgctaaaattaaaagtttggttgaaattgaaacgatgtgatggaaaagttgaaagtttgtatgtataggaaagttttgatgtgatgaaaaagttaaaagttttaaaaaaaagtttggaactaaactcggcctaaatcaaaacaagccatcgcttttagttgtgtttagttcacgccaaaattaaaagtttggttaaaattgaaacgatgtgatggaaaaattgaaagtttgtgtgtagaaaatttttaatgtgatgaaaaatttagaagtttaaaaataagtttggaactaaaccagggctttatggcttaggctcaccccgaggaccgagtttgagcaatctctccccggaagtgtagaggcgtaattgctttatctcaaaataaattcatttttcatttgtcctatagagtactccctctctaaaataacgaatcgaacctaatctaaacaaatatgtactaataattatgatgtgttatactctagtactatatcggtttttcttacgaggcagtacataccaatgtaaaactaaaagatcatattgttctcattttatcaaatctcaatgccattattttttacttaatctatttctattacatttattcattaattttacgaactccgatgtaataattagccaaaaaaacttattttaggataaatcggagaagctaaaaataaacttattttgagacaaatagagtagattttaccttgatttttcgttagcacgtttttcaaacggttaaacggtgtatttcattaaaaaactttctatatataagttgttttaaaaaattaataaatcaatttttaaatttgcaataattaaaaccgactagtaattaatcgtgtgctaatggctttcttgttctgcgtgtgctaacttaatcttcatccaaatgtatctcaaacgggacctagctgctttcgggagagaaggctaagaatttttctcccatgcaagtaaaatgggatagtttatgagcatatggttaagtaaatattagcttaaaaattaaaaaaatagattaatatacttcttaaagaaaacatatatatacatataaattttaaaaacttatcatttagttgtttagaaaacatgtggatgaaaaaacagagaatagaagttcacgtcatagtcacacagacttcatttcctacttcgcccgagtttagttccaaaatttttttcaaacttccaacttttccatcatattaaaactttcctaaacaaataaactttcaactttttcatcacatcgttccaaattttaccaaactttaaattttgacgtgaactaaacacacccttcgttaaaaaatgtcaagtttatttttagtcaatcaaactaagaaatacatatttaattggagcctacgaaatacaactaaagtacgaataaggggcatagttatttctcttcactgatagtttgtctgaaagttgctagaaacaaaatctttatagcacctgataaacatatactgtactaataattacttcctccctccttaaatgtaaaagattctgactatgaattacatgtttaaattatgaatctggatatgcacaatctgcatatgcacatagatagatttatagatatggtccataacatttagagtcgaagaaaatagtacactatggccctttttgaatcaatgagttattttttagcccgcccttaaataaccccaaatagcctaaaagttccaaacacgtgagctatttcagggctatttggaaataacccattaaaaaaactatctccctcaagggctattttaggtgggacttactgaaaaagtgtcttttctctccctctctcttcatgggaaagtgcattaaaggccaaatagttctcaaaataacccttagatacaaacaacttacagctattttcttatgctaaaaaaatatttctcaaaacctggcctacagagagaagatgaaaacgtaaaaaaaaaaaaaaaactgaaaggtctttgcctcttgcctcctggaaggccagtccaggccgctgagccgaggcggagtgttcgttattataaagccgcaagcgtttccatttccctccccatcttcctcttccctcccctctctctccatcaccagctcatccctctctagcgctcgttcgcccgcccctcccccctacggccctacgagcgccgcgcttctctttctagccccctcttccgcattactccctcataaaggaggaacagaggaaagactgggcagaggagaggacctatagctgagaagaagcagagcaagtgaaggagaaagccccgtaatcttggccatcctcctcctcctgctgctgctgcaactccggctctgcctttaaacagtgcagcccgggcggcgccggccacgacgctcgtactcctagctagcagcggagaacgaacagcgtgcagggactcgcctcgatagcacagtaaattccattccatatcatataccattccagccatcactctccaccggcaccctgcatttactgctcccccatcactcgccccggcttccttgagcgcgatctccagatcatcttttgtgtagcgagaaaggttggtgctcttcttcttcttcttcttgctgctgcagctggtggtgttgttttttttattggcggggtcggtttcctgctctgttttgttaagtcatattgtgctgtcctggatcttgatccgacgtccgtccgtacgcactcacgcagctgacgacggggaagggcggcgtggtcagcatggtgccgcgcgagcaggcggaggaggccatcgtggctgacagcaacggcaaggaggaggaggtcggggtgatgggcgtcagcgccggggagcacggcgccgacgaccaccacggcggcggcggcaagttcagcatgaagaacctgctctggcacggcggctccgtctgggacgcctggttcagctgcgcctctaaccaggtataactcatcctgctccgccatggccgccatcgcggccatgcagctcgctcgatgaaggaatcatatcgagacgaatccgaaaggcagcgtgactgaatttctgaatttcctggtggtgggtttctgcaggtcgcgcaggtgctcctgacgctgccgtactccttctcgcagctcgggatgctctcgggcgtgctgctgcagctgttctacggtttcatgggcagctggaccgcctacctaatcagcgtcctctacgtcgagtaccgctcccgcaaggagaaggaaggcgtcagcttcaagaaccacgtcatccaggtacccgccccgccttgtcatgccatggccgtgctggccttgtcgcttcttcgtatcctcctcctcatcagtaacggattgttacagcttcttatccccgtctttatgtggcataatcgaaaacacatttttctcgagcacgcattttttccccttccgtttggtcgttttcgatccttactggcttgaaaaatgcctccttttcttttgtgaaaatggcagggggtattggatcccctgcctcccatggctctcttctggttgcttgccgaaatgaaagccgagcctgaatcgagctcatccttaatccttgttcaattaatcacttattactgcaaattttgcataactacacaactatagttactatactaacaactggggctaatgggagaagcttgtgacgttgactggtggcagtggttcgaggtgctggatgggctactgggcccgtactggaaggcggccggactcgccttcaactgcacgttcctcctcttcggctccgtcatccagctgatcgcctgcgcgaggtcaaattcctttcctccccaactcaaccaaccaaccatcactctcccactgtcacttcgcagcgccagtgtaaatatgtagccgtgctgctgcgcaacagtgtgtcgtggtgacagattgggtttgtgcggatgggctgaaaacctgaccgataatttggtggtgttttcttcagtaacatctactacatcaacgaccggctggacaagcggacgtggacgtacatcttcggcgcgtgctgcgccaccacggtgttcatcccgtcgttccacaactaccggatctggtccttcctgggcctcggcatgaccacctataccgcttggtacctcgccatcgccgccctcctcaacggccaggtgagataagaagagggaaactgtccttgtcactttctcgatcatccatcgcgtctactacatgtccatttagcttgggtttgcagtgactgatgatcgtttgcgtcgcaggccgaaggcatcacccacaccggtccaaccaagctggtgctgtacttcaccggcgccaccaacatcctctacaccttcggcggccacgccgtcacagtgtaagcaaagcagaacttgctctgtttgtccagttgttaatactgtacagtagtattagtactaggactacaagctaatcctcctgaggaagtgaagtgagggagaacttttcactagctgcagcttttgcctgccaatgtggaggacatgtcccgattggaaatcaggttctggtttccattccattggtccccctccatggtactggtactcgcacctcactggtcacagtgtagtatagtgagtactactactactactaagcttaattaaaacacacgtagctgtagctttgcagctagttagctctatggcgtacagatcccaatggatggataggggcacttaaaaattccaagcctgtgcgcggtgggaaacagctgcgttagcttgcgaccattagtcggctgatcgattgatatcggtcgataaaaatttataaagatcgatccagctgctaaagctcggtgcgttcatgtgcatgtgcgatgtgctgaactggtgatgcatccaaaaggtcccctgctagtacacgcgatggtttaggggagaaaagaatgggccactatgcattagaatagactccttgagcccctttattcccattgctcgtttatgtgcctaatctattgcttggattattgagtgtgtttttgctttggcatgattagaggcccatgcgaggaataattagcgtttcagtgcgctgttccttcaaaatgcgatggtcgttagtgccttagtggtcgcatgcagttcggattggagatttgatgatcttatagtagtatatatagtatctcctagcttcaaaaatttaatgtagtgctaccagtacttgttccatagttgtgaaaattgaaaatgcttttgatgggttggaaatggaatggaatgataaggggggccagcttcattcaattcagctagtgcggagttcacatcaagctatgcaattccgtgctagttgccctaatccaacggggtgaaatgatttccatcatggattgggacatcttggtgccaaatcatccaatgatgattccatttatatcttactactactattatgctgctaggcttgcatgggaaagtttagcttagtggggcgaaggggacacagacctgctttgagaattgcttcccaattgaagaatgtgagtgtctttgtccatcttgacaatgcccctcaccacttctggtctcaggctaattcaaagcccagtttggtagcgacatgagaccattagcataacatgcatgggatgggatcttcgctagctgtggagcagagtttttaggtgattagtactcgtatttagtggtataaattattattggcaacggccttatttggccgtatttgtcggctcctccatcatttgaccggtggcggatacatgtgttggtgaaagaaagaaagcaattgcgagattccccctgccgccgcgatccttgcatgtatcctgcctgcgtgactaggagaagcagcagctgtagtagtagtcctactttttggccgtatcatttgatcaagctgattaaagtctcagcatcattgactcgcatgtgccgaggccgttttgtccgttgatttgttgattaataacctgcaagaaaagaaaataatgactgattgggggtggctgttttggattggtgcagggagatcatgcacgcgatgtggaaaccggccaagttcaagtacatctacctgctggcgacgctgtacgtgttcacgctgacgctgccgtcggcgtcggccatgtactgggcgttcggggacgagctgctgacccactccaacgccttctcgctgctgcccaagaccgggtggcgcgacgcggcggtgatactgatgctgatccaccagttcatcacgttcgggttcgcgtgcacgccgctctacttcgtgtgggagaaggtgatcggcatgcacgacaccaagagcatctgcctcagggcgctcgcgcggctccccatcgtcgtccccatctggttcctcgccatcatcttccccttcttcggccccatcaactccgccgtcggcgcgctcctcgtcagcttcaccgtctacatcatcccggcactcgcccacatcctcacctaccgtacggcctccgcgcgcatggtaacctcaagaacctctctgcacatgccctaactatgccccatcatcatcgctgcatgcatgtttttgttccggtacaccgcctcgtccatccatccacgcattcaatggcaggtactagtgcaagctagggcgaatgcaacgtgacggccaacttatactaacaactgggtccgatggatttcatcgacgcttcctccgtgttgctatagctgagcagcggatcggtcgagccatcatcaacagtggcgagactggaacacacaggcaatagaatagacagtggagatctgtgcgcaggcagcagaagcaagcagcagttcgtgttgaatgcaaaagcacagccgggccgtgcccggggcccacctcatacatgggcaaatccccaatcattgaatccagccaacaaccacattaattccaagcagcgcccccccccccccccccctcccctttcgattctggccgctgctttggcagtatcttccccaagagaggttagcttagcctagtcactttggtttagtgaccgtgcccagttctggtgcgctactgctcccatgtatagtgtctcagattaggagcccaaccaaaggtggtccctgcttatctggctggctgctgccgcgcggctcggtacagcggacgaatccacccgtagactctctgtgcaccgtgcgcgacgacgcgaagaaacgcgcggaaagcaacggttgacgccgcggtggatgaggtgggacggacgcgctgctgatgttttcgcgccggcgctgctatcgcgggtgggacatatgtaagacttccgcttggcgcgtagccggaggcgatggcgcggtggtcgccgtcgcgcccgtcaggtcagggggcgcgcgcggctagcttagcttttttcgcgcgtggggggaggggtttgggagatttttgtgcgtgggtagcctttccctctcgatccccttcctttttccgcgcctttccgaaaggcgatcgaccgaacgtgcgtggtagtacggacgcggcacggcgaataaaaccagcaagcaccaaccatgttttatgttgagaatctacaatacgcatctcttttttgacgagggtttatgttgttgtttgcaacagaacgcggcggagaagccaccgttcttcctgccgagctggacggggatgttcgtgctcaacatgttcatcgtggtgtgggtgctcgtggtgggcttcgggctcggcggctgggccagcatggtcaacttcatcaggcagatcgacacgttcgggctcttcgccaagtgctaccagtgtcccaagcccgccccggcgttggcgcagtcgccggtgccattgccgcaccactagcgcgcgcccgttccgcaccaccgccgccgccgcggcggaccgtgacaacgtgcaccgccgagcccggagcaaggaacctcgctctcctggccggcacggctgcaaaaattcagtgttgcttaggttttggtcgccttgtaatatacaaagcctctcctcctgtgctagggtgtcacaccaaaatggtagaagaagaagagggcatgggtccctacgatcttgccccgggccgtccgctgccgcgttgctttcccccgatcctcgatggtgtccttgtgtttgtttggcttgcccctccctctggcgatatatatgtgatggtcgtcatggcttataaagattttcagctcatgtcacattttcatatgatatgatgtagcatatcactatagggttatttgttttctacctggatggagcttggtccatgttgtctagcgcgagcaattgtaatcggcgattcctcgtgctagctaaaggcaaaacacggaggcctttgtttattgcgttccgctttggatgttcttattgtaaatgtagagcgattgctcgcttttttttttcttctcttccgtatgtgttacctttgcgccaagcgattaaagtttcttgagaaattttatgggcttctttgaaaggaccacaaagcaagggagaaagatatggagcaaaaaaaaagatgtgctcgtagtaatgaatggtggtcgagtggggttgtgatgcgggtgcggcgcgggtcggcgcaagctataatgactcgcactctgaaacttgcttgtgaggctcaaatgctcatccagagttctaaagatggaggctaccactactggctacactggctttgcatagttgacacagcgtgtcacgcagcagacggccctgattagcagcccatcttatcacaccagcatactgatacaccggcggttgaggctaactttataaggattagactccactacttgtactggtactagtagtagtacaattcatggatgcattattgttggcttgtgcttcacagcatcgatacggactttggttagagagaagattgtgctttaattcgcccatgtgggactcctaggctctccccaagccgttgcaaatgggattctctctaatccctcactccctcgggcatcagccttcacatggagggggcatgtgcttctattgacaggtttctctttccagatttccttttgctggtatctgtgttccttccaaccatccatgagagggggggagcgaggtgctaactgggggagcatgtgctttcgacttcacagcatatagatgttttaatctgacagcaactggccgttgatgatagtttttgtttgatttgatccctgtgttcttaagtttgaagtgtatatggtatagtacaatatacttacctctgctcgagtcccatcttgcacatggtaatgccacttgccgttgaatggaatcccaagtggaaaagaacatcaactgatgatctaaagaactatgcttagtgcttacttctatttgcaagggaattgttggcgatgctaagatacgcctcaaccatgtggagcatatgcctaattttccgataactttcgctatctgacaggctacatgtaccaagctatgagtttgaggtaaagaattatattatctttcttgtataggcgcaatcttgatctgataatggcagatcatgaacacgcgccatgcacaagtagttaggcgaacatatagcatgtagtttagaaatgcaaatcgtgcaatcttacaggaccccgaagctttctagtgcaactggaggacagcgatttgagattacaggatcgcaagaaaaggctcaagatatccgctggtccctggtaagaagctcataaggcgtagctcaattgatgcaggtagccaggtacttagcccacccaacgcatcatatagcatctacttttcagctcaacagatctgaacacacctggaaccaataatgaacggtatctcgcaaagcctcttgtttcctcgtccaaagaccaaagtgagttgaaacagttcactgattgctgaagccaatgtacgcgactgttacaaggcattgttaacatcagcagttaaaatcccaacgaataacatcagttcggtacatcatgtacttgaatgagaggaacagtgaaacttttgctggggggcaacacatccaccgaaaaatagcatgtttactggcttcgatcagaacaagatgcaaatgtccatccaggattggatcatcagcttaaccaaaaccttggcattccagagtcacgttcagctgcagcactgttgttaggtagcctctgtattctacttgagaactcattagcctatgaaaaatggacaaagggtcaattacagactttgcaaaaaaagactgaaaactaattccaccaaataatcactatgcaaaacatgtggcattgatacaccaaatatcacttaaaggaagaaaaaaacaattgggatcaagtttctctggttttgcacttttgctcaaagcaaaggtaagattcaccaaaccatgcgaaaagtagagcataggtaaaaaaaaacaagattcaacaggacagtatataaaagcagaaggatatgctttcattatttggtcaaaggcaagattctatgtaacagtgcaataaaaggggatcaagttcctaagccgaaaggattctactaaagcctagcataaaatctggaaatatcattctgcgtcaaatcaatattattgcttgcagcctagcacagtagcacaaataccctcacaaactgtgaggctgtaagcctgcgataagtaactaaagccacctcaaaaatatgagcataaagtggtatacttgagttaccaaccttctcatcgatccacattaaagaacgcagttgattatccagtatccggacagcaacatcaaatggtgtcatactatcagcagtctcaaactcagcaccctggattggaggaggctgatgtctaagacacaagtcatcactagacaagtactgcaaccagaatacttacctgagtagcattcaatgtctgaatgatggacttcacttgttctgtcatatgttgcaattcattctccacagtttcagattgctcaaaccttggcattgcaaaattattctgttaagctgatgatgtatattatgatataataaaacattaacataatcatttgtcctcacaaacaaaaaaaaacagctttgtcagccaatttggcaattcctcaaaaaaagaaaaaccaagctaagcaactgagtggggcagaatagattatgcacatatttcgagtaataacaccactattgagacaggccactcaggaaacaaagaatatcgtatgttattcgattcaggaatatttttaagcaatgcacagcatttacttagcttaagctgcatttattttagatcatgtgcagattattcatgccacgtttccaaaaggaacttctccaaaaactgtcgccttcagaattgcttaaatgcctaggctgtgttcgtttgttatctttcccaactcacctccctcgttttccgcatgcactcttttcaaactgctaaacggtgcgttttttgcaaaaaaaaattatatacggaagttgctttaaaaaatcatattaatccatttttcaaaaataaaaatagctaatacttaattaatcatgtgctaatgagttacaccattttgcgtgcacaggagattagttcccaactgcaacaaacgaattcagccctagacaacttgttctaagccatttgttatctttacaatatataatatttaaattcatcccgataagcaatcatccataatctgtccaatcaaacatttcaatgcatcctaaatcgttttaaagcaattgtcttaatttttgttcccgaagtgtggtgcactatttatttgcattactgttactaaatacaaacagatggaagtagctgaatccaaatggtgactaacattgtatctcttgcagaagcagcctcatcttcacgaagcaacagccgttcatcctggaatacccgctctgcttcctcctccatgctctgcagagccttgtcaacctgcaattatataacgagttgttcactagccagtacctggtggttaatatcggaatagtcacagtttagccaagtaccaaattatggaacaccaaaattttgattgatagttcagtttgtagcaatgaagttcaaacagcatatgcgattaatttttttcccacttaaagaggtcagaccaaagcatcatagtatggaactatggaagcaaacaacaaacatattactacaggctacagcagaacttttaaatggcaactgcaatcatcactgggtaaacaaccaaaacataactctgttagcactgcaacaaattattctcgaagaaatttctttgcacattaaaccatagtcagaatttagtcttaagcaaaaacaaaaaagcatcacatgtcatgtacaaggtttacattgcccccaaaaggccatacggacagaaatttaaaaaaactcaaccagtgggggaatgactgcccccatgggccacagcttttcattaagaagaaacctcaattcgtggatttcccatactaccagaatttcaaataagagttttgatgaatttagcatgtgatggtcacatcaaatctatgaaaccgtgaacattgaaccatagggaacaatcctgattgttaaggtgttaaagctagatgaggtaacatatcactgcctcaacaccaaattatgcgaggcataaggcaaagcgatgacacataaagtggctgcacagcctggttatgggagaaaatgggaaagaaattaacaagcgaaagagaaaataaaaggaaaaaaaaaccattggaccaaaagacggcattgagacatgtgcgctcccagctatgagaagagcactaggccactgacaagatcaatatgcactcttctgctggccaccttggcaagggagcctgacatctttgcctaccggtcgtggagcttcaatgcatccgcttgtctagctgtccaccactgccactgccagaaatgatacagtggcagcgatctagagctagtctgatggcactggtgcaagttctgcgacactaagctggagggagcaaggaagagatggacctgaactatcaacactcaactgtccttgaacatcttaccatttcaccctttctttctcctgcgaggcaaggcagagcgacaacacctctgcacatcttgccactttagtagcccccttaagatcatcttaccatccagagggaggataatcacgatgccatggaaaaaaaattcctccataccaataacccagcttatgagagacgattataaaatataagaattgtaatgtattctagatgacataaaacttagaaaaggcattccatattaatgcattctaaaatgcagcttggcagttgaaagcttgtcatccttaaaaaaaaaatcagtcaacctatcttcattaaccatattgtgcgcaattgtgtaaaaaaggagatgacagccgaaatatgatgcatccctggcagcatagcatataaataatgagcttacaggaaagcaattcactagtcaatattatgatgtcatccatggggatcagcaaatgaaagagcaaacaagcatgcaacaaaaacaaaagtcataactagagtatgcagaagacatgaaatatatgcatccatacccacctctttctggtgagtttctattaactcaagttgcctctccaagcttgtttgtgtttcaacaactttagccacctcagcctgcaagggacataaaatttattttaaatcacagcaaatgatctaattatataaagttcttttgagtaatataaacatgtatgcatgctaacacacatctatccagaaaagcaccagctcaagaggtgataatggtgggaagacaacatcagcactaacttaattagtactaaacgaagaaattcatgaaatgaacatatcttctcgcattaatctaatgtgaacgataggcagctgagagggagatcatcatagctatcaatatttaccaagagcatcctagaaaaaactataggagatatcacatgtgaagtatttgaatcaagttaggggagctgaaacaagttatttggatcagaggtagcattgcacatgtatttcgcaaaggcagaatattggcatagtttttacatcttcaatcacagtctgactagtgatagggcattgatatacacatttccctgctttacattcgactgataaagctcaccagtgaacagcaaggaaaaagcagttcgttcactttcagacttcctagtttttcattttcctaatttctcattccatcaataatcaaaactaaattacataaaatatatgcaaaagggtgaggataaataaaaaaaatcatgtacacttttaaaagcaacaatacatcggctttacatgaataagtcaaatcaacatgcattgcgcaagacaatcatctactagataatcaaataattattcatgtttcatgttcaatttaaaactactgctaagaatgaaacctccaagtctttgtaagtttgcattaccagtgataaattctagagtccatagggtaagcatggctattcaaatccaaccaggcttccttctaccctgctttcaactaattgtaatcatttttcataaatattgtctttatgcaaatgactttgcaaaaccaaatcagcaataaagaagtaaatatataaccatcaaatcttctgatattgatctagctgcaaaagttcatatgaacagaactagaaaagaagagctgtaaaatgtaaaaataagaacatacctcaagccttataagaacagtcctgttctgcagaattctcctgtcccattcagatattgcagtggcatgcttccggaacttcgcagtgcgatcttgaagttcattattccagtccctaataatctacaatatagataagttcgtcggtaaaatattactgtgttgctcaaggtaattaacaagacaatgcaaagtcaaactagaaagtaagtgttgcagtagaaaacaacaccttataaccgcaaagaataggtgcagtacctgctcaacatttttcccaacaatttctgatggtagcttaggtgcctgtgatgctactggagtgatagcagtagttgtaggactgcaccaaaagaacagggaggccatgaacaaggtcaatatcttgtagcccagaccctttaataagtatgctagagataaatcgacgggatttgtacaaacccagtgctgctagcttgaacagctgaggaagttgcctgactagtgcttgtgatggtggttgaagtacttgcagctacagtagaaacacctgttgaaaatacccgcttaacataaatctggacatcatcaaaatagactgaaaagtgataatcaaaatagactgaaaagtgatcacctcaagatttaggaaacagattgcaaggtaatgattatagtcaaaacagtgcgttacaacaacaatttcctgtattgcataggaaaggcaaatgcacaatgatcgggtcctcaaatgatgatacaaataagttatttgcgatgttatgagctaaatggttacttgcatgagggtgacatttaattgttcactgccggtaaatcaaggtatgtaaatggtatggtcaaattagactgaaaataaaacaatagttttaacaagaacatgagcactcaccgaatgacaatattgactgtgtctgtgttgatggagctgaggcagaagctggtgtagttctctgctggctaaatagtgtagcagttgttgttgctgaaggagccggcgttgtcatggctgcagatgtcgatgcacttgtgactgttgtggtagtagctgtagtagccgcagctgatgatgacgatggtactactgtgaaactgaaaccaccagcagaagaagcaggtgctggcactgagaacaatgaccctgatgtcgcgggggaagcagtagctgctgacggtgtggatgcgctcgttgcagaagcagaagcaaatgccggtgcagaagcagaagatgagccaaacggaaagctgagagaagtggcagacgagcttgctgctgcactggtgttagagaacaatgagggagcaggtgctgccggcgaagtggccaaggagaagccagtagatggagcagacgctggcgtggtgggagcagcagagctactcttcgtgaaggagaaggcgggagcggaagatgcagaagagaacaaggcaggggcggtgctcgcggtcgtggtggttgccgatgacggtgtgaagccgaacgacggagcagaggcggcggtcgctggcgacgatgagaagccaaaggacgccgtggtcgtggccgtggtcgctggggacgaggcggtggtggtgctgaagagtggtgcagaggtagtggatccaaacagcgccgagccggtgcctgctccaaaccctagagccggagaggaagccgaagtagtggtggtactcgatgcagcggccccggtgttcaacccgaagccgaaagacggtgtcgaggcagcagcggtcgcggcagtggtggtgcccgacgcagctgagccaaagccaaagcccgtggcggcgccagagaaaaggcttggcgcggaagcagcggacgcggcggccccgaacagaccgggtgcggcggcggcggcggaggtggcgccgaaaggactgggtgcggtagccgcggaggaagcaccgccgaataagctcggggtggtcgccggggaggaggtggcgccgccgaagatgttgggggtggatgccgcggatgatgcggcgccgaatacgctaggggtggtcgcggtggcgggggtggaggacgcgccgaagatggatggggcggacgcggcggcggcggtggattggccgaacgagaagccggtggatccgaagccaaacggagatggggatgaggaggtggcaggggcggcggcggaggcggcgggggcggacccgaatagggaggagccaaaagtgggagcggcggcggaggaggaggaggagaagagggaggagccgaaggctggggcggaggcgggggcaggggaggaggcggcggcggcggcggcggcggcggcgggctgagagaaggagaaggctgatggggcggtgccggtggagaaggagaatggggaggagccggtggatcccgacgcggcggaagagccgaaagagaaggaggtcgccatggctgcgccggcgtgagcgcggtggcggatttgggggatcttcttttggcagattttttgcgtggttttgccgcgggctcgtcggccgcgccggcttgagaggaaggggaaggaggggtttggggcttggttccttcgtgggtaaccgcttttttgaagtagggtttaggagggggaaaggggatttgggaggaaatgttggttgttcacttgttcttgtgccttcctggtacgtatacctaagcatgatgtgtgtgttatccaccaaatttgaactagagaatggttcgttctcacttatacgaacctatcgtagtaggcaaaatttgttataggacacccgaaaatcgtgtaattggttgtgagacaccataaaattttggttttgcccatggacactatgaaatttgtgaaattggctgtgagacaccagaggcaatattttatagtttccgaggcaaaagaggtcaaatattttttaaaaaagaccaatctaccccctgcacccagctgtccatctccctccccaacccgatttcccagtctcgaaccctaaccctaggcgacggtggggccggcggcggtggcggcgccggcggagacagtttcgacaccggcgaaggtgttgaggacggcaacgggatcgagatcacctgcagttgcaatggtgactgcaactttagcagtccttgtgtgaccgttagatcaaagaaaaacagctcagatttgaccagaacactgtagcacgcacacatagtcctgtagcgcactgtagcatgtactgtagcattggcaccttggttgtgacgtggcataactatctgtcgttgatcagtttgatccgacggttgcgaatggatgtgactgcctaacttgcagtcaccgttgcaactgcaggtgatctcgatccacggcgacgacggcggccgctggagctgtgatgatgacgcagtaaatcgatccttgtggcaaacccgacgagtcctggcggcaagtgcacggtgcggcggtttcaagccgatagcggtggacggcggagctcagtttccaaatggaggacacgttctctgcacagccgtcagttaattaactaattaagttgtcctttggtgacaaatatttcctggtgccatagaccaattagcatctgagtggattataacagcaggtgcatcgtcgccgtgcaggattgaggaggaagaagcagccaaaggcaataatggcgcaggcggagaagacgagcgagagattttctctgtatgcggaatctcctgctcgcttgatgtcaggatcgcgccaggcaaggccctattcgcgtctgtgcgcggcgcggcgcggcgcgcacacgccatgccagcatgccatggcatgccaattgcgtaggggtagattggtcttttagaaaattatctgacctcttttatctcagaaattataaaatattgcctccggtgtctcacagccaatttcacaaacttttatagtgtccgtgggcaaagccaagattttgcagtgtctcacagccaattacacgatttttgggtgtcctgtagcaaattttgccgtagtagtaaaagtcagggccgtctctagaaatttagggtcccggagtgaaatgcaaagtagggccctataatttaaaaatcatgtacaacataaataaaatatattttcacttaattatatagatgcaatatgtgttctaatattatgaatttactatatatatcatctactcaatcactgtctaatcttacccgtctaaacctccgaggtcgagttatcgagggttgagtcgacgatgaatagcggatgaggaggaggacggcatgagctagcagacgagacaaggtagcaaggcaaagccgtcgccgctgccgctcggagcgttggaatcgcaagtagcaagttgtatcgctatcgccgccacctcaatcgccgtgaatggaattgggatcgtcgtctcggtctctgaaatcggcacgtagaattagatcgctcagcaaccaacaacaggacgaaatcaacgatcgcacaacatcctcttgattttgggcaaggcctagcattgttgatctatccattgggctattgcctattagatgatgttgtattgcattgctatatttaaagtgggccttcatgtttatatgggccccctaaaaatgggggccttgtgcgggtgcctatttggcacatggccatcgatggccctagtaaaagtttcaaatgtttgttaatctctttgcatatgcattgaactatcgtcatatgttccctgcaaaccatttgaaatatttatgcgacaaagtaaaagtctcaaatcatatttgtgaaatctcacatacttaggaaatacatatatttttcattcattacatcactttttttgtccatcatccatatttagttgcatccagatcgttcatccgtaaaacacaaacacaatgctacgattgttggtaataaaaaggtgacccaaatcgcaatgtacttaaattcaaaacataccatcaaggtttgcggatacatttagaaggcaaaactatatgttgtcatatcaaacacacatagagtttttgcctttttattttcacttttcttgagtggcatatatcgaaccagtaaagaaaacattgaaaacacaaaatcagtaagaaattctaaggtgtgtcattgataggaatctaatttatcaagttgcgattaatgaagttacaataaataccatcttataagacaatttgtataagaatgttattgacgtgacgttccatcgatttaactttgttagctcatgtggagtgaacattttaccactatataacaattaagctccttaacgtgaaaagaacaatgatatcgctgcaacaaatcacgctctagcaaacatctccaagcccttcactcttataaatccgttgtcgctggaaagataaaaaccacaaccatcaaaaggagatcaccggtgagagtgctagcaaactttttcatgggtggtgtggcggcggtagtagccaagataggggtcatgtcgggaatcctgtgctgtcgcttcacgccaccgccaccgcttgaaatgcacgttaatgttgttttagcctataactatcttcgtcctcacctagaagcgatgtgttactaggctttccttacttgcaaccgtcctaactatattacgtacatggtaccatctattttttaaaataaattgatataatgatttattatagacagaagaatgtgaaactaaatatacattaagagtacaacttaaaattatttctctcctcgtagaaacgattatccgtctataagaaagttaacggggaaattccggtgatcaatgtcgagataacgttccatctcaaagaaaaaaaactgagaaaaccataatactatggaaaagtctatacgtactaactttttcttactaaatttttactaacactgacatgccatgctataagtgtatctagatttttttataactttcatctacttgaatcaaacggttgagatgattgttagtataaatttagtaagaaaaatttagtacgtgtagcggtgctctaatccttttaccgagtagcaacaggctaacagattcagagtaggcagttggatctcaatcccatcccgtcctctaaaaataaaacaaaatcgggaacaggaaacccacgcacgaatcgattcccatctaggcatctcttcccagagagaagaaaaagaactctcccgcagccgatccccaaatccccacgcatctcatggcggcgagcctgtggcgggcggtgatgggcgccggcgcctcgtcggcggacaccgacaccacgggcggggtggagttctggcgttcgccggagcgcgcggggtggctgaccaagcagggggagtacatcaagacgtggcggcggcggtggttcgtgctcaagcaagggaggctcttctggttcaaggactcgggcgtcacgcgcgcgtcggtgccccgcggcgtcatccccgtcgccacctgcctcaccgtcaagggcgccgaggacacgctcaaccggcagttcgccttcgagctctccaccccggcggagaccatgtacttcatcgccgactccgagaaggagaaggaggagtggatcaactccatcggccgctccatcgtccagcactcccgctccgtcaccgacgccgaggtcgtcgactacgacagcggccgtcctgccgcctcagtcaccgcagacggcgacaagtgatcgatttcatcgattgattggtgagcaaaaggacctgtggttcctgtaatactgcagcatatccatggtacttacttaggttttgcgattatggttcatgtttcttgatttgcgaacgtaagtgtgcatttgtatattactgatgcttatcggggaataaatttgggagtttagtgtataggatgcgctctgatactatccaccagttcactccatgtaactttctttaataaggtacgatttgtttggtcaattggtctgtgtttagttgtctaaattcttagatcaagtgtgttggtgaaaccgtagcaaatctttcaaggttagtcctgactaactctgcactcttgcccgtaaatagccaactggctttgatctatggaattataattcaattgtatatctttattcatgatcttggtttgctatagcaactgtatttgattgacagtggtgaacttataccagtgcttagtgcttatgcacagtaaaagcgggctacctcacttttgccttcatcagaagatgcaatccattccagaattcctttcctgtgaaatagatatatactttgttgtttaacagattcaaggtgcaaggagtgattttcaagtatagctgtatgattatgtgcataaagcacctaactgattatgaaaacagttgcaaccagtgatgttataacttacagtatagctctattggtcacaactattaagtcaatcaaatacctccatcatattgtcgaaacaccaaggctgtgggtttatgataatgaatattctaagctatagatattatttctaattggctggcctgattcataagtcccaacaactgttggccttcatggaatacatgatgagcaatattcagtatagacttatggagctaatccgttcatggttcattttggtgacacttgttgatatctttgtagtaaatattgttatttctctttcgttttatcatgacatgtgagtgctatctgttatgtttgtttaaaggaatcattctttgtatgcctagaaagatgcttcctgtcacaggttgtattatgtaactttttcattgtaacatgaagttaaaactctgataaactcatgctgacataaacttgccatcagtttatcatgctgacataaacttgccatcagttagatgtggtctttggagaagaaactttgtacttcctccgtttcacaatgtaagactttctagcattgcccacattcatttagatgttaatgaatctagacatatatatctgtttagattcattaacatctatatgtatgtgggcaatgctagaaagtcttatattgtgaaacggagggagtactttgaaatgggtaaacgaacatagtctgagatgcaaaataaatatctgaaaccaatcctggttatgaattatgaagcctatatgggtaaatttgtcaagaacacatgtttatattcaagtattttgttgttttgaataattactttttgtgttgaaaatccaaaattctattaagtttcagtaatatttttgtgtagtagataagtagaagcttattgctttattttactcaacctgtcaacataatttaaatctctagtgttcctttcttaagatgtctgtcgtctataaagttagtctgtgcttgctgttgtgtcatgtttttcaattacacaaccattattacctgccactttgggtttaactaaaaggtagcttgtggcagatgtgggaggaggctaatctcatgagattgttgaacactagaacttgatgtcgccattatcaactcaaaaaattatttccatgtcagttaaaagcgtgtagggtagaaagatgtactgtgaatgttacacatgcataatgtactgagccttgtggggtatatatagattacaaatgcaagagtgtagggtagagagatgtactgcgaatgtcacatatgcataatgtactgagccttgtggacggtatatatagagtacaaatgcttggatctcaaagaatcatagagacaaaaatcaatcacatcctaccataacaaccggatcatttccgttcatatccatatactcttaacatcggtgatacatgggccgtttaacactggtgcatagtaatatacctaacctttcggttttgcttgcaactatagtacatttttgtttgttttgagaaaggtatcgtctgattctccttctattgattcttttccgatcaagatgtatggattcatatgtctacatacctagattttggtcatgaattaacggaaatgtgcgagagctttatttgcctttgccattctatgagtcagctcatacctagattttattcatgaattaacgaaaatgtgcaagagctctatttgcctttgccattctattctatgggtcagcttgcattttgcgtatgacacccccaccctctttagcagcatctactaactcggaacttaatttaaaagccatattttgacccagacgcttttgggatgcttctaataaccaacgaatggcaaatgatctcccttatctatatcctattcaatcagaactttccgcatcgatcctttttattacgtcttgtttttactcctatattcttgtctagatcctattcaatcggaactttccgcgtcgatcctttttattacgtcttgttttcactcctatattgggatttaccagtaatagtccttcctttagtttcagatccttcaaggcttcaatcctccctcctagaaccctgttccctgcatttgtatgtcaatgaaatgaatgttcgggtgaactgtatgtctatcgttttatctactcccatcatacgtgtattgttggctgtatatatccacctatggatatagaggctggatttctatccattatcttaaaaaaaagatcatacgtgcattgttgtcaatgtctgcagtgcacactttcatttgctagagcaaataactcacgcggtcatgccctcgttccctccggtttgtttgcacttcagttccagctagcatccttttcttctgttgcattgatgccgaagcgagaaggcaagaaaccatttgccatggtgctcgaaggcttgtaagaaaacacgggcatttgttgtgacttgtacggttgattagacgagccgtacgactaggatgttgctgcctctttttttttttctcaacacgttacagtttcctacatacaatatagcacttcatcttgtaaatactttttcctcccctacttaatataacaccagctttgttggcttcatttttttaaaaaaaatatatactcactccatttctaaatgtttaacaccgttaactttttagcatatgtttgactgttcatcttattcaaaaacttttgtgaaatatgtaaaactatatatatatatatatatatacacacgaatcaaatgataggaaaaagattaataattacgtaattttttttaaataagacgaacgatcaaacataattaaaaaagtcaacggcgtcaaatatttagaaacgaagggagtatataacttttttttaacatatatagcacttcatcatctattaacccaccacaagtccacacctgtgcagtgctgtgcagagctagtctcagttggcactcccggacggcccggtcgcccgcacggcttcgctgccgtggcggatccagtccacggcagcgggcgtcgcaagtcgcaacgcaacgaacggcaggggcagacggatgcgaaacactcggcgcgcgcggatccgacgcgagaccagggcagctaggagaacggggacaggagggccccgcgggcgctaaccgccttgtcaccacggccacacacactgccgtgcgcgcgattccctcgtcccaccctgctgaaaaaggcccgcccggagcgcgaatgcatccgtgccgcgtcaagcaactctcggtggtgtggtgtccactgtgcagctcccgtgcaggcgttccgctttgatggaaaccgccgcggccgtggtgtgccgaggcggcgggctgcgcgcgccggcgcgtcgcggtggcagtgacagcagcacgacgcgcgcgggtggcgttgctgcctccccggcgcccgccaccaccgcgcgacggaggccgctgctcgtcgcgtcgctcggggagcccctcatcacggcgcaacccttgtcgtcgtccctgggagatggcgccgcggtacacgagacgctggctcgctccgattcggtgatcccgtcgctgaagccgtctcactgcgttgatcactcggtccaggttgacgccgacgaggagaccggctccaccaagacactcccacctcctgatgacggtgagctccactcaaaaattacaaaatcacaagacgatgcgattctcttaaacagctcatgatatattctaccctccagttcctacgaagacagtgcacgtcaaattcgtgctgcaaaagcggtgcgcgttcgggcagcgcttcctcgtcgtcggcgacgtcgcggcgctcggtctctggaatccggcgaaggcggctgctctggattggtccgaagaccacgtgtggacagtgaagaaggtgaatcccatcacgcgaatccttccattctccgtgtataatctcgtaatgaatcatccccacttctgatctgtccaggaattgccagcagaaagatcgatcgagttcaagttcttgctgcaagatcgatcgggacatgtcgaatggcagcacggtcgtaacagaatactgcatgtagctgacacctcgaacaccttgattgtctgcgaggactgggacgaggcgaagaatcagcaagtatcagaagagattggtgacgcagatgggatattttcaggaagcgatggcgtcttccaggaagatgagcttcaactgggtgaagaacaagagaccaacaagggtgtgactgtaggtgtggatgatgcaaaatcggctttagtcacttatatttacagggaaatgatgggagcaaacgacgcgatccagccacaggtaagttgcctggtgacagtattgttctgtgtaaaagggcagcaaacatttatgtgcaacaatatactactccctcagtattttaatgtatgacgccgttgactttttgacaagtgttttacatttcgtcttatttaaaaaatttatgtaattataatttattttattgtgatttgatttatcatcaaatgttctttaagcatgacataagtatttttatatttgtataaaaattttaaataagatgagtggtcaaacgttagttaaaaagtcaacggcatcatacattgaaatagagggagtatttaagatcagcttcttgttaatttaatcgtccctttttcttttctaaatcagttagcattggacaaacaccacaagattccagatgagcttagtggggaggcaaacatggcagcacaagatggcaatcacactgctactgcagccgcagcttctggttttgctggaagcaacggtgaggatgccatcttgcacaaggagggcgatccagtagagaataataggctggggctggccagcattttcttcaatgacatggcctggaccaggaaagccctgcagcagttgctccgaagccttggtttccaaatcggcacgagaaaaacatgaagtaagcatcagagacgctgacctgcagttttggctgatcacacggtctcgcggtgccttcattcaaaactcgaaagcttctacatgctgcaaacctacaaggaacaagtgtattgagaactgcaacaaaaaaccctttacgttgctaaggtctgcaacaccagcagtacttgttagcagtgcaaaaagagcaggaaagctgttagcagtgcaagtatgtttaggaccagtaatgactaagctaccaaaaaactcaattagtgaaatgcatattgtggttaaatttatctgttcgataaattctgtagaatacatctagaataagagccaggaaaagctgaaagtctggagatttggcataacatgtgctccataaccacaacgtataagctcaaccacatgtactttaatccaccagatttacgttcatttctcaatcatttcagttgtaatgctaatatgctcttgttctggtgatctagtaaaaatgatgtccatgatttgcaatgctttctttaatttacataagaaagctggcagcatttaaaacatgtaaacgtgaaatatcagcgtggacattccactttaattaaactaacttgtttacaaataactgtatccgtcaaggaaacagtcaatattcatgacatacccctacccctacctgtttacagctatccaactacgccagtatcctgtgaagattacagctttggttgtatggagcaaacggtccaaggtcaacagaatccacgatgcaccatgcccaattctctataatttatcaccttctaaactcggagaggcaaaaaacactttgcatgaaaatcatggttcaagaggcagccagccaaccataattggagaagcgcttccagtaataaaccaatggattgccagaatgccacaattttgaaaatggcatgttatcaacagctggcctcacatttcaacattatcaaactcacctctgtgggatataaggggaaattcagctgttgcatctggaataaaaataataagaagagatgacaagctgtaagataagagagacataaggactgaataatgattaatttacatcttactatccagaatacaagatatttttaggaagagatactggcaaaaatactcaatgaagtccagaacaaaacattattcgtaaataaaaatagcattcatctgcaaattaagatatgttgacgtgcaaaaacggcaagcatcaaatagctaccttactggtctcaaatgcttcttgatttgtgggtccgtagttgttttcaaggtcttcagcgcctcttctgcagcctgaaacaaaatgtttagtggtgagtatcaggaaaccgcagcaataaagaggctataacagtgctgttgccccctcgagacagaaccagcacactttgcaccaggcagttattagtggttaatgcaagtaactggatagttaggcaagtcctgataaagtttttactggccaaaatatttccattcagttttgaagtttaaatgtatcaaagtcactagaagacctacttttgttcaaaatgatatcctaataatggtaatgtgtggaccaagtggacagcattcatgggttcgaatcctgagaaggatttaatttgttagaaatcccacaagcccttttggccaaattggtaatggtaaagatggcatttccaaattcccacaaactcttttggccataacatatcacgtgaacacaagctctggtgcactcactgtgcacaccaactgacatatacatactcataaaacagagagtttttttcttttctttttttttccttttggtaaccgctgatatttaatggatttgaattccaaaacttatatataggtggagtaagattagaagtaaatgaacaattttatttaagattttctggtgacattggttagttgttgtgcacaaagtgcacctgaagcatgtgtgcataggaatgtccccccttttagtcgatgttaaggagtatatttacatctcatgttcatgtcagcagacttgaagctcacctgccattaaatatcaaacctagtttacgggggtgttttggccacttcaggaacaacttcaaatttgcacaatattatgaggccggctgaaacaggtagaattttataaggcagcttcttggttcaagcttgctagtgcaattaatgttgggacattaattttggacaaagtcatgctggtggagcattctaggagaatgtgattcgggcttgttgcaggcttgaggcagcaacctcgaaacacagaggcatctttagtattcccaataattgtgcaaatgtcaaaagtcagatcctagttagattagtatacacaattcctattagacagattttctgcaataaagcacaatatcatgtagatatatacatatgaaatgtacaacactacaatctttgcaagccagcaggtgcctcatttatcacatctgcgtgcaagtcagtgcaatgcctgatgcaaatataatttagaacgacagaactcaaaaaagtatttaaagtggcaatgcatcaacacataaaagctatgaacaaaaggcgagagcaatataaaatatagtacctgaagcttcgcaaaatctttgttcaaatcaatgcccctcccaagaatttgtcctcctaattcagcctacaaaggataacaacagttgcaacattaattgcattaacaagctcatataagttaattttaaataggcaattagcaaatatccaatttagtttagtttctaaacacttgccagtataatacaggaatatttgtcataagctaaaaaaaactaggtagcaaccagccggctccctctggcaagtagtaaccagctagttcccttcttcaaacaaaaacccaataccagacaggtgagaactggtctgctccagaactgcaacacccgggtacactgtggtataagccagaaggcccacaactatgctaggagaattctagaacgatgcgactatgcaagttaattaacctggaaatggtattctccatttaatgctgagccagaatcccgtacttgatcgcgaaatactacatgttggtcctccaagcactagaaatagcaattgcaaattacaattcaattaagcaaagttaagaaaagaaataacacattaataaggacactaaaatggaatataagtgcagcagcagcatctcttacaagttctctaataagacttataacagaggacaacctatccaaagcttttgaatgatcctgttcttttaatgtacttccagatggctcttccatagaaatatcctctgagagagtaatatcttcgagaaagccatttccactcccaggaggcttgttcacatctttattaagaactccagcaacaggagccatgaatgacaagtaattgcctgcaagtcagccagataacaggatttaaggcacatggaatttctcatcagtgaatgctttagaaaaagaatgacacctgtaaacacggaattgtaaaacaaacgtaacttttcaagcttgcaataatcaagatgtaaaggattatactcactttccaaattctggagagctttttcagcagctagtacttgggcttcatctcttgtttttccaatgccgatcccgattttttcattactaaatagaacctggaacatcatatgtataggtaacatgaggatcacatgattaagtagagatatcacagcattgctatacaaatctggtaatgcacccgcaagcaaacagcttcagagcaaaagcactggactgatgctgaagttgagagttgagacgccaaaggaaatgtgtctcaacattctaaatatatatttttctcaattagaatttcagcccaagctgttgccaagaccacatggaaacgaagtataatatgtaaaaattcaaaatgccaacctcaacagaaaattgcatgttttttccactgcttacagtagacctgaactccacctaatgaagaaagaacaggagattactctcagctcataagggcaatggcagaaaacaaatataatcttaaagatccaaataccctggattcgcacagccgtccaatttcttgcaacaccgtgacaaataatgagggggttgttgccaatgatcccccgttagattggatatttgtaccacctggaatgccacggagtgccactccgtcgtcatctacaaagattggtttatgttactcgaagcatcaaattacagatccaaaacaatatatgaattgtacttctttaataatagtgaggtacaattaggattttcaagcataatgttgatgctgctgcatttcatagtagagtactctttcctttacagggaaaaaatggtacagagaaaaccattccctcttttaatgtccgcaaggtaataataaaaaatgactaaagtgatttataaatgcaagggttcaagaaagcccaggaagaagaaccaaaagaaagccaataaagataatggacatgaggtaagtacctgacaaacgggttgatgatggtatttgtttctggtctctaggatatgcctgaaataaggaacacactagcatgatcattatatactagtctattacaaactgataaagaaactagtgatgattttgctagctaagtgatagaactgtggacttaattttgatacaaggacaaatccaattgtaagccaaagaaggatcaatttgatacacctacatttcttctaaaatgaaataacacaaagtagatggttataaataattgaaatcaagctacatgacagcatttatattatgctgtataacagcgcttaccatagaaataggcatcattagctgatttgatctaggtgaaaaaaaaaatcaagtccctaaaaatcaaagcaaagcagaaacgaagatcagcactcaccagcccattcaacctcttccctacttcagctccactcataccctcaggtataggggcaacatccttattgtttggtgcaaaattagtgtcctggaacaaaattagcagttggataaccatttagaaaataaacacacacaaaataacaacgattcaataatgttacctcacagactaagtagtcaccaacatcaggagcatatggaagatctagcaactcattttcatacattagttcaaacacttttctcaatagattttcatcgaactctctgcaatgcattgatgaacgcaaagaataacattacaacagtaagcatgatatcatcagaatgcacatacggtatcttatattttttaccaacctgaagaaaccaccacgaacattgcaagcaacatttcttgcaacacaaagcacaggcacagcatttgccatctaaaatatgcaaacagggtccagaatgagatattgttgaccaaaaaaagtgtaagcaataaaatacaaataaatacctcagcttgtggggcataatatggagtatatgctgggacaacatgaactcgaggttgatccttctcatcccaaacctgcagtcggtcatcaattaccatggccatcttcggatggcatcctttgtctttaaaaacattctgcagacactttttcgaacctgccatgaaatagaataatgaataatattggtggttatgtccatgaaattatggcaggaacatagtccagagctgagacaatagagatagtaaagcgaagatctatgttatgtattatccatataatgggcaatggcaaagcgcaatttctcattcacttaagcattctacacaaatattatattgtttaaactaagaataagttttatacaaatttaaacaatatttagtactacttatgcactatatttgaagttgtaaggataagaatgaaatacaatactaagggaatgaacgatacatgctagaaaaactatgggttttctctctgggacactaatctgcaataccgaacccattccttctcaataacttggaaacacaacataatttcattgtacatgaaaagatagataacacagaatattcgtgttcagtgttttaaagtagctactctgtgtttagtaacgatgtcaatataacaaaacatgttgagacaagaaagcaatgaaagatagcagaaaaaaaagaacctccaatttcttgaaaatttacctgactttacacatactacacgctctgcaaggttatgagagcttatcaagttggcttctggatcaagaagcctccacatctcaagagcataatctctctcagccattgtacatacatagacctcaaatcgtttgcgtcccttagcagtcaggtaacttctcaaatcctcccaagcaggccttagctttacaaaaacactagtatcgcgaacctgagcagagtattaaaatcagacaggggataaggtaatcacctcaaaaaagggaactaattacagaattctacaataattaaaaactctagttatctcaaaattttgaataactagacatatgagaattatactgagcccattttcagtccagaatgacttaatcagcttgattaatcgtctcagataagcattacaaaaataattactaaaatagaatctcttttttctaattggcagcaaacatatgagctgataataacacattgtgtgtaggttgtcaaactttgtgttaattgttatttcatcatttcccaaaccatcaggctacaagttcatttctgcatctgttttattcataaacatcacatgtacaaagcaaattatgtaactatgcagatcatacagacctgtaggtagaaacaatgagcctgaacaaatatgtcttatccgaggatcaaaactgcagcaattacaagtcatttatagaacttatttttgtaccatcgctaataaccaaatagacatacagcatgccttttgtgggcagcaaattggagcccagttctatttttccaacccaggaataggtccaactgatttcaaagtgtaattctagataaccccaggccaaaaacatgcacacaggcaaacgataacaacatttcatttaaatgaaatatatttatacatgatctatctgaattgtacctctggatttatgcgagttagaatcgcattcctttctggcagcctgataacaggccggagaacacgctcctgcccaccagagataggcagaacttcctccttttgggtcccaacgattctgccattatctgtaactgtatctgtgtcaatgaactccttgagcagctccctgtcctcaatataccgcttgatttctgcagacatccctgctatcctgacggggtcgtcttcaatatccatcctacgggaaagcatctcgatccggtcctcaaaggacttcattgtgttagcgacaataagggtttcatcgagatcaaatacgatagcaaggcaccgcaagttcagcatcccaacagatgctgcatagatcccagagcgtactgaacagcaccaaaagcatggcaccttctccaccttgctcggcattgccactaggtgtagctcctcatctccaactactaccactgcgctctacacaaacccaaggagacaaaaaattttataaatcctattatttcgtgcccctgatggaaatatcatcaatgggaaacatcatccgaacgaatcaaaccacatcaaacacacaacccatcgaagatccataatagaatgtgtaaaacgctttgattactggtgattgccccaaaatttagaagtggcgctaataccatttcccaagtagtcgctgtaaacaacttatttcgcttcgatttcgaatgggagtaccagctatactaatacaaagcgatggacatgagcgattgttgagaaattgcgtgggggcaaaccttgtactcgttgaagcaagtgaggtagaggcggtgtaggctcgggtggggaggcatcagcttggcctggagcttgcatcgcacggagaagggcgcgatggtctgcaggatggcgagcggcgggcaccgctcgctcgtcggcgagaggtggctgatgcggatctcgttgctcgggaacggcaggctcccctcggccccctgcttcatcgggaacacctccgcctcgccgaggaacacgtcgccgtggaacatccgcatggtgaccccaccggcggtggcaccggcccctcctccggggacggccgcctggggcggggcgcggggcgtcgccatcgcgggcgagagggaggaattggagagagagagaaggggggagagtgagagcgcgcgcggcgtggcgtgcgcgagcgagagaggcgccttttgcctctccttggctgcggcctgcggcctccgcctcccgcttcgacggacgcggattcgcgggttttggcaatttggggggaagaaaaa

SEQ ID NO: 68539 - DNA, 1088 bp, Oryza sativa
cataaattaaaaaaagtgtgaggatgccccccaccaaagagggggggaaaaacaaacaaaaaaaaaaaaacttataaaaggggggtttttccggcgaagtaaacaggtccagtaggaacaggttttttttcattaaagtttaaccaaaaacatttttcccttttaaaaattacggaaagtagtaaccacacgctttgtgggaagattcgccctcacaaaaggcgatgaaaataatgtgtaatccggctgttcgctatcgggagaagaccgtaaacgaattttgcaggcgagatccatgcacgccttcgggtaggcctattttaaactgtccaggggaccgcctgcaaatgggcggcgagggagggcatggaattttgcaggcggcccccttgccgccctccgctagggcgattttgtactgtgggggggggccgcctgcaaatgggcggcgagggggcatggaattttgcaggcggcccccttgccgccctaggggagggcgattttatactgtgctctatatttttgtataaatatcaatagttatcaaatctttttatattgaaaactatacaagattaaaatctccaagactggtaaaatataattttattattttttagggcatatttggattgttaccgtacaaatattttgttagcgccaaaatataagcaagttttggcactaccaaatatttggtaagggaaaattgcatttgatcatatttggcttgctgccaaaatgtaaaattgtagtgaagaatgttctacataatctcaaatctagattacgtattaccaatgaataggcttccattttcgagtgtggagtgctactgggaaagaagatataaagaggttgcctttagattgtaaattatatagcggtcgttttcactggcatatatgtgaacttaatgagatacattattcattaaatgtgacaagacgaacacgcgggggcgggaattactttattgtaacaaggcggcgccccaaaggttggaattagggtgggagaatccccaaacctttttttttcaaaagacccttttgttccccccccgcccccttttttttttttta

SEQ ID NO: 68540 - DNA, 24725 bp, Oryza sativa
gccggcccccgccgctcccactcctgctcctcccctccctcctctccagtccactcgcgccgccgcctccatttgcgtccgccgccgccgccctcagtcagcgccgcatcgggtccttctccgacgccggacccccgccgctccctctcctgcgccgtagtccgtcctcccgccctccactccctactcacacgggtgcaatacagagaatggcacggctgcaatacagagaaggagggaaaaggcagcagacagaggtaggggtagtttggtcataacacaaattggaaatagagcaaaaacattagtattaacccaaaagacccaaaatagtattttagtgaacaccctttagtttaggatagcattttaatgaaccactttgaagggatagtatttcatcgaaaccatccttttacaatagcaaaatcataattttctctccttttaactagtttcaatctcgttcctctccccgtgtcttccttcaaaaagtctagtttgcgaatgtgacgtgccagagttccattttcctcttgacagcatgttgaagggttgagcctgagtgggttgatggaccattatgttttttatgctttccttactcattattacttccatttattttcttaccaattttatgacccaaaagtagcatactagtaacttaaatatttatttttgtacaaattataatttatgataaaatgcttcgtagcataaagtttccgggtataaagtttttattccatcataaggtgtcctagtataaagttgttattccaccatgaaatttccaggtataaagcttttatcccatcataaagtctatgagtagaaagttgtatagctttggtagatatttgtttgtgtataaattgccaaaaatatttagagcactatagaaagtttggagtaaatgtagggagatatatttcatttaaaatgctacaatacgatagaaatatggtttggttaaaaaatacagtaagtatctttacaagtaaatttgtacatatcacaattgtcctaatttcactagcgaaaatggatagaatgtgtggttctcttctaggggcatcgtaagcgaacatttagctggctagtcacactagccatagtaggctacctcacaaccaccagcatactcatttcattaaaaaaaggctacttaggagtagatgtgatacaatctaatgtaacgaatctagacacaatctagtataactaatctggataaagtaataatactagattgtatcacattttctcatatattgatttttttagaaacagggacttagagggagtatagtgtggttccctgatccctagcttcccaacactgatcctccgtgacgcggaggttggtatgactggtggccgcaaaatctgtggtttgttgtgatgcggtcgggcacccactgggtaggatgcggttcttgtagatcctcatttgatgggacattagtcgactaatttaattgtccttcagaagaccctttattaggccaaacgtgtcactttgatggtcgtttgtggaccgatcgaccttgacgctctaatatgccttagtggacccaacaatagtaggcaaaaaagtggcgctctgataggccattagttgattgaggatttttttttggattgcttgaaaacttccgcccgttttttttttttgcctctaaaactttaagatttgtggccatcggattgtattaagatttgtgcataaaggaaaaaaaatgctgaaacagaattttcacataggtcacacgtaagatctcggtactagacaaccaaaccataattgaatacaagttttatataagttatatcatagttatagtgtagttacagtgttgttacagtgcagttgtagtgtagtttcactaaaaaaacttgtaacagttttttagatactccctattatttttaaggaattgaatttcacgttgacaatcccttagaattgaaagcgtcaaataatttaatatcaaaattttctgatcgagaattgaagactcgatcatgggcccaggtaggagagcagacaccatagaccgatagactttctgctcactccacaaacctagctctattttttaaatttaaaatacatttttttccgtcccctgtgtgcataggtagctagacaacggaagaattccatgcaggcttagtcgacttggatctctgatttgtagagagcgttggccttccaattatcggggatgacgtcgttggcgacaagcttctggtcagactcggtggtgacacggagggagaaggggcccttgagtggcttgggagtgtctatcctccagatagcaccccatgactcgttgagtggcttccactcctcagagcctttctccttaagttccaccttcacgacatcaccgtcaccaccgacgtacttgacaagcactgcaaagtagttggggttggagcccttctcaacgtggaaggtgaccttagtctcaccagggtacttgcagcggacgcgacgaaactgcatatcgataattcccgccttgcggagttcctcatccttgccttccttagccatggcaccaaaagcatggccggagaggtcgaagtggtaggcggcgataggctcagtgttcatgtcggtgatgtggatgatgacgggcttgtcggagcaggcctctggcttggaacacttgacctcaaagcaggagccgcagcccttgccatccttgaagatagggtcattgccacatgagttcatgccgaggaagggagccttgtcaatgtccttgtacccacaagcgccgccgttgtcgtcggggccggcaccctttggcttgccgtaccaggtacccctagcttccagccactgtttgccgtaggccgcagtgatgttggggccaggcggcaccttgggcggcccacatgacactgcagacaccatggccgctgccacgacacaggccagaaggagacaagaggatgccattgttgctgatgggtgttagttatttgtgaatgatgtagctcggtgctatggtgggtggtatttatgggcggagacgggaaagccatggatggagcgccttcgggatcgcggaaccacgcgagcgtgaaacgggctcggggatggacgcatggcgagtattagttttgttaggctaagcgccgttttcggatatgatgctctaattatttagatgaaactagaaattgaaagaccaatttttcttatactgcgattagctttggtccctcctttctgttacctagcatgcagctccaggtctccctccctccttaagcatgcacgagtttgcatgctcagccttgcacaacctctctcttctatctaatcactcatttttagttcatacttcatattaaaatgatggagggggcaattagcaaaactttaaattattttttcttctaaattatttatcttatcttttatttgattatgtcattatattttttcaattaaatctttataacaacatcgcacatgattatatttataataaaaaaattgcatgaatatttttttcctaattgaaacatttttatattacatatgaaacatcgagttataactattgaaacattaaaaattatttactaaaacattcgtaaaataccacatgcaacatttatagataaattagtgagacaccacaaaatattgattgaaacatctgaataatacaatgtgcaacattatccctagcaataaaataacttaaaatatgaaacatagtgaaattttagctggaattcgcttcttgtacgtgaaactgtaggggcacctggtttgagctcggtgtaccacgtattcactcatgatcatccaggatttcgatcacgcataaattgataaacatgacaactttcgatgactttttatacaagtttgtatattgtggcgtcctagaataatcttaacaaatgaatggtaaatctcaatatgaaacgaggatgagccacgcaagcaacaaaataatgaccgtctgattcaaacgacgacaatatagggagaaagtatcgtagccataggataagataaatggtaagaaaaaaaacttggggcaaagaagaatctagataagtttagtaaaaagaaaaagaggaccagtccccactgttgggctatcgtcgctgctgcatcatcgatgttgccggctcacctgcacagcaattaacaggacaagaagcgctcaggcgtagagggactgcaggagcacaatgagggaaagatgagtaaactcttcctcagcttccaccccaaccttctgtctggcctagctcgtccattgcagaccagcagctagagaacaagggagagttagagagaactagagaagcctcctcagtaacaaggaaaccggagaaaatgagagagagagagagaggggggggggggagagaaagagggttgtgcagctcacagctccaaagtcccaatgccacctgctcgtgacatcggactcttggaacttttttcattttcatcttagtatattctatcctatgctccactgaaaattaaaagtatttgagcaaatacccccatattattactcacctttttatatcaaagaccttataaatttccaaattacactattgtgtatagcactttacatctgtgattttgtttggcatccttttttaaaaacctacaatgaatactagagcatcgcaagcagcttataattatcttaaactagatcattccacttcttggcgggcacataatttaggaaatttcgtgagacaatgagcaaaattctctaattttggttcacggtaagatttacttattacaagatatatctatttatttataactaaaattcctctttgaacacctattaagcgtgacaaaaaaaataaatttacaaaaatatatgtagcaatagagatggttagaaggacacaactcaagcaacatcgaagagaaggcagttatagttgcaaagatagaaaggagaaatgccagcatataagacaaataaaaaccctaaccatgattcttgcactcatcattttattcagtcaaaatatgtgttgagcatttcaaattacaagcctattgttcaaacactaattttgtatgtacctacggtaaatatatgatattatgataatattgttagtccctttttggaagaatattattaatcccgttaatgctctacaaacacttattcaaacataaggatataaatcaagataaatccataaccataaataacatgtaaacatatttaacaacaagatagtttataatcacgtgaagaggcaacttaataagctagttagagggaaaaaaaagaaaagcaagcaagcagtgagaagagctagctagcttgtatgtgtgctgtagttggccttgggcgaaagctagctaaccgtgcatgcagcgacggatttgaggatgatggcgggtcctctcctttgacactggccaggcatttccctctttgtggacgtcctcccttcttctgtagggagctccataagtagggaggaggcgatggcttgacaacaggggaaggtttggtccaactaagcagtgtggcccaactctgggctcttcatggctggattcaacaaggaggctggtgggtggcggagcgaaggagacgtgagatagtgcgcggaaaagtggttgccgggtagagagcactggcgacagggtagggtcgtctccctagcttgatgtcggccgagctacctcttttctcgtggaaatgttccccttctctatgggatgctctataggtaggtgggggccgcagtacattaacatgggaaggcttcggctgccgaggcgacatcgtccactttcaggctttccttggcaggattctgcgagaagattggtgggcagcggccattggaggcctagcctagcgtgaggggtagtggctgcggggtagagggcgctggcggtgaggcaaagttgtggtcttgatggtggttggactggaagtcggttggcggagggccactgaccagttgcgatggaggccacgtgttacacaagttgagatggtagtattagagttggtgggcaacgtaccatagcgtaaggggtgcatagtgtcccatgcgaagcctagcctagtgattcactgagccaatagcgactacgccttcgggcatggtaactgtcctaggagcattgtcgaggtacccctcttccctcgacaaagatctctaggtgaaaaccatgttcattcctttggacgggtgatgacggcgtcttttggcatcgcaactttcgtgaaggtgtcgttttccgccttggggtgttgttgtagacccggcggtgactgacctcgcatagcggtggccagttcggtgttcgactctcctctctatagcttatgtttgtgcagttggtgtgaggtttcgaggcgtgcgctttgatgcacatccttcctccacaactagttgtcgatgaaaaactttcttgtaactcttttttcctctattttaataacattcggatgacctccttcgatcatcccggcaaaaaaaagtaaaaaaataaatctatagcactcaacgtagattatttctctaattattcagaggtaacactgattttgcatcaaaacactaattagtgtagctgcgtcggaagggcacgcgtgcgctagaagagcgcatgcacgcgtgtaggccggtgcagctgcgcgttgctgctcctgctcgcatgggccggctatggccaattaagtatacaactttttatttgtattttggctatacccttgtaaggctctatgcttcccttatataggttgagggcaaggttatagttaggcatacacgactttagtttcttcaccaatacaaggaaatacccaatcggggtcctatgtcatgccttcgcatgcaaggtaactccaatgaccgggttatatactactacatatatcacgatcatggcccacttcctatcttcagtcgaatattcagtctgtgtgggtatccggtactcatgtcctccacactgatgattctctcaagaagatatcaacacataggaggtgaggtttagaactcgacatctttggtaggttttgatatattagattatatccacgtacttctcccttacttttgaagttcactttgaaatttgatgcatccgatgcagagaatttagctatgttaaaagttgacgtatgagctagatgtacttatggtaaagatgccatatgagcaaaattttgtagacaatattttgcaatgatggctcgcgttcgttcatggatgattagatttggtaatactacttaaggttctaaataaatggtatatatgtaatacgagacattataaatctaattgatatagatggaatagacggatgggggctagtttttgaagtaggtaatttcgtctcgtgttattcacgccacctcttgtaagtagtgcttttaaatatagtatgacaaggccgtctggctgggagagcatacaccattatattgttggcatgtatgtgctctactatccaagctcggctagttatttcattctttcattataaattaaaaaaatccactcgatctcgtgtgtgccatatatatacatacatacatacatatatatatatacacacacatatatatatatatatacatacatacatacatatatatatacatatatacatacacatatatatacatacatacatacatatatatatatatacatatatacatatatatatacatatatacatatatacatatatacatatatatatacatatatatatacatatatacatctatacatatatacatatatatatatacatatatatatatacatatatatatatatatgtgtgtgtgtgtgtgtgtgggcgcgcgcgcgcgcttgctgcatgcagcaacacaaatatatataggcagccgcaccggatcgtacgtacgttggtttcttccttgcttaaaatgctcacttggcttggacgttggacttgtacacgctgtcggccttccagccatcagggatggcgtcctcggcgatgatcttctcgccaccctcggtggtgacgcggacggagaaggggcccttgagcggcttgggggtgtctatcctccagatggcaccccatgactccttgagcgccttccactcctcggagcccttctccttgatttccacctccacgacgtcaccatcaccagcgacgtacttgactagcagtgcaaggtagttggggttggaggccttctcgatgtggaaggtgatcttggtgtcggcagggtacttgcacttgaagcggcggaactacgtgtcgatgatgccggccttacggagctcctcatccttgccatccttagccatggcgccgaaggcaaggccgaagaggtcgaagtggtaggcagcgatgggctcgtcgttcatgtcggtgacgtggataaggacgggcttgtcggagcatgcctttggcttggagcacttgatctcgaagcatgagccgcagcccttgccgtccttgaagatggggtcgttgccgcaggagttcatgccgaggaagggagccttgtcgacatccttgtacccgcaggcgccgctgttgtccttgcggccggcacccttggccgcaccgtaccaggtggccctggcttctagccacttgtcgccgtagcttgccgtgatgttggggcccggtggcaccttgggtggcccgcaggagacagcggacaccatggccgccaccacgacagaggcgagtaggagggaggaggatgccattgctgatgatgagtattagttgtcgttggtgaatgatgttatgtagttgggtgccatggagggtggtatttatgggcgatggaggggacagccacagccatggatggcaggccacaggcatagggatcgctcacatgcgcagcgtcgagcgcatgacttgggtcgatgtcgagtcgagctagcgcatgtccagctaacaagggaaagacatcttcttaattttctttattaagggaatgccattatattagtgattgtgacgccttccatttcataatcctactagtattaattatttttattatgaggaaaagtggctaatcaccgtcattggcatcggcgtgggcgtggggcctggttcaattggcaccggttttgggcgagatttatttttaggttcgctctagggtatctgttggaggcctttttttttgtcacactaccaaaatttatcttctgggaatccatttggccttctcttggagatgctcttagcgcagcttcgccaactaacaccccttgatttttcaagccaatcaccaatgaatcgatcgtgttggcctttgttttatggcttattacatctcacagttgggtcgggtctccatccaaactattccctccttccgttgatatatgacgacggttagttgaaaaataaactaaccaacatcatacattaatggaaggagagagtacaaattaacataggccgggtcttcagaacgacttttttctatgtcatgcctaatcatggattgcagatgattgagatagtatgtacatctcttcttagtaaaatcattgcatctccacgacatctaattactattctttttaacgaaacatacacagaggacaatcactcctatgaatggacacacaaagactacgatctatctctataaatacctctgaagacatgcacacaactatagaaatggttttcacacgcgatctcccaaccaaattcgcatgcaagcactactacaggaccccctattggtaccggttggataccaccatagatgctggtttcccaaccgataccaatttgacaacacctttacccgtccacataggtgtcagtcctaaaatggacacctaactgacacctatgcaggttatggttaccggttcttacctcataaccgttacctataatccctacaatcggcacctataatatttgaataaaaaaaagatgcaaactcacacacacacacacatatcggattttccctggcggccactaaagagcaccgccaatgaaaaacattgccatattaaaaaaaaccccgtcagactaaaaaaaaatccaccgccaccttcttctccttctcctctcatcatcctccccctcctctagatccactagcagcctccagatccaccggcggcatcctccttctgtgctcctccctcactggcagcaactccctctcctctccgcctcctcccttctccctctccaagaaccgcctccgcctcagtaagcagtggcgctccggggaggcacagtgatgggcggcctatgggtggcggcggctctcctcctctctgcccctcgcctcctctccctctcccctggcctcccaccggtggcgcatggtctcctcctctctgcggaggcggggcgcaacctcctctccgttgtggccacgagcggcctcctcctcttcgccgctggccgccgcgagcccggggctggatctggctgccgcgatgatgggggtgtctggatcggccgccgtgacaacgggggaggccggcgaggaggcagcgacgacttctccacggtggcgggagggtaggagcgaatctggtggcgggcggtgcttgggcggtcatccacggcgttgaggaggtggatccgatggctgctgccacgacgacgacaacggctgggctcctccaacccccttccctctaccacttggcgaccacggcgtgggattcggtaggcggcggccacggcaaggtgttgtgacggtgggctatgcttgtggccgtggcggccagcggtgtttgcggctgtggcggccagcagcaccgattttgaattttcttttatcccaataattgttatcaccggcggttctctttagcttgattttcactagcggccaggcggccgccagtgaaaatgcattatttccacttgcatttggtcgctggcagcacctctggctgccagcgaaaactatttttgtagtagtgatggtgcatggttctcatccggatgagattaggtaaacttagggtgtgtttgaggagaaggagattgagaagattaggaagatacgcaaaacgaggtaagctattagctcatgattaattgagtattgactattttaaattttaaaaatggattaatatgattttttaaagcaacttttttatagaaaaattttacaaaaaacgcactgtttaatagtttgggaaacgtgcgcgcagaaaacgaaacaaacaaactcactctctcaccctctcgaatgctgccttaaggctctgaatagaagttatatatatactctccccttcctagaaaaatccagcttttgagaattaatctggataagcgtttatgatgatttttttttatgttctagatctagttgatatgtagagaaattgatagataggggccaatatttttatgtaggtaattttgtctcgtgttatttatgccattcgtcttgcttttaaatacagcctgacatagccggctagctgggagagaatacaccattaaagcccaaaccgaacagggtcctcttacaactggaggttgaagcaaacccgatgaacaaaagaagattcagtctaactttaaaaaaactctgccagagacaaggaagggcactaataggcagcaaaaatcttgctggagatgacacctcgtcgttgtggaggaagaagacctcccaccatagagcaaatatgttgcactttttgactcaaacaccagagaaaaaccaaattgcatccttccaaatggcgcaaggcagagcaagctctgattttgagctcaagccagccatggaaggagacagctaggacaaaaaggatgcgtgttggcatctccatcgagctatacaacaaaggagaagaaaaagacctagtatgagataaactcgatttaaaacgggatgaacctgacggcttcccggaaccccccccccccccccccccacatcacaaaccccctcgccgatgaccagcagccaccgaagacggagaagaaaggggatctagtggaggaaaagaggggctgctctttttcactcactgacagagggagaggataaggtcgagcctccgcattggagagcaatatatactccctaggtctaagcagttgtgtccaataggcttggctattagcccaaaattaacgttgccagtgcactggtccattgatccccggcccattttatgggcatacaaaacaattcacaattaagcgtaaaataaatagcgcagtgcaatttgacgtgaagaaaaggatacacaacatggttactgcttctcatgataatctcacgcaaaatcagagaatgaatttagcagaaaatattgtgggcaaaaacaaatgaccccattgtcacagggccagttcgatgggagagcagacgccattatagtgctggcgtgtatatgctccacaatcctagctcagaaatttatagattatttcgtttaaaaaatatttctctggatatatatgtgcatgcatgcaagcatgcagcaacacatatatagtatataatatatatatatatatatatatatatatatatatataggcagccgcgccggatcgtacgtacgctggtttcttccttgcttaaaatgctcacttggcctggacgttggacttgtacacgctgtcggccttccagccatcagggatggcgtcctcggcgatgatcttctcgccaccctcggtggtgacgcggacggagaaggggcccttgagcggcttgggggtgtctatcctccaaatggcaccccatgactccttgagcgccttccactcctcggagcccttctccttgatttccacctccacgacgtcaccatcaccagcgacgtacttgactagcagcgcaaggtagttggggttggaggccttctcgatgtggaaggtgatcttggtgtcggcaggatacttgcacttgacgcggcggaactgcgtgtcgatgatgccggccttacggagctcttcgtccttgccatccttagccatggcgccgaaggcaaggccggagaggtcaaagtggtaggcagcgatgggctcgtcgttcatgtcggtgacgtggataagggcgggcttgtcggagcaggcctccggcttggagcacttgatctcgaagcatgagccgcagcccttgccgtccttgaagatggggtcgttgccgcaggagttcatgccgaggaagggagccttgtcgacatccttgtacccgcaggcgccgccgttgtccttggggccagcacccttgggcgcaccataccaggtggccttggcttccagccacttgtcgccgtagcttgtcgtgatgttggggcccggtggcaccttgggtggcccgcaggagacggcggacaccatagccgccaccacaacacaggcgagtagaagggaggaggatgccattgctgcaatataatgttattgctggtggatgatacagctgaacgccaatgcgggtggtatttatgggcggaggcaagagagctatggacggagcaccgccgggatcgcgggacaaaggaaggcgtcgggggatcgatggacgcatggcggccgctacctactttgtcgggctgaccgctactagtttcggatggtgggcctgggcttcatcccaaacttcttcttttctagtagtaactttctcaattaaccacactgaacctggaattattattaattaatggtttaatcacgacaaacattaactctcactctttctgcagcagatgatccagatatatatagtgtaggtacatgcatgtcttctcagtaaaaaatcgtatattgttcatccctatttactgtacatttaatcgcaatatatactagcatcacatttgtattattatagagtatatatatctcaagcacatgtaaacaacgccagcccaaaattaaaggaaggaaacgtatcctttgccgtagcatttatcggtagtagattatacgtacacgtactaactccgtccccaatataagtacatttgcgagtttccgtgtacaacgtttgaccatccattttatttgaaaaaaaattatgattagtatttttgttgtttttagatgataaaacatgaataaaacttttagtgtgattttttttatttttttataatttttttaaataagacggacggtcaaatgttgaacacagaaaatcacaattgcatttatattgggacggaggtagtactatttgcatccaatagacttgcattaattgtgatgtatccttactaacagtacctctatgacatcgccataaaataatgcgataattcaataaataccattgacaagcgtttaaatccaagaaatgatatcaacaagcgttaattccaagaattaccatcatacaaacgattttgtctcaaaaatgccatcgcggttaggattccttctacccccacgctgttaagtacactgttcatcatatatagtatttaatggcgcgggatagaaagaactctaacggcgatagcatttttaggacaaaaccgtttctacgatggcaatttttgaatttagacgcttgtcaatggatttcttgtattatctctaaaataattatacaaatttgactagagtagtgtccggttattcaaaccaaatccaaacatattatattgtaacttttttaaccgcattagtccattaaacatttgtcatcaattagctaaaacccattaagcgtcctagatacacttccatgatggatcttggacctagtcaactagtacaatatttatattggaacaaggaggtttgcaaacaaggctttactctgtgttcttattttttaaaaaattttctatataaaagttgctttaaaaatcatattaatctattttttaaattttttagctaatacttaattaatgtaatgctaatccttgctttgtttttcttgttaggaggcaagcaggttcccaacgtagataagatagaaaataagatatggctttcacactagggccctgtctgattcttctacaagcagtggataaaattttagatacttgtgacacgcaggtgaattttagatacaagttagatatctaggtggtgtttaaatttactgaagatgaagatgaagataaagatctaagtatttcacgcaaaacgaggtggtaataatgtgtgattaattaagttttaattattacaaacttgaaaaatggattaatctcatattttagaacaactttcatagagaaagttttcgaacgaaacacaccgtttaatagtttgaaaagcgtgccacttttatctagaagtttatccggttttcgttggagaaaagaatagtgcctatatatccaaacgtagacacctgccacacaagcatgaggtgattacttctattatacgctatgttcccatttatcacataatttgctaatatcataaaagttctacgaatttaatactattttttttcttttactgcatcgtactgtgaaattaacattttgttcccatatattttccctttgttgtattcttgtatcctcactcttctccatcttaaataacagtaatgctaactccagttaatgcttgttcccatgcttcgacaacaagctcgtgtgctcgagctctctagtcatctaccgtaacatgtattttgtttaacatatgagtctatctattttgtttttgttaataataactattttaacccatgcttgatgtatccatgttgcttaactagtttgttagaagttgatacaaatttgatttctaaaattatccgagaatactcgatagtaattatacatatagataatattcagttatataaataatccaacaaatatctatgattttatggaaaaactaaaaggcaacgtttggaatgaatataatgttcataatgcactgtaaacttatcaacgtgttcaaatacatatatcttagagcaaatttcataaaactatcaaattatcataaaactatgaatttaatactatttttggagtagatatgctattctcccttcagcggccgtagacgtcggaccctaccaggggcggagccacgtgtggggtagcttgggcttgggccccacacgtggcaaaaattttcaagggagaaacactggaatattgaaatttacgtagaatttgcaaaaaaaaaattgatagctatatggttcagccctagtcttgctaaaatgctgcctccgcctactattgcgtcgatgagccggacgaggaagatggacgcccacatcttgttcgaactacacaagaaagaaagagggaaaaaaaaggaacaataacgagatgaacctgaatatgggaccctttgccggctgccagagacgaaaggaaagggaaaggaggtcacaactcacacgagagattgatttggcctttgggtttggggtcgcctctcaggatggttggagaggcccccgaaagattgcgactcaaagtccattccctcgagtgagatgaattttcgcgcaaagtaagctggatggaagttattggtggttgcatcaactgaaatctcacctcattgctagacatgaatgctccctttgctctggtctggtccatcaacaagtacgttaacgtacgtacctttggcatgcctgccttcacccattgaatgcttcatctttgtaaataccctactccatctccatctccatgttgagcttgagaagatgctacttcttggcccagcggccagaatcttttcggccctgtccttgacgttgatggcaggtactagctaggttaggtaatcctcctatccctcgcacgtgacgtgatggcctccatcttcacaagaggagcgaatcgcatataagctcagtttacatcagacatacaattgatcaacggaatttctttcacaacagctcatatcatcatctgttacagtcagttgcaactatcatcaacacactcgctctattcaggaaaattggcaacacagcaaagaaaaaacccgagtcaacagacctccaacgctccaatgaaataacaaacttacttcactgttccttgatctatacctcatcatcccccccccccccccccttcaccgaaaatggccaaggcaaacaaatctacatcgtctgcaagctgggcgccgaggctttttcggcgagcacttactcaagtaaacaggtggccctgttcggtggtctctagctctcttccaagctgcatgtgcacaaatttcctgtgcttctgcttgttgatcctggcgcttaaccttctcacctgtgattgaaccctgcataaatgcaagtacgattaaacaagataagtatggctaaacaagagtgcttacgcccaaaaaaaaaaaaaactgcgcagaaccgctatcgtgcatctttgatgcttgcctaaagacataagatcatattctttgacacttggactggggaatacaaaatttcttcaaaatatagaagtaattaccagaaaatctttgcagagaaccattgccaccaatcatatgtgactcaatccttctttcttggcctaaatgcattctttcaggccaaacagaattcaacctccttgcgaagtcctccacttctctgcatgttaaaagtaaaacttgtcaggtatgtcagtagtaaatgatgttgaatactctctgcaactttctcaacaggcttaggagagcaatgaacttgaccagatgcaactgcgattattaagcaaaacttctatgaacttgaccagaagcaactgaattatatcatgctgtttttcagctgtgaattttgaactaaccaacttatatatcagcacaaatactaagaagaattgtttttaggggcaaaacatgtaatttgctaaagcataatagcatatgcaaaatagggcgctatagagttttgatgcattggaaagaaaagaacggcgcagaaaaaacagaactgaatgcttgagatgtcatatcctcacctgtcaagctcttcctgcattgcaggatcaagtccatcatcaaggtcagcatcttcaaaggggtactcaacatcatcttgcacatctgagctttggcaaggtgttctagaaatattaccagtacccgcattgaatggaactccacgagtagcttcctcctataagtcaacagataagtaagaacttgactgttctccacacaactactcaacaaaaaacagtgaggacacctaaccttgtttacaggttcaggattagcttttggggggttcttagaatggtcctttcttctcttgttctttttcttattcttagaagctttcccacctccagaacctataaaatggataaacctttatatgaaattgctaagttttttctatatagaaatactctttgagcaagctctttggttgcatgtttgcatctttgcctaaatattgtaaccagattagttaaaatcgactatagaatttgaccctggatgacaacttagtagtttactgattgctcagcgttattcagcagaacaggataatcatggttgaatgagacaagggaaacaacgaagttatatagtcaatataactcactgtaattatacctccatccccatttataaaacatagtatctcatccagtgaccgctcatctttttgctcttcttgtacttgaacatcctgaaacaaaattagcataagattcttaatacatgacattcaaacatgaactacactgctgaatggacaggataaatatcatttcacatggcctacaggcctaatatcagaaagcatactctgatgataatacaacagtttggattttatcatatttaccttcagtttctggcgctcctgtagttctttccgcttctttgcatataatcgattcaacaaacggatcctgggatcatcatttatatttttcaggggttccaatttctcttcctgaatgaatgcaagttccacagtaagcatcaatacatgctgataactataagcagacatgcgatttgtacctctgttaagtcatctggcaaatggaaaatatcacgaatttcctcaggtgtctttccttcaattattcgagcaagtgctcgactggtaagatcaaccaatggctttaattggagactatcagccgccgatgtcagctcacatagtctttctgtatctattctgacaaacttttcatcaaatgattttcgctcctgcacaataaatgtgaccatgatatgataactggagaaatgtaaattcatcaaatgattatttcctcttataacataaagtaaatgcctaagtggctaaaagaattagcatcctctccagaaagtttcccgaagttcataagctgaatcatgccatgatccttatcgataaaaataggagtattaaaagaagcagaattacccttgagactattacttgtaacaaaacaactacgggaataacatggctgttacaggaagcaaaattacataatggtctatacttgcaacaggtggacgcctgaaacaagcagaagagagaaagcagtaaaaagggagttgccagaagacaaaacttaaatcacgacataccttgtttgagcgccctgggacttgatgaaaccgacaatagtcaagaatcaaactcaaacttgtagggttaactctttctgggagagcaattgcatgattttttgatgatcctgttccattttttactatctctcgacatatcatagggcaaaacatggcaacctcctcctccacttgttgtatggaaccatcaaagcactgaagccaaatataactcttcaacgcctgtgagttcacaatgaaattaaattggaaccaaatgaatagctgataaggctggagaacaattgtttcccctccaataaacagaaaaaatagttatgatctagaaatgcataggggtcatacctctggctttattactgccaactcactttctgacattattgccaattccagagaaacaacaaagccgccaatacaatacaccagaaaatttacaagaaactcctttcggggtataacacctgccagtactccaatggccggaaattatgtcgacaaacttttatcctgtacaacaaatcacagtaccctgtttttggtcttcaattggatagtgaccttatttctcttttgattcaacaatggtctttatttatgactaatggaatgaatgatcttgtttagcctacagtacagagagaaacccgagatgcataagttatggcattttggagtacacagggggtaaatagtcacatagaaatgcaatatgacacatgaagcaaaacttttttttaaaaaaaaaaagaagaaagatagagcatccagcttcaaatagagaaataaaatatgcagcctttctacagttgtactctcaaggtagtagcaactaaatggcatcaccaaatgacataaagctcactattgccctttcaaaagtaccgataggttcctaggttaattctggttacactacatagacacctcgacccaataggtacaaacagattcacgctgggtaccatttggcggtatgactaactgatccatatttgaggtccacaggttgagttcattgaaagaattaatcctcataaatgcagaggagaaggcactagtctatgcacttaatcctggtaccgaacatgcatgggcatccagcaaccaaatatgaaatcagatatgcatgtgtaatcaaagcaatgaaatggaaactaggtaatcaaagatacagcaatttgcatccggcgacacgttccccctgtctaatcggcaaaaaatggcctccatttggtcctcgtaaaacacatagctatacaacctaacaaggccgcggctacggcaagaaacttatccattccccggcaagagacaaggtaagaaagacgtgaatcgcaaccaccggagcagcgaaatggggttaaaccctaaacgaggattggcgccgcggagggaggcaaacggaaggcgtgtcgcaaaagcaagcaatccacgaagcccactcgacggcgacggtgtcggctgtcgccccggccaaaaccctaacccgggaaccgaccctacgcacgaacgcaaacgaaggaaaggattgggcgcgggcgcgggcgcgggggcgggggcgtacctcgtggcggagagaaggagaggctggagagggagaaggcggcggtgacggcggcggcggcggcgccggcggcgaggagaggagaggagagggggaggttgtggttttttggttggtgggggtgcgcctgcggtttgggggaagcgaagcgaaatgggggaacccggccggtggagtccttatctatcccgcaacccatcttgggcttgggcctggaattccagcccactgggccgtgggcctcccttccttcctttttcttttttttatatatgtaatatttattatctcacaaaaatatttttcatagtattaatgaccaaattaccacaaaattacatatttaactcggcgtatcacaaatgacacatttcacaccaaatttatcacggaaattacacgtttaagatgaagtatcacaaaactatatgtttattaactaaagtatcacaaaactataagtttagaaccaatttagtcacaaaagcaataatgcttatagctccaacataacaatggtgctagggatctaaactctaaaagttgtagttttgtgataacttaaatattaaacatgtatttttgtgatacttgacctttactagtttcatgataaattttgtgctaaatctgtagttttgtgatacaacgcattaaatctatggttttatgataatttggtcaaaatacctatagttttgtgaaatgtactcacagggaaataataagagggagaagtgccaaactgaggatctccaaacgctgctgcacaggctgcaattgctgtatgtatatcctattcttcatcattttaatctcaagaatagcaatatttatataccgaattgtcccatgatctcaacaacctaccacaaggacaaggatcacaactcacaaaagtggtagccatgatttcagtttgatctcatcaacaggagacactgagacagtagcagctgttgggggaaaaaacgaaaaggaaatagtgagtgacagcgtgatacaaatatggactcgctggtcgtaccgagggtcgtaagtcactagagtatgaagtagcagctcagagggggcaaaaggtacaagatcttcatcttcacattctgagcaaaaggtacacggtatcctttctgcgacaaaaaacctaggaagaaactcaatcaacatcttggagctgaccctgaacgacgcagggcgctcctctcttaccaccggccttatcttgcatgcatggggcatccaaatcatagtaggagtaccttttttttaaattcatgtcctgaactgaacatgaaggcagaacgtcaatgagagatgttgagcagatactaactgctaagggccggggaatgcagttcgttttcgcctgaacattactaccagcagcccatttcagttgcattgaactcttcaaattaaatagcctcatcaggggatttaccatagaacaaaggcatgctcagatcagcgatcgtcggagcttagacgtgtatctggtgacagtggagaggtggcggcgaacgtcgagaggggaggcaccccaccgagaagagcgtagcgacggcgaggacagccatggcgaatcgacaagctttacgtcttgtgtggaagaaagcggaaaactatccagtcgttttcttttccttttctttattttattttttattaaatactgtaaaaaataataacaatataataataatataatagtactgccaagaagcggagcgagggcacgggaacgggagacgggtgggagggattcgtatggcgtcgccggaggagagcgcaatggcggagctgttgagggtcgccgatttctcaccggcgattgcctggtccggtcgatgatgcgcgctgtgtttggcaggagacggtggaggaggaggaggtgctgcggcggctcggcacgggggagaaaggaggcggcgcgacgcctccgcctgcacgggcccaaccccaacgtcgtcatcctctcccaccaccaagtgcctccctccccctgttgataactgattcagtgctccggtatctgctaggaaggagtagttgtttcactctatccacattgttgaatactctcaatgaatgaatattgttggcgcaggccgctcttgtgcggattgttgtcttggcatttttgttttattttataaattttggaatcaaattggtcgcgctgctctttttgtttctgcattctggattatctgaatggagtctctacactgtacaccacacttcagcattattcagtaactgcgcgcgcgcgcgcacgcgcgcgcacacacacacacatacatacatacatacatacatacatacatacatacatacatatatatatatatatatatatatatatatatatatatatatataaacacacaaagctgcctccaatgcaaaagggacagtgtcatttccctgctacaaatgtcctaatttccctttggtgtgatttttgttgaaaacacttgtgtcgcaacagtggattcatcaaaatgtctgcgatgcctgttaactctacttaatttcttttctataaaagcaggtgtccctctataaacacacacacgctacttggcttgctcttgtaaatgcaactgcttgttctctcctgtgtaaaatgacaattggcaaatagcaattactcatgcttcttgacaacttggggtagtaccaccgtagaactagaaaataaactacactgaggattagcctcatgtgaaaatatcttacaattattgctgcagctcaaagagtgtctgagagattccctcttggatagtactactacagggctcatgcctcccccctcattgtgttcaaagcaacggttttctattatttcttctggacatgagacacagatatgagcaatatgagcacagatttggattttactagtgctagtttttttttaatatgtgacgccgttcactttagcgtgacatttgactgttcatcttattcaaaaaaaaaatatatatatgtcatatattttgttgtgacttgttttatcatcagagaaactctaaccttaacttatattttgacatatttgcactaaatttttgaataaaacgaatggtcaaacgttatgtgaaaagtcaatgctgtcatacatgaaaaaacagaggtagtactagtttttttaatgtactgttcatttattaaaataattcttcccaatgtgtgagtttcaatgttcacctgttttaatttttacagttggtttctagtaaaaaaaaattacactatcttgattatctaggtcccatataccgattacttttctaactaaaattgatctgtgtaagatcattttatttaaataaaatagcttcataaggtcaaatttatggttgctgcaggaggacagcatgcttcgaaaattcctgatgaagctcttctcactctgggaatggaacaatatcttccccaagtacaggaacatgatctgtgtcatacttaactccatgtcatgggttacagtatcatctacagttgtgtccctcaccattgcttcagctggccagagatcttccatgatgtccatcgctatatatttactagcta

SEQ ID NO: 68541 - DNA, 6658 bp, Oryza sativa
ttgttctcggtcacacctgaactctatctgaagatcttgtcgaatcatgttgatggccaatgcaactgagttaaaatctacattctgattttggtctgcatcagtgtccatgttcaaccgagctagtatcttcttggtcacactcacacctgaactcttatctgaatatctcatcgcatcgcatcaacggacaatgcaagtgaatttctgctgcatcaatgttcatgcttaacttctgctgctgcagatttgtcatctgtgaactgtgaacagctggttcatcagatgcagttatatcctgagctgtgccaatacagactagtagtagtaactgtgaatgagacaagtaactgtatgattttccttttcctgcactctgacctgttccaaaattaatcttttgatgtgctttaactgatgaactcttctcccctcggtgtcctttccaatgaaagaaacaaaaccgatgaagatggcatccatatttttgttgaaagaaacgaccttcctcagcaacagcaacactgcaaaacaccatccagtgtgagctgaaaagtgggtaaaagagagtgaaacatataatctgatctctaaacaatcagaattacagaacatcagcttgcttcaccactgaccaagaaacctaattttggagtcgatttttgaggttttttcatcacaattttattttccagcatttacattcaaatttctaagaacacacatataaaagttttataataagcaaaactatgacacaactgcattgtgattgaaacaagaaaccagccttttattttgccttttctcccttcccctgtataagtcggtctggctgattgcgttgtgtaactataactttttctaatatattgacaagtaattcttttgtgcgtttgtgaaaaaaagattgaaacaggaaacagtcctcccattgccaaacatttctgtgtatcatcatcaaagcaggattgctggaagcctggaactgtactaggctactggctatggtaatcagtcgctgcagcatggtacagtacaagttacaccgcgtgtgccagttcatcttgcacagtgacaattcatctgccactcatcactgtgctctctgcacttgttctgtgtaggccatgtccacaacaaccctacatcctcaggacacggagccgctggttgcagggagagagacctcttcttgttcagtgcatcaagatctgtgtatccctgtctctttgatccggtacactcccctctaaatgcacacatttaataccaggaccagcacaacatctcgttacactacagcatctgcttattattatcttatcagccgtagccaaaattaaaattttgaaacagttatagagcttataagccactgttatctttttgccatacagcttataaaccggcaagccgttggcatcttttacactacagataaggctcccatttttgtcctacaacttataatccgctgtcaaaatttggatttttaaactaagttgatattgatggtttttcattgaactttatttttcagtattggcttttaaatcgttcagcgttaggtcatctgatggtagtataactttagtttattttgcataattggttttagaaccgttagtaaaatagatataaaagttttacgtataaattatttttagttgtttttacggctcatcaataatggacgaaggctggagtagcagtaaagcagatgaaaaggatcattgcatcagtatccaagcagaactggatgatctgatcctccctctctcacccaagtcattgtcattgtcatatactaattgccagtgttaaacccaaaacaaaaattatcgggaatcctatgcatgtcataacacatatataatactctaatttttaactaataacataattattataagctaaaacagctaaagaatggaattctatctcctgtgacccagactacaatactgtaggagcgccgctgttaattgccaaggcctgtcttttttttttttttgaagataatagaagctttatttagactcagttaattacatcaagatgatacaatcaaactgagtcaccgccggcctctgcataaaatgcacatagccaaaaaagaagaaagaaacaactagaacatctcccaagcacaaaagtttaacagaaacatatatcttagtggctatcaatctgtagactagaccgccacccatgctcctgggtaaaaaacttctgtgccacctggtctaattgtcgagataccgccgtatatcttagtggctatcaatccgtagactagaccgccacccatgctcctgggtaaaaaactcctgtgccacctggtccaaacgtcgagataccaccataatagtatcccgcagtcccagttgatggaggatagcccaggtacgtagcgaaggcctgtctagattagcaacatggttttccaagcccagccttttaggcccatgagcattcttggatactctaacaaaattatgaattcccaaccatgaacagattcctctgaaaaaaaacgtgaacagattcctctataaaaacatgaacagattgacattacaaacttacatccacagtatcagagcaagagacagcacagcggcaactctgcagttctgcaccgaaagtttcagtcttgtcatttgaactgcatttcatgtctcacgtgtgaatggctgtgatcacttttactccataattacaccaaaacctccatggttaagtccccctctatacacgctaaacggcccatcagagtttgcctttacaataagttgagaatgatatggaatttcggcatattcctcttcattttttttaaaacatagtacaaatacaggcgcttataacgcgcgtaaagttacccctatgaacacacacgtgcatttcttcatccaacttcactggatcattactgtacattatctgctctacgtctctaaactatgttctttttttttaaaaaaaaagatcgattgtattgcttggatcacttgctctataagtttactttttataatatttaatttatatctataatcgaatgggtcgttattaggtttcaaattttagatttaacgttagtgtccatcaatcatttttctttttttttgatgaaatgtccatcaattttggaatgtacactgcccacacgagtgcgtgtttagtgcatgatgtatgagtccaaaaagtacatgtactcagaaagaaagttgagattagatgccaccatccattggcagagcaagcaattagcattcagtaaagcttctttgtcatcttacctggcgattgctatggacacttcaatcagcccttgtttatcttcataactttttcttcaaacttccaacttctccatcacatcaaaatttttctacacataaactttcaacttttccatcacatcattccagtttcaaccaaactttcaattttaacgtaaactaaacacaccctcagcttggccttccaaattcaatgtatagtatacgtaaaccgtggtacagatttgctattaggggccttggtttttctaagtggctcgtaattgatgatactatatgtatgtgtgccactgccagggtttcgaaataccgatcctcgctcattagcggttttgttgataaccgtgattactactcgtcctcattgacaatttcagtgaaattcagaaagggactacctactccctctgtcccaaaataacttaacctgtgatctatccgaggagaacgaatcttgacaagcctttgtccagattcgtcattttaggatgggccacattccattattttgggactgagggagtacgtccccatatcacaaggtctgttaattttaaagaaaatttagaattttatttttattttattccaagcgaaaaaatggaatatttagcacatgagaatacacgttcatatcgtcattgtaaactgtattttatatggttgccataattattatcaaacttatctaaaaaaacaaatacgatataaccgaatcaatagattaagaagagggaaatttttgaaaataaatgattgatatcgaaaacatattgaaacacaatggcttatattgaaatatttaggacccctgtgtgatcgaacaattggcacatggccatggatggccttggagaccggacatgaatttgatacaaatttggtgatcgatttcatctctaaatgtttgtcgcctgccatttatcttttgaaagaaagcttaattttttttaaacttggttaggttaaccgagcggtatgtcaatatgaactaccttgacaataccaatacccgtgattatcgtgcggttagcatcatattttcaaaccctggtttatgcctttaaaattgttgacgtgaatattagtggttcgtcgatgatgtgaaataaattgacaagaccaatacccgtggttattgtgcggttagcctcatattttcgattttgtgcatgtaaaactgttgacactgacacataattccgttgaagtgactgacaagctagaaaacatgagaatgaactcagggtgtgtttagtgcacgctaaaattaaaagtttggttgaaattggaaggatgtgacggaaaataggaagtttgtgtgtgtaggaaagttttgatgtgatagaaaagttggaagtttgaagaaatagtttgaaactaaggtggtgtttggatacatggactaaactttagtccctatcatatcggatgaatttggagtaataagcatagactacttataaaactaattacataaatgagagctaattcatgtgacaaatttttaaagcttaattaatccataattagcacatgtttactgtagcatcacataggctaattatggattaattaggctcaatagattcgtctcgcgaattagtcgagggttatagaatggattttattaatagtctacgtttaatattaataattagtatccaaatatccgatatgatagggactaaaaggttttagtcccatctaaacaagatattacactcggcctcagaaacgaagggagccggaaaaaaagaaagaaagaagaagtgatgggaaaagagtcatggggaggcttgaaatgggaattgggaagcatggcactcttgaaagtgttctcttgacctatccttggacaacaccatttgcacctagatccatcagtgtattataacgtatgaacacgacccggttttctctgtctcttgagatgatgtatgaacatcttctatttattggccgatgtgatgccaacttggatgaaaatgacctggtaaccaaaactaaaagagaaaaaaaaataaagaaagaaagaagagggtgtcattaattttgctgaacattataatttggtagtgtgcttattttcaggacaattaaacacagtgatgctatatgccatttgcatgagtatatatttatatagagactcaatcttaatttgattcatgtgtggcaattggttaccactgctacagtaatatcacatgacaaaaacgtgaggtatcaggtgttttgtccctttttttcttgtcgtttttgttcattgaatttgggttggttgtgagcttaatttcaacttgttactagtggcggagcctgagcgaaaattgggctgaatacaattgaattggaaaaaaaaattattacgcaaaaaaataaaatgggtctaaagaaagagcatatgtttaaaaaataatcccgtaaatggacgaaaaatagctatcctccatttagttgagaattaaacggccaccaactacagaagacgtatagtagtacaaagagaaaaattgggcagaagtatcttaaataggttaggaatgtggaccagttaatggtgaaatgctgaagaatctttaggatcacaccattaaaattgagtatacacaaagatatttagtaattatgtacaacaagtcagagaattatttcagaaaaaaagaaatagaataaaacaaaacagcccaatttcttctgcaagtcaaactgaaacttgaagagtacgagtgtcaaggtagaacaagaaaatgtacaactattttgtcaaagcaataccttttgtacggttaacatctctagatacgtctactaagaatcatcaaaagtgtaaacctttttcaaaataacttttatccatgactatgcaaaaccatctatctctctttaaacatgactatatccacacattagctgatcggtgaaggtcgtacgccttttcaacatttacattggtagaatagtatttcgcggtagtttacctctgaatatttcaaaagaagtttacccataaatacatcgataaaaatatgtactccttccgtccctatgaataactcactttagatttttttttccaacatgatcgtctgtcttatttaatttttttataaaaaaatcagtcatcatatataaagtactatttatgttttatcataataataataatataataataatataataataataataataataatttttaaaataagatgatgagtcaaacgttgtatttaaaactgaaaaatgtattttttttatgggtggagggagtagtgtaagagtatagtataataacacacaaacaaaaggttttatttccataaaaaaatatttttccg

SEQ ID NO: 68542 - DNA, 728 bp, Oryza sativa
ccgaagagggaggaatcggccgcggagatctcggccgccattgatgacgccggcgaggattgcgggcgcgatttcggacgaatccgagggagagagagagggaaaaacgggggaaacgggagagggaatcacggggagtgatttccccctctttattgcgcgcggggacggcgggatgcggcggattcggcggcggcggcggcgctagggcacgggcgggcggcgggcgcggcgcgaggagggagatgacaggtgggtcccacccgtcagcgagagtggcgggcgggcccgcctgtcagcggcgcgcgcgcgcgggggaggccgatgggccgcggggagaggagagagggggagggaattgggccgagccggcccaagaaggaaaaggggggaaagaagacttcttttagggttttttctttttataaaaccatttcaactttgtttatttcttttccattattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgaattttagagtcgttttgggacgcgacaataggtgccaccgggttttgataaagtgtcgagtgatttgttccccttgtagaccttgctctttgagtttcaac

SEQ ID NO: 68543 - DNA, 2204 bp, Oryza sativa
tgctaagcaattatatatataacatttagctgaaccaaaccaatacataaggttcaagctaatcaatttattacccaaggtatcaaggaataggatattcaatgcaaattggccataacaaaggaattggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacagtacataaaaagtaaacaaacatgtaaatcataattttagatgaattatgagacttgaacggcctcattctgacttcacatgaatttattatgaattttacaagattaaatctaattaaagcccatttaaaaagaattaaataaatttaattcaatttatggacaattttaatatgtagatctttattttagaaaaatttagcaacttgaaccacctgaaacggatctacggttatttagttatgattttccgaagatttaatctattagaaaaacgggaaaaagaaaaaccgatgacgtcagcatgacgtcatccatggcagccacagcacgggtggcgacctcgccggagctagggtggtcggccgggattttggaggacacctacgcgaagagaacgacgagacgaacccgatggtactcaccacaacggcaaacaacgcacgacgacggccggcgacgaggaggacgacggcggtggctcgggttgcgcggcgacggcgagctccggtggtcggcgacgaaggagaggtggcggccgagcttccccacaccacggcgcacctaaaggcgacggcggcaagcggctgcgacggcggaggcggctgcgcgacgtcgccggagttcggccggcggcggcggcggactaagcggcgtcgacggcgagctacgaggcacgagagaccacgggagagggggcaaacgaaagaggaggactagggggtcctatttatagccttggattgaagagatcggactccaaacgagaggaatcgaagccggaaaatcaaaaactcggttttagagataaactcgaaaacgagtttgattcggataaaatacccaacgatttgctccgattcttgggggaaaagatagaggaggatgagaggatcaaaacccctcaaaaatccggaagaaacggggtcggattggagcggatttggaggcggaaaggcgacgcggcgcgcagctcgggctctgtccagactgcaggctgaaggttagggacgacactgtagcagggaggcaaaacagacttctcctgagcttcctttttttcttgcttgggccgactgagagagagggagataaaacagactttggagagagagaagaggggaggccggctgctgcagctgggccgattgggctgcgcgggagagagagagagatgttgggccggaatcggcccaacgacttagggaaggatttaaaaactttttccaattaaaataatcacttaaatgatctttcaattgttaaaaatacttccaatgctcaaataatttgaagaaaaatcctgaaaatacttggacactaaaagtacttaacaaaattataattagaccatttaatgattaatttaatatttaaataattgctgaactgctctttgtatgattaaaattaggaactgagctccgaaaaatccgagaaaattccagagagtataattaaccatggagaatttaataaaaattaaatccatccatgctttatatttaagaaattttatttcccacatttaacttcacttgtaaattagtgaacatttaatataaattctaataataatttattaaataatttataagtcctgaaacaaaaatcaggatgtgacaaatctaccccccttacaaagaatctcgtcccgagattcggaacggctagaaagaaaaaggcataggtaaactgcagtctatcttattccataactccgataattattctaaggctttaaagaaaactactactgctttgaaactggtggctgagctgtaacacttgaagacacaaccggcactgcatttgctcctgtgaggacaatgttgt

SEQ ID NO: 68544 - DNA, 2799 bp, Oryza sativa
gaagtagaccctccttcctgtgggccacaaccccaccccacccaagcaatggcgcctcttgcgacctcgtcaacgtcgatccccccgagctccagttcccttgtaagccgaagctcccggaccctccttggctcccccgtgctagctagcttcatctcgttccagaatttcgccgggtgttcttgtttttttgtctgaatctttttttcttggtaccttgcaatttcttggcgtgcccagtcgagctcgacaagcagatctcctgccccctcaggatcgccaacaagaccgagaggacggtcgcgtttaaggtggtttgcggcccgtttgattgcggtgtaaaaccctagaaatatttttcttgcttgcttgcttggtgtttgaggaattgtctcgctcatggttttgcggtgtcctttttgtgtgaatgcgtgtgggtagtaggttaagacgacgagccccaagaagtactgcgtgcgccccaataatggcgtcgtgcggccgcgatccgcctccgtcgttgtaggtaatgtgtttagtgtttaactgaactaggccagagttcaagaaaccgctcaattttggggattattttgtggctgtcggaatgtggggaattttgatgcgttgtgtgcttcagtcacgatgcaagcccagattgtggcgcctccggactttcagtgcaaggacaagttcttggtgcagagcgtggtcgtcgacgatggcttgtcagctaaggacatcacctctcaaatggtagtactaaattgttgtttgcatgttgtttatggttaaagatttcgttctgaattcatggattggtgtgttgtttagttcctgagagatgagaacaacatggttgaggaggtgaagcttaaggtttcttatgtgatgccacctgaaccagcgatggagattgcagaggagtctgatattccaaagagaattttggtgcctatgcagcggattttggataatgggaggagtggttcggagctgtcaagtggtaatgtctcattgagatcagctgagatggggacagtaagtgcactgaatttttctcatatgatatttctgctcctatgagcctattaaggaaataaatggatgatttgcttaatgtgttttcaggagttgggatcacctcttggacgatttgtgagaaatgaggatatgctgaagactgcaagtcctgttgttgtacgtgctacatatacaatcaaatctttttaattgcttctatatatctctctacatatatgcgccccttaattggtctacaatttcataatctgtacaaaatttaagatgttgcttgtttctgtctttgtgatgtaaaatgttctaggaaacaagagtacatgcaggacctgatgaacaatacctcgaggtgagttcatttagcatctgaagctctctgattttttccctctgtttctcagtcatcctctgtgtggaattctattcattgttctttgtaactaattaaaaatgggggttggaatggtaggtcttctaaacaaatatataaaggaatcattcagttaatttctgtttgaatagtacagtatctagctgcagacttctattgtgcatgcatggctagttaccaacttaccaacacttattttatattccaaacaagagtttttctctgtttttccatcttcataaatttgatttatatacaattgacaggtagcagggtgttctttatatgtgtgttttactaatgattgttccaagcatgaaaattatttttctatttaagtcttaatttacttttgcattctgttctggtcattgacttatacctgcattgaataaccacttctcttctcatttcagctgtccgctttggttgcaaaattgaccgaagaaaagaagtctgcacttgagcaaaataggaaacttcgagaggagctggtgagtatttggttaaagtcatgcactcttacatgcttccatttgaaagctaatgatttgagtcatttacttagttgtaaaagaattcccccttttcaattcaaatattattacaaaaataagcatcacctccttaagtacttgttcatgtagaaaatacacataagccatatattccaggggatttatctgaagggccttcaatctagatatttcaagctgcatacatcaattgattatttgtctttagatgcttttttttctcaatataaaattcaacgattatgcgtccttagatgctacttcttctcaatataaaattcatcgattatgcgcctttagatgctacttgttctcaacacaaaattctctaggttatccatagacgacaatggataacaatattattattattattattattattattattattattattattattattattattattattattattattattattattgctgaatcgttatgcactttgcttacgatggagctgattatttttctattttttccatcgatcttgtctgaataataggagcaaatatattacattagcatgttaaaactctaatttaaggtccattgggaagaaatgccttcttatttttgttgacctactggaaattatatggtagtgaacatctttggccaccccattgtggcgggcattaatattccagaacctgccagggcttaaagcactccacattaaaggagcttcttgctggaattcgactggtgatggggtaactaagcatattttgggtggcttggaaagaatgaaaaactatatttccaccttggcagataatttccccgcaataaaaagggcacccccggggatcttta

SEQ ID NO: 68545 - DNA, 48581 bp, Oryza sativa
  unsure (1)..(48581): unsure at all n locations
ttaaaatttaactcccaataaaattttaactcatgagtgaatccacgagttaaattttaactcatggtgacgtggacgaatctcggacgtccatttctcgatccaatgatagtttccaagtttgcactacatacgtggtctggactacatattttcgtagcagtagaaaccagaaacggtaaacactgcagctgcctgcgagcagcgtgaggcactgttcggttaaccttaaagaaagtggaaataattaaagggagtttatttcgtacatatgatcgatgatgtaaaattctgcgttcgtccaactcctctctttcgttttccgcacgcacgtttttttaactactcaactgtgtgttttcgtaaaaagattgctatacgaaagttatttaaaaaaatcatattgatctatttttgaaaagaataattaatacttaattaattatgcgctaatagatcgctccatttttcgtgcggagggaatggttttccatagggccgggggtggtgcacggtggactgggtgcagggggggttgtgtacggcgaggaggtctgggactctaggagactggggtggtggtgcgcttctgccaactcggggccggggtggttgcgtttgcgtcttgcggtgccaacgcccttgcgccttttgcggtttggaccctctccggcactgtggcttctgatggggttttacccattttctttttctcctctttctaaaagtttctcttctgtgttgtgtatgtttggtaggttgacctgtgtgagtagcaaggtgtgatagctgaccttttcttcttttttttgagaactctgacctgggtttttcggctcattttctaaggctttgtgaaagtttggaacatgccagcgtttttcacgtgtttttcaaaattaatttggcccaaattcgtattaaaaacacgcaggtatatatatatatatatatatatatatatatatatatatatatatatatatatatatatatatatatttgaaatggagggaggaagtgatatctccttgagatggttggcgatgtgtacatgtaagttttgattgtcagatgtatatcggtttttatgtatgggtcgataaaaatattatgaaatatcggttagctcgattagttatgtacaaaatctttctcggtggttaaatttctagcaaatagggaatcaaaggtggtttttctgttagcaggactaattaggcttcaaaaaagccaggtcctcaaattattggtgttcatattcatttttgtatggatttttttttgccaaagtgagaaatttaattaacaagaccaccgtatcaacgagtatccactttctacgctaggtaaggtaacatgctattgtgatgaatttagctgcttcaaggaattaatgctaaacggcattatctttgatattaacttatcaatgcaatcggtactggaagagaggatatcctaggatttgtttagtgaatcaatttgagatgttgagtcttcaattgaagttattaactatagtacgaagcagcacattgtatatagaacaaccaggtgaagatccagaaaggaaaggttgaataaactatacaaaattatataacctttttaatagatgtatgacagaaaattttagcgggacttaaatagagacttccatggttaaaacgttggtagtgaggggtcggaggctcgagaccctgccgccccatggtagattcgccactgagcacaactactatctccaaatataggacatgataattttcgatcatttccagtaaaaccatggatcaagatccaatgaataggctgttaaagcaggagatactaccaatataaacgactcattcctcattatttctatattccctcacactatttattgtatgcttcaccactttacatggcttctttatcatgcgtaaaacataacctcataactagcaaccaactaattgtgtagttctcattttaccttagttcaatttaataaacaactgtaactaacccccttgtaacaatagctaggtgggcagagaataacctacaaaatccaacactttgaaaccaccaacactgaaggtcaaaactattgtttgtctaaccatcccataggttacccgaaaagaataagccaaaatcaaaatttgaattttagaacattaaaatagttttaaaactttaagttgaaagtaaatactttcaacttattttttttatattagcttttatgataaaaaatatataaattttttacatataattttttttattcattactaaaccgttacgacttataaatacttttgggtaattgatgagtccataacttttcccccctactccatcagagccattgtttggctgattttaagtataagcgaaacggtatatatgcaaataaaaactaatttgtaaataaaacttttatatacgtgttcttagcgatctaaaaggctaaaaaataaacttcgatgaaaaaccttaaaatcagcttcaaatttaaggttaaaaatttaaattttacctgataagtataagtataagcgaaaatataagcccgcataaaccggtaagcagggagtacttggaaagtcaggggtacagacgtaagaccacaataaaacgaggggctaaccatcaaaacaacccttcccccctctctctctctcacacggcctcatccatccatccccacctgagctcccaccggagaaaaccacaaaaccacccacccaaaaaaaccaaccccctccgcgatccccatttcaaaataaccccgccgcctccgccgccgccgccgacgaggaggggtcaccgatgttgtccgaccaggagctggcccggtacgtggagtcgttcgtgcgccaggcggcggccgtcccgggcgccgtggcggcggcggggggcatatcggcggagtccgtggcgcgccagctcggcccccagctcggcctcgacctcacccccaaggcccccctcatccgcgacatcctcctcgccctcttctcccccccgccgcagggggcccccttcacctcctccgctccctccccctccgcctccgcctccgcctccgcctccgccgccgctgctggccacttcttctcccagcagcagcagcagcagcagctgcagacgttcctgacggcgtcgcagcagtaccagcaccgcggcggcgcgggggccgcggcggcgccaccgtcggcgtacggcgtcgcggcggcggcggcggggtacaggtacgggcagccgttcccgcaggacgaaggggcgcatctgcagaggctcgtccagatgcatcatcaccagcagcagcagcagcagcagcagcagcagcagatggcggcggcggcggcgggggtggccgctgcgccgcccacggctgtggagagcccgcgccccgcggcggcatcgaagaaagagaggtggtgcctcccacgctttgtttttcctcttcgatttcccataccttcgcttcgagttagggcttggattagatgttcttttaggttctcgctccgatttttcagatttggttggcgcattgaggttaggtcaagactaaaaacgctactactagttttttttttctctttaacgctcacaaagttcttgatgagtttaatctttattactactgtggatcgagatatttatcacgatgatttagtgggggtggggtaatctggaaggaactggtttccgagcgattcaattggtttgcctgcttgtactacatctttaatgtccacggacgcttgtggaatcacttctagtgtacttgagaaaatctttgaatactgccgtagggatgtcaaccataccagcataattaatgcctctgaacttgttggggggcaataatggatcccgtcattctcctcaaaatgattgccatgcaagcaacctcctttggcctagaaactaagaatcgtaacgataaagttcattgtgctaaacaaatggattttccatattatttcatctggaaactggaatttaacctccagatcatatttatcatgtttgtttactccacttgattaacttccaaatcatattatttgtgtttacttcatttagattgactttcaaaaaaggaacttctcttagatttgctatttggcatgtgcttgttcagacataatgtccaagaagcatcagtgtgtctttatggaagaatgttcctgatatgaaatccggtgtacagactatgagagagataaatgtgcccttatcttgctaaatgctagcatattttactgctcggtctattcattgaaccttttttttttccttggtcgtgtttacgaaccagtgcaagtactggagtaaagagaagaggtggtccaggtgggctaaacaaagtctgtggtgtttctcctgagctgcaagctattgttggtgaaccaaccatggctagaactgaggtttgttctgctggctcacctctctagtgaattatcttgtattaactattacatcatgtatgaaaccctgacgttgtgactcaactgcagatcgttaagcagctttgggcatacattcgcaggaacaacttgcaggacccaaacaataagagaaagattatctgcaatgatgagctgcgtctagtctttgagacagatagcactgatatgttcaagatgaacaagcttttagctaagcatattagaccacttgaggcaaaaagtaggtcttcttcactctccagctatgttctgcaaaataatcaagcttttgtttgtggaataagtgctcaaaattcttgcagaagattcaaatcgagattcaaagaagttgaagcctgtcgacagcgaacccatttctcctgctgaaactgatgttaaccagcttccaattatcttgtctgatgctcttgcgagcttttttgggactggagagaaagagatgccctcgtctgaggctgttaagcgtgtttgggaccacatcaaaagcaataatttagaggttagtgattattaccaaacttttgtgtattacatagttctcatcatctcatttgaatttgttgtgctataataaacttgtggtcatttcaaatgtccaagcatggagaactacaacaggcaatgcatatttcagttataaacgagtacctaaattgtgttttaggatcaaagcatatcaagttgatgtgaggtagttagaactaagaactacttactagggaacaaatgtaagtgctaagataaggataatagtgctctttaatttcgtatcaatgctgttatatgcctgtagatttttctgatctgtttcatgaactgaattttgtatactggatgcccttcttggtctattttgattttcttggcagatctctcactttctattctctcttttagtttttcttttgtttgttggttggtagaatggttgttggtggttgaacaactagatgcatatggtggttgtatcggatataagttgttgggtgtatattcccatgtgcttttcatttttgaactcagaactggtacatggtggtcaatataattttgtatagattatcataccttatataaaatccagtgtagccatttgcgaggatttcgcaagttgcttctgtgtgcaagttggtttattatatcttttgacctttgacaggagtgaagcataagcaaagcatgtcccatttaagtcactttcctccttactttagtgtcccattcatagctaaatactagtggtttgccacctaagaaggtaatgaatgataaatcatagcataagcaaaatctgagtatacgtattggctgctcttagtttgtggtctattttatccatcatgcaaaagaattcgccacttctagtttctccatattagtttgttttgctgttcatggagatggcccagtatggtagttattgaaaatctgcctgttggcatagctagatgaagacaagaggttgctgctaggcatttataggttggatttttcagtcatctggttagcaagagattttatattatccatccaggatttcattaacataaactataatgtataaattgcttttgcttatatttgtgacttctcttcctcactgaagccattttcaatgttctctgtaaagcacacaagagatccttgtatcttgctgttctagttcaattaaactactgcggattcagtcttatatctatcttgcttgattttgttgcaggatccagcaaatcccaccatgatattgtgcgactcaaaacttaaacaactctttggatgtgaaagtctaactgccgtgagtgtttcggagttgctgtcacaacaccttttcaagcaacctaacaagctctaactggttagttatttcctttcagaacaacatcatgtattgagacttgcactggttagtgtttgctagatgacatccatccctgcttgcaactcctagttagtataggaagatgttgaacaatatcagaattttttaaagtaactggatctgctccttccctgtttgttccttgcaccgagttcgcaccttaattttattataatggctcttaggtgctggaaactactcaatctatttcatctatagcaaggtgttatcttgcatatcttatatgttaaggcagaagttgatggtgttttgttttgttttgcagatgaatcgtcttactggactctagttggtctaacaccctggtagtaggcgctgatgaaacaacagaaaatgctgaaagtgtttattctatgctttgtatccatcaaactgatttacttatgagaaaaaggctgtaggctaatctcttcacagtagcaaggaaaaagaatgatagttgttgcatattatgtagtcttgagtcttcttggaagagtcacatgtggtaggctatcttgaatttctagcttgttaaatactgagtagaaagcagcaccgaagcaaagttaaagctgatgaactttgcttgatgtaaaaatcagcaagcataggtgcgttctatggtaagtagttgctttcacctttgttgcttgaaagcctcttacattgttagtgctcttgttaaaaggacacctgtgctctccctgtattatgttgtcggtgatgcttaatttaaatttacagttttagattgtcatcaacacattaatcatttgctcctgttcatcgtattaatgaatggttgttgctcctaaccatcatcagacaggcactctttcagcctttgcttatacgcatcagttgaagtgttcttgcatagtgctgtggtgtttcagaatctgttgtcgcttcacctgccaccagttctacatctgctgctgattatttacaacatgttcttgtagctctacacagtagaccatgcttatgatttatgaagtgttattgctgtcccaatagacctacaagttcttgaacatattgtagaaaactaccatgaccaccagaccaatgatggcacatgcgactattgtcctcctgttactctcatcaagagtaccttctggcagaagcttattcgccaatgtcaaaattaccgcatccaaattctgcagcggttaaaaaaaggttaaattnnncttcaaaaaaaaggggggggggttttggggtttttcttttntttggggggggcaaatttttttttggtcaagaaagttttattgaatgctagcatgtttctgcactgtaaatgcttgcctggtgaattatctcaagaatcctctgaagtagtggcacataaaccttgttcacttcactgcaacaacaaaacaagaatacaatcctatcagtttcttcacctcttttttttttctgccgtaaatccaacattgttaactaatgtaaaaatgttcacatgtatattgctaaattgctaatcatggtttatactactgggtaagccaaatagtaacaagttgacccaaggttcaatttaatcagactgaaaaataataatctgaaattagtttacttaatgagcagcatgcccctgtagacgtgattggtggtgatgttgcagtctaggtcccaaggcagcttcttgcccttccattctgcaaggcaaaacgcagttaaatgcagtaattttttctttctgaaactaatttgtaatgcagtaacaaaagccaattcaggtgaggttatttctgaacaaacctagagaccatttgacgcctaggtcgaagccttcgttttcagtcggcttgagcacgaacgatacgtggtgcctaagcatcattgcgtggaggagcagaaacatgttctgttaaaagcaggaaatgtgtaaaaaaatgctgccctttacttgctccaaactcgttggatgctacctcatatcttctataaatctaaccatattgttctttattaaactgattaattgagaacttttgaaaattttggttaaaatttgaacaatagagacagctaaatcaatttcttgacagtgtgattttacggtcctaaaggagatagagggagatatcatagttttaaactgttaaatttggtactccctccgtttcacaatgtaatttattttagcattttccacattcatattgatgttatcattaacatcaatatgaatgtggaaaatgctaaaatgacttacattgtgaaacggagggagtacttcttagatataaaaaagtactaaagttcattctaaaataattggtatactacctcttaagaaccacatttatttttctaatttcgaaacagagcaatcactcacctaaaaagaaccccatttttttttctagagttgaatattgattccttttgttttgaagaaaaaaaaatatagcattggttccatatatatgtataaaaaccaatttagtactagatgtgacatattttaatacaacgaatatggacatatctctgtcctaggatgtgtcacgtccagttctgattcggtttttacgggacggagggagtagttaatttgtaccttgctcacttgtgaaacgtcaatggaggagattctaccgaagaagtagaggcactcgtcgccggcgagctcgagcaactccctgacgctcctgttctgcacggcggagttgagcttcaccagcctcctcaccgcccggaacccgtcatctccgccgccgccgtcgccgaacagggaattcacgcgcactcgccccctcacccccgccgccgccgcgctcttgctgctccgtgtcccggcacgcggcggcgccgccgatgggagaagaagaagacgaagatgacgacatggcgctgtcgtcgaagccgagagaagagctgcatccatggcgtctcggatgtttggattttcttggggatcgcgaggttgatcggttcgaggggtagctagctagatatatgatcgaattcctcgcgggtttggaattcgatccgtggactattccggcgaagaaagcaaaggatcggatggaatggaatggaatggaatgcgattgaaggagatgcccgcagtagaagaggttgcgaggttggcaaggcagggatgctcttccaaacttggcttgaggtccattgccctacaaatgctacatgccatttcatggctatagctgaaaatatgcttcagaaagcttcatctccaggtttaacatggcacatgacaatgtttattgtcatcactggttagtgcatagtgctattcagatggcttcgttcttttctttgattcccaactcgctcacctcgttttccgtgtgtacgcttttcaaactgctaaacaatgtgtttttttgccaaaatttttttctatacgaaatttgcttttagaaaattatatttatccacttttcaaaaatattagctaatactgaattaatcacggactaatgaactgttccattttcggtacgatgaggtacacaaccttaatgtgaattattttaccctattatggagcctgaattgtttttaccatttatcttttttatatcactaaaaggcactgatgagatatagttattccccgatgacctaaatatacttttccttctttatactccatccgttttatattataagatttttttttgtcttacttagattcatccattgattaatgtatatgtgtctagattcattaacatttttatgaatttgggtaatgctagaaaaacttacattgtggaatggaggaagtagtactttacaatgcctcaacacaacatatagagtgaaatagtttagtttttttttttttacaatacctcaacacaacatatagagtgaaatagtatttttttttaattgtcactggaggggagaggttcccacctgaatcttccattgaaaaagcattgtttagattacatggggggtacatgcattagccctagggctagctattatggatgtagagaagacagactatttgaaaaaaatactacaccaagcatcagcctctaatctgtcgttaactttaagatgctctgcccagagtgataattcttctttgcagcgcaggatcagccgttggactgacggctgaaggtcgcggaagacgacatcgtgtcggtgattccagagacgccataaccataagcagagtagatagaaggtcttgtagtgttttgaaggtatgtttggtggccgggctaaaagatgaatgttactcacttcggccacattgggtataactccgattgtcgtccaaaaagctgatgcgaaggggcacatgaagaagagatgattcgacgtttcgtcccctgtctagtagatggcacatactccctccgtccaaaaaaaaaaagtcaaaccctatgttttcgtgtccaactttgactgtccgtcttatatgaaatttttttataattcgtattttcattgttgttagatgataaaacatgattaatattttatgcgtgacttgtctttttaatatttttcataattttcaaataagacgaacggtcaaacgttgagcacggaaaccagggtttgtcttttttttttgggacggaggaagtagaggtgactgcaggattgtttttgtaaaaaggtttttggcagttggcaatcgatcctttgagagcaaccatgcaaagaattgaacctttggcggtgaagcattcttccagatgaaggtgtgaactggatccatttctgacggaggcaatagggcatggtatatccccctggcagtgagatcaccttgctgtgaaagcgtcgagaatctgaggtcctcctcctcagagagggaaatactccctccgtttcgaaaggtttgacgccgttgactttttaccacatgtttgaccattcgtcttattctaaaaatttaagtaattattaattcttttcctatcatttaattcattgctaaatatatttttatgtaggcatataattttacatatttcacaaaagtttttgaataagacgaatggtcaaacatgtgataaaaagtcaagggtgtcaaacatttcgaaacggagggagtaccttgcaatgtcattgtaagctgggatagctcctgtgaagcggctgtggaaagtcttggcgccagagtagaacagatggatcttcaggaaaccgacgccgcttggaacagatagtgcgagaagagagcagggtactgtagacggaagcatttgtctgggagccagcagtcattccaaaaggatgtgcgaagtccattgttgtcctgcgccctcgttaggatttccagctggggaatgagcttagatatctggctgtgtttagttcagcgcaaagtttaaattttagttgaaattagagatgatgtgactgaaaagttatgtgtgtatgacaggttgatgtgatggaaaaggactgaaatttggatccaaactttggatctaaacacagcctagatatagaatgccagtgaggtccaagcttgccgagttcgacgagagattttgaattcgaatttgcttctgaccagagccaattggaccaggagtttacccggtagaggctgaaaaggcgcttgagtagtaatgcatcattttgcatctgaagatttttgatccccaggccaccgaattcctttgattgacagtgtacaaacgataatggaaattatctgagccatcaatcgctttaagcgactccaagagcttatagaattttatgaaagtaatatatatcgttctaatttgaaacaatcctcttcagattaatagcctgggtaaatcttccatgagaaggtcgtccttcttctgttttctttttttggcggtggctgggtcacactgcaagaatcaagatgctgtaaattattggtgagtgaagctgtagggacaaaagggcgcatctttttttttcttattttctaggtgtgagtgcagtagctttagcgttgtactccctccccgaaaaacaaacctacaactgaatacgatatattttagtacaatgaatctgaataaatattatctaaatttatagtattaggatgtgtcatatccagtaataaattgattttctatgagatggagggactacacacttgcactgctggccaatagcccactactgaacttgccaaaaattttccaaaatactgaaataggtctcagaaaatagagaaaaagaaaagggaaaaaaatgtttcgagtttaaaaacaatgaagatttagcactgtacaacaagaacggtgtcgacatgcacaagtagcgggtgcaattcaaactcggcgccgcctcgtacattattattgccagtctaaaaatttcgaaatgcctgaaacttctgtagaagtttattggaatttgatgtgctcttcagcttctcgggatgactattgcctcgttttttcatgagcacacttcctaaactattaaactatattaagctgtatatgtatttttttattgaatagtttcttgaaaaatcaaataaactatgtttattgaatagccactaaaaagctggtctcaacccctgattcgaaccaacacccagtaccgtaagttgcagcccagtaccgcactattggtgcttggacaggatagcaaaggaatatgcctattttgccttcctcatcttttactctagattgagttgtgtcacttgccacaaaaccgggtataatgtatcccccatctttaaaaaccagtgcaaatagactctggtggtttggaagtagtttttgcaggtggggctcacatgtcagtgagatatggataaacatatgtggtgggccctatcggtttcatctccgcccatgtgatgtctacccccacccccatgctactacactgtgcgcgcatcgttccccttctcctcttgcctacatggcaccctcggcgtccctgaccaccaccactctttccgacatgcttaaccaggactgccgccgtgacgcccaaggccacggcaccttcctgccgtggaggttgtcgttgcaactcgtgctcgatctccaccgcttgggtgccgcttgtgtccctaggagcgccttcctgcaccccaatcgtcggtcctaggtccgtgccccagaaaccgccacacccagaggtgccccaattggtaaatatcgtcgtcgttgagaggcctttgagggagagagaggaagccgccgccaaacacatccacaaccaccacacactggctgagtttactcatgcagaagcgacgatggtcgtcttggcgagttgactcgcacgaggaggcgacgctcggtggcaacgaggcctcgacactgaagggagttagcggacacagtggtggtgccgcggattggttttttgaccgcccccgttaaggtggtggaggacacaacgagcttccccccatccgcgcacggccggccgacgtctcctcccctcacatgctgccagccagcaagtcctccctcctagcgcgaccggccaacaagctcctccctgcgcaagttgcggctagtgaaacctcccctgtgcgtgcccgacaggccaggtcctccccgcttgtgtacttggtcgatgagctcctccttccgcgcgcagccgactggcaagctactcccctacgagctacaaagattggtaccgtcgctgccgcccagcctttgttactaatggaaggtgggagaggagtaagaaaggaaagaaagagagatggagaggtgaggaagaagatgggataaggtggaagtcactgacatgtgggacccacttgctgattcagcgagttaaccatgggtaacctaccacgtcaggagaaactgctttccaaatcgtcgaaggagtctatttgcactggtttttaaagatgggatatgtgttatacaatttgtttttgagggatgcgacttaatcaggatcaagatagagggaggtaaaatagacttatccggtaggaaattgaagtctcgtccagactgtcccgaagcctggaacaattacacacctctattgagaaatatttgattcaaacttttgaagctttattcgtcgatattctatcaaatgctagctaggcttaaaaagaaagaaatgacacgggggagatttgtcttaaaaatactatcatactctcttgttttaagttatttgttactccagtttccttttaagttaaatatttctatctttgatatcatttatagaaatttatagagtttaataacatgcaaattatatattatgaagtttagttcacgccaagctacttcaaaatctttctatatagaagtttttcaaagtgattttatttaaattaaatcacttttcaaaatatttaataattaattgttaattagttatgagttaatgattcatctcgtattactagcaaaaaaatcaaaacctttacgctcaaacgaacgcccagttggattatgttacaacttactccctccgtctcataatataagggattttgagtttttacttgtattgtttgaccactcgttttatttaaaaaattttagaatttttttgatttactttattatcccaagtattttaagcacaacttttattttttttatatttgcacagattttttaaataagacgagtggttaaacagtataaataaaaacttaaaatttcttatattatgggacggaaacttaaaatttcttatattatgggacggatagaatacaactcaagctagcttgacagataaaacattcgaaagtagattttcatgttaggaacgtgacttgactaccgatactaaagtggtttatggtttatctagcatacaaaatgagctggatacacgcctactgcgacatgccatgttggcaccatagtactccgtgcaaaggactgttcattgtgaggacgcatgtggggcccttccaccgccctagctctgttgccacgtcagagttgggttgccgtttggctccaataatctgcctcctttgatctctgtggcctgccattccatggccacatgtgttgccctaccaaaataaaacgatgcttcaaaatgattttaaaaaatgcttgttttgtgctgttttgaagatgaaaaattcaattatttgtagcataatatctagctaaggccgaaggcttccaatctgatatgaagctggagttgtggagttagaaaaaatagcttcaccctttcttaaacactacatgctcttacgttataataggatagaaccataaataaaaatagactgtaagtgtgattgtaaaataaaacagtggatccggtggttacgtacatatgttacttcacgcgtgcaagctcgctgcgcatggtgggggaggggatggagggagaatgactatgcttttaaaataatagagatattcatgcatggatgaactagttatcactaggcaaatatagctgacgcattaaacatgtagctgctacaattggttgatcgcgtaactggtaggctgaaacatcatagccaacctcatcagggccggccttgacttttgtggcccggtgcaaaaaaaaagaaggcccccattcaccataaaaatacaagataatatttaaaatctaatttgtcattaacgaatttcacactaacaagtttaaagtacaatcaagcagtcacgatatgctcgatcaccgattagtcttgtctttcctctaagtctatcagacctgatatcgtaatatacatattttggaggtctctaatttttgaaggcccagtgtggtcgcaccgtccgcactgcctcagggccggccctgaacctcatccattgctacttgtataataaatttaagcccttgaggatttgtttattttgttttctatttcctgtttcttttttgaaaatgatagacaaggcaaattttaaataaacgttaacccaatttaaactaaaatcaccagcattctaactcaaactacaacatgaatgttttcagctccaacaacacgattgctcacagaacaattgatacaacagagtacttgccacggtagatcaagcgaggcagtaggcgtgtacgtggccgtggggccaacgctgatcaccggccatatccatcaccagcgaatttgtaccaattctgtcaacctatcctactctgcacgttggacgtttggtttaatttggactctcccaaacaacgcttttttctcattttctctatttcgctatcgtcctttggcctctcctcatacgtactagtctatgcttttagagcttacaaattcattacaaaaagttgtccaaccacgttcatcttcaagatcgatgatgtagatagatactatagctctataattctcctgactttcttctccaaccaaaaattaaaattcgattccaaactgcatttgtagttataatgaatgaaaatcaaaccaaaatgcatcgtcagaatttcgcttaaaacaattcagctcttttctaccatggttttgtttgaagagctcgaaattccgagaagaaactaatgagaaatcagctcgtaaaaatataaaaaacctacaatttttttctactttttagcttcttatttattttctaaattctacaattacaaattcttaaaatcttaacatttagaccgtatgggaaaaccgaagacttagaaaaaaaaagggtgtagttatgaaaagctcctccagcatggttcgatcaatctgatgaactggcggcgatcaatatcattcatacaatgtgtcaatgttgtatgataaaatttccccatcttttacaaaggcacccggatccatccatccatgcagctgcttttgggaaaaggtgcaagaaagtttcagtgccgtagtagtatattcaaagcagaggaatgaagaagatctcagctccatatgccgtaattattattgttgccaacggagcctcccacatgacacatgcgaccacttcaccccccaaccctcgctgtaaaacgctctacctgtagtatttcatattttcatggcaaattagggctaatcatcccaaattaatgaacttccatccaatgacatgaaaaacaactcatcaatcgatcaatattgaataaatcacaagaatatataattagtgtgattgatacagtccaaatggccaataatctcatctaattaagctagtcgcgagaaaggccctggtcttccggctagctagcaccgtagtataaattgtgggctagccgactcgagttcaagcctcaaccttctcttaattaataaattttaatatcagagttttttctcttatatccaacattttaatttacagtcaaccaattcttcagccgtattacggagtagttatatgttgctagctgcaacgtataacactcctatcctaagctactttacatatcattattgcatcctggaacaattcttggcctctgatgtcaacttctcgatcatcagtataatccactcaacaaaatctgtccatggattatttctttgtttctaactcaaatcccaaccattatattgctgtaaatcagtaatatgacactagataattaagaagaagaagctggggcacatgcatccaaaagctagctagggaataataagctcagtagattagcacatacactaacctcatcattttggggatgaaaaagatgagctaatttccaaacacatcacaagctcgaataaactagctatggctgatgcgtagctctaggcgtttgcacccgtttcaattcaaatcacagatctgaattcgagcgcacattcttcgatcggctcaagttgcaatgtcttcacgctagtgtcgatcgagtgatgaagatcgatctccctgatctctcgatcgtgcgcacaaaagaaaatgatttgagtaatgccataattaaagatcaattggtagatgttggatatacttcaacacacacacacacatgaagtaaatttacaaagttacatgaaaaaattattcaaactgataacaacaaagtaaagtcatatgtaataacaaaactacagttagaaagaaataaaattacaccctgcatacattagaaatatatactaaacaacatagaattacaattattttgggacggaggtagtacagctttagatgattgaaaacttccaaattttcagacgtttgaaatcccagagataccctaaatttcataaataatgtaccatgtatgtcaggatatagacggttacttttttttgtgtagtgctggagaaatcgaaaaccaaagtgtagctggcaaattaagaggctaggatacaagggctggcactatagaacgtgcatgcagatgcaggaacaaacaagtggtcaggtcagggcggtgcgtggctgcatgcattgcactgtcatgagcacgatgacccaatccttacaactcaaaagctctgcttcccctcatggccatgtccagcttgatcttggctttttcttcaccccatttatgcctctttgttctttaactatgcaaataaatcaatttccataggaaaaaaataaacaagactaatcaatttttggatccaatgtaaaatagtagtgcatcatgtaatcaatgtgagcttgtaggagtgtatgtacagctttgttctccaagattcccagcatagattagagactcgtttaatcatgctctaactcgtaaatttaacttcaaaagttagatatagagctttacttctctagatcattttataagagcatgccagcttattccgctttctttttatgtggagctgaaacgttttaatcgtactttagcttcagaagaaatgaagcttaagttggcctgagctgtgtcaaacaggcctagctagcaaaaaggccgatcagtttttgattagtgaatgggagcagtatttttgatccggtcacgcagggccacaaattaaagctggattaattgcttttaattaatcgcagtagttcatctcgaaaataattgaattagttgggaccattttggcctcgaaacccctctataaatagcccctccacctcaacacatcgcttcacacacgagatctcatcgatcagtcacagtgacgcagtgagcactagcttccactgctcgcatcgcttgtcatcatcatcagttcatcaccaatggccaccgtcgaggcaagtagctagctactgatcattcattcatattcattcatcctgtgacaagacgaggtttgcatttcgattcgatcgaaatcgatctcgtgattttgttgtgctgatgatgagatgaatgcatgcatggttgctttgcttaagagcaagtttaatagtaaaaccaactaccgactccaaatcatttgagtcaatttagtaaccaatttatgtactccatccgtcccataatgttgcaacctaagattggatgagacccatcctaagactacgaatctggacatgccatcctacgactatgaggcatgtccagattcatagtcctgagacccatcctaggttgtaacattataggacggagggagtaatagttacctataaacatatactactacacaattcatatttggctatacatatcacaacacacatgtatcttggagtttgtgctacagctggctataaatctatagtccactatagtccactgatcttctatcttctcgaaatgtgtttatagctggcttatacctgctcaaatgctgcaggtccaagcagtcgccgccgcgcctagtctggcggcggaggaggctccggccgtggtggaggctgtccaggaccaggagccggtcgtcgccgccgttgaggaagaagaagccaccgccgccgccgctgcggctgcggctgcgcaggtcgaagagacaaagccggcagatgatcaggctgcggctgctccggcggagactgtggctgaggccgaggcagaggccaaagaggcagagcctgcagccgccgaggaggccgagccggaggcggagacggcgccgccggcggcgatcgccgaggccgaggcaggtgaggcgaaagaaccggagccagaggcagaggcagaggcggcggccgctcccgtcgaagaagctgctgcggcgcccgtcgaggtggcggaggaggctgaggcggcgccaccggccgcacccgaggtggctgccgtcgaggccaccgagtgagctggcgagagatggcgagccggagatgaagctgatggctgccggcggcggcggcggcggcggcggcgtacgtgtgtgttgtgtaatgaattgggctccaataaaaatgtgtcaggttggctaccgggcccagtgtcagtaggtgctgacgtggcaggtcatcactggccctggagctcgtgcccgtgtatgttctcggtctgtgttgtggtttcatcgttaaaaatgctagtaataattttccgtatctttttttttgttaagattttctcttttttttttcatttttgatgtcacgaactcatgatacgagacatataagacacggtattgagggagctaaaatagacttattctaaaaaaggagcacggtgtgtctgctgtgccggcccgactgatctcaggccatgcctgatcatgcctgggccgggttgggccggcggcccatttggctatctatatggggatgagcttttaataatcacaatgcttgatgcagtacagataaacacatataagtagtcactactatgactgcaccggatccttatccatagaagtatgtgtgagtgaactacttggtggagagcttttgtttttctcatgtataattggcccgcagatggtactgccattgcaaattttaagcagtgcaaatctaattcgagtggaatttatgtagcaggcatataattaattgaacacattacgagtttgtttggaggatgtagtagtaatgtgcaaagcatttttcagttgactgttttttctatgtatgtacaacaataaatagattgttgcaaacagatcctaatattaacttcagtacttcatgtcatgttcaacatgtttaagaatactgaaagttgacaacatatttatcctagtgatgtgaacatattcaaacttaacaaaaagttggctggagtgctactgtgaagaacggaggttaacttttgatgctattaaagtgaattagaatctttcggtgcatatatctgatgtcgggaactttcagtgttatagaaccaatttcccctataataaatattcattctggtgatgtgaatataatatttttctcagtaaattattttcttgtcttaagtgttattgtgaatatatattaatcatgcatgatggagaatgatcatttacaactaacttatatgctatttttagaagaaaaaaaaacagtttttgtttgtggcattgcaaaaggctatttgtttagttgcataagttcctcaaagtactgtagattaaagttaatggcattttgtgtatactaatgtcaccatataaatgcatgggggaataggagcatgattgcttaatttcggaaagattgttttgaccatggttaaacttcagaaaattgctgcaagtagtttgtatggtcttccatgcaaactatattagataatgcttaatttcagttgttatagtttacctctctttggcgttatccacaagcagttgtcaattgctaaaatttcgaattgccacattacatgatgtgctatttctatattatggtcttacacaatttttttttaaattctcctgtgatggcagttggagaagatgaagataatggtgtaaatcatgtaatggaaggctgtaggatctttttgtaggggtgctgaaggatcaattatgcgtctgcaatgcatggcctatttacgaaaattttggtagtatttcttatgtatttactaaattcagcaataaactacacgtagacacctttttttataactttaccaaaaaaaaaattgtatggttgaaaatggcaacaatctgaatagccccgcagttctttcacagtgtctaaagtagtaagcatagactcctaggactgttgatattctaactatattaaataatgctatgtttcaactaatatggcaaaagtgatatttgatcttaattggaaattacagttattactccactaaatgtattttgtttgtacgataagatattaattggaaattaccgttattactccacggatctactaggttttattggaggcctacgtaagcccatagcatttttagatcaagaccaccattagctatactcctttaaaaataatccaatggtgttgacagtgaatatgtcaccccacctaccccgttgtaatttttacatattacgctttaaacctcttaatattacatacaactagatttaaatggatagccacattttcctatagggaaaaagtgggctacatatttcatggtaaatatgatttattgtagtaaatattgtgatattttttttcttttatatgtagcaaagcacatggatttagctagtatggtgaaactttgctagacctaatgggcttcgtttcctggccttgggccatggcctgggtggcctaaggccatgacttgaggcctactcccttgatagtagtttccgttgggattaaatccccaaaccggacctgatgaataacaactccctcaaccaaaaaaaaaaaacaaatttgagtttgagttaaactttattaaaaatattatttttttagttcaccggtttatcgaggagttttatgtttgagcatatgataccacgtgcaatgatatgtccgataaacatgctagcagagctgttaccatcgatcgatatttgaaatcggcgtgcccacttggccctgtggttgaatctgatggagatattaagtatgggcatgcgaaacgagaaacccttttaacatgtgatttaatgagtttaaacataaaattagatttatgtaatattgtaaaacaacttttatatagaaaattgtaaaacaacttttatattgtgccaaacggttttttccttttttggagcggagtttgcagagctgctccacaaatttgtactacgggggtggagctgggtttttctgctccacagctccactccatcccaaaagacccactaacctttaattttttagtgtatttacacaaaaatgccactgaaataccccttcctacttctgtcctctcgttctctctcctctccatcttcttccccatcctcctccgacggccggttgtggtggtggcagcggcgtctacgtcggcggcggcaggcggtgtcggcagccgtgggcggtggcgcggcggccgcaacgggcggctcacgggtgacggcgtcgacaggcggcggcgcgtgcgcggtagcatgggaggcggcacgcgagctacggcggcagtggctcgcaagctgaccgatgccgacggctcgcaggctgcccggcggcggcaacggcagggtgacacctacaagatgttcgacaaaatggtgacgagggatatggtaacatggagctgagtaatctagtcaaacactttctatacatacctcagctcctaaaggagccaacttttactggagttgaagtttagagtttggagctctaccaaccgagaccttataagagggatggtcttataatctacaaggccttcaccagatcctatttagcttgtagatcgattataactcaaaaacctgggtcctaagctaaaacacacacacacaaaaaaaacactaaattggactttgactaggggttgaaggtctgaccgtttggacactggtctgaccacatattattgtccagtctgattgctcaaagattagcggtcaggccggcctggcagtaaagtttacaatcctttttctaaatttagactaaaattgatctagtgctaaatttagctgtcaacagaaacattaaaaatttgagaatgttatgttgtcggctcctgagattgtaatctatttggagttgataattgagatacggacaattacataatcaaccactcaacacatatcatactcgctcaacctcgatatagaacacacgggtctttccatgcgtctaggagacgacaataccgtttgtttgtcttccattcaaccgacgcttcgagagaagagggttggggtacccaagtccctagatagctagggcagacatcatagaatgccatattggtgtccttggtagtaggagtcgtatctacgagacgaaaaccaatggtgagtatcttaggtggacgtattgaactaaaataagatttaaaattgacaaggaggtctcactttccacgtaagtgtatcgtgagggtgttcacaatacgggctacgcactcaagaggcccaagagaccaactatgctcaagatcgttgtaagtaacaagcttcacactacatcgctcgtgtacgcctggcaaaaccacgccacgctaggatccgccctccacaacacggcggtgtgcccatctctttacgtcgcatgctctccatgtagacagagaacgcgtgtctatctttaattccgtgttcttcgtttgactccgcatatggacgacatagcgttgaatatttttttttccttttttgcgccatgggtacggaacaacacgtcgattgcattgctaacgccctgaatgtcgtaaacgctcacgctactgtcgctgctactgctgctcgtaaacgccggaggcattttgcatggaacggcttggacatatctctggtcctggacttggtcagtgactgaggtgagacctgtatattttggcgttgaattagaaaggctatcgcacactgtatttgtcatggactcgttcagaaaacatgggcaccaaaatagtagtgccagcgctcacacggcaatactaataagtacccataataagcacagttgtagctttcagtgtcaaattttgatcaaccgtcttatttaaaatatttttatgattagtatttttattattattagatgataaaatataaataatactttatgcgtgacttaacttttaaaaatttttcataaattttttaaataagacgaacggtcaaaagttaggcacagaaacttatgattgtacttataatgggacggagggagtaataactagtgaactggcgcacacatataagttacgtcgcatcatgcgtccaacgaaaggtacaaacctatttagcacagctctagctttaactttaacttttctagagctgaagttcactaaaaaaagtttcagtttcacctaaaacgaaagcgaagttaggtaaaagcagtctcataaaataatttatactgttttacaaccatattctagacccaatttctataccaaaattttaaagttgaaaccctaccgagcatacctcgatcgatcatgggaccgtcacacggcttcggcgtcgaaatccgggagcaacagccggtgtttctgcaaattgcaactgttagctagagggaaattaatgattgcgacctgttggccaaactaataattccatgaggatcatgacaaggcctgcaactactgatagtaatagtaaatagcaatccctttcgtcatggacctacactactacacaaaatccttggacaaaaacacatttagattgcatacggagtattactggtcgtgtttagaaaaaataagcccattttcacgtacggtcgcattgaaaaatacccacccctctttccctcctacccactttaaatttttccccctttctcacctcccctctttttctcctctccttccctcctatccactttctccacttccttccgtcccgtcctctcctcccctcccctccccttccctctcctcccctccccttccttccctccccgatggtggcaatgggcgtaggctgcggctgcggcagcggtggcgcggcgatcaatgacgcgcgggatccggcaggcggtggccgtccccgcatggatccgtcggccgggcgccctcccctacaggatcccgctctcctcccctcaccttcctttcctccctagatccggcagaggggaggggcgtcagcggcggtgcggccgaagggaagcgcggaggccgccgccgggagcagcgtcctcggccgccgcggggaggccggatccgtcgctggccgctgtggggaggccagatccgtcaccggcaactgcagggaagacggcagcgggtctcgggcaaagtggcgacgacgatagtggtgacggcgacgacggtggtgacggcgtttttgatttttttttgattttttattttcccatgcaggcagtttaagcgcccgcgtgcgggtgtgtcacccgcacgtgaaaatcgtgattttcacagacacctcgttccagacgggtggaagatccacacgcaaaaaccgattccgaccacacgaaaaaaatcgttagtctactagtgttattccatttttagtctctcttgtttaccacaaaataaatttaatttaaattttagcaatcattataccaaattttataaaagtaagagataaatgcattgactgggagtagataaagtgagagataaggattcgatagagcagaagtagtgtatgtggaagtgtgaaatataaatttatttagaacagagtagtgtgtatatctctttataaagaaatactactagaagtatactagtatatctctttagagaagaactgctagtataatacttcctcattttttaatagatgacgccgttgactttttctaacatatttgaccattcgttttattcaaaaattttatgcaaatgtataatatataaatcacatttaaagtattataagtgataaaacaactcataacaaaataaattataattacgtaatatttttaataagatgaatgatcaaacatgtgagaaaaagtcaacagcgtcatctattaaaaaaccgaagatagtattgtttttctcatgctagaagccgaaacggtcgaccttgaccggcgacttgcacacgtacatactagagactgaccagatccaaagctcaaaacagagcccaagtcgaaggccaagtctgcatttcttggtgtaaaaaaaaagtctacatttcttctccacaacactaattttcttttgttcttttagataatatcttggagttttatataccctttgggtgtttggaggcatgcacgctgtgacacggacagatcgctgtcatctttttccctctcttgtttggaatctgccgtgcggacctggtcacattcgtggttcgttttgcccaatacaaacttgcaatgtcgcaatccgtcttgaccgctgaagaaaccgtttccttctttttatctcccttttttatcttttcgttgttgccatgatcattgtggagactgttttattgtgggcggtcaacattcggtccattttacaatattaaatacccatgcattgcaatcagcttatattaaaccctacaaaataaaataaaattattccctatctaatcatcctaatatatgtggtaaaattttgtacgtgcatgtcgagttacacggttgctgaacaattgatataaatatacatgttgtatgaaattcatatagtgaacgctcaaatataaacccacatgacagttggtggcagcagaaccaccactaccaccaatattttaaagtagtatagaaaattacaatatggatacaaaagtgtaaattccaagtggccactcgcattttaaagaaggtggttgcatccctttagacccgttccaaagtccgatctgaaatggattaaaacgagaaacataattagcatgtgattagttgagtattaactattaaaaatttggaatatatatatatatatatatatatatatatatatataaaataaagcaacttctacatagaaaattttcgcaagaaacatagcgctaaccagttttaaaagtatgctaatgaaaatttagaaaataacaacccgaagcgtagtttaggacgcgcacttcgtctgatcaaacatttattcattccaaagagatcaaacattcatgtattgtcataggtttcattttgccccttcaatgtatcttgacttattgtgctttaaggttaatgttgtaccacagtattttgtttttgcagtactgtaaggaagtgatagcaagcatttctctattaggtgtgatatattattatcgtacctcatattatttcccaaaaaagtatggtgtaacatattacttttccgtatgctgaatatattttaaatagagtgtcgctagctagatttcaatgatctaaatcctcaaaaatttgcttatcctaggatccatgtcaagatttgtgtccaacgacagcgtgatgatggtggtggcgactgcgacactatgtttagggtctatgtttggaggtgtgtattgcgtgaccgtgtccgcccactaggcaaagtccaattcttctttttaacaattcggcagtgcgatgttcatattgatagagcagaaaaatgtaaagttcagttccaatttctaattccaagacgttggcatgccctcctccctctcaagatagcctctaccttcggttcaaaaataatttcactttaatttgctcccttctaatatgaatgttattcattcaatatgttttatttatatcttacctactcacgtaaaattgatgttgctagatttatcgttaaacaaactatcataatatgcaactctttttatttattttttttatttttatagatattgttggtcaaagtagcatattaaaaattgtgtcgaagtcaaaagtacttatattttgggacgaatggagtatcatagtacaataaacttatattattatattatatctaatttattttttttaaaggacggatggagtattctggtttgctgccgtatctgccatggcgattgaggtgatcgatcagttcagacttcagagcctccgtatgattgactggatcactggatccactcctccacttttgcccgaatccgtcgcagctgattgcgaaacagaagcgcacatcgctttacaagtttacagctgcttggcactatctcagcttcgttcttcatctataaatgatcagctttaggctgtgtttagttcagtgcaaagtttaaattttggttgaaattagagatgatgtgactgaaaagttaaaatgttgtgtgtatgacaggttgatgtgatgaaaaaagactgaaatttgaatccaaactttaaatctaaatacagcctagttagttggttaatacaaagtcagaggtatatacgcgtgttttcacctgcccagatgcatggtttcttctcctgaaaaaaaattatattctagctctatctgcaggtcgaactagcatgaagcaatcaagagtaagttaaatcccgtttgtttaaaagtttgaatgatcatttgcagtactaaatgagcagaggaatggaagcatgtactactatataagtaaaggccaaaagacaagcgggaaattaaagaacaatagtactttataaacaaacaagcacctctctatcccaagacttgacaccatttaccaataaaaattatcatgacaatctaagttggggttatcaaattcttcgttatacatttaacaagcgcaagcaaatcctgccattttcttttcaacgttgatatgtgagcgctatgttggaagcgaatcatactacaactatgatttaattattttcggccattcccacaactctacgagacataaaacgaggcaaattaattgattattaattattacaaacatgaacacgggcggtctacttatgttttaatgaaacctctatagaaaagtttttgaaaaagaaaaggaacattcagtaatttaggaagcccgctaacgaaaaacggaaaagttgccactgctaatagcccaaacaaacggtgctagctgcaacataacagcttataagttgatcataagttggtcaaatactatttaaaggccagttcttttcgtttatgtttatgcttataaactaaaatttgaattttcaacctacaatttaaatgtgatcgtgaggtttttctcattatagtttatttttcaacctttactttcaaatcgctaataacatgtatataaaagttttatttacgaattatttttcgtttgttaatatgccgtttggacgatggagttcttaaaaatgaactgcatctcatatttaaaaataacagaggtagcacgcggtaaacgataaaataaataaagtactctctccgtcttaaaaagactgaatttttaggtttacatgtccaacgtttgaccgtccatcttatatgaaatttttttatgattagtattttcattattgttagatgataaaacatgaataatactttatgcatagcttatctttttaaattttttcataatttttttaaataagatgaacgggtcaaatgttagacacggaaatcgtttttttttttacgggggagtatactgatagctaggagtaacaaccaaacagttggagacaagcacgcggttcgagcgagcgtcgtctttgtggtgcaatttctcgggggacgccaagccccgctcggttcacgggcgtctcactgtgcggtgggcccatccccagccgtcccctcgcgggccaccactctctgatgctgacaggtgggtcccaccctctcgccctcttctcccctatatatacatatagtacaaaatccccgtgtgccaaactgccaatattctctctgccaaacaaaaaaaaaggaaaaaaaaccaccgcttttcgcagtgcgcttcttctctctccctctctgctctgctcttcctgagctccgcggcaaggaagcttctggaaggttctgcgggatgacgacgagcagctggggtggtggtggtggtggtggcggtggccccgtgcggctgtggtgctgcggcctcctcctgatgctcctttcaggcggaggcgggggcggaggcgccgccgcgcagaggcccccggcctacaagaccctctccggtaagctctgctgcctccttccccggtggcgtgcggggagaggaggagggggaaggggagggggaggaaggttctggcaatcggcctttgaacctttcctcttgtttttgttctgtttcccttttctccacggcattcaacgactctggtttgaatgggttggggttggggtttttgcttttgagttgattcgtattatataggatttctaaggagcaattcctttttccatggctggaaatcatgtgagcagagcagcaactgagcatatgacctggaaattgttaggagtttcataataagttgagaaatcgctgcaccgcgccgggttaattaattgtttcttgtcctttttatctgcttaattaccgatcattacttacagctctgtaactgataattattaccaattaaaattatagttcttggtgtgtttatgggttcttgctattgatgtgtatagcctgaattgagcaaaccattgggcatttgctattgcaggtaacgcgcccatcgtcatagctgaaggtggcttttcaggagtgtttcctgattccagcaaaaatgcctacgtttttgccttgtcttctacctcgggtgacaccgttttgtggtgcaatgtgcaactaaccaaggatggtgtcggaatttgcctccgggatttacttatggacaactgcaccagtataagccaagcttaccgagcgggaaagaaggcataccttgtcaacggcgaagaaaaaaaaggatggtttcctattgactataccatgtcttcgctgcaaagtgttatctgtaagtgtcaacctattattttttcaactcttctccagggttcaccgtttaggaccgaaatttcgggtttacccctgggtcctggtagtatgtgcctctgatgttcaagtttttttaaaaagaaattccctttgatcaccaaaacacatgatggttttgcctcttagctcttcacatagacataggcactatatgctttgaccgaactatcacaccattatgatattaaaacagtattcatgaagcaatgcactatttggcgtacctatcataaaactgcatgtgtgatgatcttctgttaactaatgactctgatcaaccaagaaaacctgtaaatgacgcatggtaatattttttttagggtgacatatggtaatttctgatcattgtgtcaattaagaaatctccctggtctcttcattataacagcatggcacaaaagataccgaagtcatttagctcctccagccaccttagcagcatcagctttcacgtcatacactgatgtgtccaggccacactgtgcagaaattaccatttgtagttaggtgggatcagttggttagattgtgttaatgacgagaacttttaaaatgtatttccgcaataggtattccacacaatgtgtattttggctaaagcacgtgtagaatttactctgattttgattggatgatgaaattcctctcttgaaaggtgtgatgtgttgatgtgatttgttgctaacctggtatacttctgtactctttttatgccattgaacagtaacacaggcaatttggtctcgcaccgacaagtttgattttgcattccttcccattcttcctgttaccaatgtgatagatttggccaagccatcttctgtttggctgaatattgaggttgacctactgctcttgcaacttgaacttgcaaaagttgttgttgctacttgctagctgttcatgactttgagttccatagaagctaatttatctttcattcgtgcagcacgatattttctacagacagcatggtttgaatatgacaaaatacatcctttcaattccgaagggtggttctgtgcagtatatctcatcacctgaattgggttttctccaaagtatatcaggaagagttaatcgcaaaacgaagctagtgtttcgttttcttgatgcaaccagttctgatccttcttcaaaccaaacatatggttctctgttgagtaatttgacatttattaagactgttgcctctggtataatggttcccaaggagtacatttggccagtgacaactaataactatattcagcctgccaaatcaattgtcagagatgcccacagtgcaggtttagaaatatatgcttctgactttgcaaatgatagaattattccgtataattacagctatgatccgttggaagaatatttgcattttgttggtagtgataacttctctgttgatggagtattatctgagttcccactcactgcagcagcggctattggtaagattctatcattattactctaattacttatcaaagttggaaagttcatcagtactcctctctgtaaaaagttagtgaatctgcaagcaaaaaaaattactaagaacaaaatttgtcaatggatgcttgatatttgtttgataaggaacaacactactttcatagctttatacctaataattggtcaccaccaaaatactgtggttcgtttgctctactgaaaactacataagccgattggtcaaaaaatgatcattcaatcctttttcttttggaaaggagatgatcatctgatttagttctttcttttgtagttagatactttacataagatcttgactgcaagtagaagaagaatctaggattgttgactcaagtgcttgcacatgggaaatttctttttatccaggggttgggtcattgttagcccaatataaccaccacagttactgattttccccttatccttaatgaccaacttttctttattttttttaaacattcttacagaggagcacaaagtacgtcatattgaagtttcatctacagcatgtcagttttaccattataaaattagattctatcctcgatatgttttaattttgtgctttttggaggagcactgaagcatttccctgatttgtaatatagaggaataaattgtaaagttgaatgggtgatcatagataacgatgatcattgcatcaccagcatatttggcactgtctatcatgtaataatatccataaagcatgtttggtttggattctataataataaaaggctatacaaacttacgtcctaactgattgaagattggataatttatgccttttctgcccatatactaactgattgccttgtacttccaccaatcacaattatgatgctttctttaattgtttggtgaagtagagtaataattaatgcattttaatctctatgtctgcaggttgtttcactaatttgaatgtaagcagtaagacagatcatggtatgtttcatttgggtgccaaacctactgtacagtaagacccatgttgcttgatacccagaagttctacttgatctaattgctgtagtgtttctatacagggagcccattaattatctcgcacaatggtgctagtggagactacccagactgtacggatttggcttatcagaaagcggttgatgatggcgccgatgtcattgattgttccattcagatgaccagtgatggagttcctgtatgcatgagttcaattaatctgtttgagaccacgaatgttcagagaacccctttcagcaatcgtgcttctatctttaaagatattcagcctactccaggaatcttcacattcaatctcacttgggctgatattagcagtagcgatttgagacgttagtttctttacctcacacttgctattttttttctattagaatttatctactctatcttggcaattaatgtggatggcacaataaatgaagaaaaataatcatgcatttgatcgttgtctacagccaagatatcttccccagagagtatatattatcttgtaaggaacccagtgcacaaaaatgcgggaaatttcttcaggttatctgactttctaacatttgctaaggataaagatttgtctggcatcatgatcatcataaaggtgatgcttcgtcttgaagtacttcatattcttgttaatctgatcctttagcttcaaattttctaccgcttgaattacatatgcactatcatcttccttctgtgggcaaaagttcttctgaaagttagctttcaatatttgtaagacaaacatgagttattaacacagcctgttttcggaagtctgtggtgcctagtaataatatattttacattactaccatatatatctatatatgtatatgtaaaattatattttcctcattcttgtcacatatttggaccaatttaaaatatttccgtatcagtggagccttttacattgatcaaaccttttgtactgcagaatgctgtatttatggcaaattcattaggatttgatgttgttgattctgtaaccaaagccttaagtgatgctggctataataatcaaactaccaaagccaaggaggttatgatccagtcagaagatagtgctgttcttgtcaacctgaagcagctggaaaccaaatacaagcttgtctacactctcccatcaactatcggggatgcttctgcttcctcactggtagatgtgaagaaatttgctgatgctgtcattgttgacagggaatctattttccccgagagccagggctttatcatgaaggaaacaaatcttgtgaaagatctccgttctgctgggctagctatctatgcacaggtgttccggaatgagtttgtatcaccaccttgggatttcttttcagatgtaacagtggaaatcaatagctatgtccagtcagttaatattgatggcatcataactgattttccgaaaacagtcagaagatacaaaagtaagtgtcattttctgtatccaattatccataaggttctattatttcaactcttgcatgtcttagatatgatgaaaatgaaatgttcgttcagctgatcacgcctagtatacattaactctaatggaggaaacaagtacaaaagaataaggaaatatcaactttgcagctccatttaaccaccagcaaattgtgtactgacatcttgctaatctaacatggtttttatcacctagacacaattatcctgtgtactgccatctcgctaatctaacatattttagataaagcaaatatttgtcttgttacttgaattgtgttatgttttgcacagtaatttatcctggccatattatggtgtcactcactgttgctgcttgcacgcatgctgtcctgttggcagtgaactcctgtaccggtctgggagttaacatgccttcatacatgaatcctgcggaaattggcggcctagcgcagctactcaacggcagccaagcccagccaccagctctggcaccaatgccggtactgaactcatcagacgtcactgaaccgccgttcccttctgccgcgccgaagaatgcacctggcggcgctgccaatgggagcacccctgcacccggtgcgtcgccgtcaggctctcaggccgctgctgtcatgagagccggcattctaccgatggtgacggcgctcttcgcgtctctgctcatctgagctgacatcctcagttgaagctgtgtaattggttgttcagagttcagttatcacactttccattggattgggaaagctatttattgtctgtcaatgctgtgctgctaggaatccagtagctgttttggtagggaaacatctgaatatccgtttcttcctgctgtataaatctgtttataggacaaaggctacaaatatattctagcaagcactgaactactgaatgaatgaagccgtaagtgtaactagtagtgtacattgctgactgagctggaagcttcagtgtaatgttgtaattaatctcatctcctgtctgaagagatgcattttgtatgtgttcagaggtgcaggatttcctttgaacttactagacgtggccctaattttgttttaactgaataaatgtgggtgaaatctgtagcatgagatcacaatcttgtctctctcaaattctctctgaaattatctcaggattattggttctgagccagatggtgggggaaataaaggagaaaacgtcctcacctcatcagggtcgtttcgacgagcatcaacagcgagcctctcgccggagacgacgacggcgccgccgccgccgccgccacaggagaatctggtcgagaaggccaagcggggcggaagcatctggaacattctagaaggccggcctcctcctgcttcacgctctaatagtctataaccccgtgattccgtggtttgggccttcgcgcccctggcttccgagagcgccgcgggggaggaagtttaataccataccagaaaccgagcgagggtttcttcagcttatataagcacaggctgtggcgcttcggccgtacccgacgggtttttacttattagaagctaataatgttcttactcatccttagctcttgcagatatgcctctggaggcttttttttagtgcccttgcaccttctgaaatcttacgtttaggtccttatatctagagatggcaatgggaacccataacccgatacccgacgggtttttactctattaggagctaatcgtgttctaactcttatactaatgggtttactgatgggcgaaaactcttaaccattgggtacgtggatatgggtccgttctttaccacccgtacccaccaacccgtgggtgaaaaaaactcgttgattgagcctaaaactatgaggaatataagtctcaatgactactaaatcatagcataaaactcatttcacatcttaaatattgttctagtctagttatatgacattgttattagatttcttgattatgtaatatggttgtataattttttttactcgcctttgaacggtaatgttaatagcattgctgctagagaaaatattgatggtttacaactctaatatggctaattacagtacaaaactataaatgctacaagtcaattatatgggtatggatacccgttacccgcatgggtgtgagtgtggatatggggacgattttgtacccgtgacgggtgtgggtatttaagtggggatatttagacattacgagtgtgggtatggggcaagggaacccgatgggtatgcacccgttaccatctctacttatatctcttggtccctggaggtatttttttactaatttacgtgctggtccttagctcttgcagatatgcccttggaggcatttttttgtgcccttgcaccttctgaaatcttacgtttaggtccttctatctcttccattcttttaacatataccatctagttacctttttaatcttttacttgtaagctttggcccctcgcaacattttgttcttcacatatatccttctggcatctaacaatctttcaaataaaccctttcatcttttatatctcagggtcgtagctacaaccggtttaacttgtatgaattagtccagttatttggcgatggtttgtgaactagccacgaggagcatacagcctgtacgtatggccttgatgaccaaaatatatctgtagaaaatgtaaaattatagtacagttgcacgccattcttccagccaagcatttaataaaatatcaccgttaattgtccttcaatggaagctggggatatctcaatttatcacaaaaataatcaaatgcgaaaatatccatatcaaatagtatgaggtaggtgttgacgcgaaaaacacgcactggcctgagagatctgcttaactctgcttaactctgcaggtccaaagaattgcctttgggttctgagcgtgccagctggtttgatcctgcaaccaacaagatagaaaaaagggcaaagagttaaatccatcaacgataggggattgacaggattgccaatgacgtatcgtcagaggccatgccgatgtaacttgcgtcagatcgacagaggcagatgaaaacttggagattgtttggtgtactcgatcggctgtagatgttagcgatacgtaatccatacaatgggatacgcttagatcgagtgattgggatagatcggtagctgcactgagacagtataaatcactccatatctaaatgtgccccaaagcaaggattatgcatgctcatagcatagccgataggacaaacctaacttgcatcggctaatactccaatactgccttataccaagatatcagcacagatgaaatatgtaaaactgaaaccaatctagcaagcaggatgaacctagcagattaataggaagcttaatatactttaaatagatgagatcttgatataagaggcatatttagactatccagaaccagataaggaagcaagacgactaaatcaggtaaggtcggctaaaactccgatgctatctctattagcaatcaaagaaggaactagataaaacgtttcaagacagtacttaacagatcgaacctaaccgatgtagcattaagcgtggaaagaaacataacgatgtagcattaagcgtggaaagaaacataagatctaatcaaatcgatgaaaacccattcaagattttagatacaccgcatagtctagcttgatatcgaagcctaagcttatcggccgttttcgatgatagaggctagccgatgaagcttaaatgacgagatcaatctagattatgcggtatatatgataactcggtggtttacgtaggcaggattagagtgtcatgaatatgtaagcactaatcccgagaacgcaagccgccataacaagctttacctcttcgtcggagatcgaacccgatgcagcccaactcgaaagcaaaaactcgaaacaataaaaatagaaaagggtggtgatgcgctgaagtatattgaactgtcgtcctttgattatttggtgtcgggtcatatttatacccaaagtacataatatgtccttactggacacagctctttatatctaacacaatttaaaatacgaatgagtccttcaggtggacccttaccaaaatatctctaaggaaactagaaaatgtcctaattaatagatacaattgccctttctaagactccaatccttgcgtggcaatagctatgaagtgcttcaaccaatccgatgacggacgtgggaccatctttcccgagactggttgcattggcttaccttcgtcggatctggcgctttgctgatatgtggcagtcgataccgcctatagccgatgctgctcgtaacctatacgtattctgctttctcgaacaggatttctccaaatgggcttcgtttctaacttcgaatccagctcatggtattaccaaatttggtcgttaacagtaggttaactggaaacgtatcttatgcatagaagcctttgcgcgtacacactgtgcacaccaactaccaattttcataaaaaaattctaataaaaattggacatgtactttcaatagtattatatctatgtgtaaagttttatcttcaaatttactatatataaagggtaaaaaaagaaaaaaaattctaacacatttatactcttaaatctatcagaatttttatattttgtattttagctgtaacaagaaaaataaaaattctgacatataagagaagatcatggagacaccaagaattctacggaattcctatggaatgactggccgaagaaaagaagatattggaggaaaattaacacgccgtaggtttaacccgacggaaactttctttgagtcctccatgtctctgtacgtaaatttatactatgtctttcacgtggctaaaatatcctttcattcaatttttcttatatttttcaacccctgttttatattctcgtgttttctcaaccctgtaattcagagagagcctaagggcatctacaatataagccatatcaagggtgtcattactaactgaagccactcttagagacacccatctctcaatgagggatactcgcagctgggctttcaaaatatcaagtaaccgagaggtactccagcttacgagataccccaacccacgtaaccacgattatgtatttccttctctattcctagcccaccgagcacccaccagcttctccctttctcttctcttttcttcgccgctttgatcccatcgccgtgatcgccgcttcttgatcctctgcctcctcgccctccgcagtagtcgcaaccaccgcctccctcctcaccctccgcagaagtagccgtcgtcgctgcctccctcctcgccctcccgggcaccactgcttcctccctcctcgtcctccctagtggctgactccatctctctatcccactgtcgccgctctcgccctctctcccggcagccgccgccgttcttactctctctctctcgttggcgctctgcccctctctatcccgtcggtcattatcgcctctttctcctgccctttccctctctctcccaccgccaccgctcgcctctctctcgctctctatccccttggccgttgccgctttctcccgctgctcgttgctgtccacctagctagctagcagccggatccactctctcacgtccttcctctcccgccgcctctctccctctttgcacggcgagcggcacgcggggcgtggtggcgacggcgcgatggttgctgcatcccctctccctccgccagtcaccgcctcactctccctccgtggctggtcaggaggccagatccggtcggccgtgctgtccctaggtcgtcgtcgtcgcgaatccgtctttgcggggctgccaacggctcctccaccacctcgctgcctcgcaccatcgctgatgagcaggggagacggagagaagacgagcgcgatgacaccaaggaggagggagcagcagtggagatgagggtggaactgaaaaaacggggggaggggagagcggtgtccacaggctctttacccggccatggccgacccagcgtagctcctcgcctggtcccctagccgaggagctcgtagagccgcgtcccttgtagagcagacacgcgtctctgccgagggacggtgcggcaagcttgaaattagacgagagccgaacgccgtgagccagagccccgcgccgagctacccatggtacatggcctatcggttgctagctagcttgatcacctcaaactcaaacccgtcttaattggccctccgatcctcagggctccaccacctcaacaatatccccatggacggccttgcgttgcgcaggtacgggcctaccgatcggctgggagattgtctgcgcctgtctccgggtccgaggtcgtcgcgcgcggtcgttttcgaggtggccgaggtttctctcgcggcgcgcggggtgcattgcacaaacacgcgtacccaaatacgcaatggtgctaggtaagctgcattattggtggttggcgtggtagtggtggccactgctggtgaggccgaccggcctccttgtcatgagccaaagggaggcacgaacgaacagttggaacgttctggaagaacgtcggcgtacgtggacacgtcacacgtacaagtgagattgagcagacgtacggtagtgtgtatacttctccgtttcatattactagatgttttggcttctctactcttagctagggccctatttagttatcgtataaaaactttacacactgtcacgtcgaacgtttgaatacctttgtgaagtattaaatatatgctaaaaaaataactaattacacagattgcgattaatttgtgtcacgaatattttaaatctaattgctccatgatttgataatgtggtactatagtaaacatttactaatgatgaattaattaggcttaataaatttgtcttgttgtttatcgatggattctgtaattagtttttctattagtgcccgaataccgcatgcgacaccctatataatactgatgtgacacgccaaaattttacatccctgaatctaaacacaccctaggttaactaacaaaaattttcacaatttgaccctttgcaaaaactatttttacaaatgaaccgtcaccaaaacttatttcaaaaataacccttggcgctgaacttagacacctcagcaccaaatagcgtggcgctgaatatgcgttggcacgctgacttagtctcccatccacggtggcacggcattcagcgctagttaacatggcgctgagatgtctaagttcagcgccaggtgatttgacgctgaccaaaagagtcatttttaaaataagttttggcagcggttcatttgtaaaaaaaaagtttttgcaaagggtcaaattgtgaaaatttcaggttaactaatatccatgagtttgtacccatatatataacacattcattgatttttgcatggatccattcaaaatcagaacgtcttatagcgtgaaatagagaaagtaacttggtagaggttgtttggttgacatacccatattgtcaaagcttgccatacttcatttagctaacatgtgtaatatgttgataataaaattgaagccatacttcagccataggaaagcaagcttaccatacttttattagccaataacatatgggattcacatcatggtgaaggaatcttgtcataagtatgacacgaacctggctaagttaagctgtggcatggtaaggtaaattgtggtagtgaaccaaacaattcctacatattcagagaagattggtgatagcttcagtatcaataatgcatgccaatgtttaagtgaaaagatcttttatttccgctgcgttcgttgtgtggtgtatacccctacatgatagtgggggagtactactagtactagctttttggtttgctatcatactgagaaatatgggcaagttataattggcaatgctaatattttagtaatacatgtgtctaatagataaaatattgatagtaaactaaatattaccgatttattattttaaaatgccaatattctcgtaggttacgatatttcagcttcaaaccggttctgaatatccttgtacgtgatatttacttcttccattccaaaaaggcaaaatttgctacaggacacttaaaaaacgtgtaattagccgtgggacaccgcaaaaatatgaattggctgtaagacgtcgcaaaagagtgataattagcaactagacactagagacattattttattatttttagtggaaacgaagagagaaacaattaaaaaagaccagattgccctacgtgcgcccaggatgtcagtctctcctctattttctttcctcttcctcccgacgattgttcttcccgtccgacgacgcatccccggcgcagctcgcgcagctcggcgttcccggagcagtcgggcgtcgccgcggcagccagcggcgtcggcagcggcgtcgttggtggcgagccgtgccggccggccgctccccacggctctcaggcagagcggcggtgacccccgccacacgccctgcatcgccagcgtggacaccggctgcgtgtatgcccacgcatctgtgtcctcgcaccagcccagctccagcgtccccgctgccgttgccgccgccgcgtcatctgccgcccgcctcaccacgcagcgccccgtcagcgggtggaacagcacggtgtacggtctcgcgtcgtcgtagccaggccctgcatgcatcgcatcgccggcgaccccatcggttagaaacgcgacgttcgtgcacgacattgagccggtcaccgaagaagacattgccgtcatcgtcggcgcagcaccacccgggctagctcacgctgttctccccgaggctgtctggccctgaacgactcgatcagcatgaggtcaaggaaccccgggttgttcgcctcgacgccggcgaccgcgtcggcgaggccgtgggcgagtagcgagcgccgccgcgaacgtcgcaggtgggggcgaacaggacaacagcagcgtgcgacatgccattctggttctgccgggtgaggcggagggggccggcgtacgcagcgccgacggagagagtgcgcagcacaacgaggaggctggagagggagtgctcgcggccaggggcattttagtacttttaacgctctttctctctccattttcaccggaaataataaaataatgtctccagtgtccagtagccaattaccactcttttgcgatatcctacagccaattcacgtttttgcggtgtcccacggctaattacatgttttttgagtgtcctgtagcaaattttgccttccaaaaaaaactcaattcttaggtttctatgtctaacgtttgaccgtccgtcttatttgaaaaaaaatatgaaaaaatttaaaaaaataagtcatgcataaaatattatttatgctttatcatctagcaataataaatatactaatcataaaaaaaattttatataaaataaacggtcaaacattggacacggaaatctaagaattaattctttttgatcggagggagtaaggttgtggtaggctacacacgtacggcaaattaatgaatgattttcttttcttttcagggaacagtgctacatttaacatggccgtcgtcgtcgatggtcgatcaaccgatggactgaaagagataattattgacacaccaacaaatgtacgttcatactttctaaaaaaaatgtacgtatacgttcattaattcgctactcctagctggttagctgttgatcatatcgaataagcggtaatctgccaaccatatttttaatcctgttacgacctgaggcaggcacatgtacatactatagttttcttccgttccaaaatattccacataacacattctaataatactataaagttaaaaatatcttttaaaataaataaacctcctgttcatcggcctaccatgtaaaaactcaaaatattaacatgtttacgtaattttgtaactggtgatcgaaagcggctagctagcagcctagctatctaaacgaatccaacctcttaattaccatcttagtattaattagcttagcttgcacgcctccttgaacacagtggcattgcattacattatagtacagtgttattgtgttaacagttcaatactactccaattaacagaggtgtcaggttaattagttcgtcaactacggcatggggtgatatatttctctttggatatgacagcattcagtctcgattggctgaatctgaacgaattaatgtccatccaattgtcagcttgatctagatcgacatgaggcaggggtcccagccaagcgtacatgattgcgcccagtcaccctcatagtcacctctggccataagcgggagaagaattagtggtgtatattaaagcatcaatcaaataacagttaagcaatcaaggttcagaggagacaatggcgacagatacccatcattcttccctgatctttgggattcttattagggaattgctgaatggcacgctacaaaagatcaacggagatttgaaccacatgatttacgtaaagattcgtgtgcccaagttcttctcctccagctcccatgaagcaccggctactggtgacgacccgatgaacactagtggagttagggtttagatggggggggggggggaggtggggatcaagggggaaagagggaagagatcaccgggcttagagagatgatcgtaggagatggttgtctggcgatgagcggtggacacgacaggcaatgaggcaccaaagccatggggatggtggagggcagtcggccggggttggtggcaaggacaaagtgagcttatggttaggaggagatggtcggttgtggacgaatacaacggtggggagatagggaagaggtggtgtaggggcatctcttagccgccgcctcgggaaggaggaggagagagatgaaagggaaatgataccgactggggccttgcgcggcgttgtagatgccctctgtccaacccgtgaggttgagtgacggcacagtcgggtggcagcggggagaatgcacatgcacaaggaagaggtgggggaggacgggggaagggaaacgaacttgtgggctactgtggttagagatgggaatgagcatagaaggaagagggattaaggttaggtgttgttgaacgaatctcaaaacaatccaatagtgcaaattttgcgagatttcggaggcggtttttctatcaaacgacatatagatagtctctatttattatcattgtacaattttatggtagaagctatagatgtttaattctttgaacgaaaattgcaaaaatctgaggttgtccgaactctcaactttgctagtagtttttagactctagctttgcgcttaccacttggcaaatatcatcgtcacggtgtctgatcttatctgttttgtgctgtggttctgatcaaggtacagttagctttgtctttgctgaaaaataaatatctccacgtgtgcacgaactcatccgccgcacaaattaggccacaaattaatctcaagtagctcagctcacggccggcatcttaaagacctaaacacatcggaaattatctgtagaagctctaagcatatatatatatctatcatctctagaacctcttttctgctatatcctatctgaaaaggattcagaagcaagtcagtaggtagaaagtcattaacaagtaatacaggtttttaattttaataacaaaccttaaaaagtgaatttcaaaaaaacaaactttagttttaatatatgtattcttcgcgctttaaaaaaccaatactaatcgataagaaaacatcaaaatgaattctaaaactatgtttttatatgtgcctaataagacgaagagtaaacgattgagctatttgaatagattttctttcgtagagtttgaacaactcttcactgaattcaaacaaattctactccatggcaagaccggaggaagcattatattgcatctgaactctgaagggaagacaccgcctccaaaaatatcagggaagcttagctaaaaatgccaccatgcgacgtggcgacaactcatcacgcccctcgtttccctggcacgagccttccacgtggcaacgattcgccatcattttaaatgtttttatcgtctatttttgaaatttttgcgtatttttccggtgaatttaaacttggccagatcacttctccatccattttaagtgtcgccctagctgctataaaaccagccgagacgaggcgagctgaggccaaccacggcggcggcggcgaacgatccatcagttcatcggcatggacaagaacggcagcagctacggcgagagctcgtcggacgacgtggaggcgccgctgctgctgccggcggcgaggggcgggacgatggcgaagggtgatcgtcgacgtccggcgtcgtccgcggcggcggcgtgggtgcgc

SEQ ID NO: 68546 - DNA, 6128 bp, Oryza sativa
cggcgcttgagattcgactactattggcgaattcgagctcggtacccaaccaatagcactaatgcacggctgcgccaaacttattcttcttcttaaagagagctgtggccctgtttagatgggactaaaacttttaagtccctatcacatcggatgtttgaaaattaattataaatattaaacgtagattattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccaccttattcttcttcttaatgagtattttattaagaacataggaagttttgcctctcaaggaaacgttccctcattttttatgtcacctaaaagtcatcatttttctaaaacaaaacttgacaagttagatcaatatatatgtgatatattaattactcgcaaacatatgcaagttccaattcaacttatacaaattgaaacaaaaataataaataattatcaataatgcacagtattcagagttatatttgggtttttttttaacttttgttgttgaatttgaacttatggagtgataggtttaagtgttactccctccgtcccaaaatataagcattttagcatagtgacaaatcaaatatttttaactttaaaattttaatagaaaaaataaaaaaataatcatgtaaaattgatgttactacatttatcaataagcaaactatcataatatgcaattctttttgtttaaaacatcttacttttatagatattgttgatcaaagtagcatcttgtagatcgtgtcagggtataaaaatgcttatattttagatggagggagtaattattttatcattttcctttcttaaatttaaacttatggaatggcgggcataaaacggggaaaaacacatcctaattaattaattttcacaatctagccaaaagcattcttgtgagtgtgaattaatgaaggagggtaattatgttactaatcaaatgtcaaccttgtttatttgtcctataggatcatcagagaaaggatgggctactaaaggaagggctttatgcagcggcagctgctgctgcggcggcggccaacatgggtgttgcaccgtactaagcccagctagaataattagtgagaagttagttactatctaccaagtctagctagctcatcaattaactagtgtgttcttcctatcaagctatctagggcttcctgatcatctctcttgttattaatgaagtgtactgtctctgtgcgttggtttcacctaggtataatctgatcatctagctagctaattgagcttcttctgctactagtcattttgctctatctgatatctgtgctgttttttttctctagcagttgatctgatcaaatcttcatcaattcctttcatttctaccctctttccaccctcatgccaaaacagtgaatattgtttgattgtagtcagggtttacaaaaccgcgtggttaattactatgcggttatcgcagttaccatgcatggtaactttaaatttttgaaaccacgatatttcgcgcggttaccacggggtccggtaaccgcgccaaaaacagtaagagtgtatcgtacaaaaaaaaattaaaaaccactagcgaaaaccggaccatggcgatttttctggttttagcaaaattaagccattgcctatgctagtgaaatctgacctttttcttcaaaaatttaaaatccaattaattattttaatttaactagaaaacctacgattttgtgttacaaagccagcccgggatacaacgatggagctaggatttagatatggaagggggccaaaagtattgaaggggagtactattatttaacttgttgattataattgattagattattctacgtaaaaaaatgttggagggagcctggcctctagtcgtccctctatctctccatctctattttatcataaaaaccgaccaattttaccagttttgtaaacaccggtcataacataagttttcagttactttagttttcttgatcgggcactattctttttttttcactttttctttatttggtgttcaagtacgtaggtactttggtgcagtgccctctccctgtcgagtaaagggaggccggccacggccggttgaattgtctggaatcaatgaaccacccctttgttttgcctgcttgctgccctgctccgtgcttctggaattcaaaccaattagccagtctctggagatcagctgttacagctcttgtgcttgtctccttaatatctgtgtccggatgatcagttgctaatacacgcatctctctttacccatatgcacatcccatgtcatgcgcggtactataaatagctagagtcattttttaagcattggctggtaaaccgtgaaaacatgaacgaagcaaaaaaaaaatcattatagataaaacttttatagttttaaagcctatgtaaaaaaaattgtgatgaaaaagctctaaagttaagttttagaattcaaattttggtttgtgactaataagtttgcaagtagacgataaaggacaaggatatcacaaatgtttttaaataataaggatcattcgcaggtagaggtggatagcgagctagctcagctcggctaggtcactagaaatccagctcggcttgactcgtatgaaagcacgagctagcttgtttggcttgcgagccaaaccatccaaacaattgtccctaggccatctcttgcaacctgaggcactagttcgttatctctaacgagcttaaaagccagctcggctcgttaggaaaatgaaacgagtcgagccaagcttgtcacgactcacgagccaagtgagttaacgagtcacgagctttctgtccacccctattcgcacgtaaattaaacgaggacggaaatcaatctacttcaagagcgacaagtgctactgtttgcttccaatagtgggtgttgtgtgtagtaggcacttggccttttttttttctgattataacattcggggggctaatttcttgtaatttttatctgctatatcaatatgaaacctcaccattatcttgtgcggttcgtgtttttttttttagaaaaaaaaaagagcaacaagtaaaactgagcgttttccccctaaaagcacgattcaaacagtcggcctggtttgtcctgtgggccgagcggagaccagtgccttctctagagcccggttacctggtccgtcgtgtcagtgcgtccagtagagcccatttcacccccaaatgggcctagtgtcagtggtcactgggcccgcatgctgcatatgcacacatatgggcctttctcctccacgatccgggctatgatgccactcaaggtgtagcatataaggtacgctgctttcaattttatccacgctttttatatcttatataaaagagttgactctgaggatactatggttcaaatactaaaacttataagctgaccctcgtccatctaaacttcaagatagtttttttagtaaaacacaccagcggtccttaaacttgtcaggagatttcacttaggtccacgaacttgcaaagcgcaaatcgagatccctaaacttggtttattgtatcctggtccgaagccacgtttgaccgtgatcttacctacatggcacgccatgtggaccgatgacatggaattgttttatttatttttttctcccttcttccttcttttttctctttcttccttgtcaaaaagacgaaaatgcctcgtacacgtcatcatccatgtcatcgtcttttcataaaagagaaaaaagatggaagaagggagaaaaaaaataaatttcatgtcatcgtctacgtggcgacaagaccactgttaaaagtggcttttgacctggatgatacaataaaccaagtttagagacctcgatgtgcgctttgcaagtttgtgaacctaaatgaaaccttctgacaagtttaagtaccgctggtgcattttactcttttttttcaggttaaaattttttaggggggaactacaatgggcggggagtaagaggactactccgcttttaagttttaaagtttgaaatttgaaagtggcttatctatactccattaatacgtaagacattagtgtttgagatgagcgatggatttgtcaccaccctatggccccaccaccaaggtttctcaaaccgtcgggaccggagttaccgcaccctcatggtaaccatggcaaactgtacgagaccgtataaaatttattaaaattacaacttatttttaaaatttatttgaatttaaggaggttatcgcggttttccttttaccgcacctcgcgttaagtgcgataactatgataaccgcgcggttaccggcggttggggaaaccctgcccaccactccttatattttttttattaaaaaatgtatgtcaaagagtacacatataagctaaaatgtacttcattcgtccaaaaaaaaagcattcctaacattccaaggcaaatttagtgaggagtaaaaatgaccaaaatgcccccctcatttttgggaaaaaaatatggtgataggtaggtaaaaatggtattaaagggataaaattttctgttttatgtgctggggtaggtaagatgatggaagttggttttctgtgagcaaaatttaaactcttctttttttacggaggaagtatatgtagagactaagagatatgatacatataaataattaaaaaatgattcaaaaagctactgttgcaatgcgggcattatactagctagtacttcctaccccaagaagattcaacttaggtgttaatgacactacatgggataataaatctggatagatgtcctcctaacttgtccaaattcactgtactacctagtggcccatccaattcgaatttatacagttttgttgtagctaggtagtgtttcatttcacttttactctctttgttaaaaaaactcaatctagtacttgatgttgacgtatcatagtattacgagtctgaatatgtatatacccaaattcttaatatagaatgtgtcaatatccggtactagattgattttatatgagacggatggagtgtgacggatggagtactttgattttttcagggagactaaaaagcaaacgtccgacatggtgtatcactaggtctacaggatgggacacaagcacacgccgatgtacagtgcagacaggagtaatttgctggaacgatcccaaggacaacataaaatttgaaggcggcagatcaaaacaaatctgcgtgcaggtccttcgagaaataacgtaagcggatcgcagcagcaggacggttttttttacgttctccagtctaaatgatgcttgtacgttctttcgtgttcttcataaaattctctgaactcgcgatctagactcccatcggatggtctattcagctaaagaaaaagctaaattttgaattttcaaacttaattttaatattgattttgagatattttcaacgtaatttcttttttagcattagcttttaaatcaccgagaacacatatatatatatatatatatatatatatatataagttttatctataaatttatttttattctctaataaaccgttttggcttattaaaagaaaagccaaacaatgggcccctaaaccgtatgcatcccacttcccaagctatcatggcaacatagcaaacgtgatgctgtatgtgctatgatcgactatgacattatacggtactagtcacaggtattttattttctcccatatttttttctctcggttcattttttataccgttattggtttttagccctctttttatacgtgggattggctttttttgttttcggttgatcagtttccttacacgtggttatctttttatttagctgttttctggtttatatgattaagagggaaggagaccgatggtgcttttaagttcatagagaagctcacgaaa

SEQ ID NO: 68547 - DNA, 1276 bp, Oryza sativa
catatatgctattatatgagagaaaatataatgatgctagccacgcaatctgtgcgggccaccatactagttagtgtattaaatctgcacgtcgcacctcgtagctggcgttaaatagaggatggttaatttgcctatgattaaagaataactcccgtgtgtaagggggcaaaatatgttttgattgttaaaacaacacataaacagtccaatcgtcgatgagagccgaacatgtctgtacagtttgttatcggaatcaaagtatcggatcaacgatccgatcaccaatgaaggttctagtttcgattgaaattcaaatagtacttgggtagtccgatcgccggaggcagggaggggggggggggggcaaataccaccctaatcaagagatagagatgcagtttgatggttgtgtttcagcctccttattgacaagtttccgtggtcaataccctgcatgtagggatgcaagtgggatagtcccgctatccaaataaaaattcgcttactagttcatttctcacatgatagtacaaaatttaaaagaaaaaatgaattagaagtgagataagtgagtaaaaaaacccgcttgcccgccccactggcatgcacgtcgtttgcattaacttgagtctactactgccacactacagataataagcgtatgtggccacgtgattagtagcaaaccaactaggtgcagctattactagttaattgctttcttttttttaactactcgaaactttcaaatcatatatcgaaatcataaactggtcgaacccagtattttctatttgaaatatgcaacaaaacgagttagatcagacactttccttatgtattttgtaaatttgggctgcaaacaatattcacatgtgaaattaatgactaattatttattatttacctttgaattttggtaaaaaaaatattcatcaaacaagtatacaagaaacctactgtgttcctaacattttttacctaataatcaccaatctaaaaagaaactaacaatcaccaacaaccatctgaaaaggctatatagtgtgaacttgtgcttgctaatcaaacttactatcatcatggcgattactttcacgattaaggtggtggtgcttctttccattattttgcctgtgacatcctttgagaaggatcctcttcgtaacaggtatatatgctactctctccattaagttatcttttgatcgaattggcactttaactatgcatgtaaaactagtcaagtttttatgatcattttgcccttaaa

SEQ ID NO: 68548 - DNA, 718 bp, Oryza sativa
  unsure (1)..(718): unsure at all n locations
ccaaagccggaagctttccagatgatgaagaggatgatcggcctcgcacagattttgtttcataattagtaaccttaacccaaaaactgagacatgactatatgggacactaaggtatgaagtacataaacttttttttcatcttgattttttttttagcaagggccatggcccccatttctattaccagaaatggacacaggactacaaagttcttaaaaaaacagctgactccggtgacgaggcaggctggacccacaacatcggcttcccgcgttggtgtttgcagacggcgggcgctctgtcgacggcgacgaagggcattacggcacgcatgcaaaggcgcgactagcggtggaggaggccggcgtgatgtgaagcggcccggcttgctcgtggtcccggcacaaggaggctaagggaaggttggctgcccgctgcggatgccggcacgagcgcaacgctatgagttgttgcccgcgcaccaagatgagcggtcngtggaacaggccaggtgcaacccggtgccgcatgttgaggcacgaccggtggcgatacgcggagactgcgcggnggggggggggggtggttttttaactttgtatctnatttcncagacaaacccccgaacttggagaaatgctgaaattttttgcccgcccccctgtaacttgtaagtgcggcgcctggataattctggtcactttcccaaccgccg

SEQ ID NO: 68549 - DNA, 7787 bp, Oryza sativa
ttcctgcaccccataaatatgatttttttaaacaactttcgtatagaaactttttacaaaacacacaccatttagtagtttgaaaaacgtgcgcgcggaacacaggggagaggagttgggaacctcttatgccgaacacaccaagcctgtaaaaggtgttgatcactttatcagaaattcagatcccatgttaaccaaactcaagagagcctactccttccgttatataatgatcattatatatatttatacacaaagaaaaagaataatttaaactgtattaatcaagacacactatacacatacttctacaatacatgtatcgattaaaacaccatatcatttatactatagcatgcacatattctcccatcttgcattaattgtatttcgatagaatccgtatccatgtgattatatgatgatcaatttgagaaatatttgatttcattatatgatgattagtttctgaaggagaaagtaataacataatacccacacctaccacatactatgtcatttatcactcaaaagaaaattaccttttgcttttactttcgggggcgctgatcgatcggatgcatgcgtgatcaagctggccgccggacactccctgtacgtttcacctcgcgatctgcagagttcaaacttcaaagtgcaagaataagtcctacgttacccggtcgagcggggacgcataccatggccaacgctaagatgtgacacgtacctctagcctctcccacgcggacgcgatgccaaaaagcagcaaaaagcacgtgcctgcgaggaggcgcgaacctcatgcacccctgcgcgaggcgtcgggtctaaggccagggttcgagccgtggctcgcgctgagcagcttgaggcctcttgggcgtgtagctttacgcaactttacgataaataaggtctcacttgtgggtattacctctattaattggagaaataagctctcctgtgtagccttgcccacctaacaaacggggctacggtttgcgtcggtcatggcctaagcaggcagtgtagtgtatagtagtagcctcgattgttggtgcatacgtacccaggcagcaccgtgcatattcttatcggattaggatcctctgcagtcgactgcaccgcgtcttttatcattgacatgtgagtctgaagatcatcagacccatatgtaataaatgcatctggcagtgaccgcagaggatctcaatccattctcgtcgggttctctttccctcctgcaaagcccggccggccgctgccattcaccgagcggcagctagccagcagcctacagcctgcctctcgctggctctgagtagccaagagtccaagacgtaccatctcttttctgaggccagagaacgtaggtactagtgcaaaccaagataaaaagttaccggagataccaccaaatatctaattattgaataatctgtattccctggcgtttttacattataagatgtttcagtatttttcaatttaaacttctttaattttaactaaattaatataaaaacaaagttaacaaatatattcaacgttaaattttataaaataactttatcctagatggccttttgccgattgccattgaactttgaacaatactacagtgctacgcctgaatatgagtccacgttcacagctcggctctacaagatcttaaacgaaaattaaattgacaaaacaacctcagattaattatccccaatttgaacctaatcacagcaattacttgcattctccaaaaccagactaaatattgattcttgagtagcaagtttgattagcctaaccacaccccccgtacacacgcgcgcatacagtcaccgcgaggtaaggtcacctcccccccttttcccttgcagtgggtctctcgccggtcgatctcccccacgcctccgaagaatataaaagcccccttcaccctctgttgccttgtagcctcaacacctcaccagtgcaccaccccaccaaccacctctcgttttgcatttctctgcgctcgctgtcgctgccatggattacggaggcggaggcggaggagatggtggtgtgcgcggcggccccggccgcggggaggcggcggtgggggagcacagccgtaccggcccaccggcgtcgtgtggccgccgccgccgccgggtagcacccctgtcaccgtccggaggcctccaccgtcgacctcgccggctccgcaggcggcggcttcgtcgtcgtcgacgtcgacaccggacaagctggtgaggcagaaggcgatggagatcgcgctggcgccacccgccgcggcctctccagatggtgaggcgctggcctcggacaatctcgcgcaggtatggaagaaggaactcgtccactcttctcgaggctatggtgtattggtgtacgtcactcgcaaccacgttcccatcaacaaactgagctcatcttaccctctccccttcccacccctctagatctctgcacaaccgtttactactcttctgctgttgtttctatatcgatatagtagcggtagcggcctagatccggttctaggcatgggtttcgagtgctaattctgaatgttttgattctaggcatgggtttcgagtgctaattctgaatgtttttgttgctgatcacgatgaacgttttcgtgtgtgcactgtgttcgtttacgaatctcatgctgcctaatctgttttgagacggcgagattgttgatatatgattccaagtatcgaggcttccgatctcatcctttgttcgtttacgaattttagtgctgcttaatttgttcttgagacggcgagatgttatgtgatatgatccaaagtatcgaggcttccgatctcatccttgtgatgtttggcagaaaacgaaaaccaaagcatatttgaacgtttcttagatgtctttttatttcttattttgtattacatctttattgcatccctgtagagtacattacagtttaatgtatcctcctgacatcttttctgggtgagaaaagatgtattgcattttgaatgcataagtgtcaatactgtacaatttgaatgtattttgagatagcatcttcttgtgttacatttttattgtatctcgctaaagtactgtgctgttgaaatttattccgagagcaattttggtgacaccatgtattacattttacaagaatacatttaagaacacatcttgtaaaatgtgtggtaagatttaagagcacactttgattgcatctgtagataatgccgtgcagctaaatttattccgcgagcatttttctcttgtcaacaaatgagtactgattctaaactctaatgtttcaaaatcttcagataaaaacagcattaggtggggtttgcattgaaacaaatcatcaggatgataaaatcagaaggtacaaggggattacccctattcctttgagccagctgttgtacttatctttcatctgctgtttctgtaactttaactccctttctgtttatgttctctaagttaagggaaatcaatgtagattgttgaccttctgaaatacttgttgaggtgttcacagtttgaatttttagtccgaggaaattcacttcattattctacattagactagacatactacagaggttttcctttcagctaaaatcttctcttttcagaataagtattcccaaatgacagagatactttgtcctccttacaaggttaatcatggtttgcattgtcagcccaaaacattgaattactgtttttctagtaacacattgtatgttaaattttattatttggatcctaggatcctttgttagcatgctgttaaaaacaacaggtctattaacacattatatgttaagatcatgtattgattgctgtaatgataaattgtttggcttcaacccgtgaatgccgttagttacatagtcccctgcttgaggaatgttaaggaatatagagtcctttacattgtggaaagcttttaaatctgatttttaaaaatgtcaaatagtcctttattttcaatgtagattgttgatggaatatttgaatggtctttgttaaggattttgggcatattagcatatcaattatatctggatgtgggatgaaatattttttccctttaaaatggttatgacttagatatctttcaatcttataaacgatccgtgaatattcaactgaaatgatgtgtaaatgaagtattacacgatttccctgacctgggggagtatagcatgtgctatcatctttttgttagacctgcatttttatttatgtacattggtgtttttttttccaaactgatgcccagtatttaatgttatcagattttctgttgacaagaatgggacaagatgctgcctagactctagcagtgagtctggaccatggtactccaagaagcttaataacaagaagggagtgactggaatccttagtcaatggcacaagcagacggaacagaaagctcatgaggtataatgcgacttatatgcagatccaaaccttttatgccttttgaattttagctccattttgaatatgaccttttatagattttcttagaatgatttgtgtgtagaacatgagactttttgaatatgaccttttgtagattttcttatgatgatttgtctgtagaacataagattgtatttctcttgacgatgtaatttagtcatgaatcatgtatttgtcttgatttccatctcattttttgtcaggttgttatctacaaacgttgtactgcttctggatctgcagttactctttttcttattatgatgagcttggtttgtacggtgagaggaagcaaccatggaactgattgcgacatcggcgagtactcaacgagcattgctcaagtttgtcagtatggtgctcctcccgcagtgtgttgcgaccttttacaatccgctgtccacacttgtggcaatgctagtgttttgtgtgaaattggcagatctgtgccaattacttctagaggtttcaatgttcatgatgttatggattggcaccgagagtgcacgggtcaaccagaatcatccagtgtagatgcatcgtccatttgttatgtatcaggtatatttccctttgcttgtgtgatctgttagcctgctttatctgtttactgaacaacattgtcttatctgatctgttagcctagctagtttaactgtttactgaacacattctctatattaggtgaaaggcacaaagagggcacaaaagaagagggccatcaagtaaatattttgattgagaccggtaacaaggagtgcaacgcaaggaagtcaacttctactaatccgatgtttatcggtttaggaattgggtttggatcggccatgctctttgctttcgcgctggtggtgatttggctgttcgtgagaaggcgatcacaaggtatgagtttttctttaaactagtataattctgtttgcttgtaaatacggccaattgaactcattttcattttgcatatggtcaattgaactaaataagaattcttattcctgcaggaggtcctctggtgccgcagattagcttgctcgcaatcgcgcctcacttctcccaagggcttcctgcgctgcccttccaagagcatcctgcgctgacgcttccctgcgggcctgtccctgtcccgacacctcaagaagttacaacagtgcagccagccaccagtgcatatggtcagccagcgccagtgcagccagccaccactgcatatggtcagccagtgcaaccagccaccaatccaatggcgtacttggcatcagtcgtttcctatgcgattgtagacagacttactagccgccgtcgtcgctagtacttgtgtttgtctctcctcatacttttttacaactttcttctcatacttgagacaactattgagtttgatgatttagaatacttgagatgaccactgaacaattccggttactgtaaaatttgagacagctagtgagtgctgatgatttctgttaatttggttctttaaaatacctggacgactattgattgagggctgatgtttttttcttttgttaatttggttgtttggggtatccagaattcataatttcagtggactccggacttcggaacggttcgaaaacacaaaccacttgtttttaagtttttttaaaaaaataccaagtatatcttaagacaaaaggcacgagggcatagcttttaatagaaagcagataaaattcaaattgaacttaaagtttttggaccaaatttattcggactttattgattttagtcggtttatcaacggattacatgaagagatgtgcttccaatgatatcattcagtagattttgatctaatattaggattgtgagatcctgtttagatgggactaaaacttttaagtccctatcacatcggatgtttgtatattaattataaatattaaacgtagactattaataaaacccattcataatcttggactaattcgcgagacgaatctattgagcctaactaatccatgattagtctatgtgatgttacagtaaacattctctaattatggattaattaggcttaaaaaatttgtctcgtgaattagctttcatttatgtaattagttttgtaagtagtctatatttaatactctaaattagtgtctaaagacagggactaaagttaagtccctggatctaaacaccacctgaatctgctggtgtgtttgattagagataagaaaatatctgtttatttacgttttaagggcctggtgtagataagggcctgaatgaggaacttctcctccatatatttatgatgtttccctagggtccaaatgaaatacgttttctacggctccatatattgtgcggcaatggcggaagctaagtcgaggtttttttttaatggtggaatcaaatgtactacacctatactaatataaaaaggatcaattcaaactttttgctatggccacccaactgaaatgtacaccgaaaggtctcatccattccgtagccgtttgatcgtctcatccaacgcctcaaaacgcatctaccacatgatgtgtgtgtcaatttcagggagtaggaaattggggataaacttgttgcattgacttagctctatgggcaatatattgtgtacaagagggatgggaaataaccaaaatatccaatacacactattacacttaacacccccactcaaatgcaatgtgtatgcaataacgttgcattgaaaactacaactaaacactaaactaaatcaaaagtccatgcttgatgatgacgtcgaagtgtgcagttcttgaaatgatgaagaagaaatgattcatctcatcttcaatgaagcggaccttggagccttcacggatcgttcttcagcctttaataccttaagccttcacaaattgtttttcagctcttcattgattcagagatggtgacaatgatattgaaggaccttcacaaactgttcttcggtccttcatgattgatgatgatgtcagctccaacggggagcatgatggaccaactccggcagggagttggtgatgatgacaggacaataatgaagaccaactccgatggagagttggggaagttggagatgacctgctccgatgtggagctggtgatgaactgatgatgacggctagctccgatgtggaactagtgatgatggagatagattggcaagacttcgacaaattgaagaataggcaatgacttcaatggactcaatgggaactagtaaatgacatgacgatgctagtatatactccctccgtattttaatgtatgatgcc

SEQ ID NO: 68550 - DNA, 99892 bp, Oryza sativa
acggtggtgtacgacctgcgcaccgacgtcgagcagccatcgctcccgaacccctcctccctcgagcggaggcgggatgcgctcctcgcctatgcctgcgccctctccctcgtcgagccccgtttccccatccgcctccgcctccgcctccgccgctgtcgtctcctctcccatctatcggccccggcagctagagcggatcaacgacgatgacaccgacgtcgtggtcggcctaccgcactgcctcctcctctgtcgacgacggcaagataagggacctcccaccatccacctccccagatccgacgacgacgacaaccgccgcgtccagttcctccccaggcggctgccggccgcgcccatctccgccctcgctggtcgctccccactcctcccccgccggtttagggatgagagaggaagagaggtggagagagagaaggggaagaagaggctgacatgtgggacccacgctgagtcagctgccacatcggacaaaaccggagtcaaaaccgccgagggacctagtctacactggttttgcaagttgagggacgcgttgtatccgttttgtggtttaaggatgattttgtaattcaatgacaagtcgagggaccttcggtgtactctttccttcggcttgttatgcctaacgagcaataatttttaggccatgttagattcagattattcaacgggttattgcgaaggattatctatttaactattgagataaattaaatattttcataaaacagatttaaataatactagcttaaaacaagcggtataagcaaaacattgttttcaagggtagagcaaataatgaggtgataatatgagaagaacagggcctaagctcaactcgtttaccattcccagtgagccgacactaaaaaacacaatttttcacacttttcttttattttttcaaatggactaaaaataataccgtgagtaaaaatcacatttatttttacttgcagaagatataagcgcgcttaagacatctatgagagaacacattatctttactgacggacgatataaacagtgaggatcgattttagaaaaatatgtatttgtacctaactttttcataaaaagtctgctaattaaatttataccaaacttgtactaactccgtccaaaaaaaaatgtcaacctatacatagatgggacattacatagaacaatgaatctgagcatctccagagatttgttgtcctatgtaatgtcccatccatgtctatgattgttttttttacagagggagtatatctcaatgagaactaaaactttttaagctgaataattttctatttgagatcatttagggtttaaaatatttgttataagatttaagatctatttcacagaatttcatatatacgattcaaataacctccgatggacacatgatatgtgtcaaagttgtagagctagatctacaactttgtaattcatgattttttttatttaaaatcatttaggctgtgttcgccacgcctagtccccaacatgaatagtgcgcacgaaaaacgaagcgatccattagcacgtgattaattaagtattagctatttttttaaaaaaatagattaatttgattttttaaacaactttcgtatacaaactttaaaaaaaaacaccatttagcagtttgaaaagcgtgcgcgtggaaaacgagggagaagggttgggaataaggggtgcccaacacgtcttagagaggcaaataagtattttaagtttcgacaatggaaatcaaaacgatagcattttaaatattgacattaagtgcttcatactaagatggtaatgtaatacatgtgtggagagaaacgtattgcgttcaaatcccacaaatcacatacttctggatttaggccctgtttagatcccatgataaaattttacaccctaccacatcatagatgaaaaaataactcaaatgtttgaacacatgtatgaagaaataactaattacacagattacgtgtaaattgcgagacgaatcttttaagcctaattgcaccatgatttgacaatatggtgctacgataaattcatctcggcgtttacaagtggattatgtaatttgttttattattagactacgtttaatactttaaatgcttattcgtatattcgatgtgacacgccaaaactttacaccccggtatctaaacatagaaagacacaagttaggttttcgtctattccaaacagtgctatatgaatgttgagacccccctgaagcgtccaaaatattgaccaatggattggaaaaatatcatgcaactaaccaatagtgaaaccttgtggtcccccttagaaaaaacaaaatcatgcaactaaccaaaatctagcaggaaagtgagtgctccctcttcgagatttagctaggggacaagtttcatgttcgggacctaattcgtgttctttaaatcttcctccaaaatcttctaatcaggtgggaaatctcattggttacatatagagggtgtttagatctaagggtgtgaagttttggcgtgtcatatcgggtattatataggtatcgcatggggtgttcggatactaataaaaaaactaagggtcaattgcatctatgcccccgctttcaaacccaattgttgttttagtcccactttttagggtttgcagttttaccccactttttaaaattgaagcagcgtctacctctacttctaacagccgtttggtgggtcctgcattttgtgttaaagaaatacaaaagaaaataaaaaaaaggttttaggaaatatgaatttaccttagtatccctgagtgaatggatagggtctggtcctcacctcccaacccgtgctagtgtgaattggaatcagcgagagcgtgctggcgacggtagcgagggtgggcacgcggcgaccgcggtgagggtgtggggacacccgataaagtcatggtgcccccacgaatacgtaactgtccaagatgttcagttacgcatgaaatgatataaaagcataagcttcggttatacattacttaagtcacttagttcacaacacaacataaatacaaaccattacataaatgacctataaagccttattaactgctagactccaccacaggaattgcttgggcatagaatgacctagaaaccataattgtcccactctaacgggtcaacaggatctccacaatcatcttcctcctcatgatctgaacccatttatgagtacaacaggtactcagcaagacatgcctatgatagcaaatacaataattgcaatataaaacatgcattattaagagccggaaggtttaaactctaaccttaacatttatttcatagagcctatcttaataaacatttgatataaacaacactattgaatatttaatttaaacgataataacgagcataaaattaatataaatgtcacttataaataacttgaataaaacatcaagcaataaataaattaaccatattaattaataaccatttagtttaacttgtgcccataatctggaatcatccatagacacatcaccattaattgggagcacggcgtattcgaatactctacgactctgcagcgtctgcctagctttacccacacgatactcacagctagccgggctgaaaagtaacaaggcgtaatattgctccatatctctcccttctgcctagtaagttaaaggatgctcgggtcattgctcggagtgatccggtccgaggtgtgtaccaacctacctccgcatccacttaccattgttcgttactcgatgggtagcccagaacttgatgggcccatagggcagttctgaactctcgggcccatcgagcccacatatataaatcacataaacataaaccatgtcactttgcttcacacacttgaaagctaatggccaatacatcgaaaggcctgcataagttcaatcaattggagcaatatacggccaggttcgacaaatcgatcgtgtggatgggcgaaactatgtcattcttattggcacaagagggttgattattatatcaattttaaataagaaataaccataaatatatccatatatccattacgaccataaacaggtccataaaaccaaacacatgaactccatcatgtgtaccacccgctcacaagcggttgttaacgaccaaatttggtaatgccatgggccggattcaaagttagagtcgaagccgatttggagaaattccgttcgagaaagcagaatacgcatcagttacaagtagcatcggctaccacatgaatcggctataggcggtatcggctgccacatatcggctaagcgctagatctgacggagtcaagccgatgcaaccaatctcgggaaagatggtcccatgtccatcattgggattggtcgaagcacttcatagccattgccacgcaatgattggagtcctaaaacggagcaattgtatctattaattaggacaattttcagtttccttagagatatgttggtaagagtccacctgaagggactcattcgtattttaaatttcgttagagataagagtcatgtccagcaaggacatattatgtacttcgaatataaatatgacccacaccatgtaatcaagggacgacggttcaataatactttggcgcatcgtcacccttttttattttcattgtttcgacaagttattgctttcgagttgggctgcatcgggttcgatctccaatgaagaggtaaagcttgttatggaggtttgcgttctcgggattagtgcttgcatcttcatgacactctaatcctgtctatgtaaaccgccgagttatcatatataccgcatagtctagattggtttcgtcatctaaacttcatcggctagcctctatcatcgagaggcaggtttaggcttcgatatcaagctagactatgcggtgtatctaccatcttgaatgagttttcatcgatttgattagatcttatgtttcttctcacgcttaatgctgcatcggttaggttcgatctattaagtactatctttaatcgttttatctagctctttctttgattgctaacagagatagcatcggagttttagccgatcttacttgatttagtcgtcttgtttccttatttggttctggatcatctaaatctgccccttatatcaagatctcatccgtttaaagtatattaagcttcctatcaatctgctagttcacattgctcgtttgaatagtttcaattttatatatttcatctatgctgatatctcggtataaggtggtatggaatactagccgatactagctgggtttgccctatcggctatgcttagggatggcaatttccctcgtggggccggggacctgcccctacgggggtgggggtgggtactgatttcgacccgcggggagtcggagtcggggccccggccatgggcgggaacggtggctggggaggacatccacccgcgggtgacctgcctggccccgaagatgtatattagactattaatactaccatattgtaagcccaaaaagcccatataacctatctttaagtgtttctcaaatactatcaaagcctgttagaatctaaggctctttaaggtgtccataacagcaacagaatatataatacaataatagcaatataattaatttaaaaaagtcgtgcagtctatcgtactccaaaggacaagtacgctaccaaaataactctctaactactggttgttcaaagaagggtgcatgtcttgcaaccttcaggctcgatgtagtcgtacaaaccgtctcctcctggcgcggacatttcactcgctccgactaccgggccaacgccaacgttttctatttacgcaacaatcatcacaacaataaataacataaaaaaaaagataaccaaaacaaatagtatcacaaagtgaaacaatgggtggaaaggattttaaagaaataattttagggatttttgaaatttcggtgtacggcgaaccatagggctaaaattagggtcgcgacagcgggtgctcggattgcaacgaaactgacatggatggatttggaataattctaggagtttggaataggtctcggattttgattgtgaggtcaaacggatggtcaacctgatagaataagaaaaaagatttttctgatttatttttcaacaggaaaataggatttcctgttcttctcgttatgtgcacaggaactggccgtaatcccatgacgccggttgcagaggaggccggttttgagtggggaggcgccggttttgcgatctaggggtcgaggcgattcctttttgtggtcggcggcgaggctggcggtggcgggcagaaacaggaggcggaggcggccatggcggcagcgactccggcgaactccgggaagggcggtggcctgatgaggttcactgaggcgagaggagtcctagggtggcgacggcagaagctaggcggtctggagcgacggcgcgccgtgcagccggcggcggccgaacagagcagtgacggcaggaggcggccccggcgacgttctggggacggattggatggggaaagagaggggaaagggagtacttggcatgaagaatccatttttaccttaaatttcagaggattagcgacgtatacgacgaattttggagctcctgtgaatggcgccggactagggtttcggggattttttcctccggtgacgacgattgagtcagcgggagttgggggcggatttgaggaggtgaaagaggtcgaaattgcggtccttttgcctccggtgttgagccttctagtggaagaacgaaggagttatggaggcgggaagctggaggtgtcgtccgggcattcgtcggtcgatcggcctcgtgcgtgcgcatgcgagcgtgtggcatgcgtgggctggcacgagctgggcgcaaggcggcacgggtttggtgcgaggcagcacaagctgggctcggcctagccgagaagagaagaagaaggaaaagaagagagagagaaaagaaaaaaaaagaaataatagaaaagaaagaaaaaaatatatggaaaaagagaattaaggttaaaatagagaaaaagaaaatattggggaaattaaaataaataggatttgaattggtgtggaatttagatggcccgacatttgggatagaatttaatttggattcaaaggaattatttgaaaggtaagatgcactttgcaacaaaattaaaccagaaaagaaacatcaaaaataaacatgggaaaataatattttaaataaatgtctaactcgacagttatatttttagtgaaccaaagcaagctaaatcaattttaaaaagttgtcaatttctaaatcaattttaaaaagttgtcaattttagggctgttacagagggactgcggacggctgctggcggcagccgtggcaagggcgtgcacgcggcggcggcagccgtggcaagggcgggcatgcggcggtggtggccgcggtgagggcgtgcgggtggccgcggctagggtgtgcaggcggctgcggcgagggtttgctgacagcggccgcgagagcgtgtgcgcggcagcagtgacgaccacgaggcttccacgcggcggtgagggcgggtgggctggcagacgcgccgctccgatggtagccaggcggcggctgctcccaggcaggcgacgaggcaagcgaaaatagaggcaaaatcacacaaactgaaaaaaaaaaggggtaaaaatgcgggcaaaaatgcaataaccaccaagggtataagtgtccctttactttacaactaacaccatcaaactggctgttaggactggggtagccggctggttcaatttcaaaacatagaggtaaaactgcaaatcctaaaaaaaatatgggtaaaacaacaattggatttaaaagtgggggcatggatacaattgccccaaaaactaattacaaaatctgtcacttaacatatttactataacactacattgtcaattcatgaagcaattagtcaaagattcatctcgtaaattagtcgcaatctgtgtaattagttaattttttagcttatatttaatactttaggtatgtgttcaaacgttcgatgtggcagtgtgtaaatttttttgtgggaactaaacaggccataatacattttcgatgaagatattgtaccaaacaaatggtaacagaacatgacaacagttaagactgatccccaggctaaatgacaagcacggatccaaaacatagatcatatcaaagttatgaacaaatcaaggagttaattttaagctcagcttgaattgaagtttagagtaagctcataacttcataagccagacgccaaaacaagaaagatcattagcattagcacataattaattaagtattagctattgcaaacacaaaaagatgaaaatgagatctatttgattatttaaagaaatttctaaatataaagttttcttaaaaaatagatcgcttaacagtttacgatgctgcttaatgtaaacaaggagtagctctccaaataagcccaagagaaggcgacataacttcggatacaacactacactacatattagacgaagacgctgagttacctcctacactgccaacgaccaaaattatatatttttcagacccagaagtaacaaccaaaattatagcaataaaacagggagttttcaaaatagtgcgtcaaaaatgttcagaacacagcatcgatggtagtgtgattagacttgtgaaataatgatttgtgtgggatcatttggagttccactttcccactgccgccattggcatcctggaaacatggcttcacctccacaccggtaaagacagcaacattctggtcaacatcaccccgagagtcactgttgtgactcctagagtggaagaaccttgtgatgcagaacctgccagagccgaggttgacaagttgagggtttttgcattccttcaaatcctctggcaggtaaagctcctcccaacgacccactaactgtggctgggagtccatggcagagaggttacaagcagccaagtagtgcggtgactcatcggagctgaagccaaaccagaggttgaactcaggcacatactcaaccctgccatggaagggtagggtccaattaccgacttttatccatgtgtggcttgccgtgttcaggcagtaggtgccaacaccatcgatggagatgcaaatgtgggggtcaccattgacggtgagcgatgtgtaggagctgatctctgggcggctgcagctgtgccagtacttaggttcacgaacgtacggcggcggcgggaggagttgccactgccaggtcttggagaagttggtcgatgtccgcttgtgcttgcagtagacaaaggcctcaaactgatcgctccactgtgtgcttgagttgacctctggcttgggaatcctctccataacaaaaagactgctgccagggcggtggtgttcatagtcattgtcagcatcggcgttgggtacaaacacagaaaagggcatcgacttgggcttgtggagacagggcaacatgtccatcagccgtgtctctgcttcaaagaggaaagggcgccccaagtgatccacccagaacatcttgtgatccacaaaagggaagcaatcaatcctacatgcctcgtttagagcaggtcggaacttgaggatgggtctgggaagccgaatcctctccatctttaagcctgctgccttcttcttgggattacaggagtcggacaccagtgtctgagaggtgtagtcttcttgcacagctgctgactctgatccatgtgcgattgttgttggtggtggtggtgtagcggtgttaccgaacagctggcctgccagatcgacgcagcgtagccatttggcgccttggaaggggacgtcgacgatgagattcttagcccgacgcgacaggcccatcttcagagtcgatcagcaactcccaagttccagctgaagcgaccgggccgtcaaaggatgaaaaagagaatgggaaattagttgcagataagaggtagtacaagaaagggtgtattgtttgcaggagttaggatgaaggaaggaagagtacctccaataagcagcagcagcaaacagaagatgtagccagccgagccgagataaagcttcctaatgaataacgcagatagcaaatgtaagcagaagaaaaggaaactgactttcgatcatacaggatgaagtcgaagcacaagtaaacaagcgattaaccttgaggcgcgcggtcggagcaggaagtcagactgggatggagtctcgacgcctaaaagtttgggtctgccatgccagggagggagggggagaaaatcaaggggtaaattagaaacagagaagaaaggggaatcttagtttttagttaaaagacaaagacaaaaaaaactagcgaccctaaatctagcagatacgagcaaggaaggaagagtacctccagcaaacagatgcgaccgcagtggattgcgcgtcctgccctgccctgcgatggatctatcaaagagtgttcagaccttcaaatgcaaagatgaaatcacgaaaacctaacaaacatcaccgagaaaacaatatatatgcaaagattaaacgaaataaaaggaatcggctttcgatcaaacatgatatcaaggtgcagcagatgcacagctgctgacctgaggagcgcggtccggtcggagaaggggaaaggggccagcggcggccggcggggatgggagtggcgaatcgagattgggatgggggctccggcttccccttccttttagggttcccgcatttctgcttctgtccgtgggcctctcttagaatgagcttggcccacactggtaaattatgggccggcctacgacggcgtcaaatgtcccgccgaacgagaaggtacacttgacctccctcagtcaaatgacatgtagatccaatctatcttctgccctataattcacccactacagtcctactagtaatatgcccatgctaaacactacggtacaactctatttgtctttaattttttttaaaaaatatttcatgttagccaccgccgcccgtctcccctcctcctactcgccccccaaccctgtccctctcctgccgccgctgacgggccccgcctccgcctcgcgtcgtccccgtcacctcgcaccgcctctgccttcccctcgcgtcgccgcctacacctccgccgccggtgctgccgctgtcgccttgccgtctccacctccctcttgcgccgtcgccctcgccgagcgcgggtttcgccggcggacgcggagaaagtgaggaggcgagcgctcctctccttttccccggctgcgaccaccggcatggaagaagaagaacgcggcggcaatgatctcaaccattgtggcggcggcgatgactggtggcaacgatgacctcgaccacggcggtggcaacaacgacgacctcgaccaccacagcgacgatggtaatgacctcgacctcacccgcttcaactggttgctgaccggatttggacgagaatgagatttcggtcatcggatcggttgatggcgagctcctggttaagagttaagagtaattaatcagaaattttaatcaacactgaacagcacacccatgctgtacaggcccaaccatcctgaacaaccatacccggctgtacagatctaactccaaaccaggagctaaacaaattattaccagttatagcatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtaacaataccctctgcacaacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaagaaataaagtaatcaatgcaaattggccataacaaaggaataagttcacaccacccggtgacattctaaaataaatgcatagttgaaataaatagagaattttaaatataggatcaacatgctcaaaggattgtgtttaggatctgtgtgacttgccttgcaataatcggtcttcaattaatcttcttgaatacttccggcgcactcgcgaaccttcgcaacgacgaaaacgacaagctaacacgcaaaacgaagaaaaagactaataaaaaccaaataaacaatacataaaaagtaaacaaacatgtagatcataattttagatgaattatgagacttgaacggcctcattctgacttcaaaagaatttattatgaattttataagattaaatctaattaaagcccatttaaaaagaattaaataaatttaattcaattcatggacaattttaatatgtagatctttattttatacaatttttgcaacttgaaccacattaaactgagttacaatgaattagttatgaatttttaaagattaaatcggattaaaacacttatatggattttaattgaattatgacgcaataatgaattatttttgaaaaggaaaagagaattattgcgtcagcggctagggtttgcggtgtaccgggcgcacggcaacggttcacgggaacggacggccgagatcgatcatatccaaaacggacggccgagatcgaacggatccaccgcggctcacggatgaacgacgacgatgacgtcagcggtgacgtcagcgatgacgtcagcaccggcggcggcttggcggctcggcagctcgggcggcgcatgctcgccggcgaacgacggcacgacgacgcaaacggaaggcaccaacgggtagaaggcgacgcgacgaactcaccggtgaccaaaaccacggcggaaaagcaacggacggcgccggcgacgaggaagaagcggcggcgaagatcgggtcgacggcggcgacggtgctctggcggtcttcggcgacggcgaaggggtggacggggacggcggcgacttggcgaccacgatggcgacctccccgagcgacgacgacgaccggaacggcggcggcgcacggctggagcggcggcgacgacggcggcgctaggtcacacggcgctagggcgcttccgacggcgagagacgaaggcgagggaggcggcgggtagaggagacaccgggggtccttttaaaggggttggaaggcggcggcaaaggcccacggcgaccggcggcgggatggaaagcttggggttcggaggaaagaaaccgatccgattcgacctcgaatccatgaacttccaaagcgattaagacgatgattccaaaagagaaaaggaagaggagatcgagaagatcatttcccctcaaaagatttcaccggagaaggaaagaatcgaccggatttggaaggagacggcggcggctcggacgcggctcggctagggtttcgggcggcggcggctggaggttgacgacaaccctgacaggtggggcccacctgtcagcgacatcgagagagagagaggagagcggcggctcggactgggctgactgggccggggagagagagaaagagaggggttttgggccgactttcggcccaaagccaaaagaagacatttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagatcttctcttttaagcttttaagatcatttctaattattccttttaaacaacaatttataatttaaggatttttaaacaaaaaaaaactcttaacaaatataattagatcattattgatcaaataattactgaactgttctttgtatcatttaaggaattgagctctgaaaaatccgagaaaatctcagagagttgacttaatcatggggaatttaataaaaattaaatccatccatgctttatatttaggaaattttatttcccacatttaacttcacttgtaaattaaagatcatttgatataaattcaaataataatttattaaataatttataaatcctgaaacaaaaatcaggatgtgacagccgccggtgctgccactgtcgccttgccgtctccacctccctctcgcgccttcgccctcgccgagcgcgggcttcgccggtggacgcggagaaagtgaggaggcgagcgctcctctccttttccccggctgcgaccaccggcatggaagaagaagaatgcggcggcaatgatctcaactattgtggcggcggcgatgactggtggcaacgatgacctcgaccacggcggtggcaacaacgacgacctcgaccaccacagcgacgatggtaatgacctcgacctcgcccgcttcaactggttgctgaccggatttggacgagaatgagatttcggtcatcggatcggttgatggcgagctcctggtcgcttgatttagtggcactgggctcggcggtgacagattgggtggcgctgaggaggatgaagtttcatgcaccggtatgcttcctccagtcaccgttgtttctagcgattctctttccatccccactccctattgatctgtattgcctcgtcaaatagtgaccgcgagccgatgcttgctgaggagcccgtactttaggccttccaatcttcaatcaaccgctcaagggctcaaggtgtttacacctaaatttggcacctaggatcgaaataggaaaaattgccaaagtttgaagttctgccggtttcctccagagtgggctggtctgaccgccgtttgtcggccagtcagaccgggcggtatgtggctggtctgaccggcggtatgtagccagtctgaccggcagagtccgagtccgggtctgtttcgccgggtctcgaagtttccttgctcgggaagacatgtttcgggtttcctttggattctatcccgaattggacatggaggagagcctgttgagggcaagaccaacccctatataagggagtaaggccggttcattgtaaagatcaatctacaatcaatcaatcgaatcgtttttcatattgcttttagtttactcttagtttgtctatctttgtcgatttgcgccgtaaatcgtccgccgccgctgcgagagtgcggcacctctttgtaggtttgtcctgaataccttccgttttgcccacgagacgggtagctatatagaatcggctccgctagccgatttagttatcaaaacccatcttagtctagtttttgctagattgaggtggttggcgactctaggatcaccgcaaggcatttaggtgctgcgatcgtgcttggtaatttgtcacaaaaagttgccaatacaaggtaatgcgtgtgtgtgtgtgtgtgtgagttctaaacccagccaagcacccaatcccagtcccgaactgtctagcgaggcacggtggtgtcacgcttgacggtgggccagttaagcatggggctgctggtaaagataatgctggtggttgcattgaacctgtgtttatatgttctggttttgtttatttatagtggtcatatgattgctgtgctatgcaggatgaatcaggttcgctgacttcgcatgacccatccatcaggtgtttgttggagatcttgcatttggtgttgctcgctttgtatacatgcgtggttcttttattagctactggatggcatgagaggtacagggtttcttataacttatttaggcttctcaaagggaaatagtcattttcattggttaattgatttttctggtctttacaaatatcatgtcagaacggattttcgttgtgctgctgtaggtccctctatcgcttcatcctacgattaattaatatgtttagaggcatttcctgtgtgggtcatggtttataggtgcccttatgaatgatatcgtcttctatggctgctatttctctatatcatgggcatatttattacagcttgtcaggcactgagattagattttgtttttagccatggcataggctttattgttatattcttcttactttatatattacagctttttatgttgctgagtatgtacgatgattaaggctaggtcttgaatttatagtagttttgtatggtactccaaatcaacttgggccttcgatgcttgtgaagtgaagtgaccttagtagttttggctctttctggagtaaattatgccattttatgatccttttgctcccatgcctaacaagtttttcagatgtaaatgtacgtacctttcaaaagttctttttttccccttgagacagttgcattccaggggattcagtttgccatgtacagttaaataaagatagtttcatgttcaggaaatgtagtaaggattcagccgtagtctaggtggttcttggaggaaatgcagttctgtagggttcccacgtcattcaggagatggtgcatgtgaggacactgatgttcagggttttttaaaaagatcttgaaagaatatagcttgcatattttgctggtggttttttttttaacgactcgcataagacagtgtgaagttcatattgatagagcagaaaaaaatacaaggatacaaccctgggaggccgtaaccatgaaaagaaaaggtataccacctcccacacaccgacaacaccaagcactcacccaggagaaggcctgcaccggaccggccaccgctaagcgtgaccgcccaccgcaaggccaacaaaggagctacaactgggatcgcccaaaacaatctatacaaccgacacaaaaccccgctctatccacatctcagggattcagggagagagggtgagagagaagatggaaccgctctcccccctaggccccccgacgtggccaacttgtacaaactaggacgctgatacaagaggaagagactctagaacgaacttgtagcagttgattgggaggtttcgacaagggtgctgccaagccaacgtctctagggagagaagcaacgaaagaaccgccgccgccgaccgtcgaggtcagaagaacctcgactgggctttcgcccggcaacaccactagaggaggtgagacggcacgacaacgccctcaagaggggaatgacgctcgcgcgccaccgttgccggcccagcgaggtcgggctgggttttcacccgccatccaccgcctgcctatccaccgttgacaccccaatactccaccgccagctaaacctctgccgacacgtgggcatcactgcacccgcccccctgccgaccagtctccgcaagccgccaccggtcacgccttgtcacctcacgcagcgtcgtcctctacctccatcgaccgcgtcgcaacggcaacctcgccggcctaccaccagtaccgcgcctcctcgcgccacggccaccttgcccggtcaccaccactgtcggccgcaactcccgccactgatgtcgtcggccacctgccgacgccaccagccagctgccgacgtactgcaaccaccaaccgccgtcgggcacttgctgccgccgcccgggccgtgggctccgcgctgccatcgccgtgaggtccgcgccgccgtcccgcaagctccgaactgccgccgcgacagtcctcgctcgatctggccgccggggggccagatccgcctccggtcgccggaaccacctccggcgctgctggatccgccaccctgacaccaatccatcgccgttgccaggggatttagatttgtcctgaaaaccttccgttttgcccacgagacgggtagctatatagaatcggctccgctagccgatttagttatcaaaacccatcttagtctagtttttactagattgaggtggttggcgactctaggatcaccgcaaggcatttaggtgctgcgatcgtgcttggcaatttgtcacaaaaagttgccaacacaaggtaatacgtgtgtgtgtgtgtgagttctaaacccagccaagcacccaatcccagtcccgaactgtctagcgaggcacggtggtgacacgcttgacggtgggccagttaagcattgggctgctggtaaagataactagaacttacggcgcgcttcgcggcgccctagcgttcgctttgaaagaagaaaataactaaggagaatggtgggagcatattttagttgagctgatagtgtagggtttgtttcagaagacaggttgacaataaaatgcatattggagctataacaggcagagaaacattaatcaattgttcacatattcggtaagcattgaaagaatatagttggaaagactaagtgtcacaacatttacatcatttacaccgtttatattacatatagttcttctgaaggtcttcgttccaacataggctaatacaacttgaattctgaagtttgtgaccatcacataacctgaaatcttacatctatgtgacgataaaaaaaaaagtggttgaattctgcgagataaaatcagctaagtgtaaatccagaagccatgagaacttattatgcttcatagagcaattaacagcatatatatatagaaagaaactaaatgatcagccaagatacaggtgtagagaaagaaacatccctgctatttgcccggctaccatatagaagttcaattctttgatgaactataaaatgtcattgaaattggtaaaccacctgtgatttcttcctcctgtcaattaatttatagggaaagcctgacaataaacaaaataaaaggatgagataatctaattcgtgcaccaagttcttatgtcagttgatttgttattatgttggcaactatgtagcgatacccgcgctatatttacaaacatgcatttgtcatggaattcaaagaaaacttaaagctaactggcaattctcacatttccaaagattgattaaactcacttgtcaacgcacaacactaaagcattacttcatatcaaccaactccatgctctccttcttgctagaatagttcatatgaaatcacatataatttagctaggttactgtagacgtgtttgttaggactgtacttcatatcaataagttagatggagaaaggagtaagtttctttcaaccatcacacataaaacataatctcattttatgttgattcaattggataagcatacttcgccattatctaggtcacaaagatttgaatctgggaaacatacacctatatttatatagactgaatcgctaccctgatttagtttgcaggtggtgcgatggcagcatcattttttcactaaataagaacatgattagatagtattggagtaatcaccaacaaacagtggaaaatgaaactttgccaaacacagatccaacagtgatagaaaattagaataggagtttccatcatttgacaaaattatagaagggcacaaattttaattgctagctagataacctaacaaaatagcaaggaataaatggtagaatgattgaggacagaaaacctgaagagatcaaatagtgttgcttgggcaacgaagtgaattcgtcaacccaaaatccaatatctcctattctctgcacaaacagagttgcaaaatttcccttatgcagaacttagcacgccacaaccagtgtctaactctcaaagctgctcaaccaggctagcaccttgtgaggtgggttttcaagcacaacctagtactcaatgcagccatttattcatgagattgaatgaaatgaccagcataattccaaagcacttagcaagatagcagttcagtagtgtccaaaattcagggatgaaatgattcactaaatgaagtggcgattaatccaaagcaccttacagtccagtaaggtccaagaagtcctaataccagttctgaaagatagcttttagataatgagttctgaaacatagttgatcgctttaataatgcagatactgcaacttcaaatgttgtctatcataaaatggtcggtaccaaaaaataaattcagttgtgcacctcctgcggcacagccgtggtgcagtctttggtcgaattagaatgaattatcaggttagtcaaatcaattcaagaacatttattctagaaaggttcatccagaaaatgggcttagataagcggtaaaattttctattccaaaattgcgtcagaaaagttggaagattaacagacagatatatgagtagggaaaaccaaatcgaagagaaggaaaggtaaatacctgcacgactgcacaatggacaccatacgctcgcatccatcgatcactcttatcgatcatggcacgactgctcgggaagtggctccttcgcagccgctgtggcggtcatcccaagcctcctcgcattgcaggcagaacatgcatgacagcgtaggaatacaggggaaaaggagatctagcagcttaggctcaagaactgatggcttacatgggattcttcgtaatcagcattggagcttagcactgatggctcatgcccttccaatggaagcgtcggcggtccatgggtaccagagctcgacggtcgtaggcgtcgccgccgcaggtccatgaaccatctcccgcctccatcgccactccagctaggctatcaccaccaactacggcggcgcaatggtagagtcacctccccaggtagagagaaataggggaaaaagagaaaacaataagaacggaggcggcgactggttcgtgagtctaggaggcgtgggttctctctcctttgcttgactcggaagagggtgaaggggagaggggtgggcaggagatgggggacggcggggagaccgcgaggggaagccgtcggcggcgaggagaagtaggggaagggaagacgatgtggcgccgtcgctcaagggaggggagagagcgagagaacggtggggaacagtggcggctagggtttctgggaagggaggggataatagtggtttctttttcataaaacccccttactttctctttttcagagcgcgatcctatatttagaatttcgcctccttcacatagaatatatcaggatgtcgagggcctttacgtaagaatacacaacacacaacctctattaccaaataaatagaggatttttttgcaaaaacgccacttccagctccaggcgacgtggacatcacgggaagcgaacacgccagccaaaaaaccagaatcgaaaacgccacttccagcgccgggtgacatggacatcatgggaagcgaacacgccagccaaaaaaccgcagaatcgctgtggtgcgagcattctacggtcctctttaatctctccgatgctggtggttgcattgagcctgtgtttatatgttctggttttgtttatttatagtggtcatatgattgctgtgctatgcaggatgaatcaggttcgctgacttcgcatgacccatccatcaggtgtttattggagatcttgcatttggtgttgctcgctttgtatacatgcaagtgttacaatgtaggctttattgtaaaatagcattggtggcacctactgtattctgaaaggagaagaatagtcaggctttcagcattgatcacctccatacaaaagaatttcacatttgcgatcattagctatttagctgtgccattccagagcctgaatgatgcaaatgttagaatcagctggcaaaaacttggcaagtaacaacaggatttattattttgagcagttatttcgaaacccagcctgcaccttgtctgcaaattcttttgctcccattggcattttagaattagatcacttcgtacaaaatcttaaactattatgtaacacttgcacattgtgagtatcctaagaagatgagtctttgcacattgtgatgcatcgtagcagaggaatgcattttaccttcatcatcatgattccaactggtgctccgagttctccagccttagcgaataatgacctcccaacctcatttgtcatccataattttaaggcattttgtgttctgacttgtgaagtctaaatcatttacgataatcaacattcaagagcacatgaagtttatatagcacagctacccctacaaaccttttaacttgacggccataagctggggttgaaccggacagacgatacttttcctagtgagaaacaaaggaatcatacatcagaatgtaggttgaaccagtttttaggtttgggatagttccaaggtatgtacctatataattagatgttcaagctgtttaatgccgcttccatcatctgcaggattagcaagacagcagccaatgaatttggatgggcatttcttcaacacactacaacaaaaacaaaatcaacaaatatttgtttacttaaacaccgtgggaatgctggaaagttaggggtgccaccttagatgtcacttttgcaaaaaggcccctgcatttctgttaattacgcattggtccccgctgatatccaccataaaccgttggatctcgatatagggtagatctggccgtacacgtgtccaactgtgccgacccttccgcaaccgtgaaatcgttggatctggaacggacggtgtggatttcgccggcctgcaccaaaccctagccccgtcgccccccaccctcgcacgcgcactcgccctcctccctctgcgcgccgccacgctctcctcctcggctcctcccctcacatgcgctgtcgccgccgccgccttgctgtcctcctgccctcacgcgcctctcctcgccatcctcctccacttgcacgcatcgttgccatcgcagactcgccatcttcctccactcgcgcacgtcgtcgtcatcgcaatctcgccctcctccagccatcgtcgccgacccaccgctgcctctccctcccagtgaggtctagaggtcaggtccgccagatccgccgcgccgccgctcgcgtgttctctgtccgctggcgtttgacatgttggttttgcatcatcgatctgctgcagctgtgaaaggtcgacgccatcagtcaaggtgtcgctcccctccctcctgttctaattcctgtccttgcgccgaccagccgaccattagcacagaggccgcaatgtaagtccgttctacctcatcattgattatttcccatgcattcacttgaggttttataggatccaccatcttgccttggtcccattgagttactcatgggttaggatgtatagcagattaaggagaggattggcttccattgctgctgtttgcatccgctttcaggttaagccatccattaagttttatcctcgttgttatggctgcttgcaaggctgcaagattcagatgatgtcctcactgttaaggatggccgcagctctgcaatattcaaatggtaacattcttgctaaaattgccacaaatgatgagataaactgaaatccaattatttcctttaattttaattgcattcgctatggtgcaatgtggtaagaaatccatgcactatagcaatgaagcctgttggggtcatgtatgtatggtcttctcagttgtcgtatttaacgattgctgcttattcttgttataaccaaaacctcgagagatagatcatgatcaaatgatgacatcgccacccatcatcgtactaacgcaatgtatagttacgaatttatgggtaaaataatgataaatgggaatatgacagcacccctttgtgcaggatctttgagctatggatgctaaacgataaaggtggctcacattgaactacaactgctaaaggcttaaaggctaaaggtatggatcttttaaatagaaaatgcagaaggagccttcccctgctgttttcgagggaaaaaaaaaggctaaaggtgtgaatagaacataaaaaactgaaccaatcaaatgacaatttctggtctgttgactattcagtattgcatgaggtttctatttgtgaattagacatgttcataatcaaattgaactacaagaaaaaaaactgagataattttattaagtacacatttggtatgcctgaaatttctgatataatcaaatttaatcgtcattaataacaatttatttggttaaatttgacattactttgcattaatacaaatataaaatgatatacataactcaaaataagaaatcaaagaaatgtggggtaaaataagatatatctatatctatactaatataaaaaagagttgcccctctccaatcctaccggccaaatcatccggatcaatctctactgtccatctgccctctcatgtaatctcatccgtccagttattccaccgatttcgcccccatgtggacacggtgactccgccgggcaaaaccccgctgcgatgactccgccgcgcgtgtcctctctcgcttgtcgcgatcgatggaccagcgcaccgccgcaacgccggaccaacgccgaccaccaccgcacccgtgcccaccgacggaccagcgccgccgctgttacgcctctaccgccagaccaccgcacaccaatgcatccctcatccgcaggagccccgcccgggactgcccccgacggcgccgcggtggttccccctactgccggagccgctgcggcgctcaaccagcgccgacggaccaccatagcgccggagctccctcatcctcgcgacggaccagcgttgccgctgctgcgcctccaccgccggaccatcgcgcaccaccgcatcccccttccgccggagcggagccacgcacgggactacccccgacaacgccgcggttgttccccctactgccggagccgctgcggcgctcgactagcgacgccggaccagcgcaccgccggactagcaccgacggaccactgcagcgccaagccaccaccgcggtcccatgttccgctaattcccatctcgggggttttcgtgttcgcctcgccttgccctggctcacttcggggcggaggtggcgtcgctgtccccgatcgaattctgccgatgcgcccctggctttcaagatctaagtgcatgcgcgccctcgccgcatgccgcccggcgctccggcagtccgggtggccggacgcgatcggctccgaggtatgttgcccatgcgcgcgcttgctctcctttgcgatggttttggtttggccaccgtttgattgagaggagttctgggaggtacgcgttgtcgtaatttgggggttccgttgcttgcgatggggaatgctcaatgatctgcttgtgcagtttggtttggtggctgctgttctcatacgaacattatattctacatttagtatctgtttgtgccatcctcttatgatatgagcaggttgtgttgttggcattggagtgtttaggttgataatggtcctatttggaagacatatggattgctgctttattagctgataaaaatgttgttttaaatgatcttttgcgatttatgtgggttgagatgattctacaggtggttttgatcatacacagatttgcctaatattggaacttcatcgaagagtagttgggttttcctggctgaggagtattagttgattggtgaactaaaatgcagaaggaatcattcaggaataaatgttgcatcttatcattggaaactgttataaaaaatagtgtcttcaacaacttaatttgtcatagagagaaagattgtaggcaaattcaggttttccgtcatacctccatctcctcacgattcacgtgattagcgagttgccatggatgagccagcaagacgtgcatgcaatcatcagaaacggcatcgcaacagcacagcaccaagcacatgcctattcgccagaccagatctatcatcgcataaaaccaagcatataaccaacaacacgggataatgtaagctcactaaataaatgattaactgttcaatagatcctaaacccaaaatgaaacagggtaatcaccaaacatataagggtggatcccacaatgatgttatgatgcatcccctcgacgagcgacgccgcacaaataatctctgcctgcaaaagcaactaaagcacaacgctcctgcaggccatcctgagactaaatcaaatacaacaatttatgagcaataataattatcgatatttgatctgagcctttgaacaatgaacaaagacctttactttttcatcctacctaaatgcatattccaattctcatcctaattaaatttaccatttaacactatgggttaactaataaaaatacatgaatttttttctattttcccagtggctataagagccacgacaaaacaatatgaaattataaccaccagcaagagcccctgcgtcgctctcccccagaggcgactcgggtggcgaacctagccgccccctcctccccccgaccaccttcctcctccgcctcgccgccaccacaaggacagcggcggcggggcttcacgcctcttcctacgctggcggccaagggaacctccggtgggtggcgatggcgaccgccagatccgccccgccgtggccggatctggcggggtggcggctgacggcgggggtggagacggcgatggtaggggcgagggggtgtgggcgacggtggtcggaatggcgacgatggaggcggcggcggggatggcgacgacggtggggttggcaacggcgatggattggcgtcagggtggcggatccggcagcgccggaggtggttccggcgaccggaggcggatctggccccccggcggccagatcgagcgaggactgtcgcggcggcagttcggagcttgcgggacggcggcgcggacctcacggcgatggcagcgcggagcccacggcccgggcggcggcagcaagtgcccgacggcggttggtggttgcagtacgtcggcagctggctggtggcgtcggcaggtggccgacgacatcagtggcgggagttgcggccggcagtggtggtgaccgggcaaggtggccgtggcgcgaggaggcgcggtactggtggtaggccggcgaggttgccgttgcgacgcggtcgatggaggtagaggacgacgctgcgtgaggtgacaaggcgtgaccggtggcggcttgcggagactggtcggcaggggggcgggtgcagtgatgcccacgtgtcggcagaggtttagctggcggtggagtattggggtgtcaacggtggataggcaggcggtggatggcgggtgaaaacccagcccgacctcgctgggccggcaacggtggcgcgcgagcgtcattcccctcttgagggcgttgtcgtgccgtctcacctcctctagtggtgttgccgggcgaaagcccagtcgaggttcttctgacctcgacggtcggcggcggcggttctttcgttgcttctctccctagagacgttggcttggcagcacccttgtcgaaacctcccaatcaactgctacaagttcgttctagagtctcttcctcttgtatcagcgtcctagtttgtacaagttggccacgtcggggggcctaggggggagagcggttccatcttctctctcaccctctctccctgaatccctgagatgtggatagagcggggttttgtgtcggttgtatagattgttttgggcgatcccagttgtagctcctttgttggccttgcggtgggcggtcacgcttagcggtggccggtccggtgcaggccttctcctgggtgagtgcttggtgttgtcggtgtgtgggaggtggtataccttttcttttcatggttacggcctcccagggttgtatccttgtatttttttctgctctatcaatatgaacttcacactgtcttatgcgagtcgttaaaaaaaaaaccaccagcaaaatatgcaagctatattctttcaagatctttttaaaaaaccctgaacatcagtgtcctcacatgcaccatctcctgaatgacgtgggaaccctacagaactgcatttcctccaagaaccacctagactacggctgaatccttactacatttcctgaacatgaaactatctttatttaactgtacatggcaaactgaatcccctggaatgcaactgtctcaaggggaaaaaaagaacttttgaaaggtacgtacatttacatctgaaaaacttgttaggcatgggagcaaaaggatcataaaatggcataatttactccagaaagagccaaaactactaaggtcacttcacttcacaagcatcgaaggcccaagttgatttggagtaccatacaaaactactataaattcaagacctagccttaatcatcgtacatactcagcaacataaaaagctgtaatatataaagtaagaagaatataacaataaagcctatgccatggctaaaaacaaaatctaatctcagtgcctgacaagctgtaataaatatgcccatgatatagagaaatagcagccatagaagacgatatcattcataagggcacctataaaccatgacccacacaggaaatgcctctaaacatattaattaatcgtaggatgaagcgatagagggacctacagcagcacaacgaaaatccgttctgacatgatatttgtaaagaccagaaaaatcaattaaccaatgaaaatgactatttccctttgagaagcctaaataagttataagaaaccctgtacctctcatgccatccagtagctaataaaagaaccacgcatgtatacaaagcgagcaacaccaaatgcaagatctccaacaaacacctgatggatgggtcatgcgaagtcagcgaacctgattcatcctgcatagcacagcaatcatatgaccactataaataaacaaaaccagaacatataaacacaggttcaatgcaaccaccagcattatctttaccagcagccccatgcttaactggcccaccgtcaagcgtgacaccaccgtgcctcgctagacagttcgggactgggattgggtgcttggctgggtttagaactcacacacacacacacacacgcattaccttgtattggcaactttttgtgacaaattaccaagcacgatcgcagcacctaaatgccttgcggtgatcctagagtcgccaaccacctcaatctagcaaaaactagactaagatgggttttgataactaaatcggctagcggagccgattctatatagctacccgtctcgtgggcaaaacggaaggtattcaggacaaacctacaaagaggtgccgcactctcgcagcggcggcggacgatttacggcgcaaatcgacaaagatagacaaactaagagtaaactaaaagcaatatgaaaaacgattcgattgattgattgtagattgatctttacaatgaaccggccttactcccttatataggggttggtcttgccctctacaggctctcctccatgtccaattcgggatagaatccaaaggaaacccgaaacatgtcttcccgagcaaggaaacttcgagacccggcgaaacagacccggactcggactctgccggtcagactggctacataccgccggtcagaccagccacataccgcccggtctgactggccgacaaacggcggtcagaccagcccactctggaggaaaccggcagaacttcaaactttggcaatttttcctatttcgatcctaggtgccaaatttaggtgtaaacaccttgagcccttgagcggttgattgaagattggaaggcctaaagtacgggctcctcagcaagcatcggctcgcggtcactatttgacgaggcaatacagatcaatagggagtggggatggaaagagaatcgctagaaacaacggtgactggaggaagcataccggtgcatgaaacttcatcctcctcagcgccacccaatctgtcaccgccgagcccagtgccactaaatcaagcgaccaggagctcgccatcaaccgatccgatgaccgaaatctcattctcgtccaaatccggtcagcaaccagttgaagcgggcgaggtcgaggtcattaccatcgtcgctgtggtggtcgaggtcgtcgttgttgccaccgccgtggtcgaggtcatcgttgccaccagtcatcgccgccgccacaatagttgagatcattgccgccgcattcttcttcttccatgccggtggtcgcagccggggaaaaggagaggagcgctcgcctcctcactttctccgcgtccaccggcgaagcccgcgctcggcgagggcgaaggcgcgagagggaggtggagacggcaaggcgacagtggcagcaccggcggctgtcacatcctgatttttgtttcaggatttataaattatttaataaattattatttgaatttatatcaaatgatctttaatttacaagtgaagttaaatgtgggaaataaaatttcctaaatataaagcatggatggatttaatttttattaaattccccatgattaagtcaactctctgagattttctcggatttttcagagctcaattccttaaatgatacaaagaacagttcagtaattatttgatcaataatgatctaattatatttgttaagagtttttttttgtttaaaaatccttaaattataaattgttgtttaaaaggaataattagaaatgatcttaaaagcttaaaagagaagatctaattttaatttgttaaatctcaacataaaattgggctagataaaattttgttaaatactttgcttaattctataattcctagatttttctgggatttatttgagctaaggaagtatttttaataaatggaattgcatttcatgaataatttaaattgaaaaaggtttttaaatgtcttcttttggctttgggccgaaagtcggcccaaaacccctctctttctctctctccccggcccagtcagcccagtccgagccgccgctctcctctctctctctcgatgtcgctgacaggtgggccccacctgtcagggttgtcgtcaacctccagccgccgccgcccgaaaccctagccgagccgcgtccgagccgccgccgtctccttccaaatccggtcgattctttccttctccggtgaaatcttttgaggggaaatgatcttctcgatctcctcttccttttctcttttggaatcatcgtcttaatcgctttggaagttcatggattcgaggtcgaatcggatcggtttctttcctccgaaccccaagctttccatcccgccgccggtcgccgtgggcctttgccgccgccttccaacccctttaaaaggacccccggtgtctcctctacccgccgcctccctcgccttcgtctctcgccgtcggaagcgccctagcgccgtgtgacctaccgccgccgtcgtcgccgccgctccagccgtgcgccgccgccgttccggtcgtcgtcgtcgctcggggaggtcgccatcgtggtcgccaagtcgccgccgtccccgtccaccccttcgccgtcgccgaagaccgccagagcaccgtcgccgccgtcgacccgatcttcgccgccgcttcttcctcgtcgccggcgccgtccgttgcttttccgccgtggttttggtcaccggtgagttcgtcgcgtcgccttctacccgttggtgccttccgtttgcgtcgtcgtgccgtcgttcgccggcgagcatgcgccgcccgagctgccgagccgccaagccgccgccggtgctgacgtcatcgctgacgtcaccgctgacgtcatcgtcgtcgttcatccgtgagccgcggtggatccgttcgatctcggccgtccgttttggatatgatcgatctcggccgtccgttcccgtgaaccgttgccgtgcgcccggtacaccgcaaaccctagccgctgacgcaataattctcttttccttttcaaaaataattcattattgcgtcataattcaattaaaatccatataagtgttttaatccgatttaatctttaaaaattcataactaattcattgtaactcagtttaatgtggttcaagttgcaaaaattgtataaaataaagatctacatattaaaattgtccatgaattgaattaaatttatttaattctttttaaatgggctttaattagatttaatcttataaaattcataataaattcttttgaagtcagaatgaggccgttcaagtctcataattcatctaaaattatgatctacatgtttgtttactttttatgtattgtttatttggtttttattagtctttttcttcgttttgcgtgttagcttgtcgttttcgtcgttgcgaaggttcgcgagtgcgccggaagtattcaagaagattaattgaagaccgattattgcaaggcaagtcacacagatcctaaacacaatcctttgagcatgttgatcctatatttaaaattctctatttatttcaactatgcatttattttagaatgtcaccgggtggtgtgaacttattcctttgttatggccaatttgcattgattactttatttcttgataccttgggttattataacttgactagttgagctttatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgttttataagggggtgattatgatccaggaatggtgcactgtggtgagttgtgttgtgcagagggtattgttacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgctataactggtaataatttgtttagctcctggtttggagttagatctgtacagccgggtatggttgttcaggatggttgggcctgtacagcatgggtgtgctgttcagtgttgattaaaatttctgattaattactcttaactcttaaccaggagctcgccatcaaccgatccgatgaccgaaatctcattctcgtccaaatccggtcagcaaccagttgaagcgggtgaggtcgaggtcattaccatcgtcgctgtggtggtcgaggtcgtcgttgttgccaccgccgtggtcgaggtcatcgttgccaccagtcatcgccgccgccacaatggttgagatcattgccgccgcgttcttcttcttccatgccggtggtcgcagccggggaaaaggagaggagcgctcgcctcctcactttctccgcgtccgccggcgaaacccgcgctcggcgagggcgacggcgcaagagggaggtggagacggcaaggcgacagcggcagcaccggcggcggaggtgtaggcggcgacgcgaggggaaggcagaggcggtgcgaggtgacggggacgacgcgaggcggaggcggggcccgtcagcggcggcaggagagggacagggttggggggcgagtaggaggaggggagacgggcggcggtggctaacatgaaatattttttaaaaaaaattaaagacaaatagagttgtaccgtagtgtttagcatgggcatattactagtaggactgtagtgggtgaattatagggcagaagatagattggatctacatgtcatttgactgagggaggtcaagtgtaccttctcgttcggcgggacatttgacgccgtcgtaggccggcccataatttaccagtgtgggccaagctcattctaagagaggcccacggacagaagcagaaatgcgggaaccctaaaaggaaggggaagccggagcccccatcccaatctcgattcgccactcccatccccgccggccgccgctggcccctttccccttctccgaccggaccgcgctcctcaggtcagcagctgtgcatctgctgcaccttgatatcatgtttgatcgaaagccgattccttttatttcgtttaatctttgcatatatattgttttctcggtgatgtttgttaggttttcgtgatttcatctttgcatttgaaggtctgaacactctttgatagatccatcgcagggcagggcaggacgcgcaatccactgcggtcgcatctgtttgctggaggtactcttccttccttgctcgtatctgctagatttagggtcgctagttttttttgtctttgtcttttaactaaaaactaagattcccctttcttctctgtttctaatttaccccttgattttctccccctccctccctggcatggcagacccaaacttttaggcgtcgagactccatcccagtctgacttcctgctccgaccgcgcgcctcaaggttaatcgcttgtttacttgtgcttcgacttcatcctgtatgatcgaaagtcagtttccttttcttctgcttacatttgctatctgcgttattcattaggaagctttatctcggctcggctggctacatcttctgtttgctgctgctgcttattggaggtactcttccttccttcatcctaactcctgcaaacaatacaccctttcttgtactacctcttatctgcaactaatttcccattctctttttcatcctttgacggcccggtcgcttcagctggaacttgggagttgctgatcgactctgaagatgggcctgtcgcgtcgggctaagaatctcatcgtcgacgtccccttccaaggcgccaaatggctacgctgcgtcgatctggcaggccagctgttcggtaacaccgctacaccaccaccaccaacaacaatcgcacatggatcagagtcagcagctgtgcaagaagactacacctctcagacactggtgtccgactcctgtaatcccaagaagaaggcagcaggcttaaagatggagaggattcggcttcccagacccatcctcaagttccgacctgctctaaacgaggcatgtaggattgattgcttcccttttgtggatcacaagatgttctgggtggatcacttggggcgccctttcctctttgaagcagagacacggctgatggacatgttgccctgtctccacaagcccaagtcgatgcccttttctgtgtttgtacccaacgccgatgctgacaatgactatgaacaccaccgccctggcagcagtctttttgttatggagaggattcccaagccagaggtcaactcaagcacacagtggagcgatcagtttgaggcctttgtctactgcaagcacaagcggacatcgaccaacttctccaagacctggcagtggcaactcctcccgccgccgccgtacgttcgtgaacctaagtactggcacagctgcagccgcccagagatcagctcctacacatcgctcaccgtcaatggtgacccccacatttgcatctccatcgatggtgttggcacctactgcctgaacacggcaagccacacatggataaaagtcggtaattggaccctacccttccatggcagggttgagtatgtgcctgagttcaacctctggtttggcttcagctccgatgagtcaccgcactacttggctgcttctaacctctctgccatggactcccagccacagttagtgggtcgttgggaggagctttacctgccagaggatttgaaggaatgcaaaaaccctcaacttgtcaacctcggctctggcaggttctgcatcacaaggttcttccactctaggagtcacaacagtgactctcggggtgatgttgaccagaatgttgctgtctttaccggtgtggaggtgaagccatgtttccaggatgccaatggcggcagtgggaaagtggaactccaaatgatcccacacaaatcattatttcacaagtctaatcacactaccatcgatgctgtgttctgaacatttttgacgcactattttgaaaactccctgttttattgctataattttggttgttacttctgggtctgaaaaatatataattttggtcgttggcagtgtaggaggtaactcagcgtcttcgtctaatatgtagtgtagtgttgtatccgaagttatgtcgccttctcttgggcttatttggagagctactccttgtttacattaagcagcatcgtaaactgttaagcgatctattttttaagaaaactttatatttagaaatttctttaaataatcaaatagatctcattttcatctttttgtgtttgcaatagctaatacttaattaattatgtgctaatgctaatgatctttcttgttttggcgtctggcttatgaagttatgagcttactctaaacttcaattcaagctgagcttaaaattaactccttgatttgttcataactttgatatgatctatgttttggatccgtgcttgtcatttagcctggggatcagtcttaactgttgtcatgttctgttaccatttgtttggtacaatatcttcatcgaaaatgtattatggcctgtttagttcccacaaaaaaatttacacactgccacatcgaacgtttgaacacatacctaaagtattaaatataagctaaaaaattaactaattacacagattgcgactaatttacgagatgaatctttgactaattgcttcatgaattgacaatgtagtgttatagtaaatatgttaagtgacagattttgtaattagtttttggggcaattgtatccatgcccccacttttaaatccaattgttgttttacccatattttttttaggatttgcagttttacctctatgttttgaaattgaaccagccggctaccccagtcctaacagccagtttgatggtgttagttgtaaagtaaagggacacttatacccttggtggttattgcatttttgcccgcatttttacccctttttttttcagtttgtgtgattttgcctctattttcgcttgcctcgtcgcctgcctgggagcagccgccgcctggctaccatcggagcggcgcgtctgccagcccacccgccctcaccgccgcgtggaagcctcgtggtcgtcactgctgccgcgcacacgctctcgcggccgctgtcagcaaaccctcgccgcagccgcctgcacaccctagccgcggccacccgcacgccctcaccgcggccaccaccgccgcatgcccgcccttgccacggctgccgccgccgcgtgcacgcccttgccacggctgccgccagcagccgtccgcagtccctctgtaacagccctaaaattgacaactttttaaaattgatttagaaattgacaactttttaaaattgatttagcttgctttggttcactaaaaatataactgtcgagttagacatttatttaaaatattattttcccatgtttatttttgatgtttcttttctggtttaattttgttgcaaagtgcatcttacctttcaaataattcctttgaatccaaattaaattctatcccaaatgtcgggccatctaaattccacaccaattcaaatcctatttattttaatttccccaatattttctttttctctatttttaccttaattctctttttccatatatttttttctttcttttctattatttctttttttttcttttctctctctcttcttttccttcttcttctcttctcggctaggccgagcccagcttgtgctgcctcgcaccaaacccgtgccgccttgcgcccagctcgtgccagcccacgcatgccacacgctcgcatgcgcacgcacgaggccgatcgaccgacgaatgcccggacgacacctccagcttcccgcctccataactccttcgttcttccactagaaggctcaacaccggaggcaaaaggaccgcaatttcgacctctttcacctcctcaaatccgcccccaactcccgctgactcaatcgtcgtcaccggaggaaaaaatccccgaaaccctagtccggcgccattcacaggagctccaaaattcgtcgtatacgtcgctaatcctctgaaatttaaggtaaaaatggattcttcatgccaagtactccctttcccctctctttccccatccaatccgtccccagaacgtcgccggggccgcctcctgccgtcactgctctgttcggccgccgccggctgcacggcgcgccgtcgctccagaccgccctagcttctgccgtcgccaccctaggactcctctcgcctcagtgaacctcatcaggccaccgcccttcccggagttcgccggagtcgctgccgccatggccgcctccgcctcctgtttctgcccgccaccgccagcctcgccgccgaccacaaaaaggaatcgcctcgacccctagatcgcaaaaccggcgcctccccactcaaaaccggcctcctctgcaaccggcgtcatgggattacggccagttcctgtgcacataacgagaagaacaggaaatcctattttcctgttgaaaaataaatcagaaaaatcttttttcttattctatcaggttgaccatccgtttgacctcacaatcaaaatccgagacctattccaaactcctagaattattccaaatccatccatgtcagtttcgttgcaatccgagcacccgctgtcgcgaccctaattttagccctatggttcgccgtacaccgaaatttcaaaaatccctaaaattatttctttaaaatcctttccacccattgtttcactttgtgatactatttgttttggttatctttttttttatgttatttattgttgtgatgattgttgcgtaaatagaaaacgttggcgttggcccggtagtcggagcgagtgaaatgtccgcgccaggaggagacggtttgtacgactacatcgagcctgaaggttgcaagacatgcacccttctttgaacaaccagtagttagagagttattttggtagcgtacttgtcctttggagtacgatagactgcacgacttttttaaattaattatattgctattattgtattatatattctgttgctgttatggacaccttaaagagccttagattctaacaagcttaggataaaatttgagaaacacttaaagataggttatatgggctttttgggcttgcaatatggtagtattaatagtctaatatacatcatcggggctccgcaggtcacccgcgggtggatgtcctcccccgcccccgtccccgcccatggccggggccccgaccccgactccccgcgggtcgaaatcagtacccacccccacccccgtaggggcaggtccacggccccacgagggaaattgccatccctaagcatagccgatagggcaaacccagctagtatcggctagtattccataccaccttataccgagatatcagcatagatgaaatatataaaattgaaactaatctaacgagcaatgtgaactagcagattgataggaagcttaatatactttaaacggatgagatcttgatataaggggcagatttagatgatccagaaccaaataaggaaacaagacgactaaatcaagtaagatcggctaaaactccgatgctatctctgttagcaatcaaagaaagagctagataaaacgattaaagatagtacttaatagatcgaacctaaccgatgcagcattaagcgtgagaagaaacataagatctaatcaaatcgatgaaaactcattcaagatggtagatacaccgcatagtctagcttgatatcgaagcctaaacctgcctctcgatgatagaggctagccgatgaagtttagatgacgaaaccaatctagactatgcggtatatatgataactcggcggtttacatagacaggattagagtgtcatgaagatgcaagcactaatcccgagaacgcaaacctccataacaagctttacctcttcattggagatcgaacccgatgcagcccaactcgaaagcaataacttgtcgaaacaatgaaaataaaaaagggtgacgatgcgccaaagtattattgaaccgtcgtcccttgattacatggtgtgggtcatatttatattcgaagtacataatatgtccttgctggacatgactcttatctctaacgaaatttaaaatacgaatgagtcccttcaggtggactcttaccaacatatctctaaggaaactgaaaattgtcctaattaatagatacaattgctccgttttaggactccaatcattgcgtggcaatggctatgaagtgcttcgaccaatcccaatgatggacatgggaccatctttcccgagattggttgcatcggcttgactccgtcagatctagcgcttagccgatatgtggcagccgataccgcctatagccgattcatgtggtagccgatgctacttgtaactgatgcgtattctgctttctcgaacggaatttctccaaatcggcttcgactctaactttgaatccggcccatggcattaccaaatttggtcgttaacaaccgcttgtgagcgggtggtacacatgatggagttcatgtgtttggttttatggacctgtttatggtcgtaatggatatatggatatatttatggttatttcttatttaaaattgatataataatcaaccctcttgtgccaataagaatgacatagtttcgcccatccacacgatcgatttgtcgaacctggccgtatattgctccaattgattgaacttatgcaggcctttcgatgtattggccattagctttcaagtgtgtgaagcaaagtgacatggtttatgtttatgtgatttatatatgtgggctcgatgggcccgagagttcagaactgccctatgggcccatcaagttctgggctacccatcgagtaacgaacaatggtaagtggatgcggaggtaggttggtacacacctcggaccggatcactccgagcaatgacccgagcatcctttaacttactaggcagaagggagagatatggagcaatattacgccttgttacttttcagcccggctagctgtgagtatcgtgtgggtaaagctaggcagacgctgcagagtcgtagagtattcgaatacgccgtgctcccaattaatggtgatgtgtctatggatgattccagattatgggcacaagttaaactaaatggttattaattaatatggttaatttatttattgcttgatgttttattcaagttatttataagtgacatttatattaattttatgctcgttattatcgtttaaattaaatattcaatagtgttgtttatatcaaatgtttattaagataggctctatgaaataaatgttaaggttagagtttaaaccttccggctcttaataatgcatgttttatattgcaattattgtatttgctatcataggcatgtcttgctgagtacctgttgtactcataaatgggttcagatcatgaggaggaagatgattgtggagatcctgttgacccgttagagtgggacaattatggtttctaggtcattctatgcccaagcaattcctgtggtggagtctagcagttaataaggctttataggtcatttatgtaatggtttgtatttatgttgtgttgtgaactaagtgacttaagtaatgtataaccgaagcttatgcttttatatcatttcatgcgtaactgaacatcttggacagttacgtattcgtgggggcaccatgactttatcgggtgtccccacaccctcaccgcggtcgccgcgtgcccaccctcgctaccgtcgccagcacgctctcgctgattccaattcacactagcacgggttgggaggtgaggaccagaccctatccattcactcagggatactaaggtaaattcatatttcctaaaaccttttttttattttcttttgtatttctttaacacaaaatgcaggacccaccaaacggctgttagaagtagaggtagacgctgcttcaattttaaaaagtggggtaaaactgcaaaccctaaaaagtgggactaaaacaacaattgggtttgaaagcgggggcatagatgcaattgacccttagtttttttattagtatccgaacaccccatgcgatacctatataatacccgatatgacacgccaaaacttcacacccttagatctaaacaccctctatatgtaaccaatgagatttcccacctgattagaagattttggaggaagatttaaagaacacgaattaggtcccgaacatgaaacttgtcccctagctaaatctcgaagagggagcactcactttcctgctagattttggttagttgcatgattttgttttttctaagggggaccacaaggtttcactattggttagttgcatgatatttttccaatccattggtcaatattttggacgcttcaggggggtctcaacattcatatagcactgtttggaatagacgaaaacctaacttgtgtctttctatgtttagataccggggtgtaaagttttggcgtgtcacatcgaatatacgaataagcatttaaagtattaaacgtagtctaataataaaacaaattacataatccacttgtaaacgccgagatgaatttatcgtagcaccatattgtcaaatcatggtgcaattaggcttaaaagattcgtctcgcaatttacacgtaatctgtgtaattagttatttcttcatacatgtgttcaaacatttgagttattttttcatctatgatgtggtagggtgtaaaattttatcatgggatctaaacagggcctaaatccagaagtatgtgatttgtgggatttgaacgcaatacgtttctctccacacatgtattacattaccatcttagtatgaagcacttaatgtcaatatttaaaatgctatcgttttgatttccattgtcgaaacttaaaatacttatttgcctctctaagacgtgttgggcaccccttattcccaacccttctccctcgttttccacgcgcacgcttttcaaactgctaaatggtgtttttttttaaagtttgtatacgaaagttgtttaaaaaatcaaattaatctatttttttaaaaaaatagctaatacttaattaatcacgtgctaatggatcgcttcgtttttcgtgcgcactattcatgttggggactaggcgtggcgaacacagcctaaatgattttaaataaaaaaaatcatgaattacaaagttgtagatctagctctacaactttgacacatatcatgtgtccatcggaggttatttgaatcgtatatatgaaattctgtgaaatagatcttaaatcttataacaaatattttaaaccctaaatgatctcaaatagaaaattattcagcttaaaaagttttagttctcattgagatatactccctctgtaaaaaaaacaatcatagacatggatgggacattacataggacaacaaatctctggagatgctcagattcattgttctatgtaatgtcccatctatgtataggttgacatttttttttggacggagttagtacaagtttggtataaatttaattagcagactttttatgaaaaagttaggtacaaatacatatttttctaaaatcgatcctcactgtttatatcgtccgtcagtaaagataatgtgttctctcatagatgtcttaagcgcgcttatatcttctgcaagtaaaaataaatgtgatttttactcacggtattatttttagtccatttgaaaaaataaaagaaaagtgtgaaaaattgtgttttttagtgtcggctcactgggaatggtaaacgagttgagcttaggccctgttcttctcatattatcacctcattatttgctctacccttgaaaacaatgttttgcttataccgcttgttttaagctagtattatttaaatctgttttatgaaaatatttaatttatctcaatagttaaatagataatccttcgcaataacccgttgaataatctgaatctaacatggcctaaaaattattgctcgttaggcataacaagccgaaggaaagagtacaccgaaggtccctcgacttgtcattgaattacaaaatcatccttaaaccacaaaacggatacaacgcgtccctcaacttgcaaaaccagtgtagactaggtccctcggcggttttgactccggttttgtccgatgtggcagctgactcagcgtgggtcccacatgtcagcctcttcttccccttctctctctccacctctcttcctctctcatccctaaaccggcgggggaggagtggggagcgaccagcgagggcggagatgggcgcggccggcagccgcctggggaggaactggacgcggcggttgtcgtcgtcgtcggatctggggaggtggatggtgggaggtcccttatcttgccgtcgtcgacagaggaggaggcagtgcggtaggccgaccacgacgtcggtgtcatcgtcgttgatccgctctagctgccggggccgatagatgggagaggagacgacagcggcggaggcggaggcggaggcggatggggaaacggggctcgacgagggagagggcgcaggcataggcgaggagcgcatcccgcctccgctcgagggaggaggggttcgggagcgatggctgctcgacgtcggtgcgcaggtcgtacaccaccgtgaggtcgtcatcggccgcggctgcctcctgctccgagtaggcggaggtgatgtagaggcggagcggacggcctcgtcgcccgtcgccgccgccgcctcatcgcccgttgtcacggtggccgccttgtcgcccgtcacccgtcgcctcgtctcccatcgccactgccggactcccgcttgccgaactgagcagcaaagagagagaaagaaaagaagagggagaaagagaggggaggggaagaaggggctaacatgtgggacccacctgggtcccacgctgagtcagctgccacgtcggacaaaactggagtcaaaaccaccgagggacctagtctacactggttttgtaagttgggggatgtgttgtatccggttttgctgtttaaggacgattttgtaattcgatgacaagttgagggaccttcggtgtactttttcccaagccgaatgatccagggaaactaggaattttttttatttatacatttttttattaacatatttacaaaaataattttttgtttcgaaaatttacaaatctaattgcctgccgcccttaagaagggcgatttttaaaaatcgccctctcaaagggcggcaagggacctaaatacaaaatttttatttgtgttcaaacccttcccaccggttttaattgcttaaaaactaataatgcttattcgatactccaaatgattttaaatggaaaagtgataaactacaaagttatagatctcatcaagatctacaactttatataaagtttatctccatccaatgtcgtttgaaatgtagatctgagattttttaaaatgtgttttatattttgtaacgaatatttggatatctaaaacatcttaaatgaaaaagttattaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgccctcccaaagggcggcaggcgattagatttgtaaattttcgaaacaacaaattatttttgtaaatattttaataaaaaaagtataaataaaaaaaattcgggaaactagcagcccagcagtccacgactacagcccaacatggcccaactgcttccacttctccccaagaccccaacgccattccattccattcgcatcccacggcacattgccgccacacactcttcttccacctcgcatatacgatagcagactataaatcagctataagctgatattaataagataagagagaaaaaaacagactacagacttatagccagctataacacggactctaaaacgttatgtgtatgagaaatgagaccatatgttaatatgttaatgatgtagtaccaatttagtaactactatataaatgggctattagattgactacatatgatttagagctagtagtttgctacactattaaatttgctctaaataatcgctagtcgtagtggttagatcgttgcacgccaacactcgtcaactcacccctcctcctgttgcgtgtgccatgccaacaccgcctaccgactatggcacacgtatgtgccatagtctacgcgtgtcagtctatcgtccacctttcaaatcgaaagcattggtgaaacctgatcgactcatgaacacacttatctacattataaatgagtccgtgggtcgatccacctgcacccttagcacgggggattgagctactctaccccgttgagctcaaggtccacgacttgctctcttcctatgagtaggtgaccggccaattgtttatcgtgcaaggcacaaccccctctcttccccacaccgctcgtctttgctcgccgcaccactcgtcgttgatcacgagctaaacaagccgaatgaagcaagcaaacaagttgaggtgtgccgtattttttagcttgttaggatgaagatgtgaggtagaataagccagactaagccgatatccctatacactattaataattgtccctcatatcgattctcacttccatcactttgtctcataattattttttttctaatacaatgaatattcaaatgtcatattagagttaaaaacatcgtatatttaaaaatgggggtaacactgtaagaaaatctcacattttcacaagtaagaacaaatatatttgaaacaaaaacaaaagtgcgtggaattatcgaaagccattacttattttaatttccaaatttaataagataaatatggccgtgatcgtcagtgttggctattgcaaccgttcatagttgcgcactccctccttccataaaaaaccaatctacggatgtgacacatcctaatactatgaatttgaatatatataggagttattaaaattcttattactaagatgtgtcacatcatagatttgtttttttatagaggaagtaagcttgtatttattttgaaatgctcattgctggaacaaggtttgttgagcatgtcctagttttggatatctgaactattggtaaactgatgagtatctgctaaagtggagtacttaaaaaacaaaatcacacattttaaaaaaataactggaaatattaatcgaaatgatgcaaagttttgaacttaacattaaatggactgttggcgagaatcttgcctagggttcttccggttaaccgacctgggttcgaaactttattccttttatttaaaaaaaaaatctacttaacggcgtcccgtagcggtgcggtagtcacgggacaaatttaatactccctctgtttcgttttatttgacgctgttgactttttagcatatgtttgaccgttcgtcttattcaaaaaaatttgtgaaatatgtaaaactatatgtatacataaaagtatatttaacaatgaatcaaatgatatgaaaaaaattaataaatatttaaattttttaaataaaacgagcggtcaaacatatgttaaaaagtcaacggtgtcaaataaaacgaaacggagggagtatgtccgaaacgttacgccactttccctttcctccacttatctgtcctcaacctttttcccctctactcacagctcgccagcgtccctccactcacagcttgccggcgtgcgccgccgctcccctcgcttcctccaccttcgcacgccggcgctgctgcgccgccgctcccctccattcctccgcctccccatgccggcgctgctgcgccgtcgctcccctccctccctccgcctcccccatgacgacggtgccgcaccgctgctcccatcccttcctccgattctgtccacaggtaccacttagcagcaaccccctctcatgcagcagactcaaaccataggtatgtgattcatcttaatttctaagtttcatttcctatgtcttctcgcatcccaacttttcaacttggctaattcagcttctatctacatttctgttctagggtctacatcaaagttcagtagattttctgattttttatagacgaggccaagggaagccgtgatgggggtggcaagaaaattatatcccgtgatggggtagtcgtatttgatacttgacctgttaaaattaacaggttggttactcctctcatgaaactttttgtttgtggttggaatctattttgtgacatcgagtagtctatatgaaacagacgagttacttgtttttgtgttattcatgcgtagatgagattgtacactgttaacacacatacatcgtgtttccagcaatttttactaggagtaatatctacttttatttttactaggtatcagctagattacagaaggacaataggttctgatggaattgtcgaaatctgccaccaatgtgttttgatttttctggttgatacaggggagggagatgagatgcataaactgcatcttgtcactgtttactagtactggttcaccaaaatttatctgacacaccaatatttttcccagtttacatggcactggggatactagtgtagtataaacatatattttgcacacaacatatacaactctgaagcattgcacaagaggaagctgttaaaatgaagcgataattgtacattatataactttatgtatcgataaatatatattttctggttgataccatgggaggagtggcatctactgattttttttaactaattttgtaacatgtatcactataatctgacattacagtaacaatgattgaaagcggactaattgtcatgttttcctttttttgtttttcgcacacagagtcgatatggctacatgttcagataattcagattctgtacattttgtgcctagtggtccaaggcgctcaccaagggtcaagaaatccaaccaatgtaatgctgaagagcaaaggaggaaatgtgcctcgaaaccttgtaccaagcttaaattcctaccagataaatcaaatgccatttgtggcaacaagaaaaggaagaagatggaaactgaaacgaaggtatcatatttttcaactgtcttctttctatttaagctttttttttactattcctattttcatctaatagtttgctgacaatactaaagaaaattaaattaggtttcagtgcacaatcagaagcaggtcattaccttcagctgctactcgagccgcatgtgcaaaatagcatctcaactttcacctgttcagactcagtttgtgcataatgcttgttttgagaatttactgtcaatgcaagtttgtagtatgtccaaaagcatgacaccgtggcttgtcaatacaatgagaaccaggccaactatgtagtggtaccatcattttttttgtttttaaccatgtgaatatgtgaacaaatgtcaccatgtaatggctactgccatgtcaccatgtgaaatacatcccagcttacctttcgtttgcagcactcaactttttttatgcatgtttgtgtggtacatttttttaaaaaaaatataccacgttttaaaccatgaaatcgaaatgtctataagtatccaggggctggtaccctaaagtgattttttcctcgcatttgaaaggtatcaagggaaaaccaaggtatcaggtctgaacccaactaccaaacatggtacctcacaacataggggtatcagccacacaaatataggtaccagggtctgaatataggtaccagggtctggtgcctggtagcaatccaggtaccaggtctggtacctggtagtacctggcactaggtaccaaaattggtaccggtatcaattctaaagccaggtaccagacatggtacctcacagtatagaggtatccgcctcacaaatataggtactaggtctggtacctcccagaaaacccaggtaccaggtcttaacccagacaccagaccttatacattacaatacattgtcgctataggtttcatgactggcaccacacagtacaggtattagcctcacagtacatctcacatcaaggtaccatgaccacctcaaaagtataagtatcaaacaaaattcaggtatcaggtacattttttctcggcaagtgcaaccacatttgacattttctgaccatacatcacaactgttcggaagctttcaatttagtatcaagcaacatggttcaccaatcagccaaaaagaggaattattacatgaacaagtctcatttagcaaatgtaaaaaaaaaatgaaatgttgtatttttccctcagtgctatctttctcccacaccccttagtgctatatttcttccacacccctgcaaaatgaatgatgaatcaatgaatttacccctcctcatgccgagctgaaacaaatgagaaaaaaaattataagagaccatcttttcacctcatatcaataggtctgggcgcttggtgacattgctttttttttctagcttgtgcgcttggagtagcaagcaatctcatatatgttgtactccttggtgacattggttttttgcataacgattgtagtaatcttgagcctatttttctgaaaagaactccgtaccaacatcagggactgcaggttgagattggaccccctcatcttcagtttctccatcttcatgtccaaactcatcttgtatttcaaactcatcacctgcatcaatttgatcaatgctcatggcacctgtaaacaacccagtttcaagcagtgcttccctcaacacatcatcatcatgacttgatacttgttccattgctctttcaacacaaacatcatccttgtcactatgttgctctttcatacttctttcactaaggacaacattcccctcatttgctacctcttccatcattcttccagcagatccaaccgaggaattcattctcttttctttcagccataaaaaactttttaactaaaattgcatgaataatccacacatttttctagttagtttttcaccccacacataacaagcagaacacaaaccattataccttgaaaaatagagataagctgatacctaactagagaaaaaaaatgatacctaaaaactagagaagctgataccctaaaaactacttgaatagatacctgagtgaggtacgcaaaaggaaatccggcgatggaggtcggcacctgagatggatttttgctgaggactactgcgactaggtgcacgcgctgttgccagcaaggtatcgcgcgcggaggcactggatttaggggaaggagcactcctgcttgttgtagttgaaggcgccgccggcgatgtatcgcgtgcagaggcgcgcgataccgagccgggttttggttgcgggaaggatccttctcgcgctctgcgccgggttctggctggtagttgctgcggcgctccgcgcccccgccgacgaggtatctacgcggaggcggcgagtaggggaatcgcgtgcacaacgttgggctcgatcagaaaaggaatcggtattaaatctgttgggtgctaattttatcccgtgactatcgtgcagtaacggaattccgtggggtagctgccctcttttatttaggctgtgtttagatccaagggtgtaaagttttggcgtgtcacatcggatatacggacacacatttaaagtattaaacgtagactaataaaaaaactaattacagaatccgacagtaaaccgcgagacgaatttattaagactaattaatctatcattagcaaatgtttattgtaccactacattgtcaaattatggagcaaaaaggctcaaaaaatttgtctcgcaaattagttgcaatctgtgcaattagttattttttaacccatatttaatacttcatatatgtgcttaaacgttcgatgtgacaataaaaaattttgggtgggatttaaacaggcccaacgttaaatgggccgttggttgtaaaagattggaaatagagagcggcgtccaatgcagtgactagccgttagggggaccagtctggcaacacgcaggccgtcccgttccgtttcgtttcccctgcccgagagagagagagagagagagatttcaaaattcgaattccctctgctcggctcgtccaaaaaaagcagacggcgtcagtgtggtcgtcggtcgcccccaccctctatataaagcgtcccaccccaactgccccaaccctaacactccactaacgcctcccgacgccgccgccgcctcctcctcttgtttcgccaccgccgccgccgcctacgaggaagaagaaagaagaggaaggagaagatgagggagatcctccacatccagggtgggcaatgcgggaaccagatcggcgccaagttctgggaggtggtgtgcgcggagcacgggatcgacgccaccgggcgctacgacggcgactccgacctgcagctggagcgcgtcaacgtgtactacaatgaggcctcctgcgggcgcttcgtcccgcgcgccgtgctcatggacctggagccgggcaccatggactccgtccgctccggcccctacggccacatcttccgcccggacaacttcgtcttcggccagtccggcgccggcaacaactgggccaagggacactacaccgagggcgccgagctcatcgacgccgtcctcgacgtcgtacgaaaggaggccgagaactgcgactgcctccaaggtaactagtaccctaactatctcagatctgcctctcctcaaatcaaatctgagttcaaatgctgctgctgctgcagggttccaggtttgccactcgcttggcggcggcacggggtccggcatgggcacgctcctcatctccaagatccgggaggagtaccccgaccggatgatgctcaccttctccgtcttcccctcgcccaaggtctccgacaccgtggtggagccctacaacgccaccctctccgtccaccagctcgtcgagaacgccgacgagtgcatggtgctcgacaacgaggccctctacgacatctgcttccgcaccctcaagctcaccaccccaagcttcggcgacctcaaccacctcatctccgccaccatgagcggcgtcacctgctgcctccgcttccccggccagctcaactccgacctccgcaagctcgccgtcaacctcatccccttccctcgcctccacttcttcatggtcggcttcgccccgctcacctcccgcggctcgcagcagtaccgcgccctcaccgtcccggagctcacccagcagatgtgggacgccaagaacatgatgtgcgccgccgacccccgccacggccgctacctcaccgcctccgccatgttccgcggcaagatgtccaccaaggaggtggacgagcagatgctcaacgtccagaacaagaactcctcctacttcgtcgagtggatccccaacaatgtcaagtccaccgtctgcgacatcccccccaccggcctcaagatggcctccaccttcatcggcaactccacctccatccaggagatgttccgccgcgtcagcgagcagttcaccgccatgttccgcaggaaggccttcttgcactggtacacgggcgagggcatggacgagatggagttcaccgaggctgagagcaacatgaacgacctcgtctccgagtaccagcagtaccaggacgccaccgccgacgacgagggtgaatacgaggatgaggaagaagaggctgatctccaggactaattactactctactgcaatatcaatgtccaatctaatggggttcggttcacttcttgtgttgcttaggctatcttctcaagtgttgtcgttcttaattattactcctagctgctactctactctacttgatgtattattattactcagctttgattgatgataggcacaataccctgttgccttgtactcgtaggagtatgtgctgttactgtctaactgatctgtatgaattatcatcctatttttgttaatctatcttctagtaaaatgcagagttgctgcttagagtactctacttggtgtcaactcaacttgtgtttgtttcattccagtgttgcagaatggctgttcatcagtggagagtgctttgtatgtttctttgatactcacacttctctgccactgaccactgggattgtacaggtgagagaactggcatcagggttgtttaacttgttggtatatgctgcttgttacagtacttgttgcaagtgcaaatgctgcattgaggttgaggtcgcctgttccttgtgtccaagactgcgtgtgtgcaagttagatgatgattccagtctgtgtgatcgatcatacagccacttgatcactagtattgtttacttctagtcaaagtaatttggattggctggatggtctgatcggatcttctattcctctgcaagttgaaacagttgatgatgaaaaaatgtttacacaagaggaggacaagccatgcttgcattgcacaccctgggatgcatatgccttgctcaagatctactactactatactacttttcctttttgtgaagtgaagggcaggcatgagggccagcattgcattagcattactgtcacagcttgccttgccggatcatattcatatgactgcatgtgcagcacagtcgatatgcaagttgcccttgcatttcttgggcctgtggatcaatatattcttgctcctgctcctgcagctgcacagttaaaccgtccatcaagctccagcttggagtcgcacaatacaagctgtcatatatgtttgtttgactggtcttatctcaagggattgagatccagtgcggttgctactatcactgcaactttagcagttgcaaggtagctgatggatcaaaaaccagcggctcagatcatcagaaaatactgttcacgaatcactgtagcaattttctactgtagcgtatactgtacagagggtggcagagcaaatccaagctgttggctgcatcgatccaacggtcataatatgctatcactgctaaagttgcagtagttattacaactgcattagatctcaattctatctggagattctaaagtgacacttgattaccttgttcttctttacggtgagccatgtgctcagcacgatcacttgtacagtagtagttgtgatacctagtcctagtttatgctgcatatttttttgagttgcatactttactagtgttttccttaggttatccaatgcgcctctggttactgtcttcaaggatcatccaggttatcaagattcttcattggtaaatgccattttagttttcctctctgcccacccgcctattaaaacattcatccgaatatgacgcgatttagagctctggaaaatgtgttctcactgatataaccaggtttgaagtcctgctttatggaaacaactagggccgagtttagttctaaaatttttcttcaaacttttaacttttccatcacatcaaaactttcctacatacacaaactttcaacttttccgccatatcgttccaattttaaccaatctttcaattttggcgtgaactaaacacaccctaggttgagtagttgtacgtgagtcacacaattgggtcatatgcaatgtaattttcttgttcgagaggtcccataaatagggaagaagagtactctgctcacctgaaaacctgcctgtcttatggtgatacaccatcagcattcaaccatatttacatgttcggatagtcggatacccacatccatccatcagttggccaaggccaagccaaatcccacacttctgcttcggcttgtatgtactactagtagcttaacttcacctttgcaatcctccactgcttttcacctttccttcctgtgcagttcaatcggcgcaagcgagcatgtttcagttcacaagacaggatagagagttgagaactgttttgatctggctttctagacggttttgcctgccacaagctatacactggcattcactgaaactgcaagatagtattagtatctcttaaccccacaaactagcctgattcttcaatcaatgggctgctcaaagtcgacagcgccggtcactggagcggcccatctatttcctatcaactttgccgttgcctgcgtacatcccgttggatatgtattggccaggttcatcccattttctgaaaaaaaaaagggatcaactttgccgcaatggcatgtgtgtccagaaggtagaaaccagccatatgaagtactacttgcgagcaaacacctggctgcatttgcaacccattatatttctgcgtggagtacaaaaattgcatctctccctgctgattggtagtacaaaattgaacaggctcgaaaataacaacgaatatctcttgttagttgtaactcccatcttacaccatgtaacttcaaaggcacgatgccaccttttgaagcatggatagcatcatgaggttagcaatacatatttacacatgagacatttgcaaaatgtaaaccacatatagaaagccgagcaaattccttctgagatcagtttactgtaaccagctgtaccttgccaatcttattgtgatattttcaagttcccaccaaacctgccagccacatcatgtaaggtcaagattcagctcaagagcacacaccctttggcttcactcaaaattaccagttcatcagagcaccattagcactgaagctatatgcccgccgcccacatgaatttcaacaatgaaaatccaagagtacaatgttccatctataaagaactgcttttcaactaagccacaaagtcacgactacttgatggttcacgaaatctgagctatctgatgcattttctctaaaaatatgtcaaacatctcttccattgagttaaattacctacaaggatgctaagttaagcatcccgagtgagggcttgacatcaacctcacttgattcatgtcgatccaatgatgctaagttaagcatcccgagtgagggcttaacatcaacctcacttgattcatgttgatccactgcagtgtaagatacatatcctggattgacatgctcactagacagagtgctgccattcctgatggtagactgggaattagggtaaggtgcaatgatcttaggtgtcctgtttggccagtatacatcgctgtaaaagcttgcaacaactacctggaagagtataaaaatgtatgtgaattgtggcctgttgttaccatgatatgtggtactaaaaactgattgagcatatccctgtctcaaaaatttgaagatacctggacaggtgttgcagctttgagaggtccagtgataacaccaccaatcacagaactatcgccagaagcaagggttacacgcaagcatccttggtcatttggtgtcaaaatggatccgaacaaacgaattatttccaaaggaccctgcaaaaattgaatgagagttttggtatcaactttgtcacagtaacttagctaaataagcaacaacgttattcgtttgattggttacagattatttaattttaagtttgatgttgtacttatgtaactctgtaactttatctgtttgcttttataaaagtaactgacctggcagtaagtttaataatacaaaaagctcaatttgaggaaaaacatccttctacatttgcggttttttattttagtttggaacacatgccagcaattccacccctgcacatggatgggatcaaattcaaggccgccatctcaaacactggcactcctacattccaccctttgagttaatccaggccaagaactggaatgccccctcaccgcttcgataattatttaaaaatcacttgaacatacacttgacatttatatatttggaatactatgttatctaaatggggggagggggagtgttaaactttgagcagtgtttccctccccatatgccatatggaaataaaagctgaaccttgtgatatgaagtaacaccggatgataggagcagagttgcttcctgaacagctccaagcactgaaagaacacagatcaccctcccatttgactttgacagtgccgtaatcttcggtatgatttcctgcatggtcatttcagaagaataaaatcgcttgccacattttgattagagaaaacatagtaagtagccatacatcatctgcaccaaaagaagcattatgcatacaccactctgccttttttatgatcagttctgcagttgcatatttgagaaaactataaacaaaaaaaaaatctcttcttggagcggcatgaaaaatgttgtgaaagtttgcatatggatcttttagcaaagaatgtggtgggcagaaacactaaaagaagttttctattttctgcttcagtgaattttctacagatatgggtcgatttggtggtggacaaaatccacacttttttgcaggatatgtagagctattcccaatctgttgaaaccatgtttttgtgacatccctatcgaattgcagttaaggtttgaaacaccggttttcactgaaattatcaatcatatctaaatacgaaatcaaatgtaatttagaaggcagtcaccgggtgtatttgtagtacgttgatcctaatcctagtcggtgatccttaattcctaagctgtgggtcgttgagcgagcaaaaagagggggccaaccatgaacagcagcggtagcagaggcacatcacaatctatatagcagagagagagaaatagatacctctcctgcatcaatttggagaaggtggggctggaggccaccgaattgcccctgccctgtccacaccacacaagaagcaaaaaaatcagcacatgcacaagtgaagagttagagttggaaagtacgggattgagcaccgtgaggcgcaggcagcgtggggggttgaggttgcggtggcggtggcggcggcagcggggcgaagaagcccggcggcgcagtgaggcggtcgcagttgcggggacgaccccggcgtcgcttctcgggtggtggtaggaggggcggtaggagcgagggaggaacggcggggaggggaggcggaggcggatcggagagctgcggcggcggggcgaggcgggttttcatggccaacacaaagggcgacgggccccgcaggttgcggtaggcggtcgactcgtccattgccttcgcccttcgcccccccggtcggtcggaaccctagctcactgcggcggcggcggcggcgatggtgaggtgaaaaatgaaatgaaatgtggcagcagatgggaaggaagggctgcgctcatttcctttcccattttgtttgggaactccattttgtactggactgagttagtgactggatcactataattataattatattttaattaattaattaccaccagttgcttgctgctacagcacctaccttttgctactgctgcttcttctgggcaaaaccagcatcatcactagttttagtgcagtaccagtactaagattttattttaacctgacaaatataaaaagaaagaggactactggttacaaagaaagaatgcattcatcacttcacttcactgaggatgaagaggaggagcaactagtgtgaagaccagtccgaagcaaaaaaacgatttattagtacttaattaattaaagtgttcgaaacaacacactatttagaatccggggaacatgctcatagaagagagccctatatgttaatggagcataagcataactagataaaagcgtagataaatgcaaaacaagttgagattcgagtggagcctaagcataacacacaggaatgttccttcaacaactaaagattgtgccagctttggtttaacgccaaattcaattcatgatgaaccagaaataacccctcgcaatgtagaggccaggctttaatttcttttttttaaaaaaaaaaaggaaaaaacacttcactgacggccaaggtccattatctttctcagaatgatgctgcagcatatgcattgagcacccaaaaccacaatctcccaactcctagtctctaccattttctcctgtacgtcctaaatttggaaccagaattacaatacgccattggtatactgtccagttcttcctcaccaaccattcaatcagaacctcctctttccaaaaacaagcatagcctcccccattcatcacaaaatatataaagaaaatggaacatgcactattagcccgataagagtaaaacagaaacatctagtagtacggactagtagtgtctttctacttaaaaagcctaaaatttgcacttgcagtcaacccataggattctgcaatgcaacaaacataaatgaacagccaagatcctgacaaaaagttcagcactgacttaactcgtagctagtgtggcctaatgccctaatccatccatccccaccaccaccatttgatcggagtatccattgatgcaccaagctcaaactcaagaattataatatgttggctacttagtagtacacaaacaaaaccagcactatacataattggcactggcacatcattccacaatgcctaaagagtactccactccactagattactccataaaactgccagttccaacgcgcttcatcagttcaaaacttcaaaatgcaatggcatctgcaacgacaatatagcattcaaaactgcaatgcacaatcacaacaaactccaaagatgaaagcaggctaaaattttcaagtggccagctgtttccctttatttatgtcctctctcatggaacctgccattgccctctactactaactacagaattccttccttctatctggcaattcaacaatgatatattgccttgctactgatctgctaaaagctacaaagagataagaaaaaaccctacacgcaccttccatctttatgaacagcataaaagtgcttcttttatcacaacaaaaaatatggacatgaaacccaaatatgactcataatgttgcacaccatgaccatgagaacacagttgttcacaatacctacactcttcccatgggagagaagggtgggtcgagcacaactggtctgggtggcttctcacttctcttctttgttttcctcttctcttctgccgtgactgcctcgatcagctggctcacttcctcctcgagcagcatcttaagtgaactggagtagagcttgtgcttgcccttctcaatacttacggctgtcgaagcttccgaacagtgcagcagagaaatgcaggttgagaaggcttgcattgctgataaccgcgcgtgaaaatgcaccaataactgtcctttctcgttgcccttaatggaaagggcagggagctcttctttgccaccctgttcgaagaatatgacaacttgttcatttttggactaagatcaatacatggatgaaaacagagatgaatcgtcgatatactgaataagcctagatacgtcactgacaatggttttaagggtcaaatgtctgtcttgtttccttgatcttcaaaataagcctcaaggctatcgattttcttcctataaactcataggcattactaaagcgagccatatggttaacatatatgattttatagctcacaacgaaaacaaaagattactacactaaagaaaaagtgggtctaagggcagttctctaggaggagcaaatctaacacttggaaaatttgatcaatctttcttaaaagaagttctcgatcagccttgggttatctttggagagttagcaggaaggcaaccaagtatcttagaaaccagagcatgcatagcccaaagtgatttcacacaaaaaataaagataggagaagtgaagtgtaccagaacaaagagttccataggattctcgccttcctttgtgacagaattggcccagttattatcatatgcattgccaaggacagcaatgggacaagccatgtcccatccaccgcagtcgcagcctccaccgtacctccatctatccagcaaaggtgatggactggtttcatcatcgtttggtaacccatgcagcccactcggtgtaatcacttttacagtaccaggtgacaaaccactcttaagttctttggacttgcttctattaaatggaacttggatgaccgttgctgcaatctccaaatgaggataaagatcttcttcagaccacggacaagatgttgatacatcagagttatttcttgcactgttttgctggtccatcagattaatcctctggggacagtcaccagaggctgatttctcgacggcacttgacaatgtcgattgagtagtctctgtacattgagttttctcctcagcagaaaagctctgtcttgcatgagcgatatcatacaaaacaaactcagtgatgacagagttagtcagaacaccatcttttccaacttcagagcacaagtacgaagaagcttgcatctggcctacaatcggcggtgaacaccaacgtccatctttggaggcccttccagtagcacttgctcgttttccaccactgtggaaagtgtaaatccagttcaagtcattccctgttttccaactcctagcagaaatggattcttcagggcccttgacacagaactcaaaaactggaataccattcttggtatccaatttaagaaccgcctgaagatgagcaggtgatagagcattagttgtatgctgcctttctccattcagctggcaattaattgattggctttgttcactccttgataaatcactcagcaatgatttgcgggatacacaatttttcctgttaaccggcatagtaacatggttggagtcttccatgagagatggacttctaatagatttggacttcataatagggtccagaatcttcttgaaggggcttgatcgaactttagtgctgttctctatgccatgacgaacactttctgatggacgggtgccatcagagatgctcaccttggccgacatggactcaggcaaactgtttgttgaattcctctctctctgactacaattattctcactgggacatacactgatcttgttttgcaggcagtttgcttctgtacctttacttgactctccacctatcaactgaggagctgcatttctgcagggacctttggtcatctcttcctcaagtgagatctccaagaaaccatcgcctgcatcatttttcaacagggtgcaatccatgcgtggacggtccagcctacaattctcatcaggaagctcacggaatgaaagatccaggaagtccctcgatgctcgatgaattctacgagattccacagaagacttagcttctgagcggcgattctgatgcgagaaaaggtaagctccacttgtgctaggctgggaggatgaatcaacaatctcaaatgacagaaatgcatccccgtcaagtgcagaatctattttcttcctcctgccttcgtggagttttcttatcatgctaatttcactagagctctggtacatagaaccacgctttcccacaatactatcctccgcattggtcttgcggcttcttgtgggcaagctcttgcagtggaaatttgggatgctctctacgcgtagctctcccaggttgccatctgagcatttcaactggtggtgtcttgtgtcccgatagccattttctccgatggtgcggcgaggggatcgcatgatttcaggagctgctcctgaccgagaacggctgtcgcatttggaggcaacatcttgcctcattgctgaaacctaacatgtggacacaaggtgaaagattaagctccacaatttgtactagtcgaacagaataaatggaacgaaatgcactgcaactagatgaacaaaaggacgcaaatggtgttaaatcctctaaaatcctgacctcacaagaagaaacataagtcaggtatgtgcatcttaagtcaaaaagaagaggagaatgggaaaaagaaaaagaaaaggcgatctgaattggggaaaaaaatagatgagaagcacatgtcacatcgctttgttctcgtgggaggcaaaagagaataccataccaacaaagggaaaggaaaagcgaactaagaagatgatgagcccctaccaactctagatgcttccattctatatgctccagataggaaatttttatatctccgttcagaataacaaacgaggcaaatggataacagatctcaagaaacaaacaagagaaatagttggcaacctaaaatggtgaaaattgaacaagacacctaaaagcaaggggttttggttgttgaggcaaactggagaaattattcagccggaaatgaagaatcttttgtttctgcaacaagcgaagattcttcgccgtagacgaactagccacattcattcagcccgaaaaaatcgcatcttaagataccgaaacagtagcattaccgcatcagccgccaacccaaggtgaatccaaaggtaggatcaagaagatgaacttacctttacctgcagggcggaagtcggctggaagcggagagggtgagagagagtgggagatcaagaggctttttcccaggaagtggaaggggagcaagaggaggaggaggaggacattgaattgggggagcaggaggttccctcacactcaatactcctccactaaaatgctcttggcggctacttgtatcatcactaatctaatgtatgcatgcttgtctctcactctttcttgcttgtgttgtgtgcgcttttggtcgaggaggaagccaaagcgaaatgagggagaactggagaagggacaggcaactaaagaggaaaagactagtactagtaggagtaaattataataacaatagtagtaaataataataaacagtaaaaaagtagtcgtaggtggcggtaggggttaattaggtcctaatcccctactgtctcgagggatctctacctcccgctgctaatctattagtactaatcatcattaatcaaatgcgttctctgttcttggccttgccactcgcagcacgtatttaccctgttttttttgagtgattgtgaggatgagagtaaggtaattggggtgatttaccatgtaattctccattacaagatacaaaaacttttagattttgaatatacagtactaattcttaccaatttttttatatctctattcataatcacatatgttgaaggctaaaatttattatattttagagtaggtataatagcaggttataagccagctgcaaacatattttaagaagataaataaggagagagaagagcagcgagttatagatttgtagccagctgtagcacggactccaaggcgcggtatgtgtatgactggcgggaccaggtattaatagtgtagtatgtaactattgtatggataagctattagattggctatagatgaattagagctagtagttggctatactattaaacttgctcttaggggctcatcttttcgcttatacttatcagccaaaatataatttttcaacattaaatttggagctgattctgaggtttttcatcgaaatttatttttcaatctttgtttttaaatcaataagaacatgtatataaaagttctttttataaattatttttcgtttgtaaatatgccatttcgcaaataagggaagcgatggctctgttagaatgaagcgacggagggagtagtgtttgaatggtcatttgaagcaatctgaatcatttactgcctccgtccccaaatataacaacttgtagccattaggatttgttccaaaatataacaacttctccaccaacattcttttcccaaccaatcacaaccctccaccattcactttttccacctaccttcactattcatcccatcacaaccctccaccacttacttctacctactatcttaataaccgtgtccaactctaaaacttcttatattttgggacggagggagtaccattttaccccgcatgccctgttggagtaatgggttgccgacgcgacaacgagggagaagatgaaggaagggaccgctactgagggtgtgttcgctgctgatggatgggaacctatcacccaagcacggaaaaaggagtagttcattagcgcgtgattaattaattattatctaattttttttcaaaaatggatcaatatgattttttaagcaactttcatatagtaactttttataaaaacgcaccgtttagcagtttcaaaaacatacgcgcgaaatacgatggagaagggttggaaacccttggtaccgaacacaccctcgttgttggttgccttcccttcattcatcttctccttgttggtcgctacagtgcggtgccgggccccgggtcgaaatgaatggggttgccatatgacatattgacatgcatgctttgtgtagtcctgttggttgcaacttcaaacttgatggctcacgtacccatcaccaacaataataataatgctgggcctaactaaggttagttataagtactactactactactccagttcagatggaaatgaggaaatctccatctcttttgtcaataataatactgggcctaactaagctcaccagcaaggttctgtctgtcagactctgtttgccaacacaacatcagcaccagcatagtactacaagtactagtacttaattaaactgaacagggtaagggtaatggcatggcaggtgtcctatacttctaatactcctgctggcttctatactttcttctgctcatctgtctcttgctgatgtactcctactacgagtccaatcttttcactactggagtagtagctgcatcaaacaaacaaaggaacgccgtgaccaccccgacagcgatgatcgattcacattcagggcgccactgcttacgtttcgttacctaaattttggtcactacaccacgtcgggttgccaatcatttctctccccttttcccctgcatcaccacacatctctaattattaggcctgcctgcctgcctgcccgcctaatcttcttgttactaggagtaagtaatgaaaaccatcttgtccatcagtgattatagtattattatcagaagatctgtcatgttgttgtcgttgtttagcgttggcaacctgctctctttcatgaaaaagatgcagtgctataagcatcgagagcctagggcagtagcagtacgctaccaaattttgccaaacctcatataccacctagataaaaaaaaagagtaaatttcactttggtctagttcttttgatccaagtttcacaaagaaccagggctaacacaaagttttcacttaacaccatatgtttttgcatttgattgcactttggactaggctagcaatttgaactggcccatctacacaagcaggcagaactgcagctgctagccatcttcttgccttggttgtgcgctgtcgtcgcctccgccaaagccaagccacagccatcgccaaggctacggtacctcaacccagccaccacatcacgtccttgttggatcaatgacccagctaccaccatcaacatctctttgtctggatccaacgtctccacgtccgcgacccattcaagaccgtcgccgatctctctgttctgtgaccggtgaccccaacaatctccaagcacattcttgtcgtccgagatcattgcttctcccacttgccgcaccttctcggctgtgatgcacgtgcagagctcacccacatccttgttacttggcggtggccggatcagcaatgctggtgcccaagaagagaggttgttgcctgctaacgtggatgggccacagccaacatcctatcccaaatcaccaacccctagtccaaagtgcaatctagtgcaaaattatatggtgttaagtgaaaacctaatgttaggcctggtccattgtgaaactctggtaaaaagaactggtccaaagcgaaatttactcttaaaaaaatggtgttagatacatgctctattggagatcctaccaatctctctcctccactctctctcatctctatgttttccctgatagaggaagcgaggcaactcgttcggcgagcccgagcggagcggtgatggtgccagcgtcgggaagggctccacctctcctcctccaaccggcggccttcatcccttggcaggttcggtggctagtgggagcagggcatagcacaaacaggagctcggcgacatgcgaacggggggcggatttggtggtgcggccctctccatcaagctgccgctgctatggtctgaggtggaatggaacaacgatgaaaacaaggttagttgccagatctattgcgccctatgccaccatcgcttcctcgtcgagctcgctagatctggcctcgggtttgtcggatctggcgaacgacatcgctttgggggcaacaaagatgctcagggtggtagcttcattaacgaccgccaggccttgcacggggtgtgggggtgtcgcacggggccataccctctcccaacgcgccactcacatcgcgccttaccccacacctaccaaattctgacaaagaatgcttagcttagtttggctctgtggtctttagttggaaaacagcagacgtgtgcgtggcgacagatctacgacattgatggtcaaggctgaatgccacctccgcgcactgtgaacacccttacactatctccatcaatttgtacaaccatgtccaaaatataactacctcttatagatgttttggattttaaatagatttatgcatatatatggtttatatatgtgtgttcatatttatatatacggtagtacggtggggtaaaaagaccaaaacatcttataatatgaaatgaagatcttataatataaaatggagagagtacctaataaataatatctcatcatgtatgagatagctaatccctccgtttcaggttataagatgtcttgactttgatcaaagtcaaactgctttaactttgatcaagtttatagaaaaaagtagtaacattatcagcccaagacaaatttattatgaaaatatattcaattattgaattgatggcactaatttagtattataaatattactatattttcctataaacttagtcaaacttaaaacagtttgactttaaccaaagtcaaaatgtcttataacctaaatcggagggagtatattttaggaccataaaagaggaaggactaaacgacaactctcttcatgtcaaagcccttccaccagctactgtattctgtttggcaataacaacataacagtacgtaatgtcaaatctttacatacgggctgatacggctcgtcaaaatcttttctacatatatacacacatctaggaactattcaccatatctctctacatccgtaacacgcatgcttcctccagcaaactaggctacgtaaggtcaccgcatctgatcgcttaatcaattttacattggatgatgaaatcctagctctcgtactggagtacatccatgtaccaaaatggacctgcgaatgggatggcaaatatgcagccagggtacatatgcacaccatcgatttataccttgcttgatattgaaccaacaaggcctttattgctttgcaatgacatgtactagtatagccttcataattccgcacctttgctcaatcaatttttgcttgttcgcttttggagctaggccacccgttgtctgaacatcgcatgctgccactgtcttggtcctttgtcttggcggctagtcgattgtgaaccaaattttgcaccgacatcacatcctgcgtgctgtcatggagctgcttgcacagctcgtctagagctagcatggggaatggctcctcaataagaacaccaacctgaaatgtgagtatgtgctactgggttagtggtagtacaatacaggtagggaatggggaaatgggaacagctgctgaagcaagattatcaagtttctggtgaaacacaatgaagaaaaacagactacattctttaagaatcctctcctctcaagcatcaaagctaaacaagtaccctaaacattttgacacaataaagtagtaagaaacatattcactaagatctcgtgtggttgaagacaagcagaggttggctaattgctgagcaatatacactgagtttcccaaaattaggacaacccgattctcaaccacctgcagctgcctttccatgttactccaaagacaaaccacatatgtgtagttatgactaattttagactgataaaaagacgagcataagcaaaaccaggcaagactatattgataaatgcatcctaaaaccacactaaaactaatcctgtaaccaggttctagaaggggcagccatcactgttttgaaatgcaccaatgtcttcaaaaccatggccaattgctgcctgcagctggtagctaccaaggcacaattttgaacagttttaaatggaagcacaacttggggttgaaaaataagttgagacttacttcctcaatgcagaatagagaggcagcactgataaaagtagctggaacgactatccatttacattcatcccagagtatcactggaagcgtgagatgccacagaacaagaaatctggaagtgagtctagtgtatgagagaggaataggaatcccaatgagctgctcacaaacactaattccttcaagaaaacaagatagtttagactcctacaatcaagaaaagtaaacagcattagattgtaccattatggattactagacttgaagtaagtctagcgtttgcagatcaacgggtggtaactctcacaagacaatgaagataacaataagtaaatacacctaaagtaagattgaacattggatcaatgcacaatggatggtatcagtggcccaagacaaaaaaaaaatgatgttgagttatgttacaggtaattggcaagacaagaaatctgcaggtagagatagaagagttaccaacttaccatgatattccgcttattttcatcgaaatccaacatatagaggctctgtgaaatgaactcaataatacagcgaggacgatgttttgatctgagaacaacattcaagtcatcttctgagagcaaaccctgaaggtccctttttatgtccgaatggcagattatatgacactgaggcaagaacacgaatgatatcatcagttgccgcgctagtgagtgaaagctaactaaatcaggcataattgcatgaaaacaaacgctggtctatgttttcagagactagtgaaaggtaactgcatgaaatataatttcagagagtgaagttaccaaattgaatcactggtagtatacagtagaaaaataaataaataaatacagaattaaatatataaaaaaaaaacatatgcaagagcaaaaccttgagcgcgagcgggaaggcgagaatgtagttgaggagggcgcgcgtggcaggggggttgtggtggcgcatggccatcccggcgaggtcggcggcggcggcgatgacgcgcatccatgccttgcgtccctcgtcgaagcgggcgtaggaggcctcggtgcggaagacgaggaggagggcgagggcgggggcggtgagctggtaggggagggaggaggcggtgagggcgtaggcggggaggagggtgttgtaggtggcaatggcggcggcgaaggcggtgaaggcggaaacggggggcgcgagggagaggatgacgcgggaggtgagggaggagaggaggtggcgcaggtggcggcgggagctgcggtgctcccgccagtcggcgtgggtgtagagcgggcggcggtcgcggatgcggcgctcggagacggcgtcggcccagtcgggcacggcggagaggagggagaggagcgggttggtgttgctgttggtgtcgggggctttgggcgggtcgcggaagcagcgggcgacgtgggtggtggttggcttgggcggttgccggtggatggagggtatgggcctgggcggcgccgccatggccggcctcctcggcgtcggcgaaagacggcggcgcgcgcggtggttggtcaagccattaattggcgtttggtttgtggcggaggaacggatggggctttcgccaatttgccttcctttttcttcttttaccggagccatctggatgactgacacgtggaggcactttccagggcacatgtaacaagcgattgtttcgcttttttagacccaacaaaaaattaaagacgtaatacaagtttaaaaagaaaacactattatttctttttttggtctagttttggtacattagtaatacagaaaattcgagatcccatcccacactagctgatttttatatattcttcgttcattcgtcccttttctggcaatcatatactcccaaatcatattttctatcttttcaaataaattggatataaagaaaagcttcaactcaaggattttccgacgtgccagagaagatataacattacaaatatctcaagtactgtccttccgttgataattttagtatcagtttttgcacgagtttgtttcatacaaaagtttgaacaaaatatggctgaaatagccatcacaaatgcatatgaatcatagcataggcgcatacatataagtctataccagagaaagtctcatgaaatccataagatgcaacttaacgtatgactatatacatgttccttcaacaatttagacctacctatatgtatgtaggtctttttatcctcagattactgacaaaacgtgagatattttttttaagaaaaattagtttcaggtttggggaattccaaatcaccctttttgaggctttttttttaggaaagtaagtttaagattttccgcagctacagctacaacagttgcgtgatttggaaaatggggaattccacagggtttctgagacattcgtcgccgccgcgcgcattggcgaggcggagagagagtgagagtgaggaggagtttgggtgatctctcccccgtcgctagggcattcgcttcctccctccttaagcacgcacggtgagtcgatcgctcctcttctactcgcagtccgatttccgtttgatatttcgattcgatgcgacagttatctgggcgtctaaactaatcgaacgaccccaacgcgtgggagattccaagcagcttgatttgtttggtccctccctgtggatcttgttgtatcgcactgcccaataaacattatctgtcacggttttacatcatgcgattagctgtgttgccatcctttcatgtgtctattttcaggtatatgtatttttctgctccacatatacttcaggatttgttttttaattacccttgtttttatacatcaggagttcaggactatgtagtaccagtggtaatactagtaatcataactcaagaaccctgtaggccatgttcggttaatccccatgagaaaaggattggaggggatttgttccacacctattgtagaatggaattattcactctcaatcccctccaatcctcttcaatcccttccgaaccgaacaaggccttagtgtcagaatcttctcttctttgccaactcctatttacatcttctttgccaactcctatttacatgatcatttcagccaagctgtccattatctaatatttagtcagcaaaatcaaaacaagttaggaacagagtatagaacatttatcagcacaccaattggggtagtcagctcaacagttcaactgacatcactttgatgcgtaagatcatatgctgaatattgatgaactttatgttggtcagataaacaagcaataaatttttggcacctaactatcttcaagaacaccactttgtttattttgtctgtagtgcagtagtcttttaaaaggataaaaataaagtctaagcttaaactcttagcaccagtgttttctggggcacatttctgggacaatcagtaactcgaattacaaagatatcctagtggatcaggatgattcaaagaccagaagtaaaattgtatacctgcattcgccatatgtcaatctatcactatggttgctcaagcaggaaaaaaaaactaagttccatctgaaatatcacattctttcattctttgattagttatatatgctaagaggacacatgcgcgcctttctgaaaacgtatccttcgatttttcacacacaactgtacactgttacacacttatacacacaataacaagaattcacacaaggattggaaggacaacataagattctttagtcagctgcataatattgtacagaactatcaccttccaactctgttaaatctatctgcagtgcatggatgaggagtctgtggcattatgcatttatgctgcactggcatctttcagtgtcaggaagatcctactgttcttaggctcccaagatgtatcaatcaaactaacaagcagtaaaatcacacaatacttgtctggtccactggtcctcttgattctgtcatgcggacagcttactgtcatcaacataacttctacttatgagtcatgactctacccattctatatccattctacaaatagcagagaaaaataccagcagtgactaaattgaagcttcaaatcaacaaatcattagcgacctcttctaatagttcatctagtatgaactcccatgtatcaacaataatctcttcactttccaattgaagattcatccaagtgccatcttccagatctatgttaactagctggttcaatgttcttggaaattgattatggagatgtctctcgatatgcttatttatttcttggatgaggttctctcccattggaggtggctgtatcttgtgcatgagaaaagataagcaaggagggtttctaaaatatgtctcctggattattgttatagcttcacagatacaatcaaaagggagctttagatcatctgtttgattgccttggtgtagttcttcaatcatgcaagggctgatcaattcatcttctagataccacacctctagattttggtatgtgcatagttctgatagctccagcattgcctttatgtaacttagcctggcatcctcgtcctcccagaagacccattggtctgatatagcatctggtatgtggggcctcatcatatcttgatgcatctcacctgtggataattgcaagaccaaaatacatcacctttagattagaacacatattttcttaaggtcaaaaggaaatgtaattttgatatgtttagatgagaagatacattttatcatagtttcatggtcaggactgtcaacatcttcacagaagaatggatcaaggacagatacagggctgggttgctcttgcttttcgtggttcccttcgggtgaaatttgtgatataagttcaagtgatgcacttgatctgggagtttttggctcttggtgttctaggctctcaaccacattctcaggatagctcagcaacatccctgcatgctctctgccaggttcggctccttcaatcagttcctgcagtgtagataaacacattataactcaaaacaacaatggagaccagatggaatatcactaagtattggtgtgaacatactagtgatgaggtacatgtacactgctcttttagggtgatcccttcactgcaaatcgtttcggagcaagccggcttgtcgatttcttcaatatgcataatgtcacctgcaaatattcctttgtgcttagagaagagccacgtaatatttgataattttaatgactatggtattatgtactcaccatcttgtgcagtttcttgtttcatggagtgtctatcctgatcagccttaccatctagtacttcactattaccacatgcaacactccctgaatcttcgtcagacagatctctttcttttgcatattctgtcctctcatcctgttgaatggcagaaatatttatctcttcgggtgaaaggtcaatgcggccttttaacctggggctactcctaggtgatgatgcgttgcgttgagggagggaaagcattcctatcaaggactttgaggtatgaactgttggatgcttggttgtatgactgttatactctagaatgtctgtcagatgtttcttcgcctcttcatagaagatggatgtatcctttgatgtaattatgtctccgttaatttcacctagtccatcattcctttgcttttgcttaccactggtcaaaggtctcaaattgtccttatctgactgtttagaatcctttctgactttaaagactgaatcattgatcctttgtgaatctctttgtaaatcatcttcatacactgatggtcttcctcttctagtatcaccagtcacaattttgaatctcctcctgacttccttaattgaaaatttagaactctctgttgcagggtattttggagattgaattgtgcatgattgctgatctaaacatgtagaggctgtagctacagtagtatcgatccctcttggatttggctttagtataactattttgttaaccatcttactactattagttccttctgatgtacccttcataattgatttatctttcctccagaaaaagatattcctgccctctttactatgtgttttgatggctacctcgtgctgttttgaattcttagtattttcacctttttcaagaattttccttggctctaacttggtcactacctgtctgttttgattattttgggtgttctccttctccaaagtatgcggactcggtttctgaagtgtcttcaagaaaagttccttctctgggcttagcatatctggtgcatctactagtttgttagattgataagatctgctgttacaaatatatttttcatagaaatgctccctttgcccccagtctggagattcctcataagcacgttgacagggcacactcttcaactcactaagctttgtatggatatgtgacttcaattctggacacagttcactcttatttttgcaatcatcatggtacccatagagttctcccacaaaatctgctaaagaaagttcaagatcatcttcttctgcctgtttcatggatttggaaccacttggatccagcaaaccagacggagaagccatggctgtgcttgtgctgtgacttttggctctgttttgtttggtgctctgcattgaacttttttccagacagacatcatgtcccaggtcagctaatattctttgaacctcttccttgggaatctttttcacctgttttaccttacccagctcgtcctccatgagtcttttgacggtttgtttccttgtgtcgcattcctctatgttctgagaaatataagaacaatacacttattccaagaagtaatctttaacatgcatcaaaagaaataggtagtactgtctacatgataaacataagcttgatggaaagctatatcagttaaaactatttgatgtttaccatgccaacatacacttgaagcaaatctggttttagaactcacccaacagattacaatgtaaagattgctagtactgtctactcaaattttttcttctctgctggttaatgcagaatgcttgaatcaagtccctttcatcaaagaaggaataatggttgctaaatccaagcctacacatgataagtaggcaaaaagaagtatatgtgggatcattttgtcatgcttttttttttaagtttattgttccacaacttgcattaagctaaactttcccgtgcatgttttcgaagcagtaccaagttcatatgttgcatttggattttggacgacttcttttctccatacttgctctagatatgttctggctctgaagaaaacacttagcatgaaggaattgactgccattaacatcaatatggcactttcagttccattcatcaaaattattttgttacacaagtaactgaatagtcaagtatggttaggatcactagacttctgttgcatattcgtggtgttaacaaaagcagacaacagcaaccaccagcatgagcatctatgctttttaccattaaaattacatacttactaaaataacttacatcctccccatattcatctgtttcttcaaagtccctggatttctttcttgagtgcctcctacctgcgaccatgcagagttgtaagaagatatacaaattatgataactaaatatttttcttgaatgccttcatatttgccagatgattccgaaatgtagattagagggatttattgacagtctatgacatcagaaaaatgtttactgaaggtcaaatatcatagattgattgtattgccatgcaggtgctgcattacttatattgctgcacatagttgacacaatttcacaaactgcttagtaatggtaatcaaacaaacgagaagcaaaattgtcgactttcatatttactgacagtaatcagtttttttttctggagataataataagaatgctttacatattctgttttcagtctcttgtatagcagatgaccacaatgcatattaaatttcaaaaccatatcctcagagttctaccagcaaagtaagtggctcagatcatgatcacgatcctatttgcattgtcatcatgttcatcaggtattacattttactttaaccatgaacctggagagaattacctgaaagcccaccgaaagtgtgccttctgcttccttgcttcctgtccaacagaaacttagcgtcacgtcggaaatagagcatgccgatgaggccccacatgcagcctatgttctcctgacgcctagccagtctttgacttctcttccccatgttagttggcttgttcctctacactttgcaattgaaatatgcctgatgttctctgcagtttagttcattgagctaatcctcttgcagcaggtttggttcctgagagaaactctgcagttagctgatgaacacttaggattcatcccgatgaaccatgcaagccaagaatgaaagaacaaaagaaatgagattttgcaggagcaagagaagatgaaatgcagcaaactggcagcataaaaccaacaggttccagtgttctgttattaatttgtgtactgtcaaaaccaagcaaaattatcaaaggaagatatgctaaaaactcctcaaatccacagatattgcttcatgcgaaacttacgtgataaccgagagatcgcagggaacttcaccactctgaagtctgaaccaagaaaccagatgaagacgagcattaaaattcttcaggacatgttgttggccatgtgaagagatgctaggacctgagctgtgcttccttttggcaacgatgacggaaggaatcagaagcctttcttgcacaagcctcggtcagttctagtagcttttcctctctcccctcttctgttttctgttactcctacttctcttctcgccctgctgtgaagagtggactggagcgaaggcaacactaactaactaggtaaggtagctaatggcgctgtagcagcccacaccacatggcttgcacaagcaaaatggactttcggccagtgtcccacgcaccacttttccccactcgcacaaaaagtaattgctagctgcaggcaaaagctgaagcgagcccttgataaattctgtgttgagcctgtagcaatgatataatctcgtgggtcttgaggtgtttgtagttgtaggtgcccagatatgaaagtatcataggagtatacgagtataaagagattggttttgcattgagggtgattgatatctaccgttttgtttgttctgttctgctagtgagagcccaaaaagggctccatcttgtcaagtagtaatattgagatggtgatggcatggagattttcttagctacggatagagttgtccaccaacatctaaccatggcatatcaggtttttgtcgatttgtttacaagagtgcaaaaacaattgagagtgcttgccatttccaatacgtatcttctcagttttcagttcaattgagagtggattacttcagtaattgattatggctaatttagttcagaaatggattagggcgagaagagttggtccaacataaatgagtggtggacctagcaatttcagtggcgtataaagtcacttgcctggggtgcactgcactagagcctgcaggagtacaaagatggaaaatggatatgcatatttccgcaattaaactaacctcccttgtgttctacggaagggtgctatgatgtggattgcgatgctgggtttggatatcttatcagcgagtcgatagaattagatggattgttttcttacacacatctaacctcaatctggttggtcctccccgccaaatcttcattgttatttaagaccgaatcagcaactgaattgtctagcacatcttgacttgcaaacctactctactcatgccatgtgtgttgcgtctgatactttgctgtattggataatgtgttcttttctcttgaagataaagaagatgaagattaagtttttttacgtaaaatgaggtggtattaacgtatgattgattgggttttaattattacaaatttgaaaaatagattaatatgatattttagagcaactttcatatagaaaatttttgcacaaaacacaccgtttagcagtttaaaaaacatattttgaaaatcttaattttcttccaactcttattctcttctatctgatcatttggtcttacccagatgcaatactatagtagtactagtatatgagtattcatgtcttaaaatgatgtctccagaaggaaacacgtgcggtgcttaatttcttcaaattttacactatgcacgaccagggttattggccgctaattaaattgcagccctgattgcctgaaggacactgagtagccaaagacaagtgagcccaacgaatcgcccgtggctcattatcaatttatcagcaattgctaaactgctaattacaagtatgtgccttcacattctgcgagtcagtgatttgctttaataatctcttgcaaagttaatgcaccttaatccttaggccttacttggcagttgtaataatgataaaagaaggcgtgggctttgatcctcagaaatgtgtcggcgaggcctgtccattctcccatctgatctaacctccctttttcttaagaaggggttttttttttacccggcctctaaatccaaccggatatatgcaacacttttaagctagaaacttggcctatcaaatatagaatttagtcctcaaataatccaatctgaaattcgctcctatgaagatttgaactcagaaccttggggtactactcaggtcactgtaactactaggctgcatgtccattctcccatctgatctaacctccctaccagccatagccacccctccctccatcattgcttcatctttcttgttaaacctggccaggcaaattggttggaaaacctaataactaggtttggcaagatatctaatcaaacaagatagtgctgctcgctctgtaaaatttaaagaggcaactccaataaaaatccctttgcttattattcctgatgcacacataccggttattagactagtgatgatgaagtacgctagtactgtccaacgaacttttcctgacacaacaaacactgtgtcgctgtattatactcctaacctttttttttgttttgtatagagttgtcatgtgtctcattaacttcagtttacaagtggggaggacaaacatacttcagtgagatgctatactaatgaagacgtcagtgtagcgacatcatttcattaacagggagactctgtccaagtactaaacaacagaatagtcgtaccgatgagcattttagaggagatgatggtgcaacggttgcactaactacctactacagcaggggtatctatctatgattaatccgataccatctgtcgctctctctctctctctctctctctctctctctctcctgaatcctgatatgtagcattattgttgatggagtttatatatccttttcagtttccaaacacattcaatggctgctagggagatggatattgggacagcttgttattgcgtcagtcatgagccgcaaatgctgtagcaatgcgtgctgcgcttgtcgcaatctcaagcaggcgacgttaatttactaatactccgtattatactatctgagatttggtgagcactagcaaacgatactcccaatctgcactggactggaatactggatcccgcatatgcatctttctctatctgaactgaaatgccagcgaaaaggctggcaggcacctgctgctttttacctttagcctcccccaattcacagggcatatgaaaatcaaggacattttcgagacgaacaagcagcaaacacaaataatatgcaggaggacatcacagagaacgtacgtgcaggtgcagcgactggtttgtcggtgccgggcatcatcgcttctccttcacttccatgacaactcaactgaactgtaccgaaccgaaccggcatgacatgaatgccagcataggatgctactccagcctgctgtctgcctgttctatagccaggtgcgaaagtggacagatatataggaatggcatcagctggttgctctacagtatgtgcgaaaagtggtgtctgtttgtgatgcggtacagcattcggcagcatggtaagttagttgtccactcgacctcccaacaacaaccgcaacaataacaacagcagcactggacagcaggttctagctctctagtttagtggttgatttaccttttaatttcgtcttgtcgtaatctttatctctttcctttgtttggctttatgttaaaacaatcagtcaatcttgagatgatgatgacgatgcatgcggcgttaccattaattagctaggatgcgagcacgatggactgcatctctctcctcctcctcttcctcgccctccgcaggatctccaggccctcttcggtgccttgctttgtcactttccactccttgctacctgcaccatatgttcacatgtgcaccaacccgtaaatactagcagtagcagtagaagggtaatcaaacgcaaactgtaagtaaattctagatgattgaaactctactctattacgcaatcactcgccatgacagccggcaaagcagattcagtgattgaaagcatcgtttttaattgttggttgcatggaattcagctctcttatcccctagatctcccgctgggtttcatccatcgaaaagaatgcaccctggcttttcgaggggaagttcaacggttgatagctacctgtttctgtcttcaaaatcacgcaggacgcacgtccttcactgtcatcatccgactcgatgattatgctgactggtgcctgcattttgcattcacaagcaagcaaacatgatcacgagttgaacataaggcgaccacctactatctttattaaacctgcgtgatacaaagctatgccactttggtacattcagtgatattgattttagaacattaccaattagagcaagagatgcttcttgttaacaaattggccttgtaaacatgttctttcgttactgatacagaaaggagcagggctgcatggcttaccttctttgctggcacttgtatattgacctttctaatcgctacctcttcctgtttaggtgccaccctgtagtagctcgaagcaaacggcttttgtggagctgcttttacctttccctgctccacctttggcttcagatctgtcacctttgcaggataaaccaaatgtgcagaaagcctgacattaacaaacaatcctcgtcagaatagaaaatccaacaaagatccgaagaagaacagttggtagcttaagtcttgctagtaacacaactcgaaggaatgcaccgacacaattccttccaataaaatgagataatgttccattatacaaaatttagaataattactatctagtagatttaaactggcagtatttaaccagcttcgtaacgaaaccaatggaatattaatcattcttttgaattgcttctaacacttgattttaaataggatctcaaggatttaaaaccgatttgaatttgattccatcaagaggtctttcagttcaattctccatactatagtagtgataaatacatagctaatgactgaactatgtaaggagccaagagcagaaaattacacttttgtttcaggtaattggttcatccgggaccttccagctgctactggtgctcggttcattggagaccttccagctgctactggtgtctggttaatctgggtccatccatttgaaactggtacttggtaactctggtccttcagccaagaccaaaaagaagttagagaaagatactggaagacttatggctaaaattacttgagtcatgaatttacatactgccatcatttgcattgcagcaggcctactattgacagacctgatagctctaacaaccccctgcgcaaacaggcaaaacacaatcaaatatagacaaaaacatcacattggttgccttcactatgcgaattgatgaggtttgagcatgacaaatttaagttcacgcagacttgtgcctgctccttcagacatcatcagactcataaaaaccgaaaactgaaagatatcatatactgaatatattggaccttaggttctcaagtatcatgaataattgaatatagaagaaaactttaggtaactatgcttatatggaaacttaactgtcatatttggatataccagaaaaaaaatcacatgctcatacacaagaatgataatcatttatatgcaaatgatagttttcagaataatttgtagacacttggacagttggacttatcagagttgtatcaaaactggaagtacctccatctcttttgtaaaaactctgaagacgtcacaccgcagttgtcttatatctgcttgcatttgtgtctgcagggttgcaagagtcgaggatatctcattcgatttgctggcattagaattcagaacagttgtctgatcaccctgcagttgtcttgcttgcatttgtgtctgcaaggttgcaagggtcgaggatatctcattcaatttgctgcctagagaattcagaacacttgtctgatcaggattgtgttttgtgctgcttccaaagagtgctttgagatcgtcttgtcccttaagctgtgataacacggtagtatgttaactctgacgttgcacaaaagaaaaggaaagagggaaagtggagaaaatgctgaaccatcaattatccttacaatttgctgaagtgagctttcaaggacagcaatcttttgccgtatgctaccagctaaacataaaaaaataattgctttcagttccagttgctgaacaaggacagaaatagagtgcagaaattcatagacaaaacagaagttgcacaataactctttatgactgaaagttaggggcttacaatctaatgatgcctccttcatggctctgtttaactgcattacgtcactttggactgagtctaccaccatccccatcttatgtactgagcttgccagatgctgaaatttgcgctcaacatcctcattagtaacctgacctgctgatatacccatctgtcagttatactgatgagaaaatactatggcagtacaacaacttagtgatttggagtccagataaagaatgatttcaattgaactttctattataaaagcatgcagcgatcatcttacattctatgcagaatagaaaaacagaacccagttggaaaaaacaaagtgtgcctggaactcaggtgaaatgctgctattctggtataaacgaaatgaaggatatatgagatgtagtgcgtgggtcttgagagtttacatctagtatctgcaatggaggggttccagcggtgcactgggttgcttggtaattttgccagttgcagctgagactcttctcgcgcgcaagaagctgaactggctggtaaagaggacatcctcttggatgagtcatcatgcaagccaaatctctgtacaacaatgaagacatgaatgaatgttaatgggcaagatacaaaacactacacatgccatttctaactagtcaagctgtaattagatgcacaggtacagaaatctcagtttgtgatgcaccaatgatgcttccatgaataatgcaaaagtaatttatgaggaacaggcattcatgtaatgaaatcgtgtaactgcatgtataagggtgggtgtcaattgcaaacagttttacaggacagacaaaaacggagttcaattccctgatttatcagtgcaagcgtgcagcaaggtggtgggcagcagagtgagcaatttgtaccactagtaatcaaaacaaatctgaaattgcaggaacagcctactcatagtaattggaccttgcactatctattagtcgttctgcagcatacatttttttttttgcaactgcgaccagagataaaaaaaactgacaaatgctgtatcaatactgaatctgatatggattttcaccaaaaatccacaaggcaattcagcggaagactctgataaacaccgaacaacacacagggacaggagtgagtggaatccccaatcagtaaggcaccgaaaaataccaaaatccattgggcggcagaaacaagagcgagggggagaaggagaggagaggagaggagaggagaggtgaggtgaggtgagacctgatcgcgggtgggggaagggaggagggtgaggaggttgtcgtcgagggagacctgcgagaactgcgactgcgagtgcaagagcgaggcggaggcgccctgcgagaaggactgctgcgactgcgagagcggctgcgaccgcggctgagacgccaccgccaccgccacggaaccggaagccgacgcgccgctgctccctccggtcctcctgaacacaccacaccaccccaccatgagcaaaaacacagcatgcatgagcattgagcagaaggggattaccggggagggaggacggagatggaggcgatgtcgcaggccttgttcatcttaagcttcatgccgccgatcgccgccgatcgccgtagccttctccttcgccgtcgccttcgccggggagagagagagaatattcgcaaatttgaatttcttcctgctctgcttgctttctggtgggtccctgttctccgccttttataggcaccacagctccccgtgtgggcccgcccttgcgcatggcagctctgaggctgacacatggggcccgagttttgaataattgcggctatgtcatgtatgggtgtgtttagttcaccgaaacataattttaattttagagtgtcatatcggacattttgataggatgtcggaagaggttttcggatacgaataaaaaaactaatttcataactcacctggaaactgcgatacgaatttattaaacctaattaatccgtcgttgtcacatgtgggttactgtagcaatggctaatcatggactaattagactcaaaagattcgtcttgcgatttcgatacaaactgtgcaattatttttttctttttttatctatatttaatgctccatgcatatttccaaagattttctaggaaaaaaaatcctgggaactaaacaaggcctatacaaaattaacattcaaattgcggcagagaagaaattaggagtgctctgctatgcaactgcaaacacaactcaaaacaggaatacatctcttgcacagattcaaaacaaataaggtccagtctttttttatttgagattttcttgatactagtattttgtgataacaggatacattagcacactgttcttgtgatcagaacttcaggagcacaggactaatagtatatggggaatttgttctgaccataaaaagaacaacattttttattattttgcattattatcggatcaatgcgccaaatacccccaacgtatacagcgagaagggaggtacatgatcactggtttagttccacagtccagcccatacaatcgtccacatgacccatctggaggcttgtaagtgaagtatacagctgctgacacaccacgcccactccttggttgccatattccaccctgcaaggttagcagtacaattttcggatcttatatgtcttgtcataactatctcaagaacaaacttagcatagttaaatatctcattttaatgcgtgcggcagcacgactccaattgctctacaattatcatgggcaaccaatcccgaaagatctcaagtttatagctaactgaccacctgcgcgtgtaatactacattccatatcatgttgcatttcggtttttctaaaaacagagaaaatgttgactctcagaccaaacgctggtaaagcaattggtggtgtttgtaacaggatgacatgatcatgccaggtaaatgttgaggtaataattacaaaaaaaaaccctaagaaatgatcacaagtgagaaaatcatatcagcatggtgaaaagttaaggaaaacctagcctatgaaacacgtagctaatccaaggtcttcttcaccaggttttatttttaccgaggtagtaccatttgttttggtgctatttctagtagagtagtaactaactaatccagtcttatcccgaaactgctgtgatatgtgttctaaagacattagctgcaaatttttactgcatcaaatagccatattgcacagcaagtaagctttcaagcaaagcagaagtttcacctttgccccagataagttatgctccccacaggggacaccacaacagctgttcccgtgcagaaaacttcatcagcttcaagaagctcatccactgacacaaggcgctcctcaaccttacagtaagttaacattaattaaagctacataacattaacaaaagcatttaaataacatattttttcttcctgtaatcaatgaggaaataaccctatgatgggccaacaacagctcttccaggccactaggaaaataggatctggctaatcatttaagtaaacttgagctactggtgaaaacaagaatttaatttggtattgtggaatggtaactataaaaagcttatctcaaattcacaggtaaaatgcactaggcagtcatttctttcctggtctccatgatgctgatgagtaatttaccatgaagccttttctctgagcaacttcaagaatacttttccttgttataccaggcagtatggttccttttattgctggagtagaaataacattgccctgatgcgggaaaataacatgattacgacgataaaaaaaaaagaacctaaacgatttacacatcctaagggaacttgtgccatttcactgcataaaacctaaataagcattggccaaatgggaacgcctaatcatgcaacaacaaaaaaatatcgattaggttgtaattgactaagtagtataacatcatgcgcttcgctgaggaaaaactacttctgactccagctactgaaaatatttgctaaaataagcataggtataagagaaggatcatactttcacaataaagatattgcacgaagacacttcttccagatatttcttgtgaacggcatctagatagaggacatctgaatatcctttctgttttgcaatcctctgtgcttttaatacctacatggtggcaacaaatatggaaactgagaaaccataagattaaaactaaaacagtgtgagtaatagcacataatgtatgtatatatgctagaatatcagtattcagtaaacaaatcatcactgactgactctaacttccatttcaggctaattttaccacaacatcacttcctcacaaatcacaacgagtgagatttccatttccggttatttgtctcaaggggaaaaaaattaaaataagccgtgagctgaccatttgaaactaaataatatgaaatccacatagatatccaacataatagcttcataggaacaaaaatgtttacattttaagtttcgaattcaattactcttgaaacaatagagaagcctaactgcgtaagcaatagaatttagagggtacatagttacatgctgtacatatagcagaataagcaatagccaataggtaagtacatagttgcaaatataactaactagatgatggccacagaagctgtaaattaaatagttgtagctttcatagatgcagtgccagaagttaccgaggcatagtttccaatggttttcactccgccagttccaccaggggcagcacggtgaaagttttcttctataatcaagttaataggggctaaaccttcctgtaaatcaaagataacaaatttaatcagcatgtatggtagtttacaaagataacaggggatgaatttctattcttggtggaatcaggaatcgtgatagcaaatctgcttgtggtgtaattccaattccactatcctataatcactgcaaaaggaatattatttccctaggatacatggttctttacatattggatgagttgctcgagtatctggtggaagttaagttaaaaacttaacacaaaccttgaaatagttcccaacaggggagacaaaaatcataaaggtatactcaggagcaggtgcaagaccaaggacagctccacttcccataagcagcggccttatatacagggagcctttaccggttgggggcacctacaaatatagtacattaaagagagtgacaggattatgaagacaaaagattgttgaatgcagaacttaatccaagagcataggaaaacataaaatttcttacccatcttttatttgccaaaacggtttgctttactgcatccacaaattgttcaagagttggtgcaggcatacacatcctctctgcaccatttctcatccttatggcattctcctccggacgaaacagcagaatgtatccatctgtttttctatatgcctttaagccctcaaacaagccctatgtacgaaaataatcactgtttaagcgcagtaaattcatttaggacttcaaagagtacctatttcacatgttaccaatgtttgaagttcccaatccactgtagaaactccctactaacctgtccataatttaagactccagcagatgggctcagttctataggtccaaatggtaccatttctcctttggaaaagttcccatctggcccgcattttgcaatatacataaaatctgtctggacaaggccaaaaccgaggttctcccagtccaaatcagccaccgcagaggtttccctgcaagttatacgatcaggacaatatttatcacttgtggacttgattgaaacgtaacccatggcagtgagacttgtcatatacagttcatatttacatacatgtagttagttgctagagaagcttggcatcctatcgcgcagtgagccttggagaaaggaggtggcactgaataagtgtgattcttgatctgcagtagcaagaagaggtgggggaaaaaagatattcttctatcagatcaaaaggccatcgaaagttgaaaatatttaaacccggatgcatctttgctagtagtaggaaatacaatatgacaataaatcagacgaggcttgaatctatgcatgggatgggaccagtagggccaatcaagcacaaatttcactcaaaaggaccagagagatggcatctactctacagcactagagtctagagtagccactaccacacgccaatgaatgatacagtagacaacttagttgtgcctgattcatttatttaggaattcagatgataacagtccagaacaaggaaaatagggaaaacgaacagctttgttatggtaatggtcatttagcctaaacctttacaagtaaccaacaattagagctaaacgccacgtcttaatcccttcatgtatgattagacgctcgaatcgctgggcaacaactagttaggagattcactgtttaaaaaaaagaagagggagaaaaagaagaaaaggttcgctccccattctagttcaaaagtatccactcacgcaggcaggcagcaagtagtagaaacgcatggtatttgcaaagcgaagacgagaaaaataggtggggagggaggcgagtttgagattgagaagagagtaccggaagcgacggcgtggagagagagaggtgaggacgccgctggccggcgagcggcggagacagcgggagggcgccgcgggaggtgaggtggagctccattcggtttgctctccgatgggtttgagcaggcggcggcggggggcgaagacaatggcaatgcggcggtggcggcggcggaaaccgtcgtcgtccgaataaaatagcggcggccgcgagcgcaaaacacacacaaggctaactagttggtcccaccggtcattgactcgcgggaccagctgccgcagccatgccttgagctcggccagatccggcgcctcgtggccagctccgccagccacgacctcgccggcggccagctctggtgagaggttcaccggcgagtgcgggctccacgccgagaattccggccgctgcctcctctggtgagtcctttctttttctgttttttttttgaacggtacttttctttttctgttgtttgtctatgtgatgcgtttttcaaatctaatcacataaatttaaatttgagtaaattgtacgtgcggtccttaaacttgtaggggtgtgttatctgggtccctagactctcaaaatacatatccaagctccagaacttatcataatgtgtcatctagattctaaatcgccacaacctcttcaggatcttacgtgacgttaatgtggtatatgacacaactttacaagtttaagaactgtcaatgcactttacgcattaaattttgagtaaattccaccaactatattagataaaactatggcaaactataaaatttattaaagattttgtatcacaaaattataaatttaatgtaaaaaaatattttaaaaaattatatatgtttttaagatggttttgtgaaatttattaccattattagatttttgtacatgcctagctttccaatagctgattttttttatatgggtgtgtttgataaatgggttataagaggtaggtttgaaaagataagagatgcgaagaatggatggttaagataaaatattatcctttaaagggtgaaataatatttttctatccgccaaataattagatatgcgagtgatttttaacaggtggtcaaaattaaacaattagaacgagctaatacttcctctatgctttttctaagttgggttagctcgaatatttgggaaagaaggtattagacaggtagcatccataaggttgtcttcacctctcttttttctctttatctcacttatttatttaatatatttattttaaagtatatgtagggttaattcttatatattaaaaattataagttaatacttattatttttctctcttatttatactatcagagcagatatatagtattattgatggagatcaaagcccgggccacagattgagaaggagaacttgggtacccaatggagatcaatatgcatgggaacataatacctctgttgtaggtgtagcagcagctggacaaccattgtgcgccatatatatctgcaaattaattaagctctctctctctctctctctctctctctctctatctctctgggtgccttaattttacctaactatgagtacgtatttgcctcgatctcgcaccacagctgcttaattaagtgcttaatatatgaaggtagctatatatgcctatgttgcgcggaggggtttatatagatcgagagagagatgacatcattcattgacatgcatgcagcacttagttactatacattcgttttagagttaggcaagctagcgtattgagaaagcagataacattaaatgagaaagaattatgattgattgagaaaataaagtaggtaaataatttaaatggtgaaattaattaacgatgtgatttgttgataggagaagttgttgttatattttaagataaaatttaaaggataaaagttgttatattttaagatggagggaataataattaataattgatatctgttttaaaatatagctacctatacatgatgagatatttcctaataatatgaatctgaacaatatgaaaaatgtgctatgttttaggatggagatagtagctagtttacgattatgaactgagctttttgtgttatactataaaagattgtatatagttagctctcccggccaagttgcccacgttgctcacgccctttacttttaaataataatttatctctactattataaaaattaaagatatttctactaatactttggtacgtcgttcgtatctgagtcgatttttaagttcgttcacttttgaaaatatataaggagtcgtataagaaatccttttaaaaaattcgcatgttaacttgtgacgagagtcaaactcctaattgctttagaattgaccatcatcccaataaaagttccaaattatatatcaatattatcaaaaaaaaatctcatataccttctggacaaaaaaaattctgacaattatataaataaaatagcctttacccgttgcaacgtacgagtatttttctagatagtagaaatatgataaattataagtcatgtttaaagtttatttatgataaaatatgttataacaaaacaaatgatatttttataaattgttttagatagaatgaatgatcaaatatgatgtcaaaaatcaacaatgttaaaaaacgaaggaaacaataagttcattactacagtatgaactgacttttgggtcaacggcactagctacactcgtcaaaatccactagatgcatggcaaagaatttcggtacccggttccttttgtctttatatgatacttcctcagttacaaatgatcatcatattattaaatattaaaacttttaaattgatcatcaaccctagtcctttatttaatatgcagtattattgtatttgtggatacaaattaattaagtatgcatatatgcaggggtagttaagcactgtttctagtgcatcccgggagttaaaattaaagtcccatatttatggattttacctcaccatatactcaacttaaatgaaattagttatatcaccgtgtatagcaaattatttatactatgtatagatatatatatctagtataaagtggggattttttatccatctacatttttttattattcttctttagcgaattttctatcatctaaccaccttttatttttttacttttctatttttatcgaattttctgttttgttgggatcgcacaacaaccacctttttctttttcttttttttttagcgtgagcgagcatttttttttaaacgtgcgctgcgtgctgtatgagccagggatgaaaaggaggatgcctgtgcttttatgacagtaaagtaaagatacggagaaaataagcttagctttactttttttttatgatagaagagatatagagaaaataaatttagttttccttgatgttggtgaaagaacttatacaataattaaataggaacgacggagggatggatggagtatattattgattatatgattatgtgataacattttaagagtaggaacgaataaattacttattaaaatttatcgaaggttgctttaaaatactatataaaaacttatgtatagaattgtttgcaccgttcaagtagcttttgaagcatgtcaatggtaatctgtattatgtaagaagaaaagaatggttaagtatttaataattttggatggagatttactaataaattactgtcttaataaattgtatatctttgtatttttgtggatcttaaatgtgtaaaatcatcttttttttgttttcatggtgttgaaattggttttgagccaagaactttgaaaataagtgaatgtagtttcttttgaagcaaagaccagataatatccattatcagaaaagtccctattcttttgtgctgaatgattgaataataaatggtttgtaataaacatttgaggattaaaaaatattaaatattatgaaagttgaaaaaaatgttttctaagaaattcgtatataatttttctgtgaaaattgtattatttaggagcctagaaaatgtgcgcaatcagccattgatcattctatttcttgaaaaggaataggccataggcagaaatatatataccagaggttatatatacaattcacagttgagtaatgtttccgcgttcatcttcgatgacataagagcgaacaataataatgttatatatggaactagctaggtaattaagctaggtagcagttatgtagccttttgtcaacttcgaatggagattcacaaatagaattcaataattatgtgctgtttatcttgtgttggcgtttacgagtttgcgttcgctttatgtttggaaaagttttttttttcaagttctctttaagttgcactcgttttgagtgatttaatgtaataattggctgtaactcgttcgagcaaagatggatttctattccattattaaaagatattatgggacttgtggtcaagtcaagtcatacaaatattctagacggtaactttttttttcctttttggcgaggattttagacggtaattgataactcataaattatcattagttaattaactagtaccaataggtagcagtataaattcgttattcctaccactcaactttcgggtcctttccaattttctttttgagagaccagagctggactcgcgatacgaactgtgcatttttaattgcaagtccaaatttaattgcgcgtcgacgaagcccacatatatgcaatttgtaaaaataatattggaaatgaataagtagttgaactatgcgacgaccatcgaataggtaattacttagatccacgacattgtgaccaaatttatcaacttggaaaaaaattgctactatatattcatgacatcagatgctttgcataattctaaccgtgctaattaagttgtgatggtttctgtcggcatctctccgttcgctccaattccggccagcacatccatttcttgtgcaactcatggccggaaatctccagcgacgcttaggttcggcgcagagctagggggctttctccgtctatatatggcaatacaaatgaatccaaggaaggcgatgatcgagctcaactccaggcaaaggccaaatatattaagggagatggagctggccggagatcaacgccagtcgtcgtggcctccagatccgatatataggtcgatcgccggcgatatatatggacctggaggcagggactatcgatcagtcatggcttctagatcgaggtgacgcgacgattgctagctggtggagcctcacgtgctgccgcggacgatgatgatgcatggtgctatagcctatagcagaggtgatgagacacgcaccgcaccgcctctagagccatcgtcttcccgtcggtgaagcccaatgcaacgcgctagctgtggccgacgtcgctatatagtatatatgagattagaggcagagagacacatgccacctcgatcgtcttctcccccaccgccgcgctcgacgacgccacatcgggtgctcagctgagcttgccccatttgcaccattccccaggaccaggagcacgagcgccaccgcaaatttgtctgagttgaggaagaagctactcctctgtttttaaatattttacaccgttgacttttttaagcacatatttgaccattcgtcttattcaaaaacttttatgaaatatgtaaaactatatgtatacatataattatatttaacaattaatcaaattgataggaaaagaattaataattacttaatttttttgaataagacaaacgatcaaacatatttaaaaaagtcaacggcgtcaaatatttagaaatggagggagtacataactagatggagaccccatactttaatataatttgccacgagacttctgtgtgattaagtgacaatataatatgtttggatttggtctgaataagcaggacactactctagtccaaatttgtataattattttatggtgatgtcatagaggtagtatgagtaagaacaagatcaatagtgcagctagcagcaagctctaaaattttatcatgtcaagtagagtaacttaaaagccaactcatacaacaagcaaactttatagttagctataatctatcttggtagcatacatacattaaataattgtatggatacatcagagagggttctgtatgggacccacataaacacattttttatcgtctcttctggctgcacgtgagcaatacagtttggggcacggtgcaagcgctggcgccaaaacaagcgctcacttgtttctttctctgagattttatttccttaatctcaaattaagctgataagtaagttttggagccagtttaacagctctatacctgctctaagtagttattcataaatattaatgcaagtccattggatgcaaatagtacttataagggcatgtacaatggttgtcaatagtggtatcttagcggtgctaattagaaatacttgttgacatggaagaaaaagaaagagagaaaaaaatcattgttatgcataacaatggcttaacaacgactcttaatcactataatatggaaatatggttgcatgagtataaaaaaaggaaagaatattaataaaataaatattttttaagttaatgattagagcctttatcgtctcaactattgtaaacatatggtctctaaataatcttgtattgtttaagagaccatactcgcctcaaccattgaacgtgccctaatatgctatcgataaatgctacggcaaaggatacgtttccttcctttaattttgggctggcgttgtttacatgtgcttgagatatatatactctataataatacaaatgtgatgctagtatatattgcgattaaatgtacagtaaatagggatgaacaatatacgattttttactgagaagacatgcatgtacctacactatatatatctggatcatctgctgcagaaagagtgagagttaatgtttgtcgtgattaaaccattaattaataataattccaggttcagtgtggttaattgagaaagttactactagaaaagaagaagtttgggatgaagcccaggcccaccatccgaaactagtagcggtcagcccgacaaagtaggtagcggccgccatgcgtccatcgatcccccgacgccttcctttgtcccgcgatcccggcggtgctccgtccatagctctcttgcctccgcccataaataccacccgcattggcgttcagctgtatcatccaccagcaataacattatattgcagcaatggcatcctcctcccttctactcgcctgtgttgtggtggcggctatggtgtccgccgtctcctgcgggccacccaaggtgccaccgggccccaacatcacgacaagctacggcgacaagtggctggaagcca

SEQ ID NO: 68551 - DNA, 772 bp, Oryza sativa
cagaacattgatctttgcactgggctcctccaagctttctttcacaggaataggcacacgatccaaaagcttagccagctccattttctcatcttgtctaacactgacatacttgaattcttcactgagtgaaaagagccgacatagctcaatatcacccattgtaggcttcaggtactcattgtaagttgaaatagtcccgtggctaatatagtaataactagcaatccttcctaggtcagtaacctggaagtatcctgttttcctgtcatactttatcaaattgttcctatcgagcagatttgcagcagagtgcacctgcagaagcacagaagtacaagaatcaacaattgattgagcatggactagaaggggtaacaaagcagttaaacatcaagagagcatacagagaaaccatacaatatgaacaacacaagcatgaatcaattgtcaactagatgcttcagctatggaattcagccaacaaaaataatgagttgaagttgcgcactttttacgcattttttacatgctaccttaccctgtagttcgagtgctaaattgatgcacaatgctacatcggtagtcaagatgcgcatacatttcaatagaagagactggcttgtatcatgttgctattggtcaaagagagcaaatatacaactattaagtgtccagcaacaaaatataaagctacactgcaaacagcattcggacaaataaaatccaaggccattatcctatttctattatacactagtacatgctaatg

SEQ ID NO: 68552 - DNA, 1264 bp, Oryza sativa
gacggcgagcacctcgtcggcagcgccgccgagcacgtcgagcggctgtccgccgaactgctgctggatgacgctgagcagggcctcgtaggcggcgcgcgtctccttggtctggggcttgtagacgacgtcgtcggtgagcgagaggacgctgacctcacgctgggcggctgcggcgcggcgcctgcgcttggcgtcgcggcggtggaggtcgtcggggtcagcggcggcggccttcttcttgcgggacttggtgagcttctcctcgagctcggggggcttggcctggacggcgcggtcgccgaagctcctggggtcgatcctgccccagagcgtctcgggctcgccggtgggctcgtgggtgtcgcgggggcgcgagtcggtggtgaggacgaggctggagttggcgcggtactcgtactgcttgaagcgcgcgtgcgcctcggcgccgccgcccaggttcgccatggctgcagatcgatagggtttttcagttggttttttcgtgcggaagcgggaggagaagcgggaggaggaggagagggatagctgggggttaccttttggcgagccgagggagggtcggcgcctccggtgataccgccgccgccgcgccggagaagggggagaagaggaggttggatttggaggaaaaggaaaaggcggcgatgggatgggagggactggattttctcgcggaacgaatcgaggcgagccctaactctaaaagatgacgacataagctaagctcaggtcggttcgttcgagagacgacggtttgggcccataagcccatccacaaaatagtactgggctgctggattaatgtcggtttcggcccatcaagttgtagccctcaggctctctcgaaaggaaaacaatttgggccaggtgggctcaactaccgctcaaacaattaggcccagatttcacccgtttctctgggccatatatactctgcacaagcaccctactgctctcctcattcggtcattagagtcatggaaatgtaaaatggcatatatcaacgagaaaaaagttttggagtaagtattttagtaaggtttttgttttagggtgctactttttgaagaggcaagttttgccctaaaaaggaactggagatactctactgaaagaaaaaaaaatactactcactccgtattttaatgtatgacgccattgacttttcgaccaacgtttgactattcgttttattcaaattttttgtgtaaatatgaacatatttatgtcatgcttaaaa

SEQ ID NO: 68553 - DNA, 11917 bp, Oryza sativa
ctttctcttaatctcctatgtatacgagataaactatttaccggatattcgattaaaaaaacccaaagaaacatacatacataccattaaaaaaagctataaagcccaaaaaataaatatgtatgttggtacaacatcgaaaaaatatagacaatccttaaaataggattttctatactatgaaacaaaatttattactccagaaatatgcaagttaaactagatcattataagtatcaaatcaaaggtatttaaacacccacttttaaattataatccgttgtattcaaatgctgatgacttatcatagttatattatgatataaatacattacaacacatggatctgacatataataattaatattataataattttcaaatgatttaggcgacatataataattaatttcatcataatctttgaaataacttcacatcatattttgtggtgtcaaatataacttgacaaatatataacactaactgaaatcgacatgcttgaaaacgaaacaacattatgctttgtcagttatatatgatttaattttaatttatggagactaagattctcaaatgttttttttcatatttttcaaaactatttcattggtattcctaggcaataatcttgctataatacggccccttaatccatacgtttttcccgccagattagtttgttaacaaatgtgcattaaattactcatgatatattttgtttatagtcgaggaattctaatttgtcgggtataaatgatagttgatagttgatgaatgtatgctataagtgcactccaataaattagttatttttaataatttttgaaagtaaataaaatttaaaattagtaaatgtgtctcatgcaattatgaaccaattatgaacaacaggtgacgaaaacaaaccatacgctaaaatattgatctttgtcaaaatataaacaatgatataatggtatgatactctgaagatggttatggtcatatatctgtttagcgatacatttcttaatgatcaacctcactcatttcaaagcagaatattgtatttatacataaaaaattaggtagtactgctcaatactagaaaaaattatgtctacacaaaacgtaaaaacaattattttttatgggaagaattattttcattacatcaatcttttcttgctttctctaaaggctattgaacatcttttacaagtatagttgaggtggccccagtggaaaccaccgttgacaatagtgctcaactttttacttactcatgcaatcatctttaagaatgctgatagtgaattaggacttaaaattgtactgcacactgtccttgagaggcatgagtatgtcgatatggaacccatgtttaaaggcaaccgagaaataaagacttggtatctccacctgttagaggggatattcatgtctaattttcaacactaatatcacatttaccaatagatgcagtattttaagtatatttatttatagatttagaactatgtgttgacataaacacttaggtatatagtggagataaatgttttatgtatttatgatgtattaggcttattttggtgctacagatgcagttccgtttattaaaaaggcatctagcgacaatggtaagaagtaatggtgacaataggcaagtttacataatcaggacaaaagtgatttttttaatataagaaacattcctatcgtttatattaaaacctacaatatatttcacgacatagatttttgttattatgaggtaaaatatataatttcttatacgcatatgatgtgatatgacttaattctcataacgttatttttataatcataatgaataagttccccgcgtatctgcgcgggctttctttctagttactagcaaaagacccaaagaatgctagtgaacgtgttgacagtagcaagcaatgagctaatgatctaactaccactccaagccatcatgataatttggagatgtaaaatgggattatgataagcagctaacaataataaaatacggtgataattgatgagtgattatcggatggcagcgaccagcaagcacaaaaattaactgcatatgtgtgatggagtacaagctcaaagacatgaaaaacaaatcgacgattttgacagattttgcaactgaaattaggagcaaccaacaattttgacagatgatgatgaacaatgaagcattgatgcatatcctttgttctccccaaaataaaactgaagcagcacaagctacatcagtacatgcaaagtaatggagagagaatgtgcagaggagagctggagcttgcgttgacttagccataggcgtcttagcagtgacggctaaagatgaaattgtggaagaggaagagaagatgtggaatatttgcttgctggttggagatgaaatagactacgacggggctcgctgctgctgcatcaggcaggacccctgctgctgctgcttgactccgcgagaccgttcagtctcgctctcccattccgcggtaccacgcggtctcgcctttcgccgcgcgataccatccacgacgtcattcccacgtcgttctcgtgcaacatttgtgcgagaccgacgatatatttacgcaaaaaaatttacatcccgaatatttataagaaaaaattgaattaacagtatattttcaaatttaatttctaccttagctgccaggaactagagaaagctccaggcatcagtcgtttagtaattttgatgttcatattctcgtgagttgccttgccgcattatcatgtacagttttgtgaatcaaaatgaaaaccgaaggattataggttctggaagttccatgctcaaaacaaacaattgttgccatgttagaatctgaagcatgatcaatttagcagtttcttttcgtagctgtgtcttactactttcagttatatgcattagctgcttcaactatgacctgaaacccaaattctactcaattttaagttggaacgaaactagataaaacatgctgggtaggcccacatggtgcttgtgtctatcgagcaatagctagacttatacttggtgggtacaagtccaaatttcccaacaacatcacaattgtttatatgatctgccatatccctgtttttcgtttggatatgttgctaagccgagtaaatattcttaaaaaaagcagagttagaactcaagctgtggcagagttgctctgaaatctgaaaataccaagttcagaacaagcagcacatggtacaatttagctgtattcaaacacatctagtattactgtttttaggatgtacgattttatctatttttagtccaaaagaaaggaaagcaccatatacttcatcctagcaacaataggtgcaagttatataccgtacccttcatttgatttccttgtctttgattcaccaagaactagttctacctgaataccaacattggtactgtatgatagatatgtatgttttatggcactagattttttgagaacccatgttcaagtcttttgtgccaatgataaatttggccgcaactcatggccaatatgaacataactgaaattcccggtttgaacttcattggaaactatttcagttttaattgggactagcacatataggccttgtacttcagaaatatttcaattttactgatgtaaatcggttgtactgcactggtttgcaacctgaaactccatttaaaaatttaaacctagatcataagatattcagagataatggcaagaagtagccgggccactgaagctcatggtggcattagtgctatattataatttctcttgcacttgagtgggtccttaaacaagtattataccatttcagttctgcttcagcactagtgttcatctttttcctggagttgcacatctggcgtttgcagcatttctgtaaattggcatagtataatagtgttgtcactatctcttttaaggacattctgtaaagcacgcatggatggctttctggtctggacatgcaggagaggagcacttatgttatttttttagcacttctattcagggtgaagacatcctttggagcaagcattagtgtcggatcttatgtgattgaatatttgcctgatacttttacctttcgactgagacattttactgcttatgtgattgaataagtagatgtgtagggacagttcttatcagatctgtcaaaccttgtgaattgtgatgatgctattgatgttcagatgggcaagcgattaattctgtgtatatgtgtgctagtgagtatgattaattatgcgtatgggtgctaatgtctatgattaactagatgggtaccccgcgcgttgctgtggaagaattatgtaataatatagacttaatatcggttgagcagtaagaaggagaatcggttatggaatatattcagagatttcgtaatgtccgcagccgatgttatagtttgagtctaagtgatgagcaactagcatatcttgcattccaagggctatcaacacctatcaaggataaattattttgccacgagttcgacagcttagctcatctaatgcagacagtaagtaagatcaattttggagttattaagactagactgaagataatattgaagcatgagctctcgtactccaattttttttttttggagggggggcctgtgttaacaatgaaatttggtaagccttgaagacgtcatcagcctaaaatcaatatcggcttcagagttttggaatcggccgatgagaattatcaagtcgccaatagtcggattcttgctatattcggttaagaaaactaatctattaaaggaagcttagccagaagtgaccgagttcaagaaggatgctgaatgcggcatggcaagttatctattaattaggcagtatttgttagtttccttttatctttaggaaagtgtgtttagtgtcccataaggactttatgttttactttatatttaggaaagtttctttcttgtccaataaggactagtacctacccatgggtataaatatgtacacctggggtgattgtaaactatctccacaatcaatacaaattcggcacatcgccatcctttttactgaggtttttacttatcatccgacggaacttgacacttaacgcagggctgcatcggctttcgatctccgacatagggggcaagtcctacgttgcgccggtcctaacaattttattggctacattggcatcgttcaaggctgcatcgcttcgacctcttggattgctcaggtttagttgatatatttgcctacctatttatcatatatattagttaatctagtttggtagcttgatttacttgtaacgactgatattcattttagggtttatgccggtatcggctaagtcgctttcccaaattagattagctaaggtatctaccaccctgaaaatcagtcaagggcttgattgtctagatattgtgtttcatacttagtgctgcatcagtacattcgacctactaagtcgtatttagaaccataatctctagcctgcttcttgatcgctaataaaggtttcatcggggttttagccaatgagttatctggacgttgcatcggcttacaaggattgcatacaagttggatttagccgatagcaacaaaggtttcactgtttgtctaatcttgtggatttatgacattggaccttcaaccgatgtatgctttaactttcggatcaatatttgttctatcatatcattgttagctgattggttcctacaggattatattattgttatattacattatcatcagccgattgtctttatttacatcaagtgtcagattttacatcaaacatatggccgatagctcaaaatcctatcactatcgactgataccggtatcggctggaatcactccatcggcttgtcagccgatcggttatttgatctgctatttgtatatcttgtcaattgcaggatcaaattgactggcacgtccgcacctcatcaacctttggacctgcactggagctaagcagatctctcagaccgttgtgttcgactgttcgttgacttagttcgtgccaacacagacccggtaccatcggctgagcgcggattttccgtcaaaagccgcgcgctagctcaatcactgactgctgctgctttccacccgcatcttggtcctcccgcgcctccgcctcgccagtcgccaccgtagacgtccctgtgaccttgtccatggcgaacctcaccaggttgctgagcagcacaacaacgctcttctcctgctctaccacgaagctcagcaggctctgcagaacggcggccttccagttgcccccaccgccgccgaggaggaagggaaggagagaagatgacatgtgggtcccccaatttttttttttaatagcatatgggccctacacatatctatatatcctatatagttggcaccaaaaactaaacatgcattcagccgcatcactgacaaaacatgataaaacaagagccattggatcattttcatacgtaaccacaaccatccaatagacattaaatatcaacacttatcatttttcattgattaaaaggtaactcaacattcagtgaccacttagtgtagtatatgctataaaaaaaccactacaagaagtagccatcggatcatttttcatatgtcatcacaaccatccaatagacattaaatatcgatggttattatttttcattgatcatgaggtaactcaacattcagacccttagtgtagtatgctataaaaaccactacaagaagtatttcatttttcatatgtgaggtgcttttataggtatataatatttctcatgtctatacattaaaaatttatagctgcattgcacacatgaataatccgacgtaacgcgcagagcaacatctagttttttttaattctaataccatataagcgtcacatcaacgccacgtggaacgaggacctggttgacactgtcacgtaggcgtcatgtcagcaaaaccaccctccaaaaccgtcgagggagtcaaattacaccggttttaatagttgtgggtcgaaatatccggtattgtggttactataaaattataacccaccaaatcctaaagctcaacctacaagatgctatatcatcatctgctaacaattattacacctaaaacatcattgcgtgcatagtatattatctataattctatatttattaaattttagagctttaaaatgcaaacatattaaataatcatcccacataattcacataatatttaaatatatctatccattattttttataatatcctatataactatatagttaatcatcacttagttaatgttatgtatcttttctctcattaagccaaatcatctcaattgtttttagcccttagatgattaatctatgttctaaattacctctctcatttgattctctcataaagtctcatcgcctttcttttatatttggatcatcatactatataatatttaaatgaccataaatcatattaatgtttagctatcttacatattatttgtacttattgctattatactaaactcccgcagcaatgtgcgcgtggggcatgacctagttaagtatataatcagtgacaataatctgtttcgaccaggggtcctgcgttcggaaattcccactttatatttatttgtattgtctaggtttttacgaatttccttttttcatatagcatctagtttttcattggcttcccgttatggtgctcttttatcaccttggaagctactaggtaaaatttcagaagtgagcttcatggaagacgttcgaggtttgtttgtctttcttttcttatgggttgctgaggagtaacgtggttttagttcactttaatcatctttgttcatgaacaaatcctatatatactattctaataaaaacatcagcttgatgctccctttaaaatttctctaaattaatatattctctacataacacaattaaaggacgtgggaagggcatatgggggaatgatctgtaggacactagtaatatgcccgtgctaaacgctacggtgcaattcgatgtttctttaataacttctaaaatttcatgttagcaaaaaaaagtatatgatatgtgcaattggagctttaattcaattaatatcgtacagttcacataatgtacaataatatgatattgtgtgagcacaataaatcttaataaaaattaattatatataatcaattcagaatacaatatacgaagccaatatatgttttaaaagaatatgttcaaaaagtatagatttattccattaatttgttgctactgcaaaaaaaaaaagaaaagatgaggtcacgaccaaagttcagatagacaagttcagaaatggagctatctcataaacattccaaagctcactgaaaacttcataaaatccaactaaatttacaaacgtattcagagatatatgtttttagaattcattgttacaaacatattcagagacatatgtcagaatcataaatttttcatgctggcaaccagctgaagaggtgcacagatcaagacttgcaaaagatgtactcatcttcagaacaatgttcaggcattttccattctggcagctacaacagaaccagaaaaactctttagctccaggttcattttaaaaaaaagctccaggttatccctaaccagggcactcagggcttctcctagctcgacaaaagattaggcctgctatctaaatttgagaaacacatgcagataataactttttttttgtcacacatacacataataatttgatttcaattatatcacagatgtatgttagtgggagggaggagaattaaatagcaagtattttgtcacagatgcacataataatttgatttcaattatctcactgatgtagatcacataactgaccgagtcactattgaaccgatgcataatagccattgataatttaatattaggatggttcatagcttctgttaacatgaaaaagaaaccatttttgtttccatacagcaaccatgattagtgacaatgacagtaaatggataataatatggattggtgaaaccctttcgaaaaaaaaccgtgccatttgattaaatagacggtaaaaaaatggataggatgaaaaaaagtattccgtgaagacattgaaggataagatgcagctgttcaaggaagaaacttacagttgatttaaaagtataaatatgtgcacagaagctagagcctattttatttattaaaacttatcagagcaacgcattatcctgaaaattataaggcagattatgaacttaacacaaattctacataggaagtaatgtgtcaggaaaataaatttattatgtattgaaatatatatgcctccttccagcttttggtgtagatggaagattgatcggggcagtgacattgttgaggccaaattcctcttattcggttgtctggcaaggtgatgggtagcgacggcgatagggccgtagtggcgggcattgacggttgtggggagacagcggcaaatctagaaacacttttctttctttaggttgatggaaaaatgaaccaccctactggcagttgaaacggtcgatatatgtaaagttcgctgctgccatcaaaacccgctcgatattcgtcatatcacttacaagtaatacgactctggtttctgtataccatcagaaatatagagaaatttaccatatgcctaggaattcatggtggttcctaaactaaatggtacatattagtcatattattctgaagatttaaagtacatttgaacttttaaagaagcttaatttgaattaggataaaactaaaacacattacattttggaaattggaacagagggagtatcacagtaaaagtgtaatgctgagaatcacaaaataaaagtacttgtaacaaataaatgacagtggattcaactctcaatttagttttagcaacgaaaaatatatagtacataaagaacagatatactggttttttttttgcaagtaccagggcattgtgagctataggcaacaatgtgatgtcacaaaccatgaagtgatagcagggcagtggaagttgatggctaataccatgaacagatgcattgacaatagtaaaaggcgtagcaaaaagaaaaaggacataccttgaagctcatttttcacacctttacacactgcagaatttgtcattgttgcagccctgaataaaacagttgtactcagagcaatgtagggggtaatctccagagcataacataaggacacaaattctcactaccaccagtctcacctaagccagattgatgccaccgtcgttgccaaaataaatatacagaacactgaattgcttattaaatgtgtcatctacactatttagatccgtacatacacaagcagattactacgagaaaacatacatgtctgtgtgacttcgtcaacaatgggaaaactttatcactgaaataaaatattgcttcgtcaacaatggatcagttggtgagttcttaaactgataaataaatggctgtgtgactcctacgtttgcaatatgcttgggtcctgccactgtaaaatctggtgataatttgggtcccgtcattgtaaaatatcattcaaccatgataccaataatttgaactattgattgaggcagagcggaaaataatttgtacggttgattgagacagagcggatacaaactttcttcattgcctctgacgaagaactgggaggcagtaaaaagaaggggtgaacgattgagtttgtaatgtaagtacaagggtcatgggactgcacctgagaggggagatgatggcgctaggtccacgactgcccggaatgcctcgccttagcacctcccaccctttcgtcatccccaccctcctccacgcacctagctagctagcaccgtgccggcctatagggcaagcgcccgtagatgacagaggcggcgtggtgagccgtgagcagaaggggcagagggtgacggagcggcacagcgatgagggcacgggggagtggcggcgctggcgtgaagatccatgtctgcaagagggagtgatggcgacctgatggcggcagcggcgctggcgacgggcgtggggtgcggagcggtggaagggagggagcgcgtgggaagggaggggaacgacggtgagcgcacaacgacgtgattttggggatagtgcggctgccgagaggcgatggcgatctgcgcagcggggccgcaggggtcaggagcggagagggtggagggggattagggttaggggagcgcgggcgcgggctgagtgaggagaggggcgctcgcggcgtgatttgcggggagacggggagagggatgcgtgcgtactgtggaaggaagagggggagacgtggggcgatgtgagctgttggattaagatgttattgaccgttggatgtgtgatatgatgaatgagtaacgagtaaaactatttgttcaactatagggtagatgagtaccttcaaaatataaagcaagatttttcacttggcttgtgcttaaaaacctcatatggacgaaggacagattgccatcaaggagggtatggcaaaatgactaatatcaattacaccttacgaatctggagacagttaaccacctccttgaatgtcttcttgccactgcagtttggaatacgatatgttgattaattagaattggaatacgatatgttgattaattagaatgcatcaatctcacatcctttttagttggcaccaaaagctaaacatgtattgagccacatcaccacaaaacaagagccattggatcattttcatgcgtcaccataaccatccaatagacattaaatatcaatggttatctttttcattgattatgaggtaactcaaaccacttagtgttgtatgggaaaatatg

SEQ ID NO: 68554 - DNA, 31261 bp, Oryza sativa
gaaaaagacggtatcatagcatgggttcggtgtaggaatgaaacacctctcctatatgatgcccctaagtaccatatattggaatacaaaattaagctatgtgtaaaaatatctattatcttttctcatactgggtttcaaaaagacatttccctactgtctctttattcaaaacttatatacaactagccctttcgtccaatggacatggtcacctccatgattgtcccttttggctatgccattcctccatgacaaccttgatcataagctctacttgtgtaaagctcaacttttctcccacctttgcataggtgcaaaggttaatgatggcttattactttttttgcggggtatcgcgcgatgtggctgccaaaccagcattggtaggacaagtgcctttgagatgccctggccctagacacttgaatcaatggccaatgagccagagggggatgaggtgagccagggtaaaggcatatggtaggacagtggagtatcataagggcccggtagctttctgtttcatctacaccaacacccaaccatccgtaacttcctacttggagggccctaccgatgagcgagcgatgatagcccatgagggagtggtgaaggagaggatgggtgctctgtgctttgtctgggtggagacaagttggtccaagagggaccgttggtcgcgcgtaggtaggagtgtgggaggcactcatgactacttaaactaagttttttgaaatgaatcgcacaagactgtgaggtttcaccttgataaaagatcatagctctgacagactataatcaggaaaacaaaagaaaaggacaagccacaccacatgcctacaacacaagcacctattgtagatgaacaaacaggagcataaccttccaacacactaattccatccacgcctttgcatttagggcagagaaggcaagagagaaggatggatccgctctcccttacaagaccctccaaagtgaccaacttgaggtagctagggcgctgccacaagataacaatttgtctggacgaggcattgttaggaaatagattttcaaatgattcctctagggaggatgtgacaccgaaagcgttgccgtcgaccgccctagagaaccaaggcatggttttcacctgaagcattccaaacatggagaaggaaagagattccatgacaatgccctttggagggttgcgcttcccaccctctcttgtcattttgtccaagtcattaccaacggcctccaccatccaagccccttcaatgcacaaccatcaccccagggcccactgctggccagcctcctcgccacttccttgtgcgagccccactatcaccgcctcaaggcaatgccaccactcgtcgttggtgaccagacatgaaaaggagaacaaactccgccgccgccacacctagcctcatcaagatgcttcctcctatctgcgcagaagttggcaacaccatgccctttccgtcaccaatggccaagctcaagtggatggtgagcagccacgaacaccacctcaccaagggtcaccacagtcgctccctctcctcccatcaccgcaaaagcctccaacattgccatgtctcatcatcggtgatcaagcatcacaggaggggtgcagtggccaacgttgccacacctagtcatcgcataaacgctctgatcccacccattcctgcacctccatgtgggcgggcttgcctcgccggtccgtcactctgtacccacaccgtcgcagcccaaccgagttgcctctcatgtgccaggatgccactggccgccaccacctcaggtcacctcaccgtcgttgccgtagtccctgttaaatatgtgatccgaattttaggcctacaatatattcggattagtttcctagtaggactccatgtcttttcctattaggtgtctttcttttctctcctatatatactcttgtaagccgtacagaaaggggtgacgttcctattgttatttccatacgtttgtaatcaactattcaatagtgatcattgcttgtcagcatttccacataaaattcgtgtctccattgtgcatatattttcgtaccagtcccaatgagccatcgcggcagcccatcaactagatcaagtcaggggaggggtcatttggacttggtctctccaaactccaattagctaatgtcctctctctctctctctctctctctctctctctctctctcccacacacacacatacaatcaactcgattgtcatcgatgctacctcttgcctttgcttggactagggtttgcaagcttgacccaccaacacatactgcagaaagacaatgaagtttgacgacttccttttgtgtaaggaaagggcaaatggcaaacgacatatttacaaacgaaaaataatttataataaaacatttatatacatgttcttaacaatctaaaaacaaaaggctgaaaaataaacttcaataagaaaacctcaaaataaacttcaaatttaagaatgaaaattcaaattttggctgataagtataagcataagtaaaaaataagactgcaagctccaccaatcagttatgggggataaagagggtacgatgaatttaaatccagctgacccctcaggtacaagcaagtagtagatgagcacacattttcctttcgttaatttaatgttttatagtacgctagcattgacttgacctctcctagtgcaacttgatcttcaaattgaacactgatcgacgtcgacgccttaactaagctaacagtgaacaaactcaatgcacactttagtggttacgatggaccggacgtcgacgaatgaacatccggtgtgcacattgccagctggtacgtactggctcaatcatctcaatcgcatataaaaggtagttataagtagcactttgtaagcaggtttgaggcacactgcgaagaatcaaagatggagaaacatgcagtagcattagcagcattcacttttctagccgcccccctgctgcagctgctgttgtttgtcgcggggaacggcagcagctgcaccaccagctgcggcaacgtgagcttcgagtacccgttcggcgtggaggccgggtgctaccacccggggttcgatctcacctgcaaccactcgtacagccgcccaggctgttcctgggccaagaaagcagcaccatgcatcaggtgctcgagatctccatccccaacggcaccgtgcgcatcaacagcagccgcatggtgtttgcgtctgccgttttagagaacagcaccaccatgcggtgggaggtgggtaaatcctacttcctgtcggatttaaacattatagcgttggtaggatgcaacgcccaggtctccctccgcgattggggcgatacactcgtcaactcctgcatcacgtcgtgccctctatcactcgactccggtaatggctcctgctcaggaattggctgctgtgaggcaagcattgctatgcacataccggtctacagcattagcgccaaccaagtggtggacccgggtgcaggacctgaccctaatgaaccaaattttttcgtgtacatagtagatcaggcgtcgttttatttcgacaccaacatggttactaagggcatcagcaatactcctgaagcgctcccagccatgttaaactggcttatactcagcaattcatcagcgtgctcggcatcgaccaatgcttctgcaccttcgtctgcccccgaatgttgcagcgccaacagcttctgcaaaggttacaacggtactactgctgactacgatgggtatcggtgctactgctccgatggctatgaaggaaatccttatgttgatggtggatgccgcggtaagtatgtagtactacctccgtttcagattataagactttttagcattgtctatattcaatagatgttaataaatctagacacacatatatgtctacattcattaacatatatatgaatgtgggtaatgttagaaagtcttataatatgaaacgaaggaagtacataatatgctctagactcttctttcaatattttttttatttgtaattgtatttcaatattaactctaaactcatcatttaatatttcttattttataattttgaattttatttattctaaattgtatttctatatcaactttatactatttttccaatatttcttattttacttatatctagattgtatttatatatcgactccatactatttttccaatatttcttattttacttatatctaaattgtatttctatatgcactttaaagtctaaaatacaattttaattttattatattttattctgaatttcagttagttctaaatttctatatggactttatactattcttcaatattccttttttaaaaattttgattttttttttgttatttctaaattgtatttctatatggactctacccctttgcctttaattttcttttttttaattccaaattttagttggttcaaaattgtatacaatatggactctagacacctctttcaatatactccctctattttaatatatgacgtagttgacttttttttatgatacgttaacaattctttttttagaaaaagttgtgtaattatcatttattttattgtgacttaatttttcatcaaatattctttaagcatgacttgaatatatatttttatatttacacaaaattttgaataagacaaatggtcaaatatttgttaaaatatcaacagtgtaatatattaaaaaaggaggtagtaccttatttcttaattccaaatttcagctatttttaaattgtattttctacatggactctattttttttccgattaatatgagaaattctaaaccatgagaacgaacgtggaggtttttttccctgttactttaataagttaatagattgaccggggatttattccacacctcagcaagtgtggaattaatcatttccaacaagtctccttctattttcgtgagatgagattaactgaacaaactaggctttaactatttataagtgaaaaccgactaacctttgctatcggttttgtccttgattggtggatgctatcaacttacattaagttttatatttattactttcttacagagttattacagtagaaagacttagtcatatttttactgtaaaaagtctaataacgtataccctctgtcttaccggccgacatagtggtaataagtgcgttcttattttagtctacccttctcttatttaatctaacttaatttgttctgttcgtctagatatcgatgaatgcaaatctccacacatctacccctgttacggcgactgcaaaaatacacgaggagggtatgattgccagtgccatcatggatacaagggaaacgcttcgatactgaatggatgtcaaggtacgcatatatactcccatcgtatcaaactacaattactttatgcctctccctattgacagagaagtacgtaatagacaggcagagtagcttcatagagaaatttaataattagattttttttgttaatttgttttaattgacacttgtttggcgaagtccatatatatcccggcccatcgttggggatagcctgccagacaaggccttgtagagttgcataataattttccaacatggcaacccataattttgatactaagctatttagtttcaattccgttgtattatgtaatgtaaataaaataaaatgaagttttactttcattttttttaatagattgtcccataattttccagcattgctacccgtccttccattatatatgcttactaatttatacttcttctgggcaaatttatttgacgttgatataacttagtttagttcattagacatcaaatatttcttaatagagagagtaattgataattttatttttcccgtggtatttgtctagatattaacgagtgtgcggaaccagaaaaatactcatgctatggtggactctgcataaatacgccaggagcttttgtttgccgctgccacgacggaagctacggtgatcccttcacaaaaggagggtgccgttcatctaaaggtgacattattgcacaactatactacgtaccggctatatattaatctatctatgtatgcctatgttaattagaaacttcgaagatgtttcacgttaaccgaagaaacagtgcacaactctaatcatccgccgaattaatgggtgaattaaaaagaaggaacccctacgagttacaagttgattatcagtaattttaaaattcaaaattatactaaaaatatactgacttgagagttcaaacgcaggtaaaacattatatttattaattatgtgttctaaaattattgaacattgagaaaaacataaatcgagacattcacttcttcatttttattttataaataattgtattaataaaatataatgttaatgtagaatcgtaaagggtatttctttaccccaaaagctagccactaagaatgggttgaattagttagtaccacaaattttgacaatttaaccctttgcaaaaactatttttacaaatgaaccaccatcaaaacttatttcaaaaatgacccttttgttcagcggcaaatcgtgtggcgctgaacttagatacctcagtgccaaatagcacggcgctgaatgtatgttggcacgctgacttagcctcccatccgcggtggcacggcattcagcgacagttgacgtgacgctgaggtgtctaaattcaacgccacacgatttggcgctgaaaaaaatgatcatttttgaaataagttttggcggcggtttatttataaaattagtttttgcaaaaagttaaattgtcaaaatttgtgtagttagtacagtcttcagctgcgactgtgccactctagccatggctacagtgatgggcacgaaagaaaggggtcgatcgaggaagaactaagggatatggtgacaaaatatgtcaacaaaaccattgccaagtttactttcaaaaaagaacaaaatcattgccaagtaagatgtttaactagacgaaattcttttgtgtgcgtacgtgcgcttttagccttcttttcataatgtagtatagatttttcaaaggaggtgtaccgaggcgcaccacaatgccccaattatttatttttatcattgtgctaatgtaactctcgttccgcaattaaaagttcatccctgcataatcatgaaattagtttcttaatgtatcctttcttcaggtttgaccattggtctaatagtcagcggtggttcagtccttctacttctagggcttgctgctcccttcatagttcgcaaggtcaagctacaaagggtaaagaaaatgagggataaattctttatgcaaaaccatgggttattattacaacagttaatatcacgaaacacagacttcgccgaaagaatgatcattaccttacaagagcttgagattgctacaaacaattttgacaaatctcgtgaggttggtactggaggacatggggtcgtgtataaagggattatagatctacatgttgtggccatcaagaaatcaaagattgttgtgcaaagagaaatagatgaattcataaatgaagtcgcaattctttcccaagtgaaccatagaaatgtggtaaagctcctcggatgttgccttgagacagaagttccattattagtttatgagttcatttcaaatggaaccctttaccatcatcttcatgttgaaggatctatatcattaccttgggatgatagattaaggatagctcttgaagttgctagagctctttcatatctgcattcatcggcatcaatgccaatattttatagagatattaaatcttccaatatacttcttgatgacaacctaacagcaaaggtatccgactttagagcttcaagatatatctcaatcaatgaaacaggaataactactgcagttcaaggaacgattggctacttggatcctatgtactattatacgggacgacttacgagcaagagtgatgtttttagttttggtgttcttcttatggagctacttactcgaaagaaacccatcggtggtacatttgataatggcgatggtcttgtttcacatgttatctcacttctctcaaaaggtaatctttataatataatagattctcaagttaaagaagaggaagatggagaagtcctagaagtggcaacactagccacaacatgtactaagtttaaaggagaagagcggcctacgatgagagaagtagagatggcactggaaagcatagtttcaaagaaaagctccttctgtaacaagaacagtcaatcaagtagtagatccgatgaaaatcgaattttagctctttacatgtcgatcgaaggagttaccaaggacaaaacaattacaattacagaaagcagcacggaaggggaaataccattgtcgtcaaggttttctcgataatcattctctgtcctgaacgagaacgccttgcaagaaagccggaaacttagttacatcgatcctgttctgttctaaatgattgctaaagtaattttgctgtaaaacaataataatgcaacagaaaaattgtgtcgtatcagaactttgaagtacttgtggtttagttcatgttgattaagcatctgattcgatcagtttgctctaatggactgaaattgcagagtgccgtttgtgttttcattattcattgaattattctgctagcggctgcagagcccatcggctctgtaggcgttcatttttacagtttatctatcgcacccgcgaagaaagataatttcgttctttcttatagaataaaaagggaaaaaactcacttctacttattttttttaacatggatggaatgaaaactatgtcctatcaccctcgaagcggtgaaaataatgcttcggcccgagtgtccgaggctccggacgcctctccgctcggcccatttctctctagaaagtcgagtcctccatcttccctttaccattttttctccgctccatctccggagaattttcagaatttgccatccaatacgcactatctttaggatatgccatccaattcgtactacttttaaaatatgtcactgggacgtgaattttcttcactctatgccactccgtccgatgtcagtcctcgtcgtcgttcgtccgtctgctgccgctcgcatccccttctatccgtcggtgccccctcccctcccctcgggtccattcgccggcgctggccccgtctcgccgtccatcctccggcaccgcccgcgtccccgtccaccggtgccaccaacggcgacagttggactcggcagcagctcctcttcacagcatgtccactcgggggcgagggcgggtggagagttcgggggttggggcggggctggggtcgttccagcccaaccgctcccgatccaccccgttgccatccctattgacaagcttgtttctcatccagctcataaggttttttgttttgttggtcttttttataagtttctaatggaacatctgcaattgcaaggaacttccaagctgtattagtaggatcctccacaactcagcgcgatttcaacaaaacttgagaacttggcacttccctgcagtcctgtactgttcgtgtaataacttatacttcctccgtcccaaaaaaataaatctaatacggaatgtggcacattctagcactacgaagaaaaagattactagctttttaggagtagttcaaacgaaacaacatgtttgcctccctttgatccttgcagttatcaccatagatctgccaaactgatatgttctatgccgaacagttaactgaacttacaatggatattcagttatacattgtcagtgcaccaacacaaggtgactgaatagtaattcattagtaactaagttcagatcgccttatgagtccgatgtgtttatcattcctacaaggacagattcagacgatgattctagtggcagtgaaacatgcaggatatgaagagtggaactggtgcagattgtagagagaactgatcaagctaggtacgctcctgttaatcatgatatattatgaaaagaaacagaagagatcagaagggaactttttcttgtagagtatgcaatcttgctgatcaatttacagggatcactgatgtatctactgttgtaaagaacatgtgcaacaatggaaattcagaactattgctttcttagcgaaaaaagataagaaagatatgtctgacatgcaagaattctgatttctggaggtgttgcactgctctgaaaagtgcagaataccagtatatgactataagaattttgtagctgtctttgcctcaacaatatcaagtgctttgttgaggtaaacagtttcagaatagctttgttccttctagaaaaaaaaaatcccatgaaatgtttttcatgtctgctcaaggaaatgacagggaaaggtggaaaagaaaatgaatcactcctgcattttctaaacctgaatctcagccagataatttccatccaacggatgagacgagcaaaccaggggttcggagaacaattcaccgaccccaaccaaagataccccctacccatcagcacagccgccggtgaagttgccggcacttgtgtccatcttgaaatccaaaattttccctggaaaattttcggatggatccaagacacctgcagcagtttctctttgaaacacaagattttaaaaaatagaaatatataatgttactcctgacggctcattgaatcctacagaaaatgaatccacaagtttgttttctaaaataaatgtttcgtactatatagataaaattttaacaaacatgcacttagaatatgccaatttcattgaatagagagagaaacaatgtacaaaaatatgaaaactgtacaaaacagaaaaagaaaaaagaaagccggtaaatcatttatattttggaatgtggtcaatagcactatcggagaacatgggaattttgagaaaggagaagagaaacaataagatctacgtatcttcctgataaattttctttaaaatttctataaaataagctattcgataggaattttaaacaatttcgagagggacatttcttttctcgaaaaggaccctataggaattaatgtgttccaaagaattttaatcccctaaattttctttatttttttctttgttacaaaagagccctaagttccgaacacggtgaaatgaaactgaaacgaaggcaccactagccgacaccaccggcaggcagctcgcagccatctggcccatctccatctcaacctctcacggacacacggacgatcggtcgacggatggacaaaggaacagccacaaaaacaaccagttaatttccatctcaatccacgcaacattggtcactgatatatataccctctaaacggtttacatatcagccatacttaaagttagacaaaaaaaagtactacagtacagaggatatgtgttccatactcgaccatgcaatagtcacgagctgcctcttcgtcgtctagagacagacaaacagcttatcctacccgacactactagaaaaaaaaattcgtagacgatgtgcttttaacttttcaggcggtctttttttttttggcaccatatgtccgcctgcaatataggggcgaggggcaagatgactgtccgtctgggaagatatccattttaagagctccgcttatatctttgtaggcagcgtgttatctcgtccgcatgagaagattgacctatatagtattcttcctccccgagttgagctttgtagagtttacaggaagtttctctattcaaaaacaagcaaaatatagaaaggagattttgaacttgaaattttcgatgaaattttctacaataattagatcatacatttgcgcgacagcctcaagcacgcggatatggatcctctgcagtactacacatacagtagctgccactgacaggtggaccggtcccacatgtcagtggtagtagcgtcccacatgtcagtggcagctactacatatacagtactgcagacaatccccactgcaagcacgcacatacgcaagcatgcaaaatcgatcgatcgatcgatattaggtcgtcgccgacgatgacaggacactcccggtcgattggccgcgaccgtttgtcaatggaatatctctctttctttctttctttctcgacgagtccaatcacatcatgattcatgcatggccatcaacggcgtgcgtgcgatcgagccgatgcatgcgggcgcttgccggccgcggcggcgacggcgatgcgacaggccggatcgatcgctggtgttgctcgctttttcttccctttccggcgaggtcgatcgacaacgacgacatgaatgaatgattcgtgagtcaaatgtacggtggacgaccatgcaccaatcagcccggctagtgctagtgctagtgctatccccacacgaccactctctcgagttcccctagatagatcctgtttcttttttcttttcctgattcatggacgttttccatcctctttggttatgaaaatgcgccgttttagatattggcacggtctcaacatatatttaattttaacatgtcatttttaattttttatgtatctgtacagctcggaaatacaattttaactcctatcgtaaatatttgcacatataactggaagagcttacgatattaaaagaatgcgtgtttttttttcattttaaaagtttgactttagagatagtatgttttcatggtcataaccagactagcatagtacttcctccttccaaaaatctgagacctattttattctttggtttctctaaaaatctgagtcatatttggagtcactatgtgctaaattaaattgttgaccagaaaccaagaagccattttagtacttattggttgcatgttcattatttttgccacatggtgagtgagttaattgcttcttggttttgatgaaaaagaaataggtatcagatttttggaaggaatgagtagcatataatattatggtgatgtttaaaaaaccaccattatatctctattaatttaaagcccattcgctgctccccatatatatattagcacccaaccattgtcttcaccaaaaaaaaccaagcaattgattaataaaaaaaactggctgtattagttgctttcctcactcccagcccatttctaattatacaggcccgttgtaacatatcagtaagttactcgtattaattagtattaaaggcataaattaattttcctgttatgagtgcgtcttgttaaattaacatgtggtataattggaagaggttgtactgtacatggtgtttcatcataggtttgtagaatctcttgttaaataatacagcaatcatgtggagaaaatgtgtacttttgggtgcatatagtacaattagtactaagcaagatttgtccatcgcatactagctgtcggctgcgcatctctgccttcatttctcagtcaaatagctaatcatttggggaaagtagatttgttggaagcaaagaagccttttcttttatttcttctccttttatgcctgcctaatttcactggcctgaaagtgaagtcagttgtcatacggagtgacatgacaatagatagatttatttgaaggacttgaggtaggtagatgaaagaaagcctttgtttccatcctcccctattcagcatgaccgaggttccatcgcgatttttgacattatggtcctcatataaaacttattttataaaatatgctctaaaaactaatttagaaatgagtaaattgcgtattagatccccttatgagaccattgtggtagcctgaaccagggtaaagcaacattttcatattggactggttatatttaccaaatgattcactttggtcctggttcttctatacctagctagcgtcagcaccgtgctcgtgccaagctctcctagggtcagctacttagcattgaaggcgcatacttatgatggaggtcaatctccctatctgggttcgtacttaagcttaggaacgaacaagagaaaagagagaaaaacttcccccattgctgtggagagggtgtttagtggtcaggtgggggtgtgagaagagcaagtttccgtgtacatccttggccaaggacatgagcgacctgcttctcgggctggcttggctttggcttggtgaaggtgtactgatcgatgtcggcagtgaggaggattttgtggagatcgtagtgggggacatagtagtattccccccaagggcattagctgtgtacttgggatgtcaccaagcccatggacaagctctaacttgaggtcatgcaaggcgacgggtggtttgcaggctgaaggttgagcacagtggtgtcaccgactagactcaagatcgagcatcggaatggtgccaaccggaactgacgacctcatcgacagtgcttggctttggccatatggagagaagagagccattagagggagagaagagagagatggagctggactgctggaggaagaacgggtccgagttgaaataattggcaaagacagatggtccaaagtgataatgtgtgtttaccccagtccaacttgcaaccatggtaaaaatatgtggcccaacatgcaatttactctttaaaaatagacccatagcttgccgccaaagacattggtatcgatgttatatgtatatacatgatagacgttggcaccaacatgtggttgccaagagtcacactggtgttgacatggctagaggttgcttcaagaagcctagcacagatggtcaaaggtgaaggccatctcatgagatgtagcgcaaaattacagacccaccatctctaggtaactagctcgaccttgccctccatcgacatcgtccatgggcacctggctcgaccttgccctccacagacaccacatctggaatcgaccaagcctctagcctccagacaggttgtccctaggcttgacgccagcctccatctaagacatctctaagctcaatctctgcccaagttgtctcaggctcaatatgtaatcctatgcccgtaccatctcgggcttggccattcttgagcttgacatccatttctgccagcgtagctagccagcttgacatcgggatctgcccatgccctctcgggcttgagctccccccccccttctatcataggctcgagctcagtttccacccttgtcgtccccaagctaggtctccgcatgtgttgtcccttactaggttggacctcacctctgcttgcgacatccatggcagctggtaacgcagcatgggggacgagggtcggtaccagagccattagtaccaatctctaggcacgctaggttggcttggtccaccacatgtgttggggctcggtgacagggactccagctccatggcttcaggacccgaataagtttttcagaggtttgtttctaaaatggctaaagtattaaaagtgcaaaatgtactaatatataaaactttttgagtatgagtaaaacttaataaaagaatatggctaatttatcagtaaacaaatcaaccacaagtgcatttaggtaaaagaatagaacataggactctttggggggcatagctaaaacaaactcaaatgcacctccaagctaacatatattaggttcggatttcatattcctattttcagtaattacacagtaaatttctttgataataaaggtaccttctattctttacatcagctatagatccacgtatctactccctccatcccataatataaggcacaaccactttccttaaatgttccataatataagtcatgcatgcaagcatgcaattaactataacatcttctctattaaattataacttttttaaatcctccactctcatgttatctaatcctattggatgcatgcattttatttattaggatgatccaaactacaagatgataataattatttcttggtctttgggttaaggatggctgtgccttatattttggaatggagagagtatatcacacaaatatttatcaggtgattagatactctatgtatggatagacacatgagcctttttggagagcttctgggagttgcaaatttttctcaaatcaaaagttttcctcaacagttagcttttcgtccaaattatgatgatatagttgcataatctgataatgaattagaaaccagaaaacattttttcagcttatccagatcttactctataaattctcactaataatctaaagctccttaaaacatccccatgaagtcctagctatcgatatgatccaccgctatctccgactttaactatgacaaaatgcagatcaatggaacatatttggctaaaaaaaactcttaaaaagtgcaagtgtaaacactagtagatgctaccagcagctataggtcttaaaaattttcaaccccctaggtcgccaatttctcacattggcaggtaaacttttgcagtaagtaggtagccagcatcagatccaaaagtcaaaaccagcagctcaagaacacaggcagtatctcgtatatatggactaaacaaaggtgatgaagatagcgacgctaatgccgcgccttaattagtaattaatagtgatccacgtttcgtgctgcatattgctctaccctttgtatatttctcgtcatacgcttggtcggggagagtgtgaatcccgaggacggtaaattcttggattcgtgtccatttcttaaaatggattaattcctcgagcgatgttgccgtggcgctgtgaacggagcacacagcgctgtagccataggaattttacagaatttctacagtaactttgtaagagattgctggttaattttttccattataaaaattatccaatgtttctttttttttaacgactcgcacaagacggtgcgaagttcataaggagttaagggaagacgtttttttccatgcaagttagttgagtttccaaataattgattcatttacaatgaaaaacagacacatttaatgttatttgggaattcaaattagcaattcagttatttacatatgagtgcttaagtttttttcgtgggttcaaaggaagcatagataatatgatgatgtgttaggggtacatgacttcagtcatcagggttaacaactctactaatcaacgtataaagtttggtgtccacatatattacgcatatggtgagtaggctttcgataagaatttagtaaagctacagatacagtaggcgtgtgtttgaaggcgcacttataggtgtgtgtgtgtgtttgtgcatgagtatatatagtgtgcgtgtgcagccaagaaaaaataattcgaactaagatattattatctttatcccctaaaatggggagtactttgaaaacacatatgtagtggctgcaattgtctgtactactgcaaatttactatgcatagagaaaggtttgatacatgagggggaccataaaaagttaaggatattgaccttgtttatcctctaaagtcgaaaacactagcaaaacaaactctaaattgtaagtctggtaagctaattaagtggcttgaccagtcaaaaagagcttacaggggagtaacaggaaaagggaagctttgaacagttgtggtgtcaacaggttatggacaaggatgtgatgcaacataagagagaaaacaaatatttatgagaagtgtccttggtggtggttgttagggcacaaacaagtagatgtgtagaaggaggctagctgtacatcaccagcatattaaaccaaactacaagaaaaaaatgacaaaatgcaagtgtgtataaaaaccagtagaaataaatgacaaaacaatcaaatgtatataagctagctaaaaaaaactattagtagttctcaacaaccacttctcaatcatagaagctatgtcacaacagaacacaaagtgcatgactggtccattagtcaagagtgatcaagagtctcaaaaccacacgctaaaggcacctaaaagacaaaaaggctatgagcataacgtttgctcaatgattctttgcaatgacaggagatatcaattttgcattgcaaaattatatgcaggactaagtttcttgaagattttactctagactgacataatatggttactggaaactactgcatagagactagagagagaaaattcataatatatttcagtacttatgttagtaaacagtaactgcattgcactccagaaccagggaataatctagattctagagtagatagagacgtgtatgattcacatgtatgctcatggtctcatggatgattcttccttgaagaacattacaataacatctcaaatgcagaagcaaatgattaaattataaagctgtaatattgcacttgagctccataccaattaaaaggtgactttatacatatatatagtcatatatatgaaatcttcaggaccatctcaatttctggtgataagaccaatggccttacatcataatcaaacgagctaaaagacagtctcagcaagctaattaaagcagcaagaacggcaacaggtgccaaggagaggaaagcagaaaagaaaaagaaagaaaaaagagaggatttgaattaattcagagagagaaaaaatgcctggccttcctgcataccatcatatgatcagtaccatggaacggtttcttcttcaccaaaactcgatctcctccattttgttgagctaagctcgcatggcggcctccatgccttggctctgcagaagaactactgagagaagacgacggcggcggcggcggcggcggcgacgacgaggtcaccggaatggcctcccggagacgaggaggagcagggaagcatggtgaggaagggaaggcaggttgaaggagatggtggcattggcatcctcctcttccttcttcatatgtcccaatgaactggtgctacttgcacaaagcacaagcgtgtgggttagagagagagagagagagagtggagggagggaggtttctctctgcacctagatgtaaatgtatttttggttagaatactagaggtttttaagcacacacaactagcttaggctgtgttcgcatgcaccttttcccatcccctcttcttcgttttccgcgcgcacgcttttcaaactattaaacggtgtattttttgtaaaaagtttctatacgaaagttgcttaaaaaatcaaattaatcaattttttaaaaaaaattagctaatacttaattaattacgtgttaatggaccgctccgttttccgtgcacaggagttaggttcccatctcccccatccgaactcagccttagcagtagcatgagtttacacatcaggatcatctgtggccgcagtccatgtggacagctatcagctcatgttcactaaccataccataaaaaaaataaggttttatggagccctctactgtatctttttctaaaagggtgtaaaaactattggatgtttacctctgttacactttaccactatcaacaattcaagaagaaaaatgaaatctagatgaacaatactgcaatgttgttttttctaggtacaagagaaaaccccgctctatattattgttgtacaaacccagatactgtaatgttgtcatataaagtaaatgtgaatggatatataaaacatctaatgcgtcatatttccaaaatacaaagcagtggaagtataatttagcagattgctagagatatggaggttaatttgattggaggggacaaatataaaatgcataaaaattgtacataaggaacttttttatattatttagtaacgaacaagtgacaacttgcatgtgtatgtttgtctttcacataatacgaaaattataactactcgcaaaatggtttaaatctattgttatttgtcaaataaccaaagaagaaaacattgctacaactataagaaaagaaatcagttgcctttagactttagtaatttgtcagataaccagaccatacacaaatgcaatgactaccaatgagctcgctctaaccagaccatacacaaatgcaatgactaccaatgatgcagaaaatcaaagccttttaggagagataagggagaagattgttcccataaggagctgaccaagagaacgagttataaggctttggcttgctgatcaaagcagaagtgtaggggtccaaaagtgaaagaacaccgtcttttttctccaatctcacgtgggatcaattccatctttcacacagtgaaagtttctaagagaagggtttttttaggcttgccagttagcaggggtgacttctgttttgccattcaaatctctgtttgagaagagggttgaacaatatgtgtatgcatgtgctgttgaccagcaccttttcatgtggaacacaagcaatagcaaatccctatttttgtaagatatatgagtgtgtttaaaagtaaatctaatcatttggttttccattaaaaaaaatcaaacctttcctctagattgcaagcctgcagttctaatcatgttggaagcctagaactgtaagaaataatagttggccatgcttgtcttgggtttgagtcgattttgaattttaggtttgatttcttaaaagaataattttaattagctagcttttgtacttgttttctagcgatcatgatagccagacaacaaaaataacaatattcaaaatcacctctagatttttatcctagctccaataagcagtagtagggtacgattcatatgttgatatgtggtaacacgttgcgattccacatgtacatgtggtgatgtttgtgcatgtgcactttccttgtaattgtaaaatataaacttgcaaagaagggataacctagtaaaaaaaatgcacttcctccgtttcatattataagactttctagcatcatccacattcatatatatattaatgaatctagatatatatgtgtctagattcattaacatctatatgaatgtgggcaatgctagaaagtcttataacatataacggaggtagtacctgattttcaccaaaacattgagtgatgaaatcactggtagttgcaacctattttcttcatccataatcgaagaccgcaaaaagctagatctaagagtgatccatggagaaggctcataggtgggctaggttggtgatggtgcgatgacgtggatgaatagtcaaaacagcgacgagggaatagagagaaggcaacttggtagtgctttatatattagggttgccgtaggtacttgagatccaatggtccactattagagttgtcatatataataggtgatccaacggtctaaagagcacataacctagtagggaaaaaacattgaaatggtacctttacttacaatgtttatttctaaatgtctcagagaaaatataaattatagaggataaaatacaataaagattcctcacatgaacagctaactagggcctacctcaccatattcgccctcttatagcgaaactaggtgcatggaaatattgttccctcgtgttgttatctcacattatttttatggataaggaagcaaaaacagatcgcgtgagatatcaccatgagaagaaatggaacagtgagatgtccccatggaaaataaatactccctccgtcccagtttagagggcgctaaatatttctaccggtgtcccacaatagaaggcgcatgttcaaatttgttctgtttctcccgagattagccccgttaatgatgtatgcatgcagtttcaaattggctgtgcgtagagcatgcagagagacgggttgggcccaaccagatatatgcagtctttttttaaattaggaacttagcctattgaacaagaaacttagttctcaaataacccaatctgaaattcgctcctatggagattttaactcgggaccttggagtgttattcagctcactgcaaccactaggctatatgccctttcacggataccaacataagcagaataatttttggcatagagagaaggagtagaatctggctacgtgtgtgaggaagaaataggaccaaaccaaaccgagaaagctactccctctattcatagatataagtattcgaagtatctaaagttcgttcacaaatatataagcattccaaagtaaaacttattcatcaatcacctcttatttgaatttcgtcttaccttaccattaaccacccaccccatttatcctttgttttaaaaaagcaaacatctctactaaacaacttacaaatgtctatatttattgataggagtataatagtccaaataagatgaggactgaggcaggggcggatttacaacgggggcggaggggtcttgagactccactaccgctcccgggacagtggagacccccctaagcccccactaaatttttttcccatagatccataggatgtggggactggaggttcgacttatgctgatgtagtttattcagctcccactactatttttttctagatccgcccctggactgaggagatgagaaaggtagggaaagggcaaggccatgggccaccatgcaccgcggcacaaagcggtgtacagagcaacaacgggggcaccactttgaccaccaccgccgccggggccgccacttcacggcttcactcccctcccggccctgccgcatcacgtgcaccccgggcccaccaccggtggtaggcccaccgtcgcaggcccccctcactctctcagactctcagtcggttggttcaatcgcgacgcgaattcgctcgcaggcgttgaggtcagtaaggaggaggggcaggaaggtcatttcgcgcgccatgaattgcaattgcccatacggaggtcgcacgtgcgggggatcgggcccaccggtcggacgttggcgggaccgaatcccgcgacatcggcccggctcttccaccgataatgcccccgcggctacacaaacatgatggtccatgactcgatggacacacagcttccattccgattcctcccaatcccgacgccaacctccgtctccctcccgtccatgccatactacagcaagtatagcagtagcagcgttgcgttgtcgccgtcccaactcccaaaccggccagcagcatcaccttaggcttagagacaaaacggcaactgtggagaaatacaaggggcgcagcgcaccaatccaccaccatgacccaaaaaaaaacacacacacatcatcagagtgcaaccaaccaaccaaccaacaaggaaagaggcaaaatacgtcctagtacatcaacaggcgtggattggcaaggagagttttggaagtttcctgtccagaaaattggtagtagcatgtagcctcagcgtattctaaaagcaggccgtaggacaaaacaagctcgcaccttgaaaagataggccgaggcacagcacaagtagctgtactctacagactctacacggtggctcgtgacaagagaagaaccaagtctggtgttttcaccttttcaccttcctcgccaggttgaagcacaactgcacaagtggtctttgctaacagcggctgtcagtaatctttactagggcttgggttaatgtctcactcctctagtcgtcgagccaaccagaggagccgtgcatgaaaggcggatggtccatgcctctggacagaaattctggaggtgggtaccatccttgccacaagtcatttcttggggcgaactggagtccagggaagggaattcttggagcaggaacgaacggtaatgcagggagatcactcgttgtctgtggcagatattttgcaaccactgcatcgacctcagaagcagcagggggtgcaggtagtgaatcttccagctgtctgcaaccagcaccagcttcaggtgtccctctggacagtgtgtcttccagcctttgatattgcaacccagctgaaagcctgcctcctccaggaagtgaaacgatcggctgcccagaaaagccaggtacgagttcatccagaggaggtggtgtgtcttccagcatcttgtattgaactccagctgcatctgcaggtctctctgtgagtggtgaattttccaggctatggtactcaatgccagctgatgtcacctcatcacaatccgcaaaaccagttggttgttccacaggtgcacttccaacatgatcgtgggcttctgaaccagtatgcccatgctctgagtttgacatagtttcggtttgtttttcacaatcgctcttgtcagatgatgaaatgctcatgtcagatccacaacccatgcctgcatgatattcatgggttggatcatttcttccctcgtagttgcaaggctgccgtgatcttccattggtatctgtccagtagtcccctggcgagctagtaggatcatggtatgtgtcagacaacaactgatctataacagaggcatttagtggtgcctcttcttgtctttctttgttgtcaaggtcatcatccccctcattagccatttgtgcatgccctgtgtttacaacagacctttgagtatcatctaagcaccacacatttttactgatgtgccccattgttttagctatttccttgtgtttccgagcccaatcactacggctccatagagaaagaggaggtggtgacatattccattgttccataatcttgttatcagcatcaagcgacccaggcaaatagaacgactacagttttccaaagaaacagtcagaacggaattttgcaacaccatgtcaaggataacatgcaactgtaccaaggagagtactatcgtacctttcctgcaagctgatgagaatcctcccatattagctcatatggtgggtatttcctgtccagcctaccagacattaaaaaatggagctgtgttaacaatcaatgacagccacaagtatatatggagagtgggacagtacctttcagtttccttaggaacaatgagtatgatcagcttgggcttgaaagtgagggctttattaatgaattgattagcaagagaagctttaaacccaaacggaggattcaatcccatgatctgagggaaatagcaaatatcaagtagagaaaactgagactttctgtgagaacaaataaaatgaatggctgggttgtgagtataccaatcgacatcctgtgggcaattcatctggttgaacggtcatccagtctcgtctctcaaaattgaagtcattctagggaaagaggtatgttgtgtcagcttcaacacaggatagggtgtgacaaaaatatttatcaggtgcatgactaggccctcatatatgtagcttttacccttttaatctccccggtatttccatcttactgaacgtatctatttcatgcatggtaacttgttcaatattaaaaaaaacatcatatattacccccacctttggttgaataagatcaaaatttttatagaagcaacttttttcagaagcttcaagcttttccttcaataataagctaaaatcatttgagccacagcaaaagtcaacaacctaaaacagacaggaaaaggaatgtgtagtgaattgttagaagtggcacatctggatcatgtgtaaaggtcttctatttttattatgaacccaaaaaaattggtacaatcaatatcagatggaaaactaaacatagcattaagttggtagatcaacagcattgcaagcacgattacaaagagtcaaatcaagacatcaataaaatagaaaatctgccatcatctacttctcttgaaacacagtatgaagatttgagaggttaatccaagggtataaagcaagtggcattaaacacttgacagatcgagcagacggtgacacataaatcctactattacattattgcaatcatttagtatctatgctaagcagctagggtaattgtttgcatagtatcgaaattaggacattgaggttatccattgtcatgactcggcataatatcaaaatccatagagcaagattagcacgaataaatgaaaatatatctccgtgttagtttttgagagccagcaggctcttcccagactcccagtacaaataaacaactgcccgagctaatttacttcatttgaacctggatatctaagcttggcaaggataaagcatcgatacaatatcgctacaatcgaacaccagaatttatgcagatgtatgacacaaaaagcaagcacattgaaacctgtatgttgcatcacttatgcacattcatgatgaccaaatttacataacaaagcagaacaaacatgtaccgtatcaccactttcaatataccattgtagcctatctacaatctgcataatttaaacattgttatgtcagtactaaaaacagcatcagaagaaggtagaaactagagtatataatagttaagcataacaataaccccgaggtaagaataaccactatttttcagtgctaataaaaacagggcatgaaatcaaacaacagtggttatgaaaattgaaatatgaagtttggttttcattcatcacaattgaattcacaagtggtaaaaagtagcaaaaggatatagatctctagaaatttccattggtaataccaaatgaaacaaattcctacttttgtttattggtgcagtggacatatttatgcaagcaaatcacaagacaagattgacacttgaataagattttaaaaaaaatgtgtttgattcctttgtccacgtttaactctcagcacataaaaatacagcaaaatggtacatgccaaggaatggtagaggggtagcataatttgttcttgcttaattttaatcatggcaacttcttctctaaacagagggaggccaaacagttccttctatgaaatgatgatcatctctccatcttgagacaaagggagtggtaattaaaatatttgacaagtgatgtgtaccactgcatatgaatgtgcagaggtccaaacataaacctcattgacacagtaattgtctggaactttggattcacaagtaatatttgcagggctatttgataattggaacattgtttttccaagtattcatcacgaaacaatttaattcatgcagaaccaaacaatttatagttgagtaatgaagagtaaactgaacaagagttgaaggacgagatatagatttctttttccaattacaaaatcaagtacaactttgttaaaactgacgataatgagcaaagaattggcaagaatatccatttaaaagaaacttgatcggtgggggaaagaccacccccacggctttttcacgaagaagcctcagcagccaaagccagccaagaaagtccatgaaccctggtcccttgacacgaggacctgccccccatggttcgggccttaatctgtgctttgaggcccctgtcccgtacacgagggcttgcccacaggttgttttctaacacgtgttttaaccgaggggccagcgagtgtcctttttaaaaccaaccctgaaaacttgctcccaaggggagttgaactagacgctggtaggtgctactagagtgttgtggccactggctacagacccgttcgcaagaatatttatttcatgacaagactgttttgggttaacatttaaaaataatatttataacttccgaaatcaaaatgttatcttccaaaggaaaattaaaaggatgatagatcagtacagcaaaataaccaacccacagtattactgatctgcataccaacctgctcgagtttgtccagtttggtgaagtggcgcccataagatgtgtagcgcatgccatgaagaaatggtgcaagatatatattcagtttattctgcagacaatagttcatgatatcatggatagaagaggttttgttatttctatacagactacaaacttgcttttagcatatatcactccacacaatcataagcaattacaagcatgttagaatcataggaatttttctattatctggtgtgatgttgaccattctcattgtgcataaagagaaacaaactataaggcctattacatataagaatgagacacaggagttcataatattcagcagtaaaccattgttacagcaaggaagtgtgttttcaatatattcatgtaccttccaccttgcaagttggaaaagatcactaggtgcacatacagatttgacatcttctatggatgcaccattttctaacatatgcagagcagcatttatagcctgcaaggacaatatgtaagaatcgaccaaattcatggcatttcttttaaggaagcgcagaagagtacctcaacagatctttgcaccattcccaatgtaatcttatcagtattcttcgaaaccggtgtgtgtgtagatggaaccactagctttttttgtatatcctcaatggttatatcagatgacactttctgtgcgaactcatgaatcctgaattaaaggataatctcagctcttgcggattgcagtaaataaaaacacaacatcacctaagttcagcttcaacagacattttaaagggtatcatgcaaactgcatgtacaatgaaattttgtctgttgaataaaccatggaacaaatcatttctgaattctttgttagcagccagaaatccaacaaatttgaatacaaccatttaatcatccacaatggatgctaatcttgtcagaaattccaggtgtccccatatgatttgtaataaatttctgtattctgtttacctcttcaacttttctcaatgtgattcagtagtcagtacctttacaacagagtgtaaataaaccccaaagcagttaagcaaaataaacttggcactcactcactggtggtacaccaatccaaaaaattgcagtgtatttttttttcaaacatagttgaacagtaaaacataaaaggagtagctatggtacatggtaaaattttccaccaaagattagttttccctccttaaatattgcttctgcttcctaccattcccactcgtaggatgatcagtggattatgtgataagtttacaagattgcataaaactaactacacatgtaccatagccactcccaaattataactgtataatttttagtttcaacagctttactagagttgtttttatgcggaacaaacatttggttttcacttttgcagtcaaagttgattgcataacaaaaggaaacaatgagaactgaatgaaagaggaaaacaattaacagtagaagtgcgcaagatttacctcctctcagtgcttttatcaataacagggaatgagctcaaggggataaatgacggaactgatgttttttccctagccacagcactaagagcacaatgttttgtacctccagacacaagcactttcctctttttggttatcacatcacttgaggaaaaacggttcactgtaccaaatgattttttgtcactggacaatggggcaggtggacaatcctcaagaagccgtatcttaaccaccttcttgttcattccatttacatcgaagggctttctcgtgacagcaggattatcaggaaatttaatatgatctcttgtcggggttctaagtttaggatcaatatcatgtttcctatgcaaaaattacaagatttagtcagaaatttgtgtacttgaataacaaacgcaacaattttataaaaaaaaactgagaaatcatacaggcaaaatattaatattcggttattgggaagaaggccctcccacgccctttggaaatgaaatacaccattgtcaacgaagtcatcaaaggcgattttcctatgtatagatttgcatgtattagtttaagaataaagttaaataaatatcaactcacaaagaatgcattcatgatcaactcataaagaatatgcattagtaacccacttcctgcaaaatatgaaaaagagagaaatccttgccttggcaagcatcttctatgatatgccttgggacaccgtcggcacacagcaaactgtagctccttttcatccttgttttcaccatacttgcaaacatcacatttgtgcagtgggcatgcaaattttaccccactggctatctttgttgtatattccaatgctttggcttcattttcagtaaagagtaactgtgcaacgcatttagcatggtagaaataaccacaattcgcagatgcacagggaaatacctaaaaaataaaagcaatttatcaggtcagaagatcaaaagaaattcagacagttttaaaaggaaggaataaatcacatattagacttatagaataattttgaaggagtgcaatcaattactaatcttggaattccataacaaaagggctaaaagagattaacctcaggagtatctgttttagctgaacccaacctcatgcatgcaaaacattgatatttttcaagctcacaattcttgcacaaaaaaggattcaatgcctgtaaatatgggaaagctaagtgaatgttaccatctaatatgtgtaaaacatgtgaagtaaaaacggtatcattcatgagtggaagattcagaacagatacatcaaattgacgcctagtgtagcctagtgtttgacaatcttcaccagcatccctgacggcatgaaaagatctgaggcacttgccttcgcagctgcaagagtgtcgcagaaatgcacatcacgattggtaagttatgaatgaatacatcacagagcatttttcacagcaaacaagtgacaatagttgaggttcaagcctctaatatacaatcaataaagaacacataaattttacgagaagtacaaagaatgtgtaattttctattaattctggccactgcatctaatgctgcacaaagtcaatgtaaatcactacaaaccgtccacaccaaatgggattcacaaatttaagacaagaagctataccaatatatgatatacaaaatttcaactcgcacataaccatactagatctccattcatgcatcttgaagagctccataacagccctctccaaaagtgctgcttggcacaatagtgtttttttttacgcaattaaaaaaaattgacacaatggcacaatagttttagccactaagaatgtgtaatgtttgctcccatccaaaacatcctgctgtaaaattgagcaaaaaaaaacttcctctacacccagaagttttgctacacagcacataagatcttctcaaagtaaagtccatcaccggtccctaaacttataccgctgtgtcatcccggtccctaaactcgcaaatcgaccattcaggtcctcaaacttgttcgactgtgtcatcccggtccctaaacttgcaaatcactcatttaggtcctccaacttattcagttatatcacccctctccctaaact

SEQ ID NO: 68555 - DNA, 571 bp, Oryza sativa
ttcctgcagccccatcgtttggcatatttagtaccagagcacttccgatgcatttcttcgtattaatgcgatatacagtttgcttgcttttacactttctgggtttgtttctaatctcataaaaaaatatgcatgatattagttggagtgctatgggatcagcagcttttagtttcagaatttttctacctgctaccctagtcaagctactacacaattatgatatggggcgggctgattcatgacatatgcccattcttcatttgccatgtggatggtagatacaaatttatttgtacgtgtctttcttttaccagcgaaaattcatcgcaacattgctacattcgacactgcccgtaccttaaagggaacactgggagaaaggggcaaaagctatggacacctcatgaaagccatgctcattgtaaacctatcataatttgatttggcttcaaaatataccatactggattgctggatgcttcttcaggctatctgtattatctagactattgacaatatgtggcctgcagtgactgcccattaggactttcttttgtgggtactctta

SEQ ID NO: 68556 - DNA, 1818 bp, Oryza sativa
ttttttagctttatgtatattatttcctttagagttttgttccatctatggttgttctctcttttttagttccattggtttctttcttgtattctaggattatataaattaatttatctattcaagtagcatggtgaaaatattagaaaatcagcaacataagaacaattttgatacagtatttcagcaaatctaagaagtaggagtataaatatgagaatcaatgaactttaagaagataattggtaagcacatattgttattacaatccttcacctctatttacattattctttacttttatgtgcattcaactgacattcatgtcagtattattacgtgtctatgtataacttcttaactttattgttgaatattccttactgcatcctggttgttcatggatctatatactgtatggttctggtagttgaagctggcaaaactgactacatgagcattatgcgtttaccatgaaccttactatgccaattctggaactgtttactgtggtatagatgcagtttacgtagaaatgctttggcaggattgctgctgcttacatgatctgtgaagtaggctgaatgtcttcagattgcttattccagtgcatagctcttgcatcttattctgtgaattaccatgtactatctgaagttgtgaattgatctgcatagagtgtttgcctttattttatagatgccttcttggagaccctcacaagtcacaaccagttcaactgaagtgggcgactttcataatgcatctgattctgaacactggggttgcatttagttacaagatcagattccaatagcaaatcgagaggtgatcggtcccaatagattgtctgaaactggtcaggtcatctgaaccttgacaagatctgtagttgtcatttctgttagaatgtatgccgccttggtaaatattccttggcagatagtagctcttttattatgtgaaacagaacatctgaacgtgactttggtaatattccattctgcatatgttctctcgacgccttttcatcttcggtgcttacaatttgcagtctacctttgatcttcctttttccctctcccttgaggtctcattttccctgtctgaaatacgttgggagatcatgcaatttccactaatattggtgcatagaactgcactattttgtaccgacatttgtcaactttcgtcatattgagcggagcatagtaaactaaattttgttactgtcattgttagtatagtattttgttgctgtcattgttagtatagttttcttgcctttgtaaactactagtaaaacagttttcactgtaatggatgaacagtccagatagccgatatataatattttgacagtggtacatgctgtcatgcagaagtgctgacaaaattcagatccattttgaggtccactcccttcgtcccacaaaaaatcaacctagtactagatgtgacatatcctagtattataaatctaaacatatctctgttcagatttattctactaaaaatacgtcacatccaattctagattcattttttttagggacggagggagtaattcacattagttcagcatttcacttggcagaaagtaaatgagtgccagcaaatgactctggctgctaagcccaattcgattgaccatgtcatatctggtatggaactgggatttggtatatttttaagctagctgtcttgtagcgtcccagcataagttcagttacttgtgtcattagattaagaggtaaacatatttaattgagaagaaaataatttgcactctttagaccagcctccacaaacgaacag

SEQ ID NO: 68557 - DNA, 1991 bp, Oryza sativa
ttaccttaccgcatctaggccggatatcatgtttagtgtttgcatgtgtgcacggtttcaagccgctcctaaggagtgtcacttagtggccgtgaaaaggattctaagatatttaaagcattcctctactattggcttgtgatacccaaaaggtgctaaatttaagcttgttggctattccgattcggattatgccggttgcaaagtggatagaaagagcacatccggtagttgccaaatgcttggtagatcccttgtgtcatggtcatccaagaaacaaaactccgtagccctctctaccgccaaggcggaatatgtttcggcgggtagttgttgtgcccaattgctttggatgaaacaaaccttgttggactatggcatattcttcaccaaaaccccactcctatgtgataatgatagtgttataaaaatagccaataacccggttcaacattctagaaccaagcatattgacattcgccatcacttcctaagagaccatgttaccaagtgtgacatagtcattagccacataagaaccaaggatcaactagccgacatttttaccaagcctcttgataaaacccgcttttgcaagttgagtaatgagttaaatgtcatagacttctctaatgtggcttgagatagtgcaccatggttgcttcttttgcatattgtatatttgctcctatttgctcttatgctttggacttattgccatttggttcttcattgagaaaatggaacatgtcacattaagggggagttttggactcttccatgtgctctacttccttttatatgtgagaaaatcaactaaaagtgctagtagtgttttcaaaatgcccaagtcaacataagtcaaaacttttgcaaaatcaatgaaatttgaaaactatctcttggaaaatgtttcaaaagggtccctatatgttttccaagcctcacattgctagaaaaatgatttttgaatgaaaaatgccattttggctctcttttgaagaatctagattcttgtttttggccaaaatgagattaaaccccaaaatgagtttgagaaggaatctgagaaaagattcaaaacaaagttggtagagaggaggatttgaaatgtttttggtattcaaatcatattcaaaaaccaaatatttcaaaagttgtttgaaaatcaaattcgcccaaaaacccctatagaccataaaaggccacctcctagcactcaagtgagttttgttgcaaatcttcataaatttcaaatattatgaatggttggcaatatttcaactcacacatttcaaaattgctccaaaaatcaaaattttgttgaattttattgagtgggggcagccaactgtgcaagggctatgcacagtcggctgggtggccaggcggtctgaccggcgctatatgcgcggtctgaccggcctggtggcagcggtctgactggcggcaacccggcggtctgactggccggggatggtgggcctaagaccttgtcctttcttcctcctcctccttctacccgacccctcctcatcccatctcatctcttctcttctccaactcgaaaaaactcctcctctctcttttcccaaaccctagccacctccctccaccaaatccatccggttcaaccgtcaaaatcactccggttacaccgtaagtgaatctcctcctcttcctctctctattccatggatttgtttgagttttattgagtttgtgatccatggcttggaaccctaggtgaaggaagaggtgttcttaggttttcaccaatagagggtagtttcttggtgtgattcaactccttcaaccggtaaatcactctccctcttgtgcattctctcaaatcggtctatttcaattcttgggttaagggtagtttccccctttgcttcaatctctatgaaatagacctacaccttgatattcatgttccaatcttgtgcaactttgtcctagcaatttttttaaatcatttgtgtgga

SEQ ID NO: 68558 - DNA, 1557 bp, Oryza sativa
aggtataataataataacggaattggtgatgacgggcgggcacagagaagaatgaattcggggaaatagaggcacagagatgagtcaattggagggaacaacaacaaactaagaattcaattcattgaggttgagggagtaggagatgagattcatcagatccctaagtaactagcagcggggggtgattaattcccgaagcctaagccgtaatcaagtgatttgggggtggagatggaagcaggtgaggtgaattggggaagacggaagggtgaattgaattacctggcactggcaggcagggtaggatgaagatcgaagaggaggagatcgaattggggatctgcgccgccggcgtccaaccaatcaatccaaatctccttccacttcgttcccccttcgccctcgcctcgcctcaacggagaagcaaattccgatcgattcgatttggggattttttttttccttctctctctctctctctcttttctcctcttccttaattaacacgtaggagtactcccctagtccgcctgatctgaacggagcacgtgcgcacaacgtgtcgcgtgggccgtggtgggttgggccgaatccactcttggcccgggattggattcctctgcgctcgctatcgcgtgttttgcaccttcataattttctcacagaaatgctatgtactacactttgtttttcactactttatatctaaaccctagatctatcttgtgtttatgctccagtttttggcaacatacgtacatacatacatacgtacatgaatgatatgcatatccacgacaagcaaacaacgtacatcgatcactcacctctcatcttgattaattttagctttactaatagctagctatagctagctagctacttttccaggcgcccaacatccagctgattcagtttagttaatcatatatctgcacacatacggatgcaaagaatcaataggataggatttaaaacacaatacagatacgcatatcgaacgatcgatcgatttcactgcatccatacatatgtatgttgatacatatatattcttcaatctcaagatatcaagtctttcaaaaatgcttatagagatacaaagtgtatgtatgagtttatagagatgggtgattgttgtattctgagttcctgcgtttgtactgtattttttaaaaaaaactataattgttacgttattcagtattgtagcttagctgccagccgaactacatatacagagttttcttgattggatagatgaagttagccagcgctgctcgttcatcatatcgatcccgggcgtccgatgaccagatctgtctccacgtcctccatcatgcgccgatcatcgtcgtcgcgtacgccgccgccggaataatcctcatgacgatgaacatcatcatccgcctgcttattcttcagctctcccacagacgtcgaccatggcgatgacagagccttacactgcatatataattacatatataattcatcgcgtgcgtgactccatctgtgtgtacatatatatcttaagcattcaatttggagttt

SEQ ID NO: 68559 - DNA, 95313 bp, Oryza sativa
catataacgtaaaagttgcagttttgtgataatttcccgtgctattgttgcagcaaactgaaacatgtcgctaaagttgcagcaaactgatacatttgtcactaaagttgtagttttctgaaatttactcaattttaaattttatatatgttcttagcgaattcaaaacgtaaaaacagtcatgtttattagtgattacaaaataatttataagtaagacttttatttatcccattttagcggcttactgtaggaaaaaagaatgtagttattgtaggaataaagaactatgatgagaaaataataaaattaactctaaaattaagttttgaaatttaagttttggttgcggttgataagctgaagatgaaatgacggaggtgtgaagtctccgttttcactgcaattctggctttgaaatgcagcaatatgtggtcatgactcatgataagcttgttcttggctggatcctcaagtgtccacatcttctctattgtgcagggaacagggaagtagccaaggttgggtggttgatctgtgcctgatttaagtaaagtacgcatgtgctgaatctctgggattaggagaagagtttcaggatggacaaaaaattcagattcagaagataaaagaaaccgtcattaagtagttggattaattactcagtacagtatttaataaccgaccggttacagacggcaagcaccagaaccctgaacacaagggaagaaaagctgcaaaactgtataccccaggcagcaatgacctgccatggatgcaaccatgcaatgctgatgatatatatgccattactgctcaaggtgtggtgagcctaattgttaggccatctgcatgatggatgatagtgggtttatggcaattattcgagggcattatgaataaattgaatgttacaaagttgaaaaggtgtactaaaaagtactccctccatctattttgatagtcatattttcaaatttgaaaaatttatttttgataggcatatttcaattcacacatttaatgcatgactatctattcttccacatatggttggctacatgagtattgagaaatataaatattaatgaatcgtttgtttacgagaaatgactagtagcatgtttaaatagatgataaatagaattatttatccttagtctgtgtgtcaagataaaatatgactattaaaagtagatggagaaagtattatataacaaaaagatgatgaaaaaaatgtttatcgaaaaatcgtaccatttaagagctcgggaaacgtgcacgggataattcataatccatcggccataccgaacttgctcttaattgtacccccaataccatcaatccctgattgtaggggaccctcctgaacagattttaatttggccaacattcatgtgcaaagatgagatggggaagaggccggtgagaaatggacgccggcaaggacaatctgggacagcattgcatccaatccattcatctacctcaccatgattatgctccttggagatcatgttcttgcctccagcatacatagctcctgctctttctttctttctttttttttctcttttattttcatgcaacttggctgccacatgtgtgtggccacaatgtctcatctactagctcaggtagatctgcagggagagagagagagacatggaaagttccatgctggaaaccttgtcataagtccgcacactgtacaacagtggtcacaaaatatggtttgtttggaacgcaggaatttcatggtaattttacagaggtatatgtatttttataagtttaacctgaaattaccgttgttccaatttccaaatggcaccgaaaatgtttgatggagataattgagtgtaactttgtgaattgggtctcaactagaagctaggatggtccaagtccaattacttgaaatgtctccagtagaaactgtgatttttttcatgtgaactgtgaagctttgcgggatcagaaaaatgtttattaaggatgagaggatcttcttggccaacaagatttcaactttgttgttactatcgtcgttactgtcatgtaacgtactaatactttgagtggtttagtcaactcaaatcaccaccacttgttctaagtttgacagtctcaagtctgaaagtttgtatgaacgttggacgtgcccacagattcatcacttgcttttctgactaaaatagcacagtttttccctttcaaaaaaaaagcacagtttactattgacttggtttcagtttcagacttccaggagccaaataaataaatagatacataaaagtaagaaagaaagaaagaaaaaaacaaagaagaataaagaaaatacagatggacacatatgactgttgctatcaatagaagtgtagccatcttgtcatcattattgtccatgtaatcaagattagacgacagtagggtggtgtttatcagcttaattaatccttaagaggagcagtgtgagtaatcttgtctgtacctgagctaatgaggacaaagagcagcatataagttaaatcaccttttgacaaaaaggctatgccagaggaggacattgtatatgtataatgggaaaaaaaattcacaatccagaatccaagaaaagatataccaaaaggtctctcccttgctgaaagaagtttgaaaagtggatgaagactgaagggatgatagttctagtggttgttcaatataaaacttgaaatttttgtttttagaaaaatgaaacttggtcaatatagagaaataatttcttgatgacacttcaatttttttttacaaaaatgaccccaaactgtgctggatatacaccgttgctccgtatccagtaaagggacttcagcctaccaaaaaaaaaacatatatattcatgtggcctgttgggttagtattgtcaaccggatctgattaactaaacaatatttattccagttttaagattctttggcacttgcagatacaaaagagagacaattttgtactgttgtaccacatgcatcttgtgccctcatctcactctttgttcatgctctgtcaatataggtatttagagccatagtgcctctcaattcaactttataaattaaagcacaaaacaactaattagaaacaaaaaatgctactcatttatccaaatcccttagaatatggaaatatatgactcttggattaatcatcatttatctcattccgttgttaaaaccaaatcacataatcttttttagaaaatactggtggtagctgtgaatctgccaccccaccgcccacctactcctaatcccattgtattatttacaaattaatccttaaaattcttaatataaaagacaatcaaattcaaaatgaatgaatagctgcatacaaaatcatatgtattatttatttatttattttacacggtattataatactttttattcattaattataaagctcagtagtacatagaagaatatacactcttattttttttaaccttgagtaatttcccctatcataggattccattatccaaaagaagaaacaccatgatagcaatcagttagactaacaccccaaccaaaccccactttggcactttataaaatactaaaacaaatactttttttcttcattttcaaccccaaatctccaagttaacaagaccatacaaatcatatgatactccactcaacaagtgagaagagacctcaaggagtagtaggagtagcctacaagtctacaagacgaggaaacatcaaaaaacacatcaaaaaccctatacaatccgcacttttgcgaagcggttgcccaactctgtgctccgccgtgttgccgccgccgccatgggctcctgcctctcctccgacctgcctccccgcgccggcgccggcgcgggagcgtcacccgggtggccgcagcggtggcggaggaggaggcagcggggggtggagcggggcggggctgtttccggcggcggcggcggcgtcttctccatcggcgtcggcggcaagaagctgcaccacggcggcggaggaggaggggagatgacggaggaggagctcgcgaaggtcgaggggagggtgtgcgtcaacggcgcgagcgcggcggcgtgcctgcacacgcagcaggggcggaagggcaccaaccaggacgccatggtcgtgtgggaggtgagccaggcagccatggtggatggcttctgagtcctcctgatcattggtactagtagcgttttccttcgcgtgttggttctgaaaatctcgcccgcctttttcctcgccgtgttgctcggttcagaacttggtgcttgcgtttactcgatctttccgaagtcttctttgaactttttttttcttcacggtattggctttggatcaatagcggatttgaattcggagtgtgtgtatattcgattcacagggaggagcgttttagtggagtgcttgattcgaaatgtgggatttgactttataacagaataagcaaaacctcttctatttttctagtttgttcttcgaaacagttcgagcatttcttgatttggtctcactgggagcgtcttcttgctttgttggatgacttaattcgaaatgggaaggattcagctttagattgttttgagatttaatctgaaaacgaggagtttactggttctttttgtatgtgaaaattgtggggggggaaagctcactttttctgtattattgtaatgtttcctgaatcctgataattttaaaagaaaatctgataaatgggacgtgttagttggaatattggagacttggagtcgtctgctcgtgcttgcgttgattcaaaactttctgtatagtccaagcgagatcctttcctgtgacccttggcaaaagcttctacctttctttgtattcttctgttagtttaaagaagagtatgattttggctgtttcttcaactagatgctcttgacaggtcaagcgattagtctggtctagtaatagctggcttggtatatttagcttatatcctaatcaactaatcgactcccttcattttcatgatatgtaagcaagtagttatgttgactccatcacacaattggtggagtttacctaaagggagtggtgaagtacaatcatggataattttcacttttgttttggacctacaactaggcagctagctaaacttatctagctacataggaatatcttgtgagcttgttttaggaagtcaaacaagtaaaagcagccactttatgatatgcatggtgatcatgctcttcagaggacagtaaagagaatttatgcctaaagattctcagtataatgctattgattgctaatattcaacgaaaataggtaagtacttctttattggagtgaggaggtacttccttgacaaatagtttccatctgttggaattgagtttttattttcttccttttggcttgggatttatattttttatattttttcttgttttgcctcgccttctgttttgaaatgtgagttataacagaaatcatatttctagtcaactttcaacatgaatatgaaatacccttatagggactgttcgatgtcttgctaatagaacctcttagcataggagtatcctcatttactaagggtcagttgcaacaattgctaatcgcatggaacaatgccttgtgagggttccatcatgggtgattggatgctaatttgataccttttccttgcctagttgctgactttatccatctcatttgtgctatttgaggtctgattatctgattctatcctatgtgcatttctcacattgttcacccaactacctgtgtctaccgttctttgtgtagggaatactccattgtgaaaatatgagcatactgaatagaatcccacaaatacagtttgttagaacccatctatacccttcagtttattttcctgaaaagtaatgtgcattgtcgatttgcttttaaacaaattaattatagacattaccagcttatcacatcactggtactaggagcgcaaacaattatctgacctagcccttccattcttgcagaactttaatacaagtgatagtgtcttctgtggtgtgtttgatggtcatggtccatatggtcattttgttgccaagaaggtcagagattctcttcctgtcaaaatacgcacactatggaaaaccagtgccaacgaggacactagttcccaccaaaatggaagcatttctggaagtgttaattcagaagagtcacctgttgttgatgatgaatggggtgaatatgctgatgacagcgagaagcttcctgagatgtttcttccacttaagcagtcttattttaaggctttcaaattgatggacaaggaactcaaaatgcaccctacagttgattgcttttgcagtggatcaacagcagtcacgttagtaaaacaggtgagggatgcttctaaacttgttctagtattcgtagataactgaccagcatttggaacaaaaaaaatagtggtagatattgaaatcaaaatgacagaagaactggacatggcttattttccagggattggatcttgtggttgggaaccttggggactcgagagcaataatggggacacgagatgctgccaataatctaactgctgtacaactcacagttgatttgaagcctaaccttccaagtatgttcatttctcacttatcatttcagtgggtacccttgtgttttcaaaactgaactttctctttaactgcgcatttaggattttcttcttttcctcctagatatggcttcagtcaaacttattaacgcactaagtatagttacttgtctggattggtcactctttttggttaatcgctaatcttcatatttcttatttaggggaagctgcgaggatccagcagtgtaggggaagagtttttgctcttcaggatgaaccagaagttgccagagtatggttgccaaataatgactctcctggattggcaatggcaagagcttttggagacttctgccttaaagattatggtttaatatctgttccacagatatcctatcgtcgtcttactgaaaaggatgagttcataatactggccactgatggggtatttttcttatcatcttattactttcttactactacttaatatggtgttgaaagttactaattccttttgtgaatagaaatgcatcatgttctccaatccctacttaatccatggggattggggaatagtttgatttaacatacaaagatgttacagccttcactccttcagctgcttcaacttgtaatattggtaaactcaatgcatgtaggtttgggacgtcctctcaaacaaggaggctgttgacatagtagccgcagctccatctcgtgcaacggctgccagggctcttgtcgactgtgctgtcagatcatggagattgaagttcccaacatccaagagcgatgactgcgctgttgtgtgcctattcttagaccatgcaaagtcacctgacttgattcaagagaacgagagcgaggaagaaactacagaggatgttgcaatcccagacaccgttgctaaggttgaccaagacattgcacaaggagatgcacatatctccagtgaagagcaaatcaccgagccagcattgcagcactcctacacattaagggatgttgatgagattgtaccggtagaggagcctccagtctcaaaggaacctgaaagatgtggatctgcccgcagccttgctgattgtatatccacaaacgaggaggaggaatggtcagcactcgaaggtgtgacgcgggtcaattccctcttgaaccttcccagaatactttcaggcgagaagagatcaaccagctggaggaagcggcgatgaacgattcccccgcttaagtcaggctgagagcgcatttcagtcgaaaccggcaatttcagccaggagtgtgcaaatctcttcggtccctgggattttattagagccgatttttaggtttcttcacccagattgtttcataccctgtacactccagatcgatctgttcttccttttgttctcttgtcaggaggtgtttcatgcttgggcttctttacttgtttttttgtgtataagaaagtttttgttctgtgagaagccttctgtaaaatcatgtaatacctcctcccttctcctctcttggtggatggatgttcagttcacctgctgtttctatgctggaacaagaactcaattctatatgtattagctcatgaattttcagctgcaagtataaaagcttcctaattttgcaccttgtctgccaacttggttgatcatccttacaaccgaacaccttttcttcagaatctttgtagatggccaagatgtcaaataatcgaagcccaatttaagaagtgttaaattatcaaatctctctcttttgaatcacccttgaattatgcttctgtcaaactatgtaaatttcatatcagttcttctattcaaaccgtctttatgtcttctcatcatcctttcgattgttaattgcaatcggatgtattgtaaaccttgtagctggttacctattatctctatctctactattataaaaattgaagatatttttgctaaaattttagtgcgtcgtctgtgtttgagtcgttttttaagttcatggatcatattttgtatggaatcggacacagacattttgttaaaacggacaagggctttttaaaactgtgagactctaccaacgatggaaaccatgcaaggcaccggtgtgaaacccaatcgtaatcaaactcatggatggacatagcatccacatcagtgatcgatttagaacaagtgaagttcgtaatagtgattataaggatattaaaataaaaatcaatgtaaaactgagcacatggttaactaaaatttgcaatctctatttctatctttatcttctttactattataaaaataaattgaaaatgttttcatcgatactacgtcgtccgtattttgagtcggtttttaagtttatttttttaaatacataaagagtcgtataagaaatcattttaatatgctaacttgatatgtgagtcggactcctaattgcttgagaattcttgccacgttataagaaagtaagatacatgatatggccatcatcccaataaggatttcaaattaaatatcaatactatcaaaataaaaaaacacatactttttagacaaaacaatctaacaataatacgattaaaataacctttcacccgttgcaacgtacgggtattttttaagttaaaaaaaaggaaaatttaattgtcttgtatatgaaacctgcgcggatcgcaaatacgaccagcgaaatcggtcaaaaaaaaaaaaaccaaacatccccctgtttcccttcaaatgcgctttcatccctggaaaacgtattaaaatccaacataatacgctttccttctatgaaagcgcatatacttcatctactgccactgacgtggtgggccccaccctacatctcgtcccacaaatcaaccaacccctggtcgtcgtctcctcgagggctcgaggcggcggctatctccctcctttcttctcttctctctcgtttcgaagccgacgcgtcgcggaggaggaggaggaagagggcaaagccgccgcggggatttctagggttagggtttcgaggttgagagggaaggagggagagaagagcgggtatcagccatggggatgaaatttctgaacaagaaggggtggcacacggggagccttcggaacatcgagcgcgtgtgggtggccgaggagaaggagaaggaggagcagcggaagatccaggagctgaagaagcagcaggacgaggagcgggagaaggccgccttccgcaagctccaggaggacgccggcctcaagccgtaagcatctttgtttgctgcttcgatttcgattttttgtttcccccttttgcttcgatcgcgtttggggggaggaggctagggtttcaggagaaattgacgctggcgggagcgcagggtggggggggggggggagttcaggagaaatcggtgttggcggtggccggatcggtgggcttttgggcggcgttctagggtttcgtagttgtagccttctaggccgcttatgttttgttttgggacgcaggtatccgcggttttagttagattctgctaattggttgaggtaatttggtgtaagattactgcttgcgatgagagtttcatgaagctttagctaggagttagtgtttggatctgttcgtccaactattttggaatttttctgtgcctgattggtggggagataataatgtgcatggtgttattttttttctgcaggaggcaagagagattggacttcctctacgagtcagggttggctgttggcaaggggagctccgagggattccaagcgctgcaaccatctgccccagcagctgctgccgccgcctcttcttctgcccaagcgagtgccggctcttccaaggtatcgcgaccgtttcttctcggccatgtgattgtacttatgttagtttgcagttctaaaatattttttttggttgtgcatctaattccactgatattatcaaagaaattcgtatagtaggaagatacttggttgatgtgacagggcaaaggtttttcttagtaggaagatacttggttgattcttagtaggatgcgatgcttggttgattcttagtaggatgcgatgctcaaatgtttagctgattgttacaattcttccattatagcaaatgggctgaggttgctagattatgtgctgctgttgtaaacttgtaatatgatttctcatctttgaacttgcagaaaaacgataaaatatttgccttcttacttgtatgcaaaagcaaagtgcctcctactgtctagttgtggatcattgaataagttggaaactgttgtttgtggtatggatataagaagttaattaatctttccttgcttccatggcattttacatttttatgttgtcttttgaattgttttgtgttttagacttttagtcaagggagtataaaagtgtaaaatatcagttatttcatgcgcactatatcacccattggttgtaataaaatatctattcatcactagctattagaagataattgcttattttcttttgtttggaataatttcaggcagctgctccaggtgcattatttgaggataagccccaatctgcaaatgatgcatggagaaaactccacactgatcctcttctactaataaggcagcgggagcaggatgccattgcaagaataaaaaataatccaatcaagatggctgagataaagaaatcagtaagctatatccttcttttgatatggaattataccttctgagcatcttaactactgtcaaactcttgtaatgtcaaacatattggaaggtttataatcaatcttcccctgaacatattccctgacataacttcgtcttgtgtaggtggaagctgagaaaaagcaaaaggaagaaaagaaagagaagagaaagcacaagaagcgccatcatcacaaatcaaagagtaagaggcatcactcaagtgagaactcagattcagaggaaagtgatggcagggatgagagaagaaagagtgttcaggcctcagagcataagagagaagagaaaaggtcaagacatgataagaaggatcacggacaagattcagaagacgatgaacgaaggaaaagacggcatgcaacgtcagaagatgatgagccaaggaagtcacagaaggagaagaaaggacagagggaagattcagaagatgacaagccaaagaagtcaaggaaagaccgcagaagacatgattcagaagatgaagaaccaaggagaaaacaccagaggtcagaagatgatgaaccaaaaagaagacaatctgaggtttccggagatgatgaaccaaggagaagaaggcaggagatgccaaagcatgacgaatattcacgacggggtcgttcggatgctgatgataggagagggagacactatactccgtcagatgataggagagggagacactatactccgtcagaccacaacagtgcttatccaaagcacgacagttcagattcaaggcataggcgaccggaatatggacgcggcaattccacttctgaactaggttcagaaggccaacgaaggcaggaaagccagcagggcaggaacggccctacattcaaccgtcgacggggtgtccagcacatgtcagaggaagaaagggaagctcgacttcgtcaaatgcaggctgacgcagaggtccacgaagaacaaagatggagcaggctcaagaaagctgcagacgacgatgccaaggaggcggcatctgtgaacgcaaaccaattcagagggaagaacttcttggaagaagaaaagaagagcatatttggaaccgagaagggcggaagcgccacgatcgaagagagcatccggcgccgtgcgtattattcgcagcgtaatgcccatgagagcaatgcattcaggcggtgaaatccctgaagcagagcagcagctcaggcggcctgacctcgttgatgtcagtgttctgcatttgctttagcttcttttgcctttctggtgtattgttccttgtttagtatggaagaatttttgaatgttgtacaacgcattgtccagatgttttgaatccatatgttttagtaacaatttttgccaaaatgaaaatcctacatgtgtattatagagggtttgctaacacaaaggtatgatttataagggctttgtacgctacttgggcctatttattaggggtaggactaggcctgtgggctgtttagctaactaatgggccggacttgctgtgccttcttgtcagccccacttcctcctccgccttttcttcttctagtcattgtaccgtgcctttgtcactaggtccggagacatcagatccatatgtcagtgacaaaagcactgatccagcggctgtgggagattgggagggccagcggtgtggctataggggggggggggggggggaaagatggggatgtatatcacgcggcgatcgccgagttcgtggcagcggtggcgctgctgtttctgtaggagacggtggccacggtgatcggatcgggcacaagagccaggacgctagcatcgatggcgaggaatgcgacggcatcagcctcctcgcgtcgcctgggccttcacctcggtagcatcatccgagaccaccacccgacatcagcagcaacactcgcttcactccctgcgtctccagccgcatccgcatgatattgtaaccgaaacaagagagtatctccttttttccaataagagttagataaatattaagatttatgtggtacgcttttcaaattattaaacggtacgtttcgtccgaaaactttttatataaaagttgctctaaaatatcatattaatatattttttaaatttataataattaaaactcaatcaatcatacgttaatatcacctcatttttttaatcttcatcttcatgaaaaaaaaaaacaccacgtaagagaccacacaacaccaccaaccaggccgcctcttcccgcccgggaacggcgccgcggaccgggagacgaggaggggcatcggcggcgtcgccggcccatgcttcgacgtcgtgatggattacgtcgacggacgggccgagccttgcgcgtgtcgtgtgggaggagctggcgcggggaggccgttcccggaggccaagactgatgtggcaactcctcgatggcgatgcacgtggcgggggtcatcatctttgatccggtctgcaacttctatatctacccattaactatttaatgacattgtaatacaacgctgaaattccatcaccgttttcattcccgtaataatccacatcaagaaaaaacaatccgcaatacgtataatttttttttaaaaaaaactgagagtaatacccgcagacatgctgaaacagtgaaacctgctaccactttattttctgtagaaaattacaagaacgtgttgcctccttttgacatattcgttcgatattcttttattctttccctctctgtgtacagaattacatgtgacaactgccttctgctttgcgtttcccacacctacggaagaatgggtgcccatcttgaattttatatacatgtcgcgccttgttaaaatgaacaattcgtatacacgaaccgaaaaccacaacacaacggccactgccattttgcactttcatcattccaaaatgtgcagcccccatttcgctagttctctacttccttgtaccctttatcatgggggcgggcctgaggagcaagtgcaatgcctagaatgtttggactcacaggggaaactctttctgaagaacgtcaaggttgcgtgaatcacatgcagcgatcatgtcagctcgtgaagcgttactggtttttaaaagagaaaaatgttagtcaattaaatcagcgttgaatttaggtagacaaagaaatgatttaacgtgcttggaaagttctagatgtactcaaattggaatatcaactggttgcaatgtttcttgagtacttgcaagttatgagtacttaaaagtgagcgacaattgatgttcttttgaaataaatgtatctctagtatcctccaaggaacttcaaatatctcatagataattaacaagacatacctaagagaaatccgcaagtactgccaggcattgtcagcttttggattcatagcaaccgcccgtacatagtatcgaatagagtcttcatacaatccctgcataacacggaaagctggggtattacatctctgttgccactttgaataaaagatatttgagctaggccgtggcatcattggatatataatatatatttgtactcatcctttattatgctctgtaaatcaacagttaacattaatattaccgaggctttgaatggatggtagtatttaggtggatatccaatgcacaaaaacttgaagatcttttcagaatcgagtggaaaccatgatagccaacatcttattatgaaaagcaaacaagtggaagcatacaagctcactcataaaaatgatggtttgcaagttagttgagtaaatgaataatgctgacagacaatgataaacaacattgagatatggttttgtacttgcatgcaaggaaattgttgaaactgcaattattttgttaaaaatacaattaccgaactaatggtgttatcaagtggtagcatcatgttagagaagaattacctggttggcatagctaatccccatattagcccatgcacgcacataattgggctttaagtccagagcctgaaaccagcagcaattgattatattagttccagatttacataccataaagtgctaggatacttgtattacacaattttctctaaattggagattcatcaacaagttctacacttgcaggactgcagtagaccaagccgtaaaaggatagttgtaccagcaaaataagtgaaggttcctccctaatggtattacaacactaatgctaggtgaagatgtgtctgtactcagcaggattggacaccaaaccaatggtattacaacactaatgctacctaagcaaacagtttgattagaattgattggttttactgtaatgctagaagtacagggatgcggcacatagcttgaactgaatgcactcttactatgaattatactgaaattgggtacccatagaggaatggacagaccgccagagggtaaaggtcatattttttttccaaataaaaatccaaaaggtccagatacacatcatatatggattattgccagccacgaattatatcctgttagatttgcagttcacacacaagtgaatgcaactgccataaacatcgtccgaaaggaataaccagagcccaatgaaagagtggatgaagtagctattctacacagcatgatcgagacaaagcactgtacttcttcaaccagactagttcccatgagttacaatgggattggaaggaatacagacttttcagttttttctatctggtttttctggtggataatgtaagtggggttttttaaggcagggtgtttcttttttatgtgggatgtacaatggtgggataggaggacggctctgcttttacagtagtagagatatgtaaatacgctatagcacttatagcgaaacattcaccaaagctgaaaaataaaatatcttacaataactaattacctgttgataggccaatattgcatcagcactctggatgctgtttgcttgggtcgcacctagcttattccagagagaatagtcttgtggtttcagctgcagcgctgtcttgaaagcagctatagctttatcatattctcttgataggttgtacaagactcctagaactatatggacatcagcatcctcaggtgacatttgggcagcctcattaaacaatctaataacctgatcagaggtaaactgcttagtgacaaaacgaaatgacttttttagaaatatcagaaaacatatcatacatgacaaacagtatggggtgacaggaaaaaaaaacttgaagaaaaataaaaggaccgcagaccaacagaactctagagcatacatctagaacatctgtgcaggataccatttggaaggtgaagatgccattattatttatttacattatggaacagatgggatgcacttacatcaggaccataaggtgaatcagttggctgtggaggggcgatacccccatatttggggtgattctgaagccacctatgaagatatcttaatgcttctccctgctccaactctgcatcaattatatagaaccctcaaatgtatacaaaaagcatcaaggcatagaacctgttagaactaaattttagaatattaagttaatgctagaaggaaatagacctttgccccctcaaagataaattagctttatctagttgtttaaaacttaaaagcttgtatcaatgaggaaacctcgttacttctaaccataatttatgccgcttcatttctttcaggagcatcttagtagattatgccggacactgaattaccatgcactcaccattcgtgtgactgacaccaagtgcaagaagaacttccaggtttgttggatcagcttcttgtgcacgcatcattgctgcgattgcctgaaagcaaagtaatagcatctccttgtgttaaacataagcatggaactcatagatcataatgccatatcacatggtgcttaaaatttagctaaaaataaaccataatttcatgacagacaatagtatgggttcgtccgttcaaattccatatatatcagtttatgaagttcttgcaagggtatgcaaaaacttgatagagcataattcacgtaatttctattgagatccagcacactgcatgctcctaccgaaaaaagattcataaaaaaaatattctaataaaacatgtgatgaaaacaagtgatgcacacaagcatgcagtgcacctgtgctgaaaaactaataatgaaaagttgaaaataatcagcacatggtaatttacatctacatatatcctcagtgggagagacacaatcacctgttggtcatcatcattttcagcatgtgttactccaagtagtctccaaccttcagcattatcaggattcttcaaaacttcagcctctaaagcaagaacagcttcacttaggaggcctttgcggaacagttcctggccttcctgcattggattagggtgaccaacgtatgggttcatgtctgaaaaaacataaactcctcgagatgcaccagaattctgtttggaagctgataattggttctggaacctaaaaggcacaaacagagcatgtgtaagtgtaactgatgaagaaaaaaaaaaggcttctgtcaaatagaacatggtacatgattgataaaaagggaactttatggttgcctataattaacccaaaaagacaagatattggatcaaagaagatttgatattcttatggtattctgtctggtctaatgattggtgtggaaacatatcagaagcaacacatttcaaccttgaagagatagccatgacaaaacaaggaaaagagatttgtacttactcatctacccatggatcagcagagctttcaccaaatgttcctccactgaactcttctgcccattcatcgtcaacacgcattttggagaactcatcaatccagttctcgttgaggccaccctgattatactcagtagagaactcactagcccacttatctgctccttgtgacatctggagaataaaagtaagtgatgccacatcatcagtgcacaagcagcagtatcagtgtaatatttatacagtcaaacatggtgtagcaccggaagaattgtattaatggcaatattatccaatcagaaactccagtaactggactgcaagtatgaacagaatgaacatattccaacaattttattgtatatttatattactcatttatcagaacataaacttacaaagcaaggttccatgttataaacaccacaatttaccagtacttctatagttttatcagtttttgtttatgttgaccaaagaaaaccacatccccatcaagcatgtatttacacacatccagctctctgcattacctcttcatgaacaaactgatccgcccaagagtttgcattagcattgtactgggtttgaaattcatcagcccagccactggattgggatgctgaaccttgttttacttgattatcttctataataagttcaccacggctcatctttgaaacaaactggaagaacttagagttcttccagaaaaaagtaaaacaaaagaataagttcaccacggcgaatctttgaaacaaactggaagaatttagagttcttccaaaaaagaaacaaaaggtatcatcaggtgcttgagagttgagacaggctgatccaaatgaccctatagcataacaaagttgctagcagtatagccagctgagatgaggttcagaatcaactaaagttggtattaaaccacagatgtgcagaactgcagaatggcacaacatatcaatgtggtgtcctaggacgcattagcaaataatatagcaacaatgcccactacaccatctcatctcagcacgtctagtagagtctcccctttcactcttattttatgctgacagaaatagcattgagaaaaggaaaaaactttgtcaaacagaaacctcttccattgagtgttctatattgagtggtattctacagacctgcatgcacacaagtttttaaactaatgagtcttcacaacctatcggggttaacaaatgacgagttgtttgtaaaaagtaaaatgccagaagcttcctaaagtacactggatgacatagaaaaagttatttcaagtgagatgtgcataaaataagatatcaatggacccaattcattagcaaagtggtatatcaatatattcacactattaaacctgttatgtgcaattccacaatcgtggggcacataaattggttggaattcgtagtaataaaataagtagcgtggaaactctagattatatgtcaatttatggtgatttaggtaacaagatcagtaaacttaatcctaatggattcatatcgatattgagcccaacaagacacatttaggtttatcctagtaaagtttacattggtcaccccaaccaagttgcaactacatacaactgtagataagatcataagcagaaaatatcaaagggaagttatacccttcactgttgaaaataattaggatgagttgttgctcaagcagatttttttctcaccagctaaaatatttaaaatttacccattcaaaatgaaagtatacagacctaatagagttaaataaacaaatcaaatcatcatacatacctgaaattttgggtcattattactagctaatgtctgtgcaagcatacgagattgttccatggctgccaggtttgccatattcattcctcctgtcatggccatctgagattgatgctgcaacaagacaaaaatagataacttaaatcacaaatcctagaaggcttatcacaaaattatatagctttgttttacacccattgtaaatatgctgcacatgctagggaaaggatgatatctaaacatgataacggacatagcttatcacaaaattatataactttgttttacacccattgtaaatataaaataaaattagacaattagttaatatccatgaagttaaccaaatggtacatgtgaaaatatcaaatagcccatgcataaggctctgacctgttcaaactcagaggcccaaccattggaaccatattgctgctcaaaagaatgagcccactcttcagggttattattttgcttgccaaactcagttatccatttgtctgcagcattgtgcattggaccagatctcatggcgctttgggactgattccaatactcctccatctctgggtatggtccgtgcatgggtcctttcattcgataattactgtcgatatcaagtgaatgcagcaatgtgtttacctggtacaggtgagaagtgtcaaattaggtcacagcagagaagataaaaacgaagccactgcaacaatctaatgaaatgaaacacaaatgcaagtgctttagcatattcactgaggtaacaaaaattataagttaacctgtgcttggatatattcttcaggctggtcagccaaaatgtggcgtgccataatgcaactacgatcacgtatacattgcttgtcactttcagacaaaccaagcgctggtactggaacaggttgaaatggcacaccagcttgaccacttgctaggaaagaacgtaggacaccagataagaccctttgtggtggacctgaaccaattttgggagtcagtataatgtgcttcagtatgttatcaagtgatgaatatataaacaacaataaaataaattggaaagaacaaaaactacaaatctaccatccatgactggtggtccaaaggttggccctgtgctgttaaaaatttgctcaaattctttaagctgtgcatctggcacagcaaattctgggagtcctggaggccgaaaagattcaacccaatcatgagaaggacccccacggatgaaatcagcgccctagaggtgttcaattatagttagaaatgctcaaaagggcaccaaaagcagcaaaccgaatgaccattacccgtgcaagtggcagttgatcttgcttgaactcattctctgaaccagggatggtcgataagggagcagctgtccctaattcagatgttgttggaacattaactgcagaccctggaagttcctttattgactgcacaaagaaaagggcacatacaaagttagcttgattattaatgcaatctggatgttaatcaccccaactttctactttattacattagaacagcgtaatcccaaatttccgcttcattgtattatagacccataagcattattgtctggaggatttaacttttaactttttaaggtacaccacttatatttggaacatccatttgcaattatatagtggctagaattgaaaatgacctattactacctaggaggtaaattagtcacctatggttattactaccttggagtaggtaagtttctcctcaacatacatctaagaaaaggaatcagtatgaaatttcttgtggtgttttaagatgtatttttctgtcgatgatgacaatcttttagttcaaatgaaagaataaaacaaatctgtctttcacactttagcatgaaatctcttgtgatgttttaagatgcatttttctgctaatgatgacaattttttagttcgaatgaaagaataaaacaaatgtatctttcctacttccttggaagttgaattggaatcatccagaaacagtctaatttcttgtgatgttttaaccataaaaagcgttgaaaatattgtacaatattcatggacaatctccattgcatatatttgcaatccggctgataatggaataaatacatatatcagttgtgtctagggtgtcaatgtgtaatgcaaatgttggcttaagggaagtgattaatcacatttagagcgttgcaagtgcatcccttttgttccatgaagggctaactgtttccagttggttagtagtatttatgccaaaattgaccttcagagatgaatggccatgattaccatatggttcttacagctacaggaatcataggtgcaccataaaagagctcttattaagacttgtaaaagaggtaaagataaactaggggttgacgcgggccaaccatgcacaatccttgtcccacactagtttaactaaatggactaagtttcactatttagagacacctcatgatctacttacatggatcatggaaagcactgaattgtaccaacactttaggaacaggcatgtacttttcagctacttcaccagaattgctcaggcaacttcagttccaatctaggccaaaaccccacagaatcataggtaggcgacatgacgaaacacagataaataaactagccaaaaatcagggaaatctatactaccactcgctgtcgtgaattatgataggccatctgtcacccaccaattcacttactgcacaattttatcagatgaagcagcatgatcaccaacctaaacatcacaggatcgaactaagtagtaactaaatacatccagaccaaaccaacagtacacaaacatacatcgaattacttccgttttaacttttaagaccagtcaaacgaaattgcgtcgtttccaccaaacaatcacatcgcggaggagaggaaaggggagcgacctaaacggcgccggaattgatccatccccaaccatcaaccagccacagccaagcctccgaaccgcgagcaaaaggccagtagtagtagagagcaagtgactagggctagggctaagctttacctgcgccttggacgactggccgaagatggcgttggcgaggttcccgaaggggttggacgacgacgccccgtccggcgcgcagttgccctgcccggtgatgaggtgccgcatcgccatctccgccgccgccgccggcgagaggcgttccggtcgaggtcgaggtcgaggagagagagaggagtcgtgcagcgtcgcggtggctttgtgggaggggagtagtagcggtaagcagttggaccccgataagaccaggacacgtgaaagatcgtgctactccatatacgtatggctggtttggttggttgagaataccttttctttttccttcaaataattttaattttaatttaattttatctttgtttgtttttttctcgcggtgaaaacttttgttttttaaatttagtttctatacgatgcgagaagggtggagacaatcgattagttttaaattcgtttcgttaagttccacgaaattgtgaccgaattttctgagagtctcctaccactgaataggagactttgtactgtgtctcacagaaataaattttgtccggttaagttccacgaacttcccgtagaatatcagagattcgatattgggtgatctttttatattgtagattgtaaatttgtcctcatgaattttgacattttgtttattctatttgatcactcatcttattcaaaacatttttacaaatataaaaaacgaaaaaatatgcttaaaatacattgaataataaagtaagtcaaaaataaaataaataaataataataattattttttaaaataagacgaatagttaaatagtaagatatgggtacgaaatttccgagggagtgagcggaatacactgtaccagcacaaggatttcctctaagcccatgggggcccaagtaagcccaattggcccaacacgagacgcatacgtacaacaaagcccgagaaggaaacctaagcacaacccaaaaccctcccctctctctctcgcctcaccaccgccgtcgtcgtcgccgccgccgcaaccctcgccgccggcgctaggctcgcgactccgacgatgtcggcgccatccgaccccgccgtggccacccacccgcaggcgggcgccgccgcggcggcgtcctccagcagcggcctcaccttcaagctccaccccctcgtcatcgtgaacgtctccgaccaccacacccgcgtgaaggcccaggcggcgtgctccggcgacggggcctcgtctgcggcggcgggggggcagccgccgagggtgttcgggtgcgtgatcggggtgcagcgcgggcggacggtggagatcttcaacagcttcgagctcgtcctcgaccctgtctccgggaccctcgaccgcgccttcctcgagaaaaagcaggagctctgtgagtgaaattccggcgaatcttctgcgctttttgttagggtttcggcgaaatctagtggtacgagggtttgattcgtgattgcggttgtggccgtgcagataagaaggttttccccgacttctatgtgctgggttggtactccactggaagcgatgtgcgggacactgatatgcaaatccacaaggctgtaagttcttgttctgttcttagggcaagctagcagaaagaagtaatctatctggtcagcaagtgcccaacctgtctcattatgacaatgtgcttggttgtttgctctttttacagaaatagaatatgggggcttggtgtaatgttgtttagttggcatggttggcagtgctagcatctaatatctgtggggtttctggttgaattctgaaagggatggtagaagaggacatggttttcctagttttgtggctacaccaaattatattgttatgaacatatactgtttattgttatgttatagcatcatattgggtggtggagcagatggtaggcgcataccgtgctatttatggaccaaagaatgttactatgtattcaaatattcaaattgtgcgatgcaattattctggccatataaattgatgctacaattttctaaaatatctgctgtagtcatgtgtcatgtattccaaaatgttttatgccttctttcattgccaatttgccagcagtagcagatagtagtgcttatgttgacattgcgtacatatattctctatgttgtgtttttactcaagtttctgttagcaaatgaaataggcatgactgttaactcttttataacctcattgcttataaacatatatattcttttgagatctgctctgtacattgtttttgttcctctttgtgttacttacttcttttttttattatccagctgatggacattaacgaaagtcccgtttatcttcttttgaatcctgcaatcaacctctcccagaaggatctccctgtaacaatttatgagagtggtaagtgaatctgacttcagcttgtatcattataaaatatattgcaattgatttcacagtttttatatggtttgggtttttgttttacttttaggtgtacgtcaattatgcatgtacctgagatgtactccaccttttacatattgcccactactcctagaagtcttttttcccccaaatgccaccttttagcatcacgtatatagcatgtgtgaccccttgatttctcagataattgactcaaaccagttcggtgttctttcatggtgctactgttattttattgttccatttctccgtctgtttattattctaatttcctctttaccattttctgttatttctttttttttgacatgattttctgtaatttcaagagttgcatgttatcgatgggagtccgcagctcatctttgtcagagctaattatacaattgaggttagtttttttcttgtgtgtgttgctttttccataaataatttttgttaagacttaacgttagtacgtttgatttaaagactgtagaggcagagaggatatctgttgatcatgttgcccatctcaaaccatctgatggtggctctgcggcgactcaatgtgagggttcttcttatcatcagtttatgtcttacagatattgagttgtactacccaatatattgtttttggaaaaatgatactgacagatatatttgagcagtggctgctcatctgacaggaatacacagtgccatcaagatgctcaatagcagggtccgtgttatccatcaatatcttgtttccatgcagaaaggtattttttgttgctgttgagccctcaaaatatgtctgctattcgatgtgcttgaaatatagttcaaaatatgtttgccacctgttacttcaaataggtatcaactgtaaatccctttaccatcactgcaggtgatatgccactggacaattcgctgcttaggcaagtctcaagcctagtaagaaggctaccagcaatggagtcagaaaaattccaagatgacttcctaatggtctgctaacttgataatattctctttatttttgtttatcaaccgttgtccttcatgcagtgatgatcttctctgaattttcaggaatacaatgacaccctcctcatgacttaccttgctatgttcactaactgttcaaggtatgcccccacttattatgcaaactacaaagccttttgatatgaaagaatgtcacaacatcaacaagataagattaaaaaaatactttatagggaactcaaatcagcttgtgatttgtacacttcaatgtattatcagcaaatttaatagattcactaatgttagtaaatccgtacttgcaaatgaagttatctgccaagagatgaagagaagttgaatcataatggttgtttactcgtttggcattgcacccatgtcagtgtattaatactcttgtaacttgcagcacaatgaatgagctggtcgagaagtttaacgcgacatacgagaggtcgactgccaggagaggaggccgaggtgctttcatgtagattttcccccttctgcatctgcagctggttctctgctgagattttggaaatagttacccatatggccaggaagtttttgcgtataatctgttaggaactatatctggcagccatcaagtttcttccaaactcatgctccctcgttcaggattgacacggcaaacatgttgatattcttgattctgtgcctagatcgttgtttattcctcattcgccaagattgacatgtaaagtttatccccatcacccccatggtagttacactatttgactccctaaatggatatggatgcaggtttcctgagttatgcttgtaaatttctttaggttaactgtatgtatggctgttggtgttcacgcagcttgaggtgatgtgatgcgttatgtatggctgttggtgtcaacgtagctcgagctgatttgatgcgtgattgactgatggtcatggcaaaattaaacgggactgtctatacatcatttaatagaaaacccccataaaaatcttgcaaattgcagaccacccgattactttaagatccgtgcaaagaaacacaaccctaaaaacctcctcatcctcctttctccctataccgtgctgccgctccctagcgtgatccgcgcctttgttgccgccgctcggcctcgctagttggccagaaggcgtcaacggcgccggcgagcacccccccccttcggccagcctcttccccctcccctccctcctcaagccaccggcggcgagatgcccccgccgccaatgccggcccaccgccattctccatcaccatggcttcggctccggcgcctcgccggccgctcgttccaccacctcccatacccatccctctaaacccggcaaccaccctcttcttcctactcccacccccaccccaccccaccccgggaccttaattagtcggtcctctgctggagtttaggttgtcgctggcgccggagaagaagaggagatcaccggagttggaaaagaaacctagagcacgaatcgcgaagcacatccaatgatacaaaatttgcaagatttgtgtatgcgttttctgtcaacagaagcttaacaattccgtttacggtggcgaaatgacctttcatgtttcaagctaatgtagatcatgaagctgagcccgaaaaaaattccaagctactagaaaacaaagacgatgaaaaccaataaatttccaataagaattcattactttattacaggacacaagcagccgaccaatcctaagaacagctccttgtttacaatctacaagtgcaaagaaaaccaaccaatcctaagagctgttccttgtttacaatctacaagtgcagagcaaaccaacaaatcctaaagaacagccccttctaacctacaaacgcaagagatgttccacagttatgttacagaacggatgaaggaattacagaatcaaacccgaacgacaatcttcggtttattgccttcgaatgtcaggatggcactgattcctgcagcccatctcgcaggcgttgccacagactgttaatccaggctttcgctccaggagctccgcgacagttggactgcagccacggcgttccaacatgttcttcccaacaccaagccacctcaggcccctaaaaaatggcggctcaaatagtcccaggaaattacgtgacagcctagaacaataggagagatccagcattcttagggaacttttacccaaattgtgacgcatagaacctagagtttcaagagaagaatcattgatgaggaggcagttccggaggcagaggctgctgatctgctcgcagttcttggcaatcaacgtgacagctctgcctgatattctaggtacattcccgatatccagtgagattagagttttgttgatggtgccactcccgcacaacaaagaagctatgccattgttgctgatccttttgcaacctctcaaacataatgaagacattgggcaccgcccattaccgagtgcagataatcctgcatcggtaatgtcagctccagcaagatccaatagtgttagcttcgaaagctgcgaaatagaagccaacccagagtctgcgatgctcctgcaacctgataggtctagaacttccaacttggtgcaggatgagagtgagatggctgtttcactggttaatagactacagcacagcaacctcacttccgtaatctttggagctgcctcatcaagatcaagacatgtcaaatctgacaagtatccagtactgacctcaaatttcttcaggtccttgcaagactgaagaagggctgcatacccagcatccctcactttagaaaacccagcaagtctaatggttttcagttgcttgcatccgtcagcaagcatcattatcccaaagtcagttacccttctgaaggtggacgaacaattctgcttaccacgtgtcagagataaatgtgccaggttgtggcataacccaagtgcttggagcccaacgtttgtcaggtcattgtgcaaatctggttctttcattgggttatcttctaggcacaactcaactaagttatggagactcccagtgatgaacgcaacaagttcatcagttattatgtcaagaactaaagagagtgattctagagtgttgctaatagatgtcttcagacttgtgcttataggaaatagcctctttgcctgccaattcgacacaggctgtagcaatagtaccttgatggtactaggaatgggtaccaatgactcaaaatcaacggagcctggacctagcagaggaaagaacttgagtgaaagattctgcatggagagaaaagaacgtcagattagattatccgaccagattaacttttcaaagagttccatgtcattgttaaaataatatggctaatattatgttatctatactttagtattcacacattctcagcctaaaatattatttacaaaatactatattgctatgaactgaccatatatgtacgcgaagaacagtattggggttcatctgcaacaaagattcctcacctccaggtaaccgcatcctttgacgatgtgtgctatggactttcggcagatcccgaaatgttcatcatcatctgaagctgccatctccagcacaaatgatctggatataaagagaagaattcaacatgcttcaatcgacatcatttgggccaatatacaacctatggaatgtacaaatcaatttcccctaatgtttgtcacacaaaaacaaagtttaaaaatcaatttcccctaatgtttgtcacacaaaaacaaggataaaccgagcagtgtgcacaatatcatgcaacaaattcatcaattcgattcccctgatagaatacaatttcgtgggcaatcgtgcacacagaaacaaagccaacgctgaaggaagaaaccacacctcaaatttttgcatctctcaccaactgccacaaagaggtacgaggagaaggacgagcacttgagcagcgagagctcgcggaggcttcccttcgcgatggcgcccaccgcggagtcatcgaggaggctgcagttgacggcgaggcagcggagcgcgccattgcccgcgagaatcctattcaggatggcattcgtcggcgggaacatctgccaacaccaacaccaagcgcgtttagggggggaaatcgatttggggcgcgggggggaaaggggaagcgagaggagaggatggggggagggattgagagatgagccccctcaccgataggtcgagggaggtgacggcggagaaggcggcggcggcggcggcgcggagggcgcggcaggacgacgcggccgagcacgcggcctccagctccagcctgacgaccacctccacgaggagcgcctccgggaggctctccaccaggccgcgcgcggcgctgccggaggcctcgccgccgtccccctcgccgtcgccggcgacgacgagccggcgtctcttctccattgctgctccccgtttgcttccgggccaggggagactggagaagcgtatagatgtgaacacgggccccgggatataccaccagacatctggggcccacgagagggttggtgtatgacatgtgggcccgcccaaatgagaacttttcttcttcttcatttgggtcgtttatgacaaacgattttattcacaaattgtcgcatgagttgagttaatcatgtactccataaattgtcgcatgagttgagttaattatctactccatttgtttagaaatatagtagtttgtgtcattcaagttttatttttttaagaataatgctactcgtgcgtgtcaacaaattaaaccatcctcatttggtttctccgtccacatccttatgttaaccaatcataattacctctctttttaatttctttaaattctccaattaaaaaactctagaagcgattatattttatgagagggagtaaatgattcaaaacatgttgagaatatgtatgccatttttttttcttagaaatatacttgagctaaattcttttacaacaattcttagaagataaaatcccatccatagcaaaaaaaaaaaatccctctaatatgacatttgacatttgtttagtctacagatgcatctttgaccatattttaaaataagtttatgatattgagtaaattttgagataaatttacgcataccactttcacgttcttaaactaaatatttaaaaattcatagatattcaaattttaaaaattcatattgtctaaaatatcgtatatttatatcctataagggagtaaatatgaacgttgagtagcattgccaagagtacaacaaaatgtaaatgatccaacattcaacaaaggccaaagttaatacaaggaaaaactggagcactgagctacatttattagtataattaatgaatgtaaacaaagaacaaaagactgaaagttataatgtacatttacttgtgtagtgaaatgaacttgaaaaaggtgtagtcaaatgaacatactagtaatacacaagtatcactgggttaactaatggctatactactagtcaatggtagattcctaggcttggacaaagctttcttcagtcaatgttatttcaatattacgtttttttctctctcgggcatgttcaatctcaggcctcaaaaccaaacaaacaatgtcaggcattcctggttaggaaaaatgcatcgagatttcaggggatcttcaggcaccagtcttcctcaggcaccaaccaaacacacccctggtccatctgaaaatctgagaacaaatttgctttgtagtgattgatccatatgctaggctatgcttgtacatgctacaaaacgttgaggtacaaaatgtttatctgccaccaatccgagaaaaatttacttcccggagattgatctatacgttttttttttcccttcagtgctccaagccaacagaacaaatggaactgtcaacaaaatgcctgcctgtagacaaggggaaatgataagtgattaagtttgtaatcctagagaaaaagttgcaatgctgcacaatgacaatatgagcgatggtgaattgatgattaagaataagcaaagggaaccattgattcaattattcgatttgtccacgaagttctaaaaaataaacaacaaagatatccacgtgaatgagcaatagctggagaagctttccaacattattttgattgataattattcgattgcttggtttgaagaataacagaagagatgggcaatagatgaaaagatgataatatttgccaagacttcagtaactggattactgaatatctcaatttgacctggttatcagtaatacgattctgtcttaccttgtgtcatcaattgattctgagaacaatgctgcttgaataaccacaagtccaaaatttcattccccatagtttccgctgtcctgtattcccaacattatttcctcactgttctcccattcagtcaggcataaaatgagtgccaaccaagtgttaactgcaaacaagagcaccattatgaaagggaccactagtatcgatcacattgaactcaaagaatctgtgaaagggacatagttatcgaaattgccatatctaaccttccagcaaccatgtatctcaaagtttgtttgtagatgatgaatcatttggaatttcgaaaggtacacttggcttatgttttaagatcatttatgttcaaattgtgtaagtcagtacttttatctcaattgaatagcttcaacaattcatttacattacataatccaacttaatacagaactatgtcctgagattactcgtgggaagctttgtaaagcaatcaaaataaaacaaaagcagcagttatagaacttaaaagccatggaaattatcaacaggtgtcaggggcacagaactttcccttaaaaaggcataatctgagttcatacaactaatgtaactcctatcgcttgtcaaaaataactcataggatttcactactccagttttttatgcctactcatcaatatcaaaataatcatcaatctggagtgagaagcacttctacagaaagtaacaactaaagaatatgtttcccgtgaaataaataaagtattatatgaattcttgcctaagcttttttgaagatgaccgtatagcttgaaattctacacatgatatttctttattctagcaatattaatcacaagaatttctagaacttttccgtgttagaaggttttgaagtaaaacaaattctccttaagagcctacctgattcttgattttttttttctattagatattaatgttcttatcttagttagatgaactactgttaaacagctgaacattgctatctaagcattgcaatttggctgcaaaaataaaatgaatgaatgaatgccaacaacagccttacaattacatgtggtggacatacagcaaaaaattccatccagcagtcaaatactcaaattatcttctggtgttcccaagagacaatatgtcctggaaggttttcacttcatcatttgaataggaaggttttcttcctattaccaatttcattatctctcttgcattcctgtcctttgaaattgatatgaggccttttagcagttggttaatagtatcaacacttggaaaccagtttttctccatgctgtctttgcacagcctgaatgccaaatcaaactcccttctctcacagaggtaatgcaccattgtctggtaaaccttagcatttggcttgcatcccctcccatgcatcgcaccaaatactgtcttagccatctcatgctcgcccatcatgaagaaacccttaataactagattatacgtgatctcatctggccttaagcctgatgcatacattttcctcaccaaatcattcgcttgccagccccttctcctgttaaccaagaactggattctcacattgtaactggcaagtgttggcatgcaacctctcaacctcatgagattccacagaccatccccgacctcacgctggccacacttatagaatgcatccatgagtgttgtgtatgtgatgacatccggtctcacccccgccttctccatttcctgcataacccgaaatgccgctcgaagttcccccaagtcacacatcattttcaccactgtattgtacgaaatgtcatccaactcaaccccatatgtctctgaactctcgaacaactgaaggacctcatcaaacagccgcgctcgcagtagcaccttcatcgtggcattgagtgacttggccgtgcgcgggcatccatacaatcccatctcgcgaaaagtgctcagcgcgtggtccggcatccttgccttgccgtacagacctatgatcctgaccacgaacccttcccgcctcccctgaggcaacgccttgtgctgctcgagtatctcctccactaggtcattccgtcgagcacctgccaggcgcgccaccgcgtcctcgaacgcgaaccggttctcaatcaagaggcggttgtgcgcgttggccctgaacagctcgtacagccgcaccgggtccctctcgttcttgatcctgaccagaacggggggctcggcaggctcgacgccggcggactccttggtggtggaggggtggcggcgccgccacttggagctggcgacggcggcgcggcaggaggcgatggtggggaagtccggctgggagtagtgcgcgtgcgcggagaacgggtggtgcgaggtccgggagagccccgccgcgatgacggtgagcgcgatggcgtcgaacgcggcgcagagcttgcggatggcgccgagggagagcatctgatccgccccgatcccgaggccgccgcccgcgccggagtggtagcgtcctcggcgtgagctaggtctctcgggggtgggctcagcacggcggcgtggaggcggcggcggcggcggcggccatgggcgcgggatgcgtaggtgaggaggagagggaggagagagttccacggctgcgtgcgtgcgtggaggcgcaacccaccgcgaagtgtcatgaactagcgggccttcttcgtctacggcccatcaaggcccaagttgatcgctgtgcttagttattttgggcgctttgcccaacttgcaatttatgtatcgctggtggtcaaattagttgttagggcatcgatgcaaattggtattttctagcagattgcggttactacactatagccatcatttaagggttttttctatgtaaggcctagatcctaaaaaaattttggccaaaaacgttacattaaatgtttggacacatgtatggggaattaaatgtgggaacaaaacaattacacagtttaaatgtaaattgcgaaacaaatcttttgagcctaattacgtcatgattggacagtgtgatgctacagtaaatatttgttaatgacggattaattaggcttaataaattcgtatcgcagtttacagacggaatctgtaatttgttttgttattagtctacgtttaatacttcaaacgtgtgtccgtatacttttaaaactttacgcccaaagaactaaacacaccctaactcatctctcctgtatttcttgttctttgcacacaatttggcatacagtactatgatagcacctcgattgacatcatgatttgtgaaaaagattgtgatgtattaagtattaaccactcatgtttgttgctgtgaatctcagcatgtgacatcatgacattaatcaaaggcatatgctgagatttgaaaaatgagtaggttgttcttcgctctgcaagtttagtctatatgtttagaagagccattggcattaatcaaaggccagtcaccattattgctttctaggaaaccatcttcgcacctgatcatcgacgccacatccgattatggcaaggaccagatatcctggtccaaagacatgaaaagtaagctcgagaaactggatgagtccagttcacagattgagagcctggttgtctgctgctgaggatggcaaggttgagctcatccctggcctgcaatcttggctttgacagcttcgttatgctgtcgaagctgctgacaagacagcgtgtttgatgagatcgagtaccgatgtaatccctgatgaggtgactaattgagagaaggtttccagtgccatgaggaaagtgttcagtttttttttgggagagtggtgaaagctgatcctgtaatgcagagcctgcaagagcttttttttttgccagtgaaggagttggaggatatcctcaggtggatcctgaaggatgcacttgcacaacatgtattcaataagaaagaactggaagggaagtttcatcaagaattcaagatatggatccatgcctctagtagacttgagacgataagcattgccaaaaaagatggtaaagtcagtgacaggtgtgaattatgacgtcaacacccttgataaagctcacaagagactgatggacattgatgtataaagagatttctgttggtgctggatgatgtttggaatgaagctgatcaggaaagttggagtaaagccattgctccgctaagatgtgcaggccatgggagcaagatgctgataactacccggttgggttcagttgctgatatgattggaaaagttgttgggcagcacataagaatcattttggagggcttataaaaagatgactacttattactattcaaccagcatgcatttgcagatgttacaggcatcgatgagcatggaaggttgctctcaattggtatgaagatatcagagaagcttaatggaataccgcttgccgcgaagacaattggtgcaatgctgaattcttgcttaggtggtaagtattggaccagaatactggaaacaagaactttcgatatagaaaacaacgacgttgacctgattacaaaaggttacagtggcctcatgacaactctgagattgagttacaagcacctacctgaaaacttgcagttttgcggcattttcccattaagttgcagtggcctgaccagacttgaaccaattttttcatgagtgatcacctttcggatcattgaattgtgagaaaggaacacttggtcggcggttcaaaggcggcaaagggtgaatatgagaaccttccggttggaaggcggcaaagtgtaatcacaacaatagcacaagcatacacaagtaagagtatgactctatgatgatgatgagccgttgaggagctgtccaatatcatggattagctgtgccctcaagttgtccacgctgtccatggtaacacctcgggccacaactccaagccaatgcgactctgatcctccagcagcgtggtttcgccaccaaccacagatcacctcagcacatttaatcatgtaaagggcacattcggttccattgttttgcttaggtgtcggagctttagtgcatttcgtctcaggaggtaggtaaggaagcagtgatgccgcaagacggcgtgcagctctcaaattagcatcaccaggactgctgtcatggtgggctaagcatggtctgcctccaaggttgcggtcaaacactaggaggctccagtgtgtaccttcacccaacagatggggatcctgactgttcactggaaaaaaggactagttttcgagaggggagtcctagactctgtagctgggttgacacaacagtagcatctgagtttcctagtagatgtgacattgcaggattcacaagcaacacatcttcgctgtcaattctatctgataacctgttgaaagcatggaccacaactgggtcagtgaaaaactcctgagagcaaagagagcgtaggtcatctatcgtcactcctgccgctgattcactgcttgttgggagagcctggggtgatagattttctgtgttgctgcttatcagagaactgctagcggggagagcctgcagtgtttcatctactgaacagccgccaatctgagaaccaacacttgtgggaagagcttgtggtgcttcattaattgtatcaccgtctatctgagcttgtgctgataaattttggtcaggcagcttaggatgattctccacaagttgattggtacaatcaagatcagtagcatctgaggagtttcctagcagatgtggcattgcaggattcacaagcaagacatattcgctgtcaattctatctgataacctgttcactgggtcagtgataaactcctgagagcaaaaagagtgtagatcatctatcgtcactcctgccgctgattcactgcttgttgggagagcctggagtgatagaccttctgtgttgttgcttatcggagaactgctagtggggagagcctgcggtgcttcatctactgaacagctgacaatctgagaactaatgtttgtgggaagagcttgtggtgattcatttattgtatcactgtctatctgagcttgtgctgataaatttcggtcaggcagcataggatgatgcttcacaagatgattggtacaatcaagatcaaaacgtcttgctttatgcattttcaacccaagctcctcctcgaggtatgaaaccagctcatcatagtatttctcctggtcctgtcatatgtaaatgaaataagttgacagttgaattgataagccaaatactatctgcctaataatatgcaaaggaatcgatacttacatcactcaaactccatcttaagaaaatttctggagcaactggaggacctccaagtttgcctccagatagacccttcttttttgtcaactgttgctgacctctcctgtgcactgcactgcgtggcgtgggctgtggctctcgaggcagtggaatatcctcctccccatcaccgccaagatctacatacaggacaccagctcaggtctcgtggtgggggtggtaatgcagtatgtttgaaaattccctccaaataagcatcgacatgaagataaaatgtgcttttcagaagatcatcaaaagtaagcaattctcttatgccacaatcgtggggattgtatctttgattgctaagagacctcataacctgttggctgattgaactccaattgacgattagcctcttgacccattcaaaaccatcacctaaccgtgaccccgtaccatgctccatggcatggcatatcctttttatgcaccattttgaattttgattccaaaaacattacgaccatcatgcccaatgaaatcttgaacccaattgggactcttctgttgctaggctgataagaggaaagataacgaaaacattttttgaacagttgcagattcagccatgtattttctgtcccatgtggggatatttccttatgatttccattgaacggaagcttatgacattgtgacgaattcatataactcccaagattatcatcagaccgcatctcataaatgcctctgttgttgaagaacccaacaagccagccagttctagcatcaatcactagtacaacgtattctgcttcatacctaaggacataatagaatgtcccgtggactggtgttgtatatagcatcattcggctatatgttaccctgaaagcagaattccacaggagccagaatctgtagtgcccctggcaatgtatgaagttctcaacaaattcatgttctgttccatcaagatatagagttactgtgttctgccaaaggaggatgaaggtaaaatagaaagatcagttcagttgcattcacaggttgaaaatgggtagatcaattcgttagcagaccgtaaattacaggagatagaaaaaaagtgatcgacgatcataccctcggtgtgagagctggtgttttctttttgcgcctgcccattatcaacactaagatacttcctccaacagcaacaaggtcagcaaattatcctctgcagccacagggaaggcgtagtaaaatcaaaataataattaagaactaaactacatcctaagaatcaaaacaaatcgtgctatggtaagaatcaaaattaactgtgctccctccagccgcagcagaaaccagccccaaacaataaaaagaaattgattttttttacaagaaacaagcccattgtggtgttctctccagccgcagcagattttttttttgttttggaatgcgcaaaagaattaagcatcaatcagccgcagcagcaatgcaccggcagcagcagaacaatttccaggagaccgacaagaaaaactggaaacaaaaccaaataatcgaaacaaaccgagtttcaaaataaaaggaatccccggccattctatgcaggataacatacaagaatggacctcgaacatctgctcctcctcaaacaaggcacaagcaagaagaagtatgggagccctagttacgacttggtgacacatttggctaatgcgaaatgagaaaatttttaaaggccatcccccgaatacccaccaaatcgaccaaacggtagctgccatcctagaggatattaacgatagagagttcacctttaagccgccttaattttcttccctttagctttgttcgccactctgttggtttttttcctagttgtttgtatttgctgctactatcctatgtgatgtaaaactcttctctatccttctaatatagccggcaattctcttgccgtttactgttaaaaaaagaaacaaaccgagttttctgattccagtgattcctcaagatcaccggcagaacaatatctcccgcgacgaggaccatacagaatagaaaggacaatgcagaagagaaaatgctgcagagaggagtccgaccccaacaaaatcaataactgatacaaagaaaaacaaaatcaaaacaagtcctaattttttcatcagaatcagctagttcagagatttcttgagctaacagttggattattctctatcaacaacacgatcttgcgacacaatgtccccaagaacttgcggcacaacgcccccaggcgatccagagcaaaacaagaagaagaaatgggagatcaaccccaagaactatagaactaaaggtgcagaacggcccgaactgatgcagcagaaaggagaagaccaaccccaagaacagagcaaaacatccaagaaacaagaattgtcgatgttctttcgaggctcaccggcggaatagtatcctccagaaactagatggcgggtgcgggcaggataggctgattcttccaaagtactggacaccgtgatcgtcgatgagtcgagctccctcggcttggttccgctgccgcgctgagcgggaacccgaagcttgaagacgattgttttttttttcctttcctttttttttccttgggaaaaatggttgtcttgggattgggcgcatctggtgcccctcttcttgataactgggccgggctaaacgagcatgttgggctcgctcagccgatccacacacccacaccctctctgtcccccaccgcgtcggccgccgccgccgccgccaccaccgccgccgccgtcgccgtcgatgcttgttcatccccaggcgccgccatcttcatcgacaggtggaacatccgccgctctgaccccgaacgatagcagcttgaacttgaagtgatagcggcgcatgccgccgagtggcggctggcgagaggacgcatggtcgagcgcgcccgtggggacgtcgtagccggcggcgaccaccgtgtgctgcctggcgtggagcggccacgaacgcgacgccgccccgtcgatgtaggtgaggtgggtgggggttggggggcaggtcgcgctccgccacccaagcgcgctttggtcgagctcgtcggtggcggcggagatggcgtcggggccatcgccccactccatgttcaccgccgcactatccaatcatccgtgccgcgggagatgatctcccggacgatgtcgcgcgcgtgagccttgccctccgagtccacggcgcggtccagccatgctcgcctcatgctcgatcgggtgcccagccgcttcaaactccgccgacatccctgcacgtcgagccacccccaggcgccgatgttgtccaccgcgctggtcacctcgaacgcctcgtcaagcgagcggccagccaccgccaatccggccatgatgcgcagtgagacgcgagagcggattgggattgggggaagggaggtggagaggctctaaccctcatcgagcgaaggtgcgggtggcggcgtgaaagcggagcgggcgagaccgatcgaggcgaggcaacggttcacgcgcgcggtggccgtgcagagcagcaccggcgcggcggcgcattggccgaggtggcggcggctggtggggaaaattgggatttcgcgtcgtggtcctcaaaattggatttcacccgaatgcaactgtacaggaggattcaataaaatatcactcttaattaaaggctaccttacataaaagttacgggccagtttaaattgctaccctaccaaaatttgctctggtagaatagcaaactaaacacctctattaaaacactacctatgctataaatttagctttgcccatgaacttgtctcttatggacatattttggcttcaatccaaataaacattttcaactttaccctaccaaaattttagtagtaccaaaacttgctcaaaatttggcactaccaaaaatctggtaaggcatgaatcctaacatgccctgcatctattacttttaccatcaatatcaaagagaatttaatttatcttgtgtgtaacaaatatcaaagagtatatacactcatggaaccaatgagtatccttctttcattcatcactcaacggtccagattgtctcggtgaaatctcaacgattgagatcgctcccacctcccacctccctcgattgcgcgctcctcttcgccccctctctatcgctctcacgcgccgccgcccctccccaaccccgactcacgcggcgccaccgccctcgactgtcgctgctccgccgtcttcgcatccgtcgtcaccgccaccgatccccgcgccaccgctgtagccgccgccctcgactgccgccgctccgccgtcatcgcatccgtcgtcccaccgccaccgattcacgtcgccgccgacgccttcctcgcctggtcgctgccgagaccttcctcacccccgcgattcccaaccctaaccgccgtcactgccaccgctagcccccgtcgaccgtcgcaccgtgccgcgccgcaccgtctcgcccttccaccaagcccccggactccaacgtcgccgctccacgccgccactccagccccgatccacgccgccgcagccgcatcaccgtttgtttccgccatgggggcgtgattccgcgcgacggctggaggaggcgaggtcgggcctgccctccatcgatggcggactccgcgtgacggctggaggaggcgaggtcgggcctgccctccatcgacgctccacgccgccgcagcccgcagccccgtcggcgccgttgctgcgtcgcttcatcgccgtcccgacctcgaaggagaaccggcttcgagtccctcgcgccgccactgatccagggctcctcaaccctgcaagccgtcgatcccgcctgtgaacaaggtaagagtgcttctcgatcccgttcctgtacatgaggaggcgacgcacagcgcgtgggagggcaggcggaggcgaggagaggcatggctgccgtctgccgggctcccgggcgcagcctcacagagctgcggcatccacgccggacggcgccgcggcgtggcggggcgcagccgcgcaggcgtgcagcacaggcgccaagcagggcaggggcagggcggatggcgcagcagcaccaagcagcaagcaaggcaagcagaagcagtagcagccatcaggccatcacgcccaatctcccatcagcagaaaatggacagaaagagaaaagggaaggcactggcatcacaaagaggttgtactttttttttatttgacaatttcagaacattgcaatttcaaagtgtacaaatttattactgaaattgcaattaaatattttatttttaggatgcttgtacattttgtttcactcattgctttttatcttatcaaactaatcaatctttgctatttgtttttcagattctacatatgtatctatcctcattagttcatatatgtgatgtacggctgaaagcttgaatcagtgaatcttgaggtatttttgagtacctacttttatatttacacttatttgcaaatggatgatgaattgtgaacttgtgattaagtgcttgtactatgacttgctgatataatgttacattgtacaatattgtgcattgaattttttttcttaattcttgttctgtgttaactctcgcgtgtggtagtttattggccacacctaaattttttttctgtcctccgccactgttcatagagatgcataatggctttaggaatcccctttgttgactaaatccccattgttcattattaaacattgttcactgtgcatggatatctgtgatgcaaaactctaatccaaagcctattttgcatttcaactaaatttcacgtgttaatctcattcgtgtggtaggatttttttttggggtttcattgttgtcattggatgagatacttcacatcttgttaacatttatcgtcaatctttcattgtaaaattgtggggaagaaatggcctatctcagataattctattgtgtcaatttttctatgtgattgcttatatctagcaaactgacttaacctttcatttcaaatgatttaatctataggacgaaaattcagattgccgaagaaaaattcaggctgacaggacaccatgtcaactgctattgtttgctgcacaatcaacgaaatttttggctgattctactaaatttctgtttggtataggtaatttcttccataatgattaccccttacaaatagtgcaaatgtatacttcgtgggtcaatcttcgcactgttgtagaatctgatgtttaaaattgcctgcatccggtttacaaatcaagaaaaaaaattgccctgattactgtgccaaccatattttctttgagggattgaccaatctttttcttggaaaagcttaaccctgttccaaacgtaatactgcaaaattttgctcaatttcacatgcacaccacagtgtagtcatgcattaatgattttgatttcacggtgtgacatgcacatcacattgtggacaagtacattgacagaccagcattttgatttcacatatattcttccctgttaaagcccggtcatcctaatcgatctgggatctaagaattagatggtatatgcagtacctttagtttttcttgcaattgactctaaattcttatgacgttcagttcatataaataactatatcctacagaatagatgaacctatttttctttctctagggcaaataactgaagagtgttggtatttgagttaaccactttttacgaacctaacctgctgcagttccacaaccatggatttaaatagattgttcatgtagttcctattttttcttgtatcctacgttcacagatcatttattaaattttccttgtatcctacgtttacagtgttgcatgaatcaggaaaaatctgattgaaggatctaatatttgaggactcctgctctgctgttgactacttcactccagttattcaaggtatcaaagttactctaaaacagtattaaacattatgttttgcattgttgaaaataaacaaatgttcactgtgcattattaaaaagtatgttttgcattgtgtctttgctttaatttgaataaagaaatgttcaccatgtaccgagctggactgaaattacttgaatggatcatcaccacccttgtctgaagtaaacagtacctacaacagataatgctaattgcgaatcattcttggcaattgactgcatttgtaattgattgttaattaattttaggcgcactatactgcaaatcatgtcagctttcctgagcatttgtaatgatcaatgattaaaacaaattattattattatttatcttcgtagcagcaagcttgagatattattggcaaatcatatccaaatctctgtcaattacgctttcatgcagcagatcagagtaaaggttagcaaatcatatccaaatctctgtcagatgctattttggcaatatttccatgtattacatgcccatacatgtcaactcacaagacatacaaggcaatattgttatgtctttccatagatatcatgatagcaacaatggtaacattatcctccttagcctatatatatgtgggtgaaggagtgtgatccaaaaaaaaattactgatcctccttagccggctgcatacgactgctcaacttcaactcatcatcttggtatcgttctccaagctatctcttatgtgttggaaattattatatactttagtttgcacctattgatctcctatttcttatgtattgtaataaggcatggcatccatggatgatgtggatttttcaccacatcaagccacacctaaggagtcaatgaactccaaggatgatgcgaaggtgcagccttcgtcagggcaaacaccaaacaaggggaattattacatggggcacgcgaatgccatcatgatgatgtttcaatacatacgtgatggttgccggcgtgttgagagttccatggaagactagaagtgcaagaaggtagaaaaaggacacggtgagaaaaggaaggtgggagaagggtatgatcctcgctggtcttctcccatcgagataacaatgaagatctgcaatgacgacgtctccgatgaagcaaccgagaaggaaacatgatttagtattgtcactactgtgttttggctttagaataaaataacatttcttgtgaattacacaagaaaattcagtaaacaatgtcgttcaggcctattcagtactgcttgtgaaatgcacaaccaaattcgatgaaactttgttgttatgatgcctattcagtattgcttgtgattgagttgatttctgggacctatacaaatgtgctctacctcctgttgaactactatgtatttgtttggcacggttggatgcatagcaatgttcctttatatttgttttccatgtctttttatataaggagacatcacacaccaattgtggtttagatctcacataaataaattaggtcggccaattttctgacgttgtgtagcactattgatttctgtaactcttttgctttagatcaaacacatgtaattcttttgctttagatcgaacacattttatttgcttcagggctccattaatttaaagagctgaccaatcacatgaatattgatttatgaacatgaaagcgtataaaaaaaaagcaaatataattaacataagaaaccagtatcgctaatttgctattatgttgcctattcagtcatgataaaggagtaaaggactgctagatgtcaaacttatgtgtatggtccaaatcctgtaatggcccattaacaactaaaatacccattataaatacttatatgcaatactcaacctaagtgcctttgatctgtcacgtttatcatatatcttaaggcacagatatatgcattatcatatatctttaatatcatattattatgcattatgacatggggcacaaatatattggtatatcctattctaatattttacttgcaatatatttgatgtatgatataaattgaattaaagctcaaatgcacagttaatataataatattttttgctaaacatgaaaattttaaaaattattaaagacaaatagagttgcaccgtagcgtttagcacgggtatattactagttaaaataactcatcgagttatgatcaagcatttaatttacctcttcatttaaatcttaaattcataaagactacaaataaaaataacttatttgaaaaaactcaaatatgaaataaatctaactcttgtggatggagggaatatttcgaataaaattgccgctgactctccttttcaagcttatctcctaactccggcttgctcattggtgatgagctgatgatgggctcgagtgtgggaaggtagcaaccttcacctcctttgttgcctcggttttgtcgctctggcgcaacccccatggccgatgtctacctagcaccatggccgttgcacaccgcatagaaaagtcacatcatctttatctttttgtcctcgtagcttgaccagtccatggccgttggcaagcccaaggactttccataacggccgctgcatccgcaagctcctttgcgtccccctcccacctccaccataaaagtcttggacgccacgcggtagctcatccatacctagggcatgggggatgcttatgttcgagtgtcccgaggagtgcgtggaagctgctgggatggtgggtgccatcgtgcagctcacgaaggcactgaggtcgttatcaccattgctattggctacctcattgccaccgagaggagaagggggcaccaaagagtggtgtgtagctcacgtgacgcggctagagaggagctccgccacctcatggttgtggtgcagcttgatgtgagcgggctcttcagctcggcgccatggcatttagtggtagttgataagggcatccatcaccggagcgagaaagaagagatggcctatagagaacccatgttgttgaaagtgttattttatcgaatcctttttgcacagtggtatttaggcgaaacctatttttgagggtggcataatcccaaatttctcatgcataggggaacagaagtttgcctatgagaatattgactactgtgatgtccctccattgtgatatcttaaaattacttgtaattttatattgtttggcatgatattcagcttaaaatcacttgagacttctttggttccataaaaatattgaatgggatttagtatgaaactaatctcctcaattctctccgacctgtctcctgtaatgaacattgtttatgcttttttagtaaaaaggctggcgcagagcctttgatttataaaattctctccaatctctccctaagcctattggcccataaggatattgaaagggacttgatgtggatttaatccccccacaatcctctccggtcctttttcttgggaattgaaaatatttttgacgagtatttattaaactggtgatccttgtataaatattactgattgaaccagcaaccgtagttttattttaaattgttgatttaattcgtgtgccatgtccattttccagatatggtgagttaaagattttcctttttaagtatatagtgatttagtggcatggaatggggattggggaagaaaatgtctttgctcagaaaggtccgcacttccacaagattaactccttcatgctagcatgatatgttttatgctagcatgatgtgttgatgtttttttggttagcatgatgttattgaacaaaactgtatgagttcattaacttctcatgcctctttctagcttgtagacattgacgattaatgagaaacgtccaggggtcttccggctagctccataaggtggtgggctagatgatctgggttcgaagcctcacctcttctaattatttgatattaggttcttccctaatattcgcgtttttgacattggcgattaatttgcaacgttgaaaagcatgagtgaacgcgtgctacttatctctgatgtggcgtactttaaaagagacagcgttggagctagggaagaagcggagggggagatgccggggatggaagaggagtatggcggaggaggaaggagtggaagatgcagatattttcaacaactgactaccaactaattgtttcctactatcttaagcttcctaaatgggtctcaataacatatgtttcttttaccaaattgattaacaaagtaaaggggaaaaaacaccaataggctactgtgacatcaaatctgaccaaacaacatgcacatctatattggcgaaataatgttggatccgttgaatagaacctgcatgagtggtagccttgaaggcacaatagcgatggatttgattggatccattttcgccggcggccgctaccacaggcgtaatcttgaaatcaagaatcaacacagtgcgcagctgcacagcaaccacgaagtttctgagttttgatggattaacaatggtgccatcgaagagcttgatttcctcaggtatttgactgacaaagcaagagatggataagtgtatgccgccatgaattagcttcggaatcttaatttgtatggtgctttccttcccattgcgaagaagggctaagctgatatccacggcgccatggatgccatggatccgccgactatacaccccatgaaatggtgtaaggtcgctgaaggcggccaccccgtcgatgagctgcaagtcgtccttttcgtcctctcctttcttgatcttgaggtcgtactcgatcacagcaggattttccagcgagatgcctcgcttaggacctgacaatcttataagcgagttgggatcagagtagtggccaggcaagacgaaaggatcatcccggccgcggttgaagatgtagttgcgcagggggtcaaagagatcccgggcagccatgaagccatagatctggaccggggcgtcggcggcggcgttggacagagctgctatcttgatggagaagatttgcatcatgcggcagccatggtggacgatgcaagccgtccagcatggctggcaatggtcggtccgagccgacagcctcatcggcagcaggctagtctcgcgggtgtcgtcgaggcagtagaggctgtggaacgggtgggagtcggggtcgtagatggatccgtcgctgtgcttgacgccgatgagctcggaggcttccatcatgtcgtcgtcttcgtcgatgtcgtacaagaattcctcctcttcctcatcatactcccaattgttctcctcctcctcctgctgctggtcatacttcttccccgttttgattggagcgagggaacaaggaataaccaacgcgttcttctcttcgttctcatgtgatgacgactccggcggctggcaatcgccggcgccgcctcccttgtccatggatcgatcgatcgatcgactgaatcaccctccggctgggacgctgggtgcgtggtttgtttgggggtcatgggattagcttgttgctgccttttatctgatctgatgggaaacaaaccgtgtccgattccgaccggtgaaccgtctccgagtctagcgactccgtcgtccctttcccggttttaccgtcgtcacgtcctgtgccctggtgtttggagtggcggctgcgtcacggatcatccgactggtaaaaaaagaggaaagtcagggctgccttaatccgcaaagctgccgagggaccgacccgtggaatttgctatatatttgtcgcgtgattttttttctacgtattttgtcgttttttcgaccgtatgatctgcgccgcgatttgtgctgatttcaaaggttgctaaatgcaactgggccaccatttccttccggcccaattatccttcctccctcctggcccgacatttcctcctctttctttcctcaccccagcccagcccatctctacaagccgcctccatccttccccttagcaaggccggcccatcctcccatcctctctccggccagccaaagcaccaccaccttccttttttctccccggaataagtccactttcgatcacccacgcgagtttgaatcacgtcctttgaaccgtaataatagaaatcataaccacatctttcataactaagaaaaaaaatctttcataactaggttaaataaggtcctgagacagtacaagtgattgttttgattgatgtggcatcctagtcgacaaatagaaaatcaaaaaaaaatgtgaagcccatatgtaaagtggactccacctctccctacttatcccctctcttccccaacaactcgtcggcgacgagaggagaggcgaccagcgagcccgtttgcgtgaggtggcagttgcggttagaggttggcgatgccactggtgtgtagctcaagctcgccgtccacgggaaggtggcggtggtggtgggcaaccggagaggatggggccgcagctgtttgcaagtgaccaagtcatcgttccgcccatttcaacactactgtcaaatttaaagttagcatatctctggactatagaatagagtaaacacaaattttgtttctggtcctgctgattcaacaatatcattccatatttccatttaaactttgcagccaaaataaaacctcaactactactatttaccctctcaacctccacactaaagttgttctaccagcagcgcgcacactttattctctcctctttatgtcagcattgacgaagcactgtctgtcatagtggcatatcttaagctgtggtacttgctatctttcttccctgatgtttgttcagttgagcagcatgtgcatgcttcacttcagcatcagtttgacatctctgaaaaggcctcacacctgccggattcctatgacaaaaaaaaaaaaaaggatcaacaatggctgaaggataatctgctccaggcttcatctttcacgcaaaaaataactatttttcaatcaagtttttatttttttaaaaaaatgttttcccattcatcaacatcagttcgtttcattgccgtttattaacttcagtgctggagtgattttatagtctttaagggtaccatatttccaccgtacatttgatatctcacggtactaagagatatatatatcatatttgcactaaatgttttggtatctcttggtaccttttaataactgtaaaatttctctcagcactgtacgtaggtttgcatgtatgttttgatttggcctgtttcagattgtagtttgtacgaatttgatgagaaacagtttcgaattactacaaatctgatgaaatcgccgcgaaccgtacagaaacttaagtaaagtattagtggtacctgatgaaatctgcaagaacaagaacatccctgtcagagggagtaagacaggagtgtactggagtacagtgtactcaacatcatatttaaagcaaacactgtaaaaacattgcctgctccaaaatccaaatcagtgtcttcacagtacagaagtgcctgacaaagctgacagattcttgtgttctgcatgtgtagattcgatcaggaatgccataatggcatggatcgcgtttctttatcatcagatcatcacttctactctaaacaacagtacgattggtcctgctcctacacatcaccagctagtagatcacaaaactgaaataaaaacagcttgaatttgcatcagttaatgttcgataggttgtaaaatgcaataagatgtccttccattctgcgcatttctcaaaaaacagataattttctcagcttacagcattagtttttctttaaaagaacattaccggccgtatatatttttttcaacaaaccaaattaaacccatcatctctttgaaattgccaatttttttggcatgatcgaattaaatcccccccccccccccccccaaaaaaaacaactaaagcaatgaaattgatgaaaaccataaacttcagatgctacgaaaccattttgcctaatccaatatgaatgtggtgcgatttggagcaatagacatcatcgttgttcatgaaatgtaccgtagacaataacatgatataacctagaaaatgaggagatcctttcttgcttccaaaactctctttcctatttgcaaattatcacatcattgatctcacaccaatacaagtagattatctagttcatcagttctaatcccaatctgccggccagaaaaagctgaggatcctatgccacgtacagacagcagaggtaaaacaagcaacccaatcaagaagctggacaaagctgtttgccacaaagctcagctttggcctcttgtaatcatgtacgcaagtacggaggttaagaaaaaaaattctttgtgctaatcatgctgttataaactcgttccgtcacaagctagcacacctatatgagataaacatcccgtgtgaaagtatatcctgcgccaaaattccttaccacattccggtgtttcaagtgtataatcattaccttccaatttcccaattatacttacaagacacgcacatatattacacatgctaaaaagacataatccaaccacaaatattctgatgtatgatctcaccacattactacgaaagcattatcatccggagtattatgtttggtatcgaaggtatcaaatctggtacttatgatgatatcgtgcaatggtataccattcgtactcgctctagtaagtctgagaaaagaagatcgagttccttcacaaaaatagagttgagacattaggcgtgctgtttcagtttattatccctgcatctgcgtatttggatacatgaataaattgcattcagaattagaccgtgaaacgaccgacccggcgagattatcttcttggttaactttggtacgtaatgagagaaacatggattgtacgacttttaatgcgtaggtatggtgtgagatgatgatttgctgccgtagtgaagtttactcccataatctccaccacgtgtacgcccttgactggaccgacctgaagagagtttatctaatttactgacaaatttggtttaagcaagcaatcacaaatgaatcacaccgtgctgttctaagatgtttatgtcctcaacgtcgtcaagtcatatatagtaatagctaaatgctgtggatagatataaattaatgtgtactccctccgtccaataaaaaacgaatctagaatgatgtgacatatttcagtactatccagattcgtactaatagaatgagtcatatctagtattatgttggttttttatgagaccgagagagtacttgatgtttagaacattaagggcttgtttagttggtaaaagaatttgcccttacatgtcacatcggatataaggacagacatttaaagtattaaacgtggtctaataacaaaacaaattacagattccaccaggaaactgcgagatgaatttattaagactaattaatctgtcattagcaaatgtttaatgtagcaccacattatcaaatcatggcgcaattagacttaaaagatttgtctcgcaatttcctggcgaactgtgtaattggttttttttctacatttaataatccatacatgtgtctaaacatttaatgtgacagtgtaaaaaaattgtttggaaactaaataggtcctgattgtgaggttttcacaacaatgtgtccatgtggatgctttttgtatgatgaccttgtattttagagatgaagtaagataggaccaatatgtacaaggactagtttaaaataattgaactaatagctggtataaaaatatccaatagagttagttaaagtgatagattatttattatcaccattattgtctgaagtatagatacaaccgttggatgcatcatcacgaaaacatttttccccttctccatacaactccaattgttccttcaaatcattaatgatttatatctattttcttttattggtcatccaatacatttatctagatgctgccaatgcaacctggcttgcataggtcccttttaatgcaacaggagactccacactaatactgttcctaattcctgcatctgtttttacaaaagatgatcgagcagctctgaagaagatttgttaatagttcatggatcacaaagcaaggcatctcaggcatctggtgccatgcatgcatttcatctgggctatgtggttgaagccctgcacaagtatgcatgttcagatgtttcagtttctgtacatgttcaggcagaaagctagccagtcccaagttatattcagacattcagtgcccagttcagttgctgttgcccaaactccattgtagcagtgtgcaggtttacatggagcttggcaggcagaccacatgcatccatgcatggatcaggaactcatggtgcagtgcatataaacatggagacaaaagcagcaatcaggtcgagaagagaagataagccttcgcttctctgttggatcatacatgatgtggacatagattttcatcctttcgaagggttctcttacatatcacttaaatatttttttaaaaaaaataaaaaaactaagatatacacgtacaatttaactattacaagttgtaacaaaaataacaaatttcaggtatttgttactctctccgtcctaaaatataagaacctagaactggatggaacatttcctagtactactatccagattcgtagtactagcaaatatcccatccagtcctaggttcttatattttgggacggaatgagtatttgagaaaaatacaaaaaagatattgacaaaacaccaaaatctaaaaaaaataccatcgataagtgtgattctataaaacatcattgtacaaatgactttgtcttaaaaatatcatcgtatcctatagcacttaaggatggttaataatgtaaccctaacgaagatgtcatttttaagtcaaagccacttgtccgatgacatttttttttgcaactcgcacttgtcaatgtcattttttaagaattggacgtttgttaatgatattttttggattttctcttgttgtttttatcacaggtcgaaatctatagagcgatatatctcatattgatttattttaatttttttaaaaaaataatgactatttaagtgatatgaactagtgtctctttatggatggaaacatttttccctgcgtgatacaccagttctacgctcagtgctactaggaggctagcagccacttgctgctgctagagcccaaagaacagtactgtcagttcagatcagttgcaacttgcaaggtctccatcttagtggagtactttagttattcgatcctataaaggtactccctccgtaccctaatataagaggtttttgtgattttacttgcacttgcactttaactattcatcttattttaaaaaattagaattattatttattttatttgtgacttactttattatccaaaatattttaaacgcaattttttgttttttatatttgcataaattttttgaataagatgagtggtccaagtaaaatatcaaaatcgattatattaggggacggaggaagtaattacaaagtctaaaggaatgaaatctccagctagataataaaaaaagtgtgttcttttgttttaagcaggtttggtctgaggtgacaaagactgtctgttagaagtttgcaatgcccatacttttacaaaccccttcatgattagcgattttaatccacaagtctgaataaattccagcatgtctgatgtagctcatagaagcatttcagcttgtcttaatttttttctgtcctcatttttttaatcaaatgactatttcattgtacagtcgtaaagccatttcaaccacagtaatctgctggtaatttttttaatgtcatataaatttcataggtagtgatattactgctgatttcccaccattcaactttcttaaattaatgcctaatatatcatgattatttttgctggcattggtctctttaagcatgtgggatgtatatttgtgggtgtgagtgtggtgagcgtgcgtgtgtcttatcaataatgtaattttaaatttttttatataaactattttataattttttaagtaaatttcatgaaacctcacatgttatgatttaagttgcacaaaatcacaacggctctggtacatggcatataaccatagatattacggtcataagatttcaccaataaaaatagttaacttacctacaatatttaaatgatggattaaaagaattcatatatttcggaacttgtatgcatgtatggtagatcaaagaaaatttagttaatggtgtatataaaactaaatgtcatagtaccagcattacgtgcaagtgtgcaacatgccaaaactccaatagttttatgcaaattggatcataacatcgtggttacgtgaaatttactactatctctgtcttaaaatataacaacttaatactcggatgttatatatcttagcaatgtaaatcttgacatgagacatatatccataataagtagcagtacatattgtgggatagggcgagtagtttttttaaaaaaaaaaacgaaacggtttaaaaactaatccatagttagcaagtggttaagtgagcaaccgtttccatcaaagacggggcaaaagtgagcggggaagacgacacctccgcagctcggcgcacaaagcctgcaggaaacccatcacctgtaaccaatccttccatcttctctgccttctccttcgcttcaccacctcgccaaaaccgccttcccttcccttctcttcccttccaacctctcgttgcggtttgcgctagaaaaaaaagagaggagagatttcaagaaaccgtgggggagaaagaagcaggcaagaagtagcagcagcagcgagtgaggctaatctggtcagtttcagaacagattctttgttcggtctctatccattgcaagaacaggttttgttttttcttttccctttttttgggatcagagtctctccatttctgatgctgctgctgctgctgatgatgatgatgatgcaaggcttgtggcaacttgtttggtgaaagaacaacgagagggatactgggatagggatcaaaggcaaaggtttttgtttttaccccgtggtaattgttcgttcggtttgtgatgggatagttgctgggactgtgaatcattttgccccttcttatcatacagacaggcgcgtgatttgaccagcttgtcgtctctgctctgcctctatccatccatccattcatacatccaaccttgggggttcttgattctttttctcatttcttggggaggcttaattgttgctatcgccctccgcttcaggtgtccatttgaattcttcgtcgtttctttcgtatttaattgccatttgctgatttgcctctttatttcggtgggttttatggtaataaaggtgtggttcctttatcatcaaatttgaggtgttctgggttttctttggttcttttttggagcactggatttgtgtgctcttgtaaatcaaatagagtttgtggtttggttcgtattttacacaatcgagttgtgtttttattttagtttgtatcgaaatatttgcatacttgtttctagttccttcaggcttcagttctcttcattattataaaaaaaaatttggtcctttcgtccataatttttttcacaattccatttttgaatgtatgagcttgaattatgtgacttttcagtttgagcttgggattgtcaccttttcatggacgggaccaacaaccatggagcactgatggacgattggatgcttccctcacccagtccaagaacactcatgtcgagtttcttgaacgaagaattcagctccggtcccttttcagacattttctgtgataatggcagtaacaaacatcaggatggacttgggaagagcaaagctttcatcgattcaagccgggaagaaactgctcagctagcaaaaaagtttgaatcaaacctttttggtgccaaccagaaatcaagctcaaatggctgtctgtcagagaggatggctgcaaggacaggttttggtgtcctgaaaattgatacatctcgtgtcggttattctacaccgattcggtctccggtgacgatcccgcccggtgtgagtccaagggaacttcttgagtcgccggtttttcttccgaacgccattgtaagtgacttcctcacctcaatcagtatttgctctgtgtaatgttcagttactctactcatgtggtttatatggaggatatatttgtcagtaaatggtgaaatctaaaccaagatacctattataaaaaatattctaacgcaagatacagcatctttaatttctcttatgtctctgcagcttcgtataattagtggaattttggagaagaaagtgactatatatgttgatgactgattaatcttaatgtcatggttttgatttatgcaggcacaaccttctcctaccactggcaaactgccatttttgatgcatagtaatgttaaaccatcgatccctaaaaaaactgaagatgaaacacgccatgatcgtgtattcttctttcaacccattttgggatctaagccaccaacttgtccagttgcagagaaggtagttttctcaaacaatgttgttctattccctatttactgcaaatctgtaatcactgctcgcctgctcggcgcagtttgttttactgttccagcaaatctgacgagcaaaatcaaattatcagtgttttttatgcattggtctgatgatatttatacttttcagggtttcagtgttaatcatcaaaaccagccttcagtgacggataatcaccaggagctcagtcttcagtctagctcaactgcagccaaggatttcacttcagcaactattgttaaacctaagacatctgattccatgttagacaatgatgatcacccttcccctgcaaatgatcaagaagagaatgcaacaaacaaaaatgaagagtattcttcagacctgatcattacccctgctgaggatggatataactggaggaaatatggacagaagcaagttaagaacagtgagcatcccagaagctactacaaatgcactttcacgaattgcgctgtcaagaaggtggagcgttctcaagatggccaaataacagagatagtctacaaaggttctcacaatcaccctttgccgccttccaaccgccgaccaaatgttcctttctcacacttcaatgatctgagagatgatcactctgagaaatttggttccaagtctggtcaggccacagcaacttcatgggagaatgccgcaaatggacacctccaagatgtcggtagtgaagttctgacaaaactgtctgcttctcttacgacaacagaacatgctgaaaaatctgttatggacaaacaagaagctgtggatatctcatcgacgctctccaatgaagaggatgatagggtaacgcatcgtgccccgctttctctgggctttgatgcgaacgatgactatgttgaacacaagagaaggttggctagccttagtcactaatcactcaatgaaccaatcttcactttgagtagctgattgttttccttcaattttattcatttcagaaagatggatgtttatgccgctactagcactagcaccaacgccatcgacataggagctgtggcgtcaagagctatccgggagcctcgcgttgttgttcagaccacaagtgaggttgacatccttgatgatggttaccgttggcgcaagtatgggcagaaagttgtcaaaggaaacccaaatccaaggtcaattctaatgccatttttctcttttggaacaaattctttgcagttcctctaatccttcactacaaaagtaaatgtttagcttcacaatatgacactgtcatcgaaggaacatttctctgtccatatgtgtgcatccatagttggtacaaagaccggaaattactcgcattatctaaaaaactccattttgtatttgcaggagctactacaagtgcactcatccgggttgctcggtgcgcaagcatgtggagcgatcatcgcatgatctgaaatccgtcatcacgacgtatgaaggaaagcacaaccatgaagttccagctgccaggaacagtggccacccaagctcaggctcagccgctgcaccacaggctaccaatggtcttcttcaccggagacctgaaccggcacaaggtggtggtggtggtagccttgctcagtttggctatggctcagctggtcacagaccagcagagcagtttggtgcagcagcagctggtttctcctttggaatgctgcctcgtagcattgcaactccggcgccgtctccggcgatcgccgtgccggcgatgcaggggtacccagggcttgtgctgccgagaggtgagatgaaggtgaacttgctgccacagtctgggaatgctggtgcagcagctagccagcagctgatgggcaggttgccaaagcagcatcctcagatgtaaaaatggcaggaacatgagacaaatggtgtttgctgcttatgtatatgaaacatttttggtgcttttgttaggagaatggagtgttattgtagctcaatttactttcgggggaaaaaaaagcagatagttcaggcaattgtaggtagtagaggttctagaaaagataaatggctttggctgagttctaaataacttcctcctttttcattagcatgtttactggattgctaaactatatattttctgtaaaaaagattatatagtatttttaaaatttataatacatactttaattatgcgctaatgatcccccttgttttccaaggcgtctacagctacagccgaactcagcctcagccttaataagatcagaacttctgcgttgacatcttaggctgactggttttacaatcaacaaattcaatcttgaattctgggagcaaaaaactgcagcaaaaaaaaaggtattttataactttacaggagtaactggtccgcagatttgcattatccagtaattgacgtgcagcagaagatcggacagaaacaataaacagtcaccatttgcaatgcttttttgcgggacagaccaaagtgtacccagtatactgtcatgtcagaacttcgaaacagtcaacgctaacaaaagcgaatcacaccatcaccgcttatatattttctctgcacaaaaatgtgcatatgtggcaactccaagaaactttacatttgacgaggatattttttgagtgaggaggttttaagttaaccctaatcatgttgaaatgtcactttataaatttggtatttctcttcactaaaacgtacaaccaaaacttcagcacttctttttgctcagtggccattaacagctgactgctggaaattctctctttgataaatggctttccaccgctcaagctcttccctgcgaaataatataaacaccagaagttagaaatgggaggagaaattgacccctttctttgggaggagggccagttgcagacaattgcttatactgttgtacaatatcaggttctctaatgcactgttatatagtcgactgcgttagtgctatattatcttatgatgtatgatacaaaagataattgccaatcttgtaggatacaattgtttagctgattattgtgtttctaatgaagcaattaatatatgatcacttatacaaggctactttgtttaagtaattatttttgtagaccactgtctacacctgaacagaatgtacagatgggacaagtgcactgacattgagtatgggagccaaaggagacaaaaaagatcaattaatctgcttgggcatgtttttagattgtttagatctgggaaatatgtgcatagatacagatcattgtttatgtctaagctctactgaaattagctagtcccgatcacttatttgagtttgaccttaaggaacttgatcccaacacagttattaaagaaatcattaagtatcggaaagaacaaaagttgtgtatatatagtccacatcgtataatggataagctaagtcttgtgtaccgaggtggtaaattcaagtgccattgggcagttggggccaattgagttatctagtttccccaaggcaattagctgttccaattattggttcacatccaaaaagaagcagccactgcaattcaataaatgaaagaaaaaaatacaagaaggattaccttaagcaccaccctattgaatcataatgaagaaggccaaggaccttacgtcttccatcattcctacggccagccctccgttttaccactggaagttgcttgatacctttcacttccatgagcaccttagcagtgctcagatctgtatctggaaagcaggtcactagtcctctttcattgccgtggtactgaaaccctctagtgaggcatgatgaaacaagagaagaatttgcctgaaacaattaaagcatgtaagtatgtgcatcgctaatttcgatattactataagggcctgtttggataggggtgttcaaatttaaatactttggttataagtttaactgcacgtctgcatcctataaaattccagatccaaagcatcccttaaaacggcaattgctaaattaaattataggctttaaaggtgtgagattttgcatacatccaaagtagatgaatttgccccattccgtggagtatcttcacttaattcagattcaaatcctttacggcgaatgtcaccaatcgtaacaattccttcaagaaaatcttcactgtctactacaagaacacaattttgctgcttatcatgcataagccttgttgcctccttgatagtcactgtaggtgtaaccttaataaattgctttgacattgcttgtgatacctggaacactcgttgttagaaagctgaatgaccacaaaaatatatcaaatttactaaggatgaacttgacaaaataataaagagaatgtagaaaagaggcatggaacctttaaatcatcaagaagcatatcctcattgttaataccatagcggtagggatcatcgtctagaattgcaagttcaacgtcatctctgtctggtcgtctccggtctgtctcattcctatctgtaggaggtaatagtgaagaataaccatgccgaggagatgtagcctcaaacgcctctttgttgccagacattacaacagatggcacccatattgctaaaccaacagctccctgtaaattaaaaataagggtgagcttatgtcacaaggagtgtgcaaactttcatgcttagaagcaaaatagcaaatatatgggatgagacatcaccatcagaggcagtaaaattctgtaatcttttgttagttcgaatagtagtagtactgaagtcaatggaactgagcagactgatgctagtgtggcagccattcccacctgaattaagcagacagtcagtatacttcgtttctatcaaactttaggctaccttcctagctcaaaaaaggaaacttactagtgcataagcttgagggtgtgcaacagcagtgttacccgggatggcagagtttattagttctgctgctgagcctccaaatacagcaccaacagcagcaccaatcatcaagcttggagcataaaggccaccaacaagaccagaacccttgcagagtgcagttgctacaacttttgcagcagccaactgagctaagagccagattccaggggctgaggcactttttccagtatgtaaaatttcatcaacattggtgaagccccagtacagtattccagggtaccttagagctattaaacctgctccaagaccccctaacgcagggcatactacagcagggaggctgaatttcttccttatcaagtcaaaagtctttgtgaaccaaaccaccaactgtctgaatgccacactcactaccccacaaagcatgcctaggataaggtagagtggtaactctgcagaatataacattagtgatttagttggttgcatatttaccagttagacatatcaacatgaaaacagtaatagatacacagttcggcgttcacgtcacagatataccagaacttcaaactattcaattgtgaatggcaagaaaacaagatcggaacaataagaagctgctaaaactaacgtgttgatggtaagggaaccaaccacaaaacttcaaaaccatgagcatatacaagtgtataaatgcgtgatgcatatataaaatagattataaaggcaggatatcacgagtcctctgctatagtagtaagaacaaaaaaaaatctactcaagttcaatacctaactaagcaaaatccaccttcagtaataccaggtttgatcagaataagataaaataccagcagcagattttagttcatacgtcgggacaataaaagctgccttctcccctagcaaaacattggacacagttgatgatataactgatgccaatataatcatagcagtggtaaatggcggtgaattctctgctcgaagtggcctcagtactgtttcaatagcaaaaaaacatccagcaaccgcagcattaaaacctaaagacaaagcaacacaagtgtcaggagagaataaagaaaaaagcattggcctgaagatactggatgttaaagagatgaaattgcaaagatacgtggtacaacaaagatctatagtattgtatttgtagttccagttgcttgcagaattagtttatcttccttttcttgttaacttgtactaacatcttataatgctaaaaggcagtgggaaacgattccaatctgttgcaattcccagatgaatgtaaaaaaatcaaacagatgatgattatttaaaattacctgaagcaatcccagcagctgatccggcagcaacaagagcaattctccgttccctattgttctccatcatttcagcacatccatatgcacaagatttaccaatatcaacgcttggcccttctggccccaatgaacatcccgtccctagagtaattgcagcttgtattgctttgattgtaggaaaaatcgcagccatgaaatcaacaccttccctttgagatgataatgattgttttatctgctcaaatatctccagtaatccgtgcatcataccaacaacaactccaccagtcactggaattaacaatatcctatgccatgtatcagcaagtctctggaggcgaagccaagcagctccctctgtgggtgtgcctgcccatgcccattcatgtatgatatgcacctgaaaagaatagttagccactattgaaccagcagattggtatatgagaaaagtacaaacaggaaacttttggtttagaaatgatcatctaaacttgattggatagctcccgcttaacagatctaagttatttcaaggaaagagccttttctagtaactttaagaaatgggggttcgattaattgcagttcagtcaaagtaaaataggcacatactgtattaacccggtaggacttttctgagtttctatctgatcaattcagatctatgaagtattcagagaacacaaacaatgcaccaaaattgccagcaagtagacataatctagtaaacctcagcagattataataccacgcaagattcgttttcacctaaacccatgccataagaggaagactttaactagcaaagacctcatgtttgtatcaactatccccgtggcatcaaatttcacatgaagaaaatacattatcatctccacgaaacaccctaaacggcaggataaagtaaatgtacagtccatattctcacacgagaaaatggacatttagccacgttcaaaacatggcttcgctagaatgccatcccgaaaacgcgtttcgctaaaatgccaatatgaaacgcgtgctcactgccactttgccattttagcccttttgtgcattttcgaaatcatttttgctcctccaccgggcgatgagacaaaattgcccttcatgtcctccgtcgccgctgttgaggaagaggagctcgtcctcgctggccaatctccatgtccaccacaagcagctcaccgtcttcctcccagacggcgaggtggccggcgagtcttccgacatcttcctctccctcgacctcgccacctccgccgactacctcgccgcggtcgacgacggtctccgacgaggtcgcttcactgcggttgacgacggcggctagggtttcgaggcggccccatgttctcgccggtgacggaggcgaaggggcggcccatggccttgccagtgacgaaggcgaagggggatgcggtggagaggcagcagcagctgctggtgagcctcgccggcaacagaggcggagggggacgcggtggaaaggcagcagcagttgctggcgagcctcgccggcgatggaggcggagggggacgcggtggagaggcagcagcagttgctggtgagatggagcgcaagcctccgccgccgcgaggcctccttgacgacctcgcctccgcctccgcctccgccttgttggtgctgtccggcggcggcggccaggggcagccgccggtggttccatcactccgcgcacccgcacacccaaatgccctcgtcggcagtggcggtgggctcatccagcggcgttgccggccatcccgccctcgtcgacggcggctacggaaggggaaggatggtggatggaagggcattttcgtctcattacccactgaagaagcgaaaatgatttcgaaaatacacaaaagggccaaaatggcaaagtggcggtgagcacacgctttatattggtattttagcgaaacacgttttcaagattgcattctagcgaaaccctgttttgaacgtggctaaatgtccattttctcattctcacacaaatcagacaagaaattcctccaaaacaaagtgtacctacatattgaagggtgctatatacagcattgcgtttattcattgcaacctaaactgtccagtagaaatcccctgctcatatatcccatcccaagcaatcaccttaaagatatagatctcgcaagaataccagacttttcctagtctaaggtaattaacgttttttttttcccgcaactttccccacgcagatctctcacttaccccgcggttgaacgcagcgacgcagatgccggtggcgaggccgaggaggcagccgacgagcagcagcgcccactcgggcggcgcgccgtccccgagctcgtcgctgtcctcggacccgggctccccgccgccgccgcccctgggggacgccgccgcgccctccgctgcgtggcggtggtgccgcccccggctggacagccggcggtccaggctccgcagcagctcgcgcacgcggctcctcctcggcgtcgacggcgagtccgggtccgccgacgacggcagcgcccccgcccccgaccgcagcggctccaggtcgctcgcctgcgccatcatgccccgccgcgtgcgagcgagggggatctagaaccgaggcgatcgcatcggagtaggggaaggggaggatctcgcggcggatctcgccggtggcctcgatctcgtcggcggttgggggtggcgatggcgagaggtgaggtaggagaaggggaaggcacgttcgcgcgtggcggtttttgcagattagccctcgagagagtttgtagttgcaattggtgggtgggaggtttggttgggccgggttgcacttgggcctagtggacacctgccaggtccattcactatggttggcttaggttggcataaaaccacttgaacatgttctttttttttcaaaccattaatcacttgaagtttgatattcacctcacaagctattttgtcgcaaatacccactaccctacttagttttttttttcaaaactcaccctagtatgcacatgcttaaatccaatcaacatttcgtaaattgtgagttatcaatgtggtcgctaccaaattaaatacttctacaagtatagtctcgatgtatttttggagattccacgagtagaattgccaatgaaaatttaaatgtcgcactgagtttctctatataaaaagaaaatcaatgaaacatgaaaagtaagtctaatacaagtacttggataagatgactaaggtagtttagcctatgggtggctctacattagtgaaaataagatgaggttaagcatgtgccaatggggtggtctttgcaataaaactaaataggggtgggcatttgcaacaaacttacctatgtggtggaatgtaaaacttcagacaacttatgggtgttttttttatggctttggaaattggattgcagagggaaaatatcgatattgtgcttggattagcttcctataaaatttttttaaatgaaatttagtttttacgaataattttgtgcttgtttacttaccttcttagcaatcatgaaaataaacctatgcactaaagtggcgaagaaatcataaaatcgaatttcaaattttaaatcaacgatggtatttgtttcctgtgtcatgacgaaacagtttggatgttttgcaatattttctgttttacctgtcccacattattgcttggagtatttgcttagcacgtcataatttcagtggagaatccacataaacattggtggtcattgttgcgataaaaaggcgtaatatttcactatttcagcatgtcgtcctgtcactattcactagacgcattaagctagaaaggagctttttttttctttctgtggttgcaaaccaagcgtgaagcaaaaactgaagtattttgaccaagaaaaagatgtttcactgctttcagtgatcagtcaaagcattgctttcccaggaaaaaggatgaattgttcggtgaaatgtcactgaaaaagatccctggggtgctcatcagacgttaccatttttcctgacaatcttgcctcaaaagatgaatcaggaagcaaggttgttcatttgatgtaattgtagccatacatacaaggaaaatctactcaaacatggaatttatggacttatatttcaggcccagattagaccatgaatgcaggattatgtacatatctttcatccaacagatgagattagtcttcactcacctggacaggttactggacactgttctatgctgaatcttgaaagcttgaaaatattagtatatactgctgcatcaagcgtatgactgataataagtatactcatatggagaatcctgacaaacaaaaaacatttaccaatcatgcagattagattagtcaataggtgcaggttctcagaaagcatgaacagcttgagaacatcttctgcttatcagctagagacaatgcttcgtctaaatgaactgattcagtgaacattcttcaccaaagttactatcttgatgaaataaagccatttccctttctgaaagttgaatccagaaaactcaacagtaaagagattaaaagttttatgaaatagtaactgaactgtactgtacatagcgactcaagttacattcatatggcaccgtgaagcttttggctatcatatgaccatcactaacaaaacttgttggcgtcacagattcagaaatgccgagacatgaaaacttctgatcaccctctataagacagtaacaaaggaatacacatcagtacattgcagcaactcacaagggtttcagatatgatctcaaatcttactcctgtatctgaccagctttgccaatgtctcttgagcagccagtgtatgggcatgaccatggccaagcataacagtccggatgctaatgcaagtcctgcacaattcttcgccggtgtcaaacagcccacctcggagcaacagcttcgccctcgtctcgagcagtgtcgctttgagcagcgtcacttcctgccagacaaactcatcgacacggtgattcggttgcagcttcttcctccagcaaagcgacccacggttcaggtcctggatccgcgatgcgtaagacttctccacctcctcaaggacattggtgcacaccttgagcagttctaaagccgagccgcaccgtgagaatgtcatgaaggagtcaattgccaagggaagtgccgtcttccttatgaaatgcaccatgtcgactgccttgagctgaacagaaggtggttcagacttgaaaccaaacacaaggaatgcactagcccataagtggtccgagtacactgaggggttaccagccctcattacgccgttcactgctgcagttgttggtgccaaacctcccctaatcttgccaaagagctgtgttattgggtggaactggatccagcagccaggatgacgagttgcctttcttgccagcccaagcttgacaagtaagagtgctgactccacctcagcttttcgaccatgtggagctagaaagcaatgtgtgccgcatagaaatgcagtcttcagggattcacccaacaggtgcatactgcctttcattggtagcttgctcgctgttgcagctaatagcgtagacgacacaggagcaggagctaaccaagaaccagcgataatcatctttgaggtaaggcttcctccttttgctcggtccatcaatgcaaaacaaaagaccaggacctttattaggaaagaattgttacgacagaagccatcgtcattggcaccaagtgggaacaaactctcattcagtgatattctctcgacagcctcaaacagagtggaaggtgtaatcatgagctcagacagcagtgaaccaacgatccacaggccaaagctcaaccgacctaaccgctcgtcaagcttcctaagaacttccatttcctcaggcggatagtcattcttctgcttcccctttatcaatatcatggcatcattgtatgagagctgtggcagttgcatcggttcaaggttaatcacacgtggtaaacgtgtggtcacaatgacatgtgtcgctccagtgttcctagggatgaagtcatggagatccttaccttcccaccaatccctctcactctcaaggttatcaatgacaagcaagtacggcacgtcgcggaacagctcccgcttcaccctctgaaaagcatcaaactcctgctcctcaaagctcctgatcctacctctctccttctcagcctctgcactgatgtccaatcccaaattcatggataaattgagtatgttttgcctcaaataccgagcttcacctccaatccacaggaccatcttgtaccgctgtgaataccggtaagcaaattccaatgccagttcagtcttgccaattcctgaagaaccagtgatgcagagcacactggcactgccatatcctttgctgttgcaccgaaaccttgacctcctgtgctttgatctctgcttctgaagatttctccctttacccgatgataactctataactggatcaatccaggcctccaatgtcggctccttgcacttgcgcatctccaaactgatatacctggcattcgatgtcctcactgtgtcactctcctcatcagcaaacccatcagacacaccactcgatctgtcattcgcagcggaacccctcgggcaatcaacctcttggatatccaccgtggaaccgaagaacattccttcaatttcacttagctccttctcccttccaacgaaatgccggttccgcggaaaaggcattccttcaggcccttcactctccttctcagcaatgctcttcctgccaagcttggaccgcagcaaggtgaccgtcttggacacgcagcttctccaattggtctcattcgcctcaagcttaaactcatggcaccgcatcaatccttcgaacgcttccttcccctccttatcctccaatttgccgtcgaaaagccccgcgatctccggtggctcggtgtcgaacagtatgggcaccaggttcttcttctgagcaaagaacctgatctcctcgaggctgaacggattgaggaaacttgacatggtgacgactatgacgccgaatgcgacggagcagatgatccggtcggcgatctcatggctctgcgtgtcggagtacttggcccggtcggcgacgaaggaggcgatgccctgcagctcgagctccgacttgagccacttgcagaaccggccgaggctgccattgccgtggtagccgatgtacacgtcgcagctccggagcttggcgttcgacgacggcgacgccacggagccgcgggtgaaggacacccgcggcacggggaacgagaacgacacgcgcggctgcacgccgccgccgcagtcggagaccttggtggccgggtcgatgccgccggagtcgtagcgctcggacggcggcgtccgcgacgcgctcggcgcatcggtgtcctccgagttggagtaggacgccggcggcgacggcgccgccgcttcctgcggtggcggcggcgccgcagcgggagtcgggggctcgaggactcgaggcgagatgtacggcgactgcagcgccgacacgaacgcggaggacggcggcgacggcgagtagaggtgcggggtgatggagatggccggcgagatggggtttgaccggtcggagctgctgctgaatccgccattggtgcggatggtgagcgacttggtggcggcaatggggatatccttgggcacatcaagaaagctcccagcctccttctcttcctccatggctaccaccaaatcacaaaccttggcaagcaatctccaatgcactgcatgatcttgtgctcctcatgttcctatcaaaagatttgggggagaaagggaaacaaaacaacagatttttgtcacaaaatcgatgaaagagagcaaatggagacatggagtaatcacatctgattaaaaaaaaacaaagaacacaaagaactgttctaataacctgcagattctctgattgattctcaacttgattccatttgcatccaaaaaaatgtgtaaagaaagaagtttcaagagagaaaaaaaaacttactggtaaggtatccttcaggaatccaatgccacagaaaaaccactgataatatcaattgttttctgcagaaatgcagaaccacttgctgatgaggggctttagcttcaagaaccaagaaaaaaaatggcaaggagagactggagccggatttggaatttaaaaaagaggccagcttttcccactcaagccattgaatgggacgggtataactataactatcccacctcctgtgatctttgtcctaggaggaggaaatgaagggtggaggccccttcatgacaagcaaagtacaggttcagtttaagggccctcttcctcccttcatatgaccaccacaaaccctaaaaataaataaatgtgtgagtgtggcatcaaaaggagcaagtgaatgtggagctactactagtgctagtgctagtggcacacaactgcaaggtgaagtgatgaagaagaccagcaccatttccaatggtgagatgcaagccaaggccaaaaaccaacccaccaaaacagtacagctcaactgcagcagcaatgccaaagcaggtggaaaaaaataaactatataaaacacttttattaggaaaatttttatatatgtgttcttacctgtttaaaggttatagctgaaaaaataaactataatagaaaaccttaaaattaactctaaatgtaagtttaaaatttaaattttgatcgtggctgataagacaacgtgaagacaataagagtttttcttcatgtccatttgagtccaatattccgtttaagtctcatcttaagatgtacctcctttgtccaaaatgatttaaattctaaagataaatctagacaatttaaatctttttggacgggagaagtatgcacattatactttgtgcacatcctgataggagtgttgttgcatgccactacaattgatgcatgctccctatattaggagtattcaccatgtaggagtagattcagcaaagcaaagggtgattcacatctgaaacagtgctttcaaagtgggggtttggtgataaaataggctagtaagaccttgttttatgtgcattggagggtgatgaccacacactgtgtaactattttacagtgccccaagcttaggtagcaacttaaataatggtggcaatgcattagcctttgggtaaaaaccctaagcaccagtgggacagcatcactgcatgcaatgtgcagggattagggataggaagaggatgatagggaaggagatcttgatcttgcagaagaggacatggaatagtgctactgtgctagtgagagagaggggcagccatggcatggcctcaccttgttttggcctagaaatctggacccaagggagagaaaccaaagaccagtccaactgctgctgcagtaagctctgcacttgccatcaaatgctactatcgctccacacagttcagcagttcatccccacaaacacaaaagccttgttggtttgtctaataagctaaagtaaatattaaaatttgatttttggaacttaatattaaaattgattttaatatattttaaacatagtttctttcagtattaactttcaaattactaagaacaaatatataaaagttttatttataaattaatgtttatactctaataagtcgttttggtttattaggtaataggagtaaccgatgaggcttaggccctgtttagttcctaaaaacatatgcatggagcattaaaatatagattaaaaaactaattgcaccattagggaggaaatcacgagacgaatcttttgagcctaattagtccatgattagccataaatgctatagtaacccacatatactaatgatagattaattaggcccaaaagattcatctcacggtttatagacgagttatgaaattagttttttcattcgtatccgaaaataattttcgatatccagtcaaacgtttgatatgacatctaaaatttttttatttcaccgactaaacaaaccctaaactctctctctagcacatgttgcatagcagacgtggcagagcggcaggtgatggggttgagacatttatgatttgattctatcctgccctttcctgttgaccaaatgggtgataccctaaaggtcatggatccggtcctaaaggttttctctttctttcggtggcacagtagattgttgcaattagcgggaatgtttttagtcatttgaaactttggggaaaacattttgagcttttcgtttttcaaatttcctagtactagtagtaccatgtagtagtaccatgggacggaggaagtgctacatatctgctatatgctattcgtcccaaaaaccagcgtagtaccggatataagatattccagtactaccaatttaaacatacatatgtccagattcatcgtactataatatgttacatctagttttagattcgttttttatgagacggtggagtatacctcttatttgtctctccacagacatcgttaattcctttttctttttttttcgaggacatcattaactctaactagctgttagtgtgtcccaatcctccatgtcagctattatccatagcattaaatatattgtcacataaataaaaatataatgtagtaagagagttaataaagagagataaaaaaataaaaaaaatcatttctcgtgcaagaaaccatctctacaccagaaccaaaaatgaaaacatgagaataggtggataaaatgagagagtagggagatgattggatgaaaatttaatttgaagaaaccattcattgtatatatagttctatgtatagtgtctgtatgactagcaaatatgaagactattttgataatttctgggttaggaatggccttagtttgcagtggtacaaaacgagtacaaaacactttggttctatcatccacgtaaaggcactggacccatcaattatccaccaaatatcaaaaaccaattatcttatataccaattgttaattacaaattaacaaccaaaacacactaatgtccaattttcacatgcttggctttataaattagtaagaatgcaagatgtaattagcaataagaataataattaagattgatttaacgaatgatgccatacgtcggccccgaacgaccactagtgtccaactaacatcagaaccattcttgagcatgatgatttaaatgaagactgtaatttaaacttttgctagtcttatgctatacctccgtttcaatatataagacggatcttatcttttggatattacgtttcgtcattcattttattttaaaaaatatgtaattgttgtttattttgttgtggcttattttattattaaaggcattttaagtataatttatatttatatatttacactatttttttaataagacgaatgataaaacgttaggttcaaaagccaataacatcttttttttaacaacggagtaattacattagcgacttcgatataattaaatccatcgttcgcctctttattcctcaaataatgtaccattcatgctgccatgcacaaacactcaaatctgtacgtatagaccacaggtttttgaattttggtgtactttgtttcttcttgaaacatacggaaggatcgttaatccatcttttgatcagtaaacagtacaaacggtacagccaaccaagcacagccaggaaattaaactgcctgttaactggatgaattcatggagatgtttctgtacgtcttgcagtataaatgatcattcaattctaaagtgttttgaaattataggccctgtttggaagattagcccagggctaattttaagagctaatgtttagtcatgaattggtaggctaaacattagtctaaggtggcatgtttggatccatgggctaattcaagactaaaatgtggagagagagagagagtagaaagagaggagagagaaggagagagggctacctttttatggtacctgtgcaaaattagtcccattagcaccccttggaggggctaatgttttgaggggggctaattcactgtagccaaaaattagtatacatgtttggattcttgagggctaattcatgacttaaaagtgggggctaatgtttagcccatgaaaccaaacagggccatagttagcaggagcactttttaagctcttgggaaagaaaaacaacggctcacaactcaccagctccaatgatagctgagatggcatgcactttatcccaaaacacggtgattagttgggtgctcctctttaatatttttcatgtgaacagtgcgtccggccgttccaagtttccaactggttaattatattaaatttcggccagatcatatcaagcaagagcatttttctaggataatatatatgcaaaatgaaattctgctagcctcttctgcatcaagcaagagttgaaaggataaaactgcattttttttcatcggtaaagtgaacaatatgtcgatgaataccaagcttatatgcgcctgattgttgaaacgaagcatttgctacatgcttcgaaaaatatattctctaaaaaaatgtcctaatgcattgcttagaccacttgttttaaattatttattaagtttatttatcaaaatatttaatttatttttctgggtcgataaaaataacatccaaaatcttattaagaaagaggtgaaaatttaattcatccatataattaaatagatatttcaccgcaaaaatcaattcacgccgtgtttagttacaaagtttttcttcaaacttccaacttttccatcacatcaaaactttcctacacacacaaacttccaacttttccgtcagatcgttccaatttcaaccaaacttttaattttgatgtgaactaaacacagcctcaataatccatttcaaaacagagcctctgaaccaaaaaaaaaacatccatttcaaaacagagcctctgaaccaaaaaccagatataccataattgcagttttcagatgtcacggctggttagctgttgctagaagagtatgggagcacacacacaccaggtgtatgggcccatgccgtcattaggagaaggtatatggaatctgctacatggaccaattatatgttcagtccaagagagtaggcactggctagttggtatataattttgaggatcagaatccagacatgatggccatagaaatcaggatctgggtctcctgctttcaatgtgtgatccaattggccctccctgcacaagttgaagagagtgtcaattctaattggagctgtgggaattgattcataattgcaaaggaaaagagctcctgattagcagagttattataaagactctcatatggctggcttaacatacatatttagacatatataacttgaaagtatgtagtacggagtagtacctgtatctaattaaaatgtagaaagtgtgtaaacttgtgtatggtgatgctaatttgtgcaaaacaaatagtactggtatgtggtatcacaggttcaggagctactctagatttacctcaaaactgtttagatttaccattcttcaactgacaatgcattctgaagtttaacaaactaaaaagccattggatttactcctgtgaaacataccagatggcagctagcggaagcattacaaaatttcagcaaatataatctgcttccatgttccccatcacactggagaaagagcacctcttgtgtccaatggaaggtccaatcaatccaatccatccatcatgccatttgagaaacacactcaggtgacaccctgatccaacactagtctaccacctactccatggaatgcctctcctaatccaacactggtctatccatataaaaacacccctaccaccaacaacaaaagccaactcaagcaaaaatgaagtagaggtagtagtactagcataggaactactaaaggcaagttcagctcttgccttttgctttgcatgagtaacctgaaagcctgaaactttgtttcaggtccagtcacttggattggttccaactccccatctatcaacccatcactttctttatgcacactatgaccactgatctgcatttagcacagtcttaactcctcctaacatcaactatctcaggttaacaacaaaaagtatttaacatagtactaccatggacatttcgggtgcaaagagcagtgtaaggtgatgatgatgatgatgatgatgcagagaacaggctgtgcggtattgcagaattaccaactgacaacagctttgcttcagcattgcaaccaactgagagcagcatcgcagaattaccggggatcatggcgtctgaatgtgcggtgcctcgcctgaatcatgctgtagaaagagagcaagagagagcagtgatgtcctggaccgtagcatcatcatcatcagtacccattgccatcccatgtcgtgtggtttgtttttcgtttctttgtcgggtgatagtttgtaaagttgctgtcacaatgtcactcttcttcaatcttaatacaaaagatgcacaatacttctgtgcattctcaaaaaaatcccatgtcgtgtactcgtgtggtttggcatcgcgctgcttctgaaactgttgcagatgtggataatggatgtggagcccaatcaattggcaaagagctgattatgtgttaaatggcttagtaacgaattattattattattattattattattattattattatgtataaaatatttatatatgtgtccttggcaacttacaaattaatactgaaaaaactacaggcctatttagattgacgacgttttcaatcatacaattatttggtaaaattgataattatgtggctacgtttagtttgttaggcaatgtgtatagaattttgacaacattattaagccaatcctaccaaaattttgacaatgctatcaatttatcaaaattttggcatcatcaaattttgataatgctcattttggtaccaatccgaacagatcctacattgaaaataatttagcttgaaaattaatttttgaaatttaaattttgacagtcgtaggacaaacaataaggctacactggacgggtttcatttccatcttctcgcccctcgcatcgaactgccgttttctcaattatacggaagacgcgcacatgccaccacgcatgcacaaaagcatgtaccgcgattttgatgggagcgctagccatggattccaatttcatacccacacaaacagtttttttttcagctgagatccaaagaggataattgtactgtactactctctatttgcatccgtagaccgtagtagtctttcaaactcaaaagttcccacatgaaagtggggtttatgatgggaggtgcatcaggcaagatgatcggtgcatcgggctggagatttgaagtcctcttgtactgtttgtactcttgtatgcacggatcggtgtacactgctcgcggattcaattcttgcgcgggcggcgcggggggggggggggggggggggcatttgtacagcattcgcctctcgttccattgattgctcttcttcctagccattgttgggctgcagccttatgggcctgacctgactgatgcaacaatctcagtatatgggctgaaagttatactgaaagttcaagaaagatgttgtgacctaatcctcacaaaaaacagatccaatactaaggataaatttgtattgtatgacttcagaatcatccctggaattatgtttattttaagataaagggagtatctatcgcttatatagcaactggaattcatctcaaaatcaatatgaaaggaagaaaatagaaaattactagaaaacagcaagtgaaaaaaaaggcacttttagaattccagcctctcctctaattaaacacgcatcaagctctaatatagtagtactagagtttaaaattttggtttggccctttctatcgcggggtactaatagaactgtaattttggaatattttggtccaacataatttggattcaaacaaaatttggtctagcaatttcaggtcaaatagtttaaccacgggagcagggcgggctgaaattccattccggaattttgaaccctgagtagtacaattgatgctatactgaccttttcagaaaatggaatgagcatccctactgcaactagtacattcgtatagatatataaactcaaatcattcaaacgatccatgcattactagcacagcacattcaaacaatcatttgcagtaattgagaagtggattaggaagcatcttgaacaactaaatttgcctcggaatgcgctaaagagaggctgctctatttgaggaggctgttgtctcggatgttaatttacttctggttgtccatacatccgtggccagcaaaatggctctgtaatttaggatattgcttaggcaatggattgcaaaattataatctccgagtgttgcctgcttttgtcatctcctgcttagaacctcgagctgcttgtcacggcatttcgtgaaccgtgggatttgtcgtcgttttgacgagcaaatcaaaaacttggtgcaatcttttgtgattagttcactgcacagcagcagcagaagaattcctagcctatcgattaggcctgttctgaaattgtgatggatggaattcagaaattctgaacgtattgtgagagaagtacagggtacaaacgttataaaagtctaaaaactgctacgccaaattgacttgtgcgagcacacctttaaaatacatttaccttctaattaaaaaggctgtccagtattgaactgggacgataacttattcttctcataccaaaaccaaaactcctatcaatactgaaaatttcttgtgtgttttttaaatttttgctttattctttctatgtctctgagttttgacttattccatagatatccacgagtctgtgtttttcctctatatgcatttggtggacagttagacttttttttaaaaaaaaatgaccatattatccctcgccagtacataagctctagcttcttattagagataccattattaagtttatttaaaaacttcaattataacaattgaagggggcaattgtttgatccaaaaattgaaaactaaaattttaaatgaattgcaataagatttgattaaatttcaatggaggggaaattacacggagaaccaatttcttttgattttgtcctcttcctatatataccaaaatttgattatttttttacctactttagccaggtttgatgaaattacccatagaaatttcgtcaggtttggttgaaattcatttcaaattttgatttccaaatttagagtcaaataattctcccattctaccttttagaaccagatcgtattcaacttcagaattatatttttttaagctaacacttaatgtgcaagcgaggggcaacaaagttaatctataaatataaatatatatttttttgtagggatataaatataaatatatgatgaccaattcactcacaactaatagaaaatacataaagaggataaaaaaaactcaggagtatataaagaataagatagaactaaggcatagaagggtagagttttttcttcctcaatatagagaagatgacaaagaaagaactccaaaatggactgcaatatatttttttgaacgattatagactgcaaattacgggtcctaattaatcaacatcacatcacttcacttaccaacatacgtgggaacttgaccgggacttgttgccgacggaggccgtaaagctgaccaccaacgacgacgcgagatcgctggccgtccgatgagcatcggacggcggagatgaagcccgtcgacacggcggagtgagcctcccgccacacggtcgacttttcccgtcttgcccgttctctcgcggcgctgcctgccttctctttttttccaccgatgactcagcagcctatggagtatggacccgtacactgcaaaatacccatggtttgggcataaacaccggtaatgccactgccaatagcacacagaaaactggagctttaccaatacttgtgccgtctcttttggaacaaatgattttttttatggaatttctgagaaatccgattctacagaaaattttcctacgtgattgtttgaatcataggaatagctataataaatatcctataaactttctttgaattgactcgaaacatagaaattttgggaaaaattctaacatgggctttaatctcttagaaaaatcctgtcttatatattccttatgattcatgtgtttttcctatgctctatccaaacgattattcctaccgtttttatgtgttttcttaccggttaccaaggttcacaactttggtaaggaattaaaagctgctcacaagcagtatcttcaggtttttttttaaaaaaaacgttgataaattgacaaaaaccaatgaaacctttataaagcttgtcaaaatttaaatctcagtatttttataatggtttgtttatattttcgaccctatctgaaaagatcagatttgatgaaatccaaaccgattttcaacgggattgtaagtctgctactactgcaaagctttcagtttcaggttttgtgtcaaacatcgcaactttggagtagacatacgtattatgtgcacgattttttccagcatggaacccaaaaccgacacatttatgaggctcacaagtcacaatctaggacgaagagagccttctaatagaaggtgtagaaagccatagaattttatggcaaagatgcaattaaccaccaaaaccgaggactactggatgttcaaacaggggttggtgtggtgtgcatctcacagtcagtcagtcccaaattcttgatctatcttaaattaaaaaccatttgttgactctataaccacgatctctcttctgcttggaattctctatcctatttttcatctcatattctaaccattgattatgccatgattggatcttggcacagtgctctgcatgtgttcttgtgttaatcagctgcccctaatcccctaggagaccaatctactgctgcttagctcctgatacaaatttgcacattgcccggtgaaaattcagcaactgagcaagccaacaagagcctgggtttctgaactctgactagcagtttcatcaggtaccaaaaaaaaaaaaactcatcttattccctagttgagatcatcagtttgtttctgaacatttttttttttacattttgcggcgttgatcagattggtttgagcttgggagagatcgatggggtgcgtgtcgtccaagatcctgagcaaatcagggagcttccaggagaaggtggtgagccatggattcaaggggagcaacctgatcgaggagatcatcctgtccacccccaagaagagcaacggcgatcagttcttggccctcctccgcacgtccacctcgtcggcgtcggcggcggcgagcagggccaaggacgccgccgatcagagcaccacggcggcggcggtggccgccgaggagtttgtcaagatcgagacgatcaacgtgtccgagctgctcgccgggctggaggaggaagaggaggaagaagaacgcgacgacggcgagaggtgttcggctcaggcgtgcgtgctcgatggcgcggtggcgacgccggcgagggcgacgagctttcgcaccgtggaggagttcgacgcgctggtgacgcggagcggctcgtcggaggtggcggaggcagcctcctccgccgatcaagacgcgacgggcgccaaaccgtcggagcaagaggaggccgccaccgccgccgccgggaacaagaggcgggcgagggcgaggcagctcggcgagctgaaggtgccactgccaccggcgttcgacttctccaagtccggcagcctgcgcgactggctcctccagggcggacagatattctccccgggctcctacgtcacccccaagttcgggacgacctcaccggcgccttcgccgccgccgccgcaagaacgtggaggagtactccacaacgccggcgagccgcagccgcagcacaccgtgtttgatcccgagctggtcgcgcagttcgagcaagccatggagcggctgtccgaggacgaggagcgcgtcttggagaagatcctggaagccatgggagcggcggcggaggaggaggaggaggaggaagcgacggcgacggcgacggcgaggctggagatgccaagccatcggccggtgatggtggtgcaggagtaggcgacggttttggtaggtttttgcagccgcgcgtgtgtgatgtgatctgtaattttaaaccctgtgcttgcaaaatgtaaatatgaatgtgttcagtgatgatttctgtcgtgtctcggcaaattccaattcagttcaaattcagtctgccaagaggacgatgacgaacacatcaaatgcgaaaacgctaatccgcgaccagatttatattagggaaccatcgatgcatgtagcagaatctgaggaagatcttgggccaaagaagcatctggatgcgaatgggtttatagttgagggacacaaagtgcacctcttccctctccattgggtgatttagctgcagaaagtttacttgaggtccctcaaaaaataggggtcagaatcacttcccacaaccgcaaaacagatatatagtaccctcaacttctaaaactagtgtaaggctgtgtttcaaagtgagtgttgggaacccatctcccatacacgaaaaacggagtggtccattagtacgtgattaattaagtattagcttttttttcaaaaatagatcaatatgattttttaaacaacttatatatataaactttttacaaaaaatgcaccgtttagtagtttgaaaagcgtgcatacggaaaaagagagggaggtgttggaaacttgctcttgcaaaaacaccctaagttgagtccctcagtggtttttggatagcggttttggctgacaagacgcttacgttgtgtgttgacctagtcttgtcttatgtgatgccaaattgatgcttacaattaaaaaattagtggagccaacgtgtcaagggttgtcttcttcatccaccctctcccacgacttcacctctcctggccaatggcatggaggccgagatccatggcggcagcattgccttgtaaagttcctgtgtcgtcacgtgttgccacagcctaccaagctcccgccacaaccatgttgaggtctcccgtcaccaaaccgctccccccctctctctgtccgcttgatccgaagcacctcgtctggctcctgacggctctttcctctagtcgtcttcctctttccaaggccgagcttagcctccgtgccaccgtaggatgtaggtgatgctggcaggaagcgagtgcgtggagagagaggcaaggaagccgacagcggtgaagcacgagaagacggatgggtaggaggctgcaacaaagctccctagggcctaggctgtggggtgggccctgtgctccgtacttgttagactgcagttacccctaaatctcaccatcctcccaccttcggcctctggacctcacctcatgcatcttggcggccctcatcctaaaggaggatggtggttggcggtatttttgatcaagtgatgaaacaattatatataagtgacaaaacaatatcaaaattatttaagagagaaatcagatgtcccatctgttgttagggttgaaagtgattcggataattttcgtccgaccggacattttttcggattcggatagtttcggtcggatatatccaaaaattttcaaattcggatttttttttcggatatgaaaacgactatgatataggtgatatctgtcggaatctgatatccgtaggatattatccggtattttccatcggatatccgactcacacataagactgccatagaggaggtaaatcacacaaaagctagcccaacccaaagaggaggtaaaacagacttcttgacaaaaataaatttcgaattgaattttatgatattaaatgaactcatatgaaaaagttataaaaaacaaagttgtagaactcaataagatctaccaattttattttggtcatttcttcatccgagtttcattgaactatataaaatttgatttttaaaatataagaaattcaaataattcttcgggtagtaaatgatttcaaatggaaaaaaactatcaaaaacaaagttgtataatttatcaagatctacaacttttattctggtcatttttctatatgactttgtttgaacggtttaaatttgaatttgaaaatataacaacttcaaacaacattttcaaatactaaatgatttgaactaaaaaattcatcaacaacaaagttgtagaactcatctagatctataacttttattttggttatttcttcatccgacaaagtgatattaacattgttcataaaatttacatatctctcatttggttttataaattataaaagagatatgtaaattttgtgaacattgttactatcactttgtcggatgaagaaatgaccaaaataaaatttgtatgtcttgatgagttctacaacttttatgtgcattttttcaactgaaattatttactgtttcaaaatatcatttgaagttttgaaattgaaatttttaattgataaaacaaagtcacgagaaaatatggccaaaataatagcagtaaaaacacaataacatgatagagcatgattttagaaacatttaagaaaaagaatcatccaatttggagttcatatgagtgagataaactagtttcaaatttttaaattttattttcacatacgactccttaagacgcccgtgtagaaaaatttgatttttccatataggctcttaagtggtccgcatgcaaaaatgagctcattttggcatcttaagtaggggtgggtattcggtcagaccgaaaattcggtattggtcttcggtcttttttgaaagttcggtcatctaaagcgcaagaccttttggtcttgaaaaatgttgaagaccgatcaattcggtctcggtctcggttagactgaaatttcagaaatatttagaagaatcgcacaaatcctcaatgaatttcagatccaaaaatatcatacacataaagaaaattcataaaaatcccacatcggctttcttcactgtcatatactcatcccagatcagatttggcgccgctcgtcgccgtcggggtagaggaggcaccatctgatatgcccccggggtggagccatagaggaccgcagcttaggcttggcagttgggggcttgaggcctcctgcctcggggctccggcagcatgggcgcaagaagaggaggtcgtcctgatgtgacttgtgaggaggaggaggaggcaacgtggaggagaagatgctgggatggtgcagaggtgccagcgatggaacatgatgccgatgtgcgagagaaacagaaaggagcgattgggtgaaaaaaagaagaaagaagcgctctctcctgggtgggtggggagagcgtggcggctaggtggatgaggagaaggcagtagagagagctagggttttacttgtgttgggcttgctttcttgggctgatattgtgctttcaatgaaattcggtcaattcggttaacagagggtgatgactgaaatgaccgaataaaattcggtcatctagcacataagactgaagtactgaccaaatttatcgatttcggtctcggttatttcggttcggtctttttttgcccacacctagtcttaaggagtcgtatgcgaaaatgccgacgcggcaagttgtggtccatttgcaaaagtcatagggtcttgtacacaaaaaaccgtttgtgtagttgaggggtttttatattccgattaatatttgtcaccgtatttgtattggataatattcgatttcgttttcatatcgatttttgatttcgaaaaaaaattatgaaaataaatatgatagagctagtttccgatcgtattcgatccattgtcatccctatctgttgtctcgtccaaacaagcatcttacgttttctgcgtggttttggcttctgcccacagtttaccacagcagcagctattcagcccgtagaaaattcagatagccaaattggccttgttgctgtcttgtggattgtggcttctgttgaagtcttactccattttttccatctactatatccgataaatctcctgccgttttaccgtttcaaaaaaaaaaaagtcttactccattttttatcagttcgatattttccttagataatggtatcagttggatatacaatggttggtagaatagcgaggagaaaatgacatcacaacatctgtagagctagaaagaaaatccattacaattagtcaaatcagtcaagttgcggacatctgctattttctttatcccaaaatattataactagtttaaactcatattatatgagtgtatcaagataatattagtaaaagataacttttaaaattaaacatcacatactactcatactacaccttaattttattatagctcaaactagttcggaccaataattcacctagcccaagaagatagccaactccttttatctctctacttaagacttgttatatttgacatgggtggaatattatagactagaactgctatgcttcccacaaccagtctaattgcgaaagtcttcggattagatcgtctgaggtggatttttacttttcaagagcaaatagcctcatttgttgcaaattttaaatatatttgacattaaaacgggcgtatcacctatcactttatattgggtttataaaacctggcagttttcatgaaaaccagactttttgaccggctcaagaacataggccgctcagttttccaggtcaagttaaaaaaaatcaaactgcatttaaattgtttggcaaaatttgatcggattaggtttcaaaaaaaatgatcggattttgtcaagagtcaacggttttcaaaaagtttttgcaaaaacggagaaaaccactaactcatggtttttggctctagaatggttcggtgaacatacaaataatctacgatcacagctcacaggataatgttaattatttaagttcgatctacaagtgaggaactaaaatatccagttcagctccagatgtgactgcacttttcgtagttcggttaatcttctctcttctttttacacgtttggatccaagctcttctttcacgtacgtgcaggtgtagccacagatgacaccagggccacaatccattttttctacttctgttattactagatttttctgtaattatttgcatagtacatgtgtcatgtgtggtgtgtcctccgtagtactttatcgtgctcgttttgtcagtgaacagtgatactgtattctgattggagtaccatattcttttacgcccacgcgctccacgcggtaggagtgcggtcagtctcgcaaaattattgtactccctcccagcggcggacgcgtccttaaacacaaaatttatttcgagagacatctctatgtaaggcttaaacgagcaatgacaaaaaaaaaaacataagggaagtactactacacgtcacaggcatataagtatttttttgctattagtcgatgcaggtctctttcttttcttcttataaaatttactcttaaattatttatttgatctacaatctgattacatcattgtgtttgttgcaattaaatctttataacaagatcttagatgactatattatgatgataaaacatttatgttatgaattactttttattatatatgtaagttacttttatcatattatcggtgaaatgggaaccaggttacccatttacctggcaaaacaattataagtaaaataaatggcgtgcttaaactgatattgctaggggcccaccttggtaggtctcgggctcacctttacctgtttaagggataaggctgtagcctaaggtctgcttcggacccgatcttgtcctggatcccgagctcaccttaatcattataagtcctacattactaagtaagaagagcgtaaagacatacaagatttacatcttaagagaaatagactaaagactgccgcaaacctagccttacactaggtctcgggctcaccttagctcatctgggttacacattgctccgtgaaaaggagcgtagactaagatctaccccaggcccggccttgctccgggccccaggctcaccctagttattggtcacactttctaaaaggggtggagggtggagacatatgaagttattctgacaggattgtgagtcgaggtctgcctcggtccagcctcgccctagctaggacccgggccaaccatggtctttgtatggttcacattcttctacaaagaagagcattgaaacatataaaatagatacattgtctactcatcaaagacatcttcaagaagctcgccttagaatagatgaactatcatcatggaaagcgcgagggcacgacctcaggaccggttggggagatggacacgttccacgagctattgtgaagcggtcctctccgccataaatgaaataggtttatggagagcaccagctagtctagagctaaaaggacatggacaagacacatgcgctgatttattagtgctagtggcaccttggatgcgtgtcgaacatgccccatgccacctgatttagctaaacgggcataagtgaaaccgtggcgttgtttcaggcagcccaggttccgccaggcccaccactcgccacgtgctgggctagctggcgcgacccagctgtctcggacagaagcccggggtaatgcaagttttaagtcttagtggtctcttgaagactgtgttagggaaccagccagcaacgacaagacagctgataagacaagacaaagagtagatttgtaataacgtgaacccctctttgaactataaaaggaagtggacaagctacggatgaagggttggactctttagatcgatacgcttcgctttgtagcccaaaaaggccatctttgtactcaactgatctagggaagccaacgaaaccaacacaggagttaagtagtacacctctgggtggcctgaacctatataattcctgtgtcttttgcttggcgagagctcggcccccacaaatctgatctcactttgatctctttctcatgccctgcaccacaaaccccctggtcgaatattcacacttggggaggggtatccactccccgctgtccgaggaatcgctccctcgacacatatttagaaattacttttagatttgattaaattacttctcatatattcatgatgctctgagttgattacttttattaatgtttttagtcaatttcataatttgtgctgattaaatttaatttctagctagacccatatttttatccctacaatgaattacttctaatgtcgtaacaactttcttttattttgtgctaagttactgttatgatttatgtaaattactttcaggcttcattaaatttactttcataaatgtatacctaattactttcggactaatctgttgggtgttcacaccttgttatacctaattttaatggctcatgactactataaagggcaagggggtcttgaggtgtggggcgatacgggtcgtagctgggtcggtcgatccaccatgcctaataggtagattgtaacaccctgaaaaatttgaccgacaaaaaaaatcaaaactctaaaagtacggattttcaaaaactttttaaattaattgcatcatgccgatcttattcgcctattttatttggaattgatttcgaagttcattaatcgtaaagaatagttaattaggaataaaccctaaaaacaaattggtaaaataaatataattaggtgtggatagaaataagtaaaatattatcgcgaccatatttggatcaattgaatttaaatgcgatgcagtaagaattaaccctaattaaaattcaaataaattatataaataaaatatgagtaatattaatctagagtaaatccattggttggaatgacacaaatattgagtaaacttcatttatacaaaatttaggatttatagaatcaaatttaaataataaataggctaaaatcgggttaaataataaaagacactgttcattgcactctaggtgctcgacgtggtcccttaacccagcccctcctttcccccctctctctgtcgccaccgtcaccacgcgccgccgcccgacgcgccgccgcccgtcgcgcctggccgcctcgcgccccgagccgccgcacgccgtcgccatcgtcgcctgccgccgcgccgccgtcgccatcgccgccggtcgccgtcgccatcccatcgccactgccgcgccgcgccgtcgccatcgtcgcctcgtgccgcgcgcccaccgcctcgcgcccagcgccccgtacccgtcgcgccgtcgccaccgccgctgtcgctgtcgccgtcgccatcgcgtcccgcctcgcgccgcgcgtgcgtcccatcaccgccttgcgccgcgcgccaccactgccgcgccgtcgccgtcccgtcgccgcgcgcgcgttccatcgccgcctctcgccccgtgccgccgcgccgccggcgcgtcacccgcccctctctcccc

SEQ ID NO: 68560 - DNA, 610 bp, Oryza sativa
acacacattcattaattcactgggtttgtcctgaccaggggcggtcacaccgcccacatagtggctgtctgaccggcgtgccctggccggtcagaccggctacatagtggcggtctgaccggcaccactttcccggtcagaccggccccctggaggccgagatgatgctgctcgggatggccgatacagagccgacggagccgtagtcggtcagaccgagccgatggcggtctgaccgagccgaggccagtctgaccgagccgaggccggtctgaacggccgccccatgtcggtctgaccggccaggccgatggggccctctgacagggctacaacggctagttttctagccgttgcagagtagcacggtctgaccggccacatacctccggtcagaccggcagagcacaaagttgggggatttcacccccaacggctagttttggtgggtgggagtataaatactcccccaccagcagcaagggggctctcttggcacccaattcaattgcatacactctttgcacctctctcacactcacttgagctttgtgttcatccatctagtgtgttagagggttgtttagccaagagtcaagtgtatttgctt

SEQ ID NO: 68561 - DNA, 5354 bp, Oryza sativa
tactgtcagtggcggtctgaccggccgagagcctgcggtctgaccggccgaggaccgtcggtctgaccggccgtgagccgttggtctgaccgacttggggcttgcggtctgaccggccttggctctcggtctgaccgcccctgacagacagcactcctccttctcccacttcactatgtggcttctaaaattgttgcttatccatcctttgctccttgtttttcagctacgcctccccgcactcgccatggtcgtcgtgagcccacgcccgatcccgtcagtgagaatgaggaatcaagcggagatgagtatgttcaaagtgatgatgacaatatggaaaatgttgagggtgatgagatggaaataagtgatgatggtgatgacaatgagagtgtaaatggtgaagatgatgaggcaagtgatgatgggagtcctctcgattcctccatccaatttgtgtttaatttgaggaatgctcaacaatacactatcctccgtcatcatgatcaattccggaggcctaacgattgtaatgatccaagatttcatacacggttccaaaagtccgtgtatgcacaagtgtatgccaacaaagccttcgccgaacacaagtggatttcttggaggcacattggtgagacaccggagtttgagaatttgcaagagatgttccggaccgttgggattgatagaattgtcaccatgaagcaaccttttgatgaagatctcatccggcaattctatgccaccgtatgggtgtccggcgattgtgatgcaatgaagtggatgtcggggaccctccgatgctctatcaactgccgtgaattcaaggagttcttgcacattcgcttcaacaacggggatgaccttcatgatgagcacacccacaaccccttccccattgatcacttttctcagttttatgaagaagggggaaggcacacatatggcaaggtggcgggtttgagggctctcccaagtgtgatcaacagcatagtaagggccaccatcctcccaagatgcggcaacaatgatgacatacgcggagttgcttggcatgttattgatgccattatggatggtcgtcggtttgatgttatcaaccttatgatgaaggagattgtcatctcaaaggggactcttggacaaggaatctattatgctccatacataatgaggttgattcaaagcaagttgggacaaattggtcacaatttaaaaaaacataaggagtacaagcctcgtctccaactctcctcccctagagctcctcgtgtgcgccaaccaacattcgatcaaggtgcaagctcaagtgcagccccccctcctcctcaagggtatgatccaagtgcttttttccatccacaatatgcctactttggaatgcaacccaatgacttcttcaacccggtccttggggctattaataccctaagtgaaagcattcaacgcttatccactgggcatgaagcattgcatgaggatgttcgtggcttgcgcaccgatgttggcaacttgaatacttcggtgggaagattgcatactagggtgggtgtattggattctcgagtcccgccttagagagtacccaagcttttgtctatcatcgccgccgtgatgcttctcatccttccacttcggcgcgtcctccttctcctccacaagagtgaagacctttttggtgcttgatgccaaaagggggagaatagtgtgttctatgttttgtgggttgggactagtagtagtgaggttagtcacctcatttttaataggttaaggaggattgggctatatttggtatgggtatgggctattactctatattgtgtgttcctttttcgttttgttgttctctatgtcatttggacccttcgtggtcttgtaatagcctatatttatttgtgagccctttatgtggtcttaatgtgaacttgtgctatgatggatgattggtgtgacattgatatatttgtgaccatcttatgctcatggatgaatatttcttgaagttcacattgagatattgctcttgtgtttgtgatatgttgaaatgtgaaattgaattgtgcattggctccatatttgctatttgtgattgttatgcatatgtttagggggagcttttgcttgtcaatacaacatatgtccatgtgctctatgtttgattatatatatttgtggtgtttgtcatcaattaccaaaaagggggagattgaagcatctaggcccccggtgttaattttggtaattaatgacaagcactaattgtggactaaccgttgtctttgagctatacattttaagttaggtccacgtcatatgtgcgcatggataattatcgatggattaaaattgacggcgcaaagcaaagggaaagaagacggtaaaactagcgctttaatttagaattgatcgaggtgtagggcgatcaaatttgctagtttaattttagtttcgccgtactattaagaggggtaatgacctagcaaagagatgattttaattgccacattaggtcattgcattttcatttgtgctctctttttcgttacacacacattcactaattcactgggtttgtcctgaccaggggcggtcacaccggccacatagtggctgtctgaccggcgtgccctggccggtcagaccggctacatagtggcggtctgaccggcaccactttcccggtcagaccggccccctggaggccgagatgatgctgctcgggatggccgatacagagccgacggagccgtagtcggtcagaccgagccgatggcggtctgaccgagccgaggccagtctgaccgagccgaggccggtctgaacggccgccccatgtcggtctgaccggccaggccgatggggccctctgacagggctacaacggctagttttctagccgttgcagagtagcacggtctgaccggccacatacctccggtcagaccggcagagcacaaagttgggggatttcacccccaacggctagttttggtgggtgggagtataaatactcccccaccagcagcaagggggctctcttggcacccaattcaattgcatacactccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttactcttggaggttgccgcttcctagacggcttgtggaggagttgcccggtgacctctccgagaagattgtggaggaggcccggcgccggtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcacctcaacggggagtaggaaaccggcgagtttccgaacctcggtgaaaaatctcttgtctcattgtctcatttgattgtcgcatttacatttgtgcaatttacatttctagagacacacttgagatcatatcaccctaggattgcaaaacattgacataggagcgtgatttacttttctagagatataattgagccactatcaccctaggtttgctaaacataacttagttgcttagttagagttcactctcaccaagcctagcaacttaggttagatttgattaggtgttatttagttttaaatcgcctattcaccccccctctagtcgatatctcgatcctacaggcatacggctaataaaccatggagaaaatgaatggtgtaaaccaaagcaatttattttcataatgattcaaagttaacactagtaaaaaataagctatgataaaaaaaacatctcaaatcaattttaaaccgttaggtatcttagctaaggtggataaggctacgttcatttggaatggttgggatatttttctccatgcaggcaaaacaatgcgaattattagcacatgactaattaagtttaacttaaaaaattagaaattaaattaattaatatgtttttctctagcaatttttcaatttttatagagaaatgtagtatcgtttaacagtttggaaagcgtggtagagaacgagagagtaaaagctaaaaaaaatagagaaacaaattcttaaagcaagtttaatagtatgctataaacttatatatggaggagaggaaaaaaaagagaaaagtattagctatcatgtaagagcccgctctttacatggttaatataatgtactagctatcatgtgaagaagcgatagaaaaagaaaattaaagataaccttataactcatatatttatataatttagttttaatattaaacttatatctagttgattctaaactactcctttcgtttcatgttataagttgtttgattttcttcctagtaaaaaattatcaagtttgatcaaattagtttcaaactttatcaaacttaaaattgaatatatttcgataatatatttgttttgtgttaaaagtattattatgagttggtttggtttgtggcctaaataggccttaccaaatttttgtcagtgccaaattttggtaagttttggcatgactaattttggtaaggcaaagttgtgtttggattgaagtcaaaatagcctaaattcactattgaaatggcctattttcttaggcatgccaaaatttggcttcaaactaaatagacactaaacactattgaaattgccaaatattggtaagcctaatttaggcctaaaaccaaaccagtcctatattttctataaattttataaaatttaaaagaagtttaattaaaaaaagttaaaacaacttgtattatgaaatgaaggaaatactactacctccgttttagtttacaagacgttttgattttgatcaaagtcaaactataatatttataataccaaattagtttcattaaatcaataattaaatatatttttataataaatttgttttgggttgaaaatattttttttctataaatttagttaaacttgaagcagtttaatttttgatcaaaattaaaacgtcgtacaactgaaacagatagcgtgtcttaacagtttgacgagaatggttgatatgccctgaaatggtcctccaagtgagtgacagtaattccacgctcgcacgcacgcatgggcggtggtgctggtggtgtgtattcactgtttaggcctcagaccgaccatccgaaatccccgattgtaattaaagcatgccacgctagcacctccatatgatccatctaccccccttcataaat

SEQ ID NO: 68562 - DNA, 6232 bp, Oryza sativa
gatgagagcaagaaagaaagaaagaaagaaagaaagaaagaaagaaagaggagagaggttaatttgttacttagaaaggaaaggctccaaggatgactcgggaccacaattatactgccaacacctggttgccatcatcacccttcaccccatatgcccctttcccatttttcctatttttattttaccatttttggttgcgcctgtacgatctttcttgtggtacaccgtaaaccgctagtttttatcgtaaataaggcgccgcagtttatggttttctctcaagagacgctgtcacaatttttatatagtagtggatgatggctatagtcatcctaattttgtagtcattttctttttctcttagttcagtaaatcctagcttgtaaggcttagagacggaaagatggtctggaaaataccttacacatgtatagagataacactttggtgatgagttaaaatcaagtggagcggcgctacaccataccaatatacaataccaagcaaccttattttatatatgataatcttcaactaattcattgttatttattttgtttaccacaaaacaaattttaaaaggttaactgttgtgataattaattaaggcaactagacaagacatgaaggatggtaagtgtagcggtcaaggagtacatactgtacgtatgtgcaaaatgaatcgtgtcctatataaatgaaattaaatgcccataccataatatatttgctcagttcaggtacatatatgaaaggtcaaaataattaagttaaacactaggtaagttgtaaccagcctttttaaacttattagttattatagtatgaattcttaaatactaattgaactgctctattttgtttttcttattttacatacaagttgccgtgggacgagagctagcttacttgccacaccaacaccactcttaactataactattcagccgatagtatttgtcgacttgttgcaatcaaattaaacaatctaattactaagatcgagtgacatatggagcatgtatttatgatagtgcgcggagccaattaatcatgtggtggatcccatatactccctccgtttcaaaatatttgacaccgttgactttttagtatgtgtttgaccattcgtcttatttaaaaaatttaagcaattatttatttttttcatatcatttgattcattgttaaatatacttttatatacacatatagttttacatatttcacaaattttttttaataagacgaacggtcaaacatatgctaaaaagtcaatagtgtcaaacattttgaaacagatggagtagctagcaaaatattcatatatattactacctccatcccaaaatgtttgacgccgttgacttttttaaaaatgtttgaccgttcgtcttatttaaaaaatttaagtaattgttaattatttttctatcatttgatttattgttaaatatacttttatgtatacatatagttttacataaatcacaaaagtttttcaataaaacgaacggtcaaatatgtttaaaaaaatcaacggtgtcaaacatttagggaaggagggagtaattgtttggtggattttacagtggttttcaccaacaaacaagcgttggttactgtgaggaaagggttaccggacctagcagtgacacggtcaccagagtggtatcaccattgacaccaaccatgcatgcatggtaaaaccaagcggtaccattacaaacacaagccaatataatcgagctagctgtagggatcgatgtgtgacgcaacattggaaactgctcgtctacttgtctgctaattggcgtgtgcaaaccatagagactatcaatgtatataatgcacagtaaaattataattcaagatggataacaccaaaagcgacaataaccacatgaaagatttttccgtgcggatagaatagattttcgcgtgcggagcttccacccgtctggaagggtgcgtctgcgaaaatcccgattttttcgtgcgggtgacgcacccgcacgcgaaaatcgattttcgcgtgcgggcgcttagaccgcccacacgggaaaataaaaaaacaaaacaaaaaaaaattaaaatccacccgcaaaccctaacctagctgccgtcaacaccgccaccgccgacgatgctgccttgctcgaggcccgtcgtcgtcgtcgccgccaccaccatctgcggtcgccggcgacggatccggcctccccaccggccacagatctagaacttggaggcgtaggggaggagagagtcatagcagatgtccgggtaccgcgtggtcacgcagtgggcgcagaggaacgccgtcgccgacgaggacgtcgtaggctggccaccggcgtcgtcgagtcgttgtcccagcggtggcaggccgctgatccggcctccccgcggcggccggcgacggatccgcctccacgcggcggccagagacggatctgctccgccgccaccgccgcgctcgccgatgtcgcggctgccgcgcccgccaatgccgccgtcgtggccacgcccgccgatgccgccatctccgctgccctaaccgagggcgctgccgtcaccgaggaggagaggaaggatggggaggaggagagggaggatgggacgatggacaggagggaggatgggaggaataatggtagcgcgcatgatggggaggacgggaaggaggataagagggagatgggaggttgggcagcgcgtgggttacgctattttcgtgagtggatcacttaattagcaagcccgcaagcggcttatttttgtgtgcgagactgttaagtgaaccgcacacaaaaattgattttcctgtgcaagcgacggcccagagcccgttcctcattttcctgtgcggttgcacttatggtccgtttggaaacaaaatggtttggtgtctaggaaaatcttgcatgtactggtgcttgaagaaacagaatgatcatgatgtgtagaattaacatatcatgtgtgacgtctcaaaagaagtactccatatacggtaatgcatgttagatgcagagatgtgcatcaatgatatatgtagacagccctgcatagaaaatgcgtttgtgctacactatagttgtacttatactagtttgggggcaccgatcatcgtgcaagtgagctgcttaatttgagtgagaaatgaagggagcacgacgcttgtgtttctaccactggctccacgtgtcgacacactacttgcttgcgcttgcccgttcgtacgaggaccaggtggcctcgtacggacacatccactcatgcgccgacacgtggaagacctgggcccaccgccatcaaaagccgcggtggggacctccacgtggaccatcttgcagaccgagcctcgtactccctccgtaaaaaaaaaagacaaaccctggatttccgtgtccaattttgactgtctgtcttatatgaattttttttataattcgtattttcattgttgttagatgataaaacatgattaatattttatgcgtgacttgtctttttaatttttttcataattttttcaaataagacggacgatcaaatgttggacacggaaaccagggtttgtctttttttgagacggagggcgagccaaccaaaatctgatttttctttccccctcctttttcattatttttcaaagaaaaaagatcacacatctgcctgattgtcagattccacacctatcctacttcaaactagcaataatatccatccttgttctgctttcctgcttgcaagttgatcctgtttcagtttcctagctccataaaaatatagtgcaaaccaactctcatggttagctttatcgttgaattaatcaagtaaggtctaaaccgagactaatggttttgatgagcgcgccgtggcgtctaaaagaagaaatgacgtgttgagtatattaaccattcatgcttccttgtccctttagagaaacaaacaaggggcaagaaaactagggagatgggaaagggaggtgtggcccttatcataaaaaaatcatattggaaactcacccaccctaactaacctaaggtaacacaagtaggtctctttaaaagccgatcacgaggttagaaactatttctttaaaaagtagggaggatccacttggtccaattggatcccttaacaaaactatgctaccagacaataaacttttggagataaaatactagatatatgcacccaataacattacttcaagctttcaaagtgcaggtttcctagatcccacaaaacctatttgatgattatacagtgtttatctcatactaacagtatcctataatatacttcctccgtttcatattataagactttctaacattgcccacattcatatatatgttaatgaatctagacatatatgtgtgtctagattcattagtatctatatgaatgtgggcaatgctagaaagtcttataacctgaaacagaggtagtaagagattttgactaacaaatgcatcgccaaatttcttatattgtgggacaaaaatagaatgtagctagcatggatacatattagatgttacacctagaggacacgcatagagagcacacagatttgtggaggagttttgtaggatccaaattatataggactttttcctttttggtcatttgaaactaatggattagagctttccaaatgctataaaattcctaagaaagggctaaatgcatgtaaagtttggagaaaagttagaaagaactcaaaccccttggaaagctttcttcgagcatatctctctcttctggtttcctgtgtttctcatacggtttattgaaatgaccattcatgtatttttccatgttttgcaattacaattctatcaagattttgtgtttttcttattcgttttgttttctcaatccagtgtataaaacgagctctaaatgttgttataaccatataaagtaagtaccaacagactgcactaattcgataagataaaatgattgatttgtgtggaaataccttgtccttatgtatatttatttcctagacacttgtaggctagcaatcaatattttttatttttctccttatcacttatatgtgggcctcaagtctattttttaaaacttttttttatactgggttgtcatatggacatcatgtaattaagccaaaaccaccctaaaacagccatggatttgttttgtatatagttttttaatacttgggaaagcgagctacggggtatctagttttgcggaattgctcaatcccgggcgaccggcgcagggggagccggatcgggcgctcccccacgttcgctctccccccacgtgaccctgttgggccccacccacttctccctcccctttctccacaaaaagatgtttcacctagtgtcctcacaatgtttcactatgtatagatttaatgttgcagtgaacgaaacattccattgcaacaaaaacccaaatattttggaaactctctattaagggaatttggcttattttttgttccaccaaaaatgtttcacctaatgtactcacaatgtttcgctatgtataaatctaatgttacagtgaattgaaatattccattgcaacaaaaaacccacatattttgttattttctgttccaccgaaaaatgtttcacctagtgtactcacattgtttcactatgtatagatctaatgttgcagttaactgaaacattctttcgctatttgctgaaacattgtttttatataaggtgaaacaacacccgatttaaacgagtgaaacattttcgatctactttgtgaaacaatttcgatatacctggtggaacatcgtgcaacatttaaaaataattcaataataagcttattttttttcgtcaggatatatccatgcgtggtcttgttttaaagatttaattgcaatgaatttaatggtgcaatcggatcatgatttggataagtaatttaagagaaaaatcagtttaaagtagttttacacgtaaatcgggcgctgacgtcaattttaacccgtttgcatcgggcgcccgagccgagggaattttttttatttatacttttttttattaaaatatttacaaaaataatttgttgtttcgaaaatttacaaatctaatcgcctgccgccctttgggagggcgatttttaaaaatcgcccttccacagggcggcaagggacctaaatgtaaattttccagcataacttgttagctctataattttacaa

SEQ ID NO: 68563 - DNA, 5169 bp, Oryza sativa
ctgcagcccgcctgactggcccggtgacccctgggctcacctgacggagtttgccggcgctgtcgacgaggaagtcaaatgcgccgaaggagatttgggtggtggcggggaaagtggtggtgctggcgatctcaaacccagtgggtgccatctccgccttgaaaacgatcaagcgccccctacctggcgcgccaactgtcgatttctatgatcggcaatatattttatggggtgcgctagatcaaggagagatggtgacgcaggtgtttatcctggttcaggccctcgagatgaggtaataccctacgtccagtgtgctttttctctgtattcgtggaaagaaaatgaatcgagaagcccaaaggatttcggaaggacgccggcctctttatacaatctcaggccgccggcgccaatcaagaccccgtatcctcacaatttggatacttgccttctattacatgattggggatctgttactataatctccctgtcttgcccaactatgttagacttactatatcggtcatgggcccttggcccacccccgaagcctaacttgggccgctaccgtgaggtacccgggtgccgtatcccccacagccggtcccactaacttccatctaaactaggggtaaacgcctctttcggttcaaaaaagtgtgggcaaaaaaacgaaaaccctaaaaagtaggggtgtaatcaatattggacatgaaagtgagaaaaaaacgaaattgtccagttatggttgaaaaaaagagcaagggcatttgtccatccgtgttaaattatttttgtatctacacgaaaactaaatgttactcgtaggcattattacttgtatcgtgcattggatggctagctaggagtatgtcttttttggaagtaatgtgggaatttccggttaatgtggaaatttttaactattttacctctttagatttattcttcatgcagcagagccccaattagtacaagtataaatattgtgaaaattctaaataatattcctctacagtatcaaatttaatgtataaaaaggactgaaaatgtacctttattcacagtggtctttttagatttctttgtgtgtaaataaaattaagggatttattaagtgtcactctaaagttaaatcccgtatttgtggaatattgccttgattttgttctaagagcgggcgttaatttgtagaagagaagattatgaaaacttgatatgctgggtgatttgatcaaatacaattccttattcagtgctttccctaaaaaaaatataattccttattttagatgaaaaattaaggaacctcttatgccaattacacggaggggccatctaaggttagagatgatacgtaggccatgagggtaaagcctcaacctttcatctagagggaggttataggataacatttttctttatgggagaaatggaagcgttaaggaacatcaggaaatatgtgaaagatgtttcttgatttcaaagtgatatcagaagagaaacaacacaaagggactatatacaacttcttttagataatgagaacttttattgaagtcggtcaattacatcaaagtatacaattatcatgagaacactgcgagtcggatatatatatatatatataactatatcccattagagagctctccaatccagcaaggcgtatacacgaacgaccgattaacgccttcgacgtgccaatggtcgaaaaaattggggcgtaacctacctaagtcttgagccttagaggtacccaagtgataagccaatcctctgcttgatccttcatctagaaagataacttctttgtaaggatgaaatccaaggattaaaaaaccaccatgagaagacctttgaaccctatcctccaagtcgagaacatcatcgctgtcagagtcccactcgaacttcctttccgctacttctgcattgtaattagtgtcatctccatcataaacatcacggcggctgtagtgtaaagtccatggtccgacactttcctcatcgtagttccagcgctgaaacgagagttgaatttccttgtcgtatttcagttcccacttcatctgctcacatgattcgttgagaatccaaacccgtagatggcaccgatcaagtactgcgaggtacacgcccttctccgatcttgcaagaaaaggatccacatatccatcttgcgctataggcaatttaattacttgatacttacttttcgacggagaaattctgcaaaatggatcaaagtagtaagcaaaaacagctgagaacatattaccctaaatataaatgatattattatatataataaacaaaaatgattaaggactagttagttctagtacctcataacaaaattagcttccctatgtacgtagagtgcacgtttccaatagaccgcgttgtactgttccaatagcggttgcgatctcatatccgcgatcgtcccggcggcctcaccttcacgtacaaaggatctctcttcccattgccctgtgctcgacgagaacacactcaagaagcaaggagagggtggccactctgattcctcaacctttggcctcagttttttggacacaaattcctcgggagtaacactcgggatcaggaacacctcgtagtgcggagatacggtgggatcgaacacgaggtactcgtcatgatagaagctcctcgtgatcccgggccgaggtggcgggggttcagggaaggccgcccaccgctgcgtggccgggttgaccacgtagcggctgcggagcaggagcaggccgttgcagtgatccacgacggtgctcctggcggcggagggggtgaagtcctcgaacttgccggagatcgccgcggcagggggccgcgcggacgggcggcggaggaagaaggacgtcaacacctcgtggaagttgatgaagatgccccccagtgacagcgggaggaggtccgcgcgcagcaagcggtggccgtcgacgacggcccgccagggcttgcagacgcagcggcacgcggctagtgggcgcggcgcgaggcggcggaggatgtcggcgagcacgtcgtcgggtagtaggtctaccatgttcagtttcggatcctccggctgctccatctctctctgctttaatttgctgttaactcaatgctcggccgtgtactgctcttgggttgatttatggaggatgggtggcatccgatccgattccgtcttggttaacaactcgagtccgagtccgagtcggagtcggagtcggagtcggaacgagcacgcgcggcgcggcggcaggttcaagctccgatagagtaacgcatgcatcgaattctttcgtctgtaacactagaattttgtgtccaagttctgcacaagtttcagtcatgcattggaatgggaatcaataatttgatagtaggagatgagagcagcataattagctacctacggtgtgcagccatggatccttttgggtgcaggattcttcaactgagaactacatccaagatgcaaaattactgtgtgtgatagatatcgttttgagcggcatctccgcatctgaactctgaaatttaattattcagtatgactcaattttttgtagagatattcgtgaaagcaaaagaaggctttctttactgattagattactagtgttatgaatcctcgataatgtagtagagatcacacatgaatcactgctttcttcaaattggttcgcgtggatctgtaccggtcttagaggctgtttggttggttgccacactttagccatgccatagttttttagcaatgtatttggttcgctgccgcaattgtgttatgccacactttcttaacattggaacccacatgtcatgctctcaaatttagagctaaatatgccacacttatggccaactatttctaaaccacatttgtgccaccatgccacaactaacataaacttagttatggcaaggttagacatcaaccaaacattcccttacttcagatgaaaaaaacctctatagccgacgagaaaggcactagaagtagcaggcaaacaaggaggcggcgggtggcaacctgtagcgcgaggaggcttaccacaccgtcgcaggcgctccctagggcacttgagataaaagggattttccgcattcgaatttgctaatctggctcacgcaattcacgcagctccggtacagtgattcaatgtttcagtgattgattttttctgtttagttctcaaaataaaaatttttacccggtcatattgaatgtttaaacacatacatggagtattaaaagtagaaaaacaaacaaacatatttcgctaggaaattacgagacgaatcttttaaacctaattacgccatgatttgacaatgtggtgctacagtaaatatttgctaatgacgaattaattaggcttaataatttcgtctcgcagtttcctggtagaatctgtaatttattttgttattatacaagatttaatactttgaatgtgtgtctgtatatcctatgtgatacttaaaaaaaaattaggaactaaaccggtcttaatgtttcacccgacatttgatcactcgattatttttaaggaaatcggacgtctgatttggagctctatcctctctcgaggaggctatgggctccgcgctggtcactaagatcgtggaccattccgaataacctccacacccggtcgcgattctcaacggtttgtacctggacactatctatctacattttattttgtaaataaaactcagtaattactattgattcaatttaaatgttattaattattataaataaaaaatggggcattgaagcatctaggcccccggtgttaattttggtaattaatgacaagcactaattgtggactaaccgttgtctttgagctatacattttaagttaggtccacgtcatatgtgcgcatggatgattatcgatggattaaaattgacggcgcaaagcaaagggaaagaagacggtaaaactaacgctttaatttagaattgatcgaggtgtagggcgatcaaatttgctagtttaattttagtttcgctgtactattaagaggggtaatgacctagcaaagagatgattttaattgccacattaggtcattgcattttcatttgtgctctctttttcgttacacacacattcactaattcactgggtt

SEQ ID NO: 68564 - DNA, 2568 bp, Oryza sativa
tgatgagatctataactttgtagtttatcacttttccatttaaaatcatttggagtatcgaataagcattattagtttttaagcaattaaaaccggtgggaagggtttgaacacaaataaaaattttgtatttaggtcccttgccgccctttgagagggcgatttttaaaaatcgcccttcttaagggcggcaggcaattagatttgtaaattttcgaaacaaaaaattatttttgtaaatattttaataaaaaaagtataaataaaaaaaattcgagccgaggcgtcaccctagttttgcggtggaggggtacgaattagactgggtcaatagttgagggagttgcaatgacttcattctaacgggcctgcacgtatgctacagttgtgcgtaaggaagctacagtccagttctggcccagcccagcccatgtagaagaatagaaggtgacatctttccttcctccctcgcgggcggaggcgctcacacgcaaaaaccctaaaaccccagtctacccttccttccccgccgccggcagccgggacatcaccatggcggacgccgtgcagtaccgcctcgagcggatgtccgacgagctcgacgacctcgagcgccggggcctcttcacccgcgccgagctcgccgaggtcgtccgccgccgccgcgacttcgagttccgcctccgacgccgctccccgctccgctccgacttcctcgactacatcgcctacgagctccgcctcgacgccctccgcgacctccgcaagcgcgccatcatacgcgccacccccgacaccaccgaccacgatgctgacgccaccgacaacgacagcagcaagaagaagaagaagaagaggaacaagggcaaggccaagaagtggaagaagtccgtctccgacatcgccggagtcctccgcgtcctcgacatctacaggatggccaccgtcaggtacaagggggacctcgacctctggttccgttacctcgagttctgtcgcgacaagcgccatggtcggatgaagcaggcaagtctccccagaaccttcccaccttcctgtctcatcctgcccattacttctttctccatactatgtatgatactgcggcattgccttgttcaatcaattttgttagcttttctacatgcggctcttgattgatgtagcaatggtttagtactgattactatatgtcgccctttcatttcttggccacaccgtagtgagtgagggacacgggcaaccaactttattcacttatttatgaatgcataggttcatttcatctctttgtctctgtttgatcaataagaattttattacggttgaagccttcttgtgctctgaatttaagtttggcattgagtgaagtcgcatgactcacattgtgattatcgggcagcaagttaggccatacgtcttgctgatagaaatttatagattacttgacaatttcacatgaacttctggttgtgcatcagaaataatacgctataaatagttgaatgctgaagataataaagtcatgaccccacttattgttgaaatttattttttttcctgggctttttacaccgaataaccattgtctggttcatggtagattaccgcgcaatcctgaatatgacataggctgcactggtgtcactggctatgcgtcgcgaaaacggtatgagattacactacagtgctgccactaaacagaccccgcatccagctatcactggagctgttgtgttgtgcactgtttgttaaggcggcggtggggacatggtaagccatagaaaaaagaaatcgttcaatgctcaccagtccagatccggtaaacgttaaataccagtcattaacctattgaagggtaagacagaaaagctgtagtgtaagcgattggttttatgtttcatatggaattagttgtttaagttttcacaacattcgagctaagaaagaataaggacttccccagtccagtgtgtacttgtttgagatctgattgtgttccgaaggctactcagtatgcatagaaatatagtcataactggcaaaaggttggagcttttgaagtttttgaaattgtgttttttttccttttgcaaatatataatgtggccagagcttgaaagctatttagagatgaaacttttcttttcttttttttggttcttggatgtagatttcattttaaatcttagtatgagttgatgcctgtttgtccttcttttgttgtgtatttatgtgccccatttcatgccttttttgtttgaacttctcctccgatgatatgtaaacatgcgtatatatatttttggaaggctaacattgaattgatctcactatttactaaatttacatatctcatgttcattgtattatttttcaggctctggcacaagctattcgttaccaccccaaggttcctgggctctggatctatgcagcagcatgggaatttgatcagaacttaaatgttgctgcagcacgtgctcttatgcagactggtcttagatcttgtccagaatcagaggatatgtggattgagtatcttcgcatggagcttacctatcttaa

SEQ ID NO: 68565 - DNA, 2996 bp, Oryza sativa
cccggcaccggtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttacatttctagagacacacttgagatcatatcaccctaggattgcaaaacattgacataggagcgtgatttactttcctagagatataattgagccactatcaccctaggtttgcaaaacataacttagttgcttagttagagttcaccctcaccaagcctagcaacttaggttagatttaattaggtgttatttagttttaaatcgcctattcaaccccccctctagtcgacatctcgatcctacaagtggtatcagagcttggtctctcttgattgggtttcaccgcctagagagaagatgtcgaacgaggtgaaccatgtagggaaggctcccatgtttaatggcacaaactattccacttggaaaattaaaatgtctactcacctcaaagctatgagcttccatatttggagtattgtggatgtaggctttgccatcaccggcacacccttgacggagattgatcaccgcaacctccaaccaatgcccaagccatgaatgccttgttcaactctttgagctaagaggagttcgatagagtgagcaaccttgagaccgcatatgagatttggaacaagttggcggagatccatgagggtccaagtgagtacaaggatgccaagcttcatttcctcaagatccaatataagacattctccatgttgcctcatgagagtgtgaatgacatgtatgggaagctcaatgtcattgtgaatgatctcaaggggcttggggcaaactacaccgatcttgaggttgcccaaaagatgcttagagccctaccggagaagtatgagacccttgtcaccatgctcatcaactccgacatgtcaagaatgacacccgcaagcctcttggggaagatcaacaccaatgacatgtacaagctgaagaagaaggagatggaggaagcctcaccctccaagaagtgcattgctctccaagccgaagttgaagacaagagcaagagcaaggtgaatgaagtcaatgaggacttggaggaagagatggtccttcttgctagaaggttcaatgatctcttaggaaggagaaaggagagaggaaggggctccaactccaataggagaagaaatagaagacccaacaagactctctccaacttgaggtgttttgagtgtggtgagaagggacactttgcttccaagtgcccttccaaggatgatgatggagacaagtcatccaagaagaagagtggaggctacaagctcatgaagaagcttaagaaggaagggaagaagattgaggctttcatcggggaatgggactcaaatgaggagagctccgcctcatccgggtccgaggaagaaggtggtgatgatgcaagctccaagaagaagaagatggccgttgttgccatcaagaaggctccatcactcttcgctccactttgtctcatggcaaagggctcctctaaggtaacatctcttagtgatagtgagagtgatgatgattgtgatgatgtttcctatgatgagcttgtgagtatgtttgaggagctccatgcttatagtgagaaggagattgtcaagttcaaggccctaaagaaggatcatgcttctttgaaggtcttgtatgaggagctaaagacctctcatgagagactcaccatttctcatgagaagtttaaggaagctcatgacaacctcctttccactactcaacatggagctcacattaatgttggcatatcttgtgatttgcttgatgatagtgctacttgccatattgctcatgttgcatcatctagcatttctacctcttgtgatgatcttatggatatgcctagcccttgctctagttctagctcttgtgtttctatttgtgatgcctcacttgctgttgagaacaatgagcttaaggagcaagtggctaagctcaacaagagtttggagagatgcttcaagggtaagaacactcttgacaagattttgagtgagcaacggtgcatccttaacaaggagggacttggattcattccaaagaagggtaagaaaccttctcaccatgccactcgttttgtcaagagaaatggtaagtattgctccaagtgtcgtgaggttgggcatttggtgagtgattgccccggaggtaagcctcctaagacatgcatgtttgattctcattatatgcttacaaaggctcatgatggtagcattgttgctagatatgtgggtttccctatactcggtggtaaaaacaatgccatttggatgcccaaagctttggtctctaacctccaaggacccaaacaagtttgggtacctaaaagaacttgatcttcttttgtaggtgaactaccggaccgatgggagccattgggtgcttgatagtggatgcactcaacacatgatcggtgatagggctatgttcaccacatttgaagtaggagggaatgaacaagagaaagtgacatttggagacaatagcaaaggaaaggtaattgggttaggtaaaattgctatctctaatgatttgtcaattgaaaatgtctctcttattaaatctctaaatttcaatttgctttcggttgctcaaatttgtgatcttggcttgtcatgtgccttcttcccacaagaagtcattgtttctagccttcttgacaagtcttgtgtgttcaaaggttttagatatggaaatctttatttggttgatttcaattctagtgaagcaaatttgaaaacttgtttagttgtaaaaact

SEQ ID NO: 68566 - DNA, 10300 bp, Oryza sativa
gagtcacctcctgtgacagtgaatgaattattgaaggaagcacaaatcaacgctggccttctccatttttggctcttctgtctctacttttttttttctcttttacaatagaaatatagtacactaccaccattcacgcacatggaaaaaggggaaattttattattttttcattctatttatcccataatataagatattttagtgtgctacttatcgcatccatcaactttaatttaaatttttactacctacagtatatattttaacaccaatctacccactcaagcacaaccaaatctcatttaatagggtattctagtctttcttgctatcattaatctactaaaagggaataatcccttatattagggtatatacaatgatgtttaatatccgttgccatgatgtaaatttgatgacgtcgaagagagaaggggaaaatgaaatatggttgctccgcataacaacaactcagagttgattcttagtatttattaaaggaaattttattgcattagagatggagaaaagaaaagaaggatataaaaaatattttggtgcattaatggttactcatatatattagagagcttgttatctgaacaataagagtatatttctctaagtgatgtgtactgtattaactaagagctcgtatggggcggagggagtactatctacttcatacttgatccctccgtcccaaattagatatcgctttcgcttagctttttttcttgtaacgtttgaccattcgttttatttaaaaatttaatgcaaatataaaaaatgataagtcatacttaaaatatttttagtaataaaacaagtcacaaacaaaattaattataattccataatcttttgaataagacgaatggtcaaacgttacaaacaaaaacttgaaatatcaagtattttggaactgagttagtataaagaatgggcacacgactattgtagtatataggatgctcctcttgcgaagaactgtagtatcctatcatcaaatcgtgtagtaatatttagaaataataaaatagcacgacttaataattttgaaattgtaattactaattatcgagttgcattcaagtttgcaattgtaccctttattatgtttcgataattttaaattttggaaccagtaaaaactgagttttgtattctttgtacgtacagattaaatgggatacagtaaatatttcctataacgtgcagattaaatgggatattacatggtccacgatcataatacgtttcatctcatcaacgccagttctttccgattgacacgaagctctaaaaaaatgcttaattactagtagaactataaatggacagttaatattgaatcttgaatcgtcctagctagtctaccgtcgtccttgtcctctcaaatgcacgtagtacgtactgttgcctgccgaatatcatcatcgcatctgttaattgctggcaatggtcaccggaagcatatatatgcacgatccaacgagcaccattggagcgacccatcgatcgagatgaattgaagagactagagatgtgatgatgtcttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttaggcgttggatcgaaatccaacacagctgtatgtattttggattaatttctctcgctcaatgagaatagcaaattaagctgacaatcaattaattaatggattgaaaaaccgattactttacacaaatatatatgcatgcatggaagtagctagtactactttattaatcaaacttgctttgatacgtactgtactgtgtacagtatgtagataacgacgctagcttctaacacaacgtacgtattgcgcacgatgaatacgtgattcaattgattcatatagtagtacgttcttcatagcatagataggattcgttgattggattcattgatggatgcatgcgtatacatatatcctactgtgcgcatgtcgggatttaaattgggcttacatgtgcatatatgcatggctcgattttttttcgaacgcgcaaaaggattgcacgtcaatatattagcagaaaaaaagcttttgttacacaaagcaatcagccagactggtttatacctaaaaaaggagagggggaggcaaaataaaaaaacttgaagataggaactaccacgacggttaaaaacacaactccaaacagatgtgacgattggtggctagggttttaatttgctactccctttcgttccaatatataagtacaatctaaaacagatgtgacgatatatccagattcatagttttaaatatcacattatactcggttaaatttatattggaatgaaaggatactgcactagtagtagctatacttaattagaggttaattgtactatgtgtatatggttccaacctttcaatcctgtccagattgactcctccctctctcaatcaggcaggacgatcagctagtactgctctctccatcctaatcaaggaacagcatcttactaatgttataatacaatacgcgcatacatacatacgtagatacaattagctaacacatttttattctctaaattcgtttctttaatagagtgaagatctttaattttgttggatacttatatacattgtgtttattgggataaaagaaatgataagataataatattattattttattgatttttaggatagtggtagttgcgtattttatgatagagggtgcaatgacatttctatcttaatcttcctagggacataggatctcgggtaaattattcaattctaactaatttatattaaaataaatagatatatcggttaatagttacttcccccgtttcacaatgtaagtcattctagcattttctacatttatattgatattaatgaatctagatagatatatatgtctagattcattaacatcaatatgaatatgagaaattatagaataacttacattatgaaacggatggagtagataattaataagtactatattgaacttggatgtttctttgattggtcactgggaggaagtaatatagagctaggaaggagagagataggcagtagtactacacctatatgcatatcgatcggtatcatggatggatcgagatgtgacaataagtgcaatgcatgcattgaatataatactatatataaataaatgaatatatatgttggggccgggatggtcacgcacaaattgccaaaatattaatggctagcttagctagcatacaaacccggccagatttaaacatgcatgcacgctccccctctctctctctctctctctctctccttgcttgcttgcgtatatgcatgtatggtccatacagtatgcatgagagagagcgagagcagagacacacatgtacacacagagggagagggatatattgatgcatgtggctaagctatgctaatctctgtcatatcgatcgatcgatgtactgtttatatatatgttggtctaatggtctggtgctgggctcacaccggccggccggacgacgctgcctgctggccggctagctacagtagtactggtacccgacaacgacatatatgaagtagtagatacccacactgcatccattgttagagtttgcatcgaatatatgtatgtagtcggttacagtttaaaacttggagttgtaataggtgtttggactaaagtaacagtcggattctattataggctctctcataaatagaggagcgtacctgttataaccgcatagcgacataacatagcgagagggagcggctgccagcggcgaccggccgtgagtcattgtaactctaatatgctggatcggggaggagtgccctttatcaataccctggagatgtaggctacgactgaactccgttatcaaatatggtgctcggtgtgtcatcgtgtttggatctcctatagtgttttcttccgcggtttggtttccaatgtgatttcggggccagtcttataacaagtggtatcagagcacttgttagagtgcgcaggccagcccacacactgtgggccactcaggtttcattgggtctactccaccacaggcccaacgaagtacaactttagatcctgagtctacacaacctaaaagactagtctgatggtacgtaccccatgcaacaacgacatatatatggagtagtagacacccacactgcatccatccatccagctagctattgtagctccatcgatcaatcggacgacactacgcattcaaaagatctccattcaaaaacccgacatgtacgatatgatgcatggagtgcgtacatcccaaacaaatgacatgtctatctcaaaccccgccggcccccattatgttaatttctctcttccatgtctcaccgctagatacatgtatagataacctaggacataatacttcctccctcccaaaatataaataacatttgtatagcttttttttcacgggaattagataatagattattgtaattagtaaggatgagtaagcataagtagctagctagagaaattaaacgacacatgcaggtctgattgctcaagatgacaagaagctagcgggtggacaagtatatatgtttcataacaatttttgaatgctgaaataaagcttgtcatattttgggtccacggaaagagtatatgataagtttagtctctaaacgtgggcatttcagggctttggcttattaaaaaaaacatgttattaatgttaaaaaagaataattttagtaaaacttttgtacttctgtttttaacggaacaaatgttaaggttaagtgacacaaaacgatttaaaaaaaaacctaaattatgtttctgaatttcataattggacatgcccttataagctgcagcttaaaaatagaagaagaagcaatactacatctgagaagatgaatattaatggatagtttatagaccaccatagcgcttgttaattagaggtgtggtgggtgtttgcctgcagcttttataagatcaagtagctagtcggtcggagtagtaataagttagttgttcggacagacaagaataatggatgttttcctctcttttttctttaacttctaggcatcctatatcgacacttgctctgtttctatttaatcatcatataataaataaattctttcactaaagatcaaggaaggcttaacgtccttatacacttaatttattatgagtatattgtaaaaaaaatatcaagaaatatatatgcttaaactcctccacatacacaagaaactgcatatcaagcaaattaaggagctagggttatgtaatatcaattcggagattctaatttttgattatgtgacgggctgaagtagttttaagtgataacctatccaccggtaagaatgtactctatctgtactaaaataactttattttttatccatccacacataccaataaaaaaagactagaatatttctagtttatcagattttaatgcaattattttatctgctccaaatgtatttatcatctgctttcacaaactctcatgcaatgattatttaaaaataaaactattttgtgataaattaatgggaggagaaaaaagaacttattttgaatagaagggagtactcatgttcttaaagttaaatattaattatttgtaattataattgaggaggcaaaacaaaaccttggtgttacatctatccaatggagcagaagtagataggtataggtggacggtggtccagtttgatgcgtggaaaagatacggatggaaatgagtggttgccgcctacaattgatgatatttgttttgtttgtttgcaattgaattgaattggaagggcagggttggtggtaatgataatgacagtggccggccgacatgtgggcccgtgttggattagggtcccctattaatatactattgtacgctgctgcattgcggtgcccattctggtcgaccgtctcctcctcttgtgcatatctattgttttctttctggtactgttgtatgctagctaggctagcttctttccttaatcaattgattaattagatataattaatggctatccccctaaattacacaagaatcctgctaaattcatgaaagagcgatgattgctaattccttctaggatatcctttatattatgggtacgggaacgggatacggcaaaattatacgagcaacctccattttttgattcattgtagtacaacccctctgctttagttcatatgtaagaattaggaaagtaattttggtgcaaactgtttcgaatatagcattataaaagactacactaactacgactaactttgtgagcgagatgacatttagtatttgacaatttgaacagtcggaaaaaactggagtacattgagattggaggagtatatacttacttgagtgtaaattaaagctcggcctcagagcattagacgcaaatggaactgatgcgcgcagtaataaaagggatgatgctgcaaagagaaaagaggctactccagtaaatgtagagtataactgaaaataatttccaggagaattgaaggacaatatataaaggtacttgtagctccaagaaatgaagtcaaaattaagggtgagcagtgcgtgttatgcaaatgcatatgctgccgattgatccatcgatgcgtctttatcagtcatgcacctggctgtatgtaacgtactactactgctgtgcgtcgcgtcctctttcacagagctgcaacccctgccctgccctggccctggcagcttgcatcgcattgccaccaccagcaagctctctgctgcaaaaggaagaagaaactgcattcaaaaggaagtctagacatagaaagatctggagagtaaaaaaggaaggaaatttctgtaccttagctattgctttgctattgtagataaagtaaaccatgcagctcattaaaaattgaattaggagctgataggaattgggaaaagtttgttttacactctctgaataccgaactattaaaaccattcacttcagtttgaaccttaggccgggtttagatcccaacttttttttttcaaacttccaacttttccatcatatcaaaactttcctacacacaaacttccaacttttccgttacatcattccaatttcaatcaaactttcaattttggcgtgaactaaacacacccttaatttgaatcacattgggtaatctatcaatgacttggcaaagtagccaaaggcagaagccattttattttattttaaaaaaagtagtagaaagacttaaaagacctacaagaaattccatttccactaccaagtgcttataatgcacgactgacataaaacatagatggtctaaaaaaaatatttactacttaaaaagaccatagtggtgatggttgttcctacaacaaaaaaaaagttagaaatgaatacataaaacttatttgttgggtagcccactaaactttgttcacttcccacaaaatttatcaagtttggagtactccaaccttgtggaatgacagaaacttactgtatcgatattgccaatttctttatttgaatcttctgcaacaatttgtactgcagttgaagagtggaagcatgcagccatgcagggggcatcaggtctgtaggccaaaaaggattgacaacacatacatgttattaccgggttccattatttgacaatactgaacggaacaacggcctatgctgatgccagcgttaagcagtgttagcagacacggtaatactgtttagcttcactaaagtgctagcggaggcactggagttaaacagacttggggtacatgtgtgctattcaaccaggaaaagctagctagcaaacaatattgttgcaacaggaaaattaataatgcagttgaaccccatagtacagctaggaggtcagcaatttactcatgcatgacacgcttggcagacaagaactgcaggtgttgagttttttaaagggaggaaaatgtacctcacaactcaccagggcaggagatatcatcatctactatgggctatggttacaaacttacaatcacccaaagtgtcagtaggcagcaactcccctgcaaatcaaaaggttgaacaaaatttgtgcaagccaattattacaaaacaaccaactgtagtaaacaacaatgaattcctcctgctagttaacaatgacgcaagtttaagctaggtaaatcactccatcttatgtagccctttggctctttgcacgtaccttggtgacattaccattagttgcgacgttgcttgggttcgccattttgtttgctcacccaaaagaagtttatttcctggcctgactatccagttttaattacattctaggcagctgcccttctctgttaaactgacatgtaacagtagcttctaacacgaggcaaggttacagctgctactgttctctgggccttcaggtcagcacctacagtgccaatctgaatcaaaagttgatcaactttttatcaagatcgtacaaccatatagacagaaagcaaaaagaatgacatctcaagttagatatagtaatagttgtaaaagaaagcacaagagcactgtacagaacatcaagtcgacacaggatacattccaagaaaatcaacagggaatcaaaacaatatgttcattacaataccaatttgactgatataagatatccttttagactcacagaaacagtaaacaaggtgttctatccaattcttctttggttatgagatatactgcaggcaaagtagtcaacacaagtttgatgactatatacaataataatatcgtgaagtgtatgtttttatatctctctgtaaaggttgagcctgttggtggcaccaagcatcctattaacgacagtcgctccttggcttggagaggtaatatctgacgaatctcctccgatttgcaaggaggagaccgcttgagctgctatgaaacctgggcatgcaactgactggtggaacattccttggtagcacggtgcctgcaactgcaagtccttcacctctccccaagatggcaatggctggccaatcccccaatcaatacacctccctttgggagcataaacatgatcagcgcactgtatcagtccatcaggaggataaatatcagcgccttgtgcatccacggcgaaatcaaaaccagctgagtgatcccaatggttgcatcttctgtgcttgtttagcatcaaatggcagggttcatcggagtcctcaccaatgaggacatgaagagcaactgcttcagctatcgcagcaccttcctcatccagcctttgctgttcttccctcttcttctgcttcttcttttccagctcagatataatggcagcggagtttgcaagcgctttctccagccgccgtctcttcttctcagcctgcttctggcgatctaattcatccttggcttgtttcttcttacctttcttcaagactttgcccgcctgattggccgcggccttttccatgacaactatgtactattttcagctaaactccactagtgactgtaattgtaattacgggaaagcaaaagcttcaaagttcattgtttggagtgatccaggccagaaagcaaagcactggctagcgctaaaaagaaacaggcagtgcaggatgctacacccactcaggtctgaatgagtatcttatcttgcggaagatgcagtcccaaaaggagacgacaggtgagaggaggagggagaaatggtaggcggttgctatttcatccgttggtaagagggttgtgagaggcttgtttgtggtgagctcctgacccatcttagtagcaccagaattgagggaaaaccacagccgaccagctcataagaatcttatactgcatcaggaggaaattaaaagaaaaagatcaatcagcttagtaaaat

SEQ ID NO: 68567 - DNA, 15265 bp, Oryza sativa
attcccccaaaaatgtctccttttgtttccatcactgttatatgttatgagcaacattcaagttacaaacttccattgtttcaacctttgaggtatgcttgaatcaacttatttagtaaaacgtcattctttacagcaccttttgtaaacatgttacaacttgtgccttgggcttttacaggacctatttattttgaaacagcatgtcaatgatctggagcattggtgatcaaagttgagcttggctgctgcagtgggtatggaaactaaaagtcaggagaaagcaaattgagggatttgaggtactgtgcatgcttgttgataaagttggaatattcaacactgcctggatagttaagattgacagtaacagtttattgcattgtgttggtgacttggtggtaaattacctggatatgaatagcacaacagttacagatagtcagaatttgaactattatccccttttgactgctttagaataatgatgctgacgtgaatttgacaaagaaatgttgtgtcaaacctgtatgcgttgcatgaactggagttgtcggatgcaaatggctattagctaatatttttaatttacatatacctagaatgactaaaccgtactatactgctatggtttaattggatgatgtgcaatgcctacagaataaaacaagtatccacttgatggattagttcgctctctaccacacaaaaggagttaggattggagatccatttgcatttattatgtacatctagcaaaataatactatgcacatccagcaaaataatactatgcatttgtctaaacctgttacctacatgttctatctgagctttttattcatgtatgaccacacgctcggtttgaacaaggctggaaaaagtgtttactctatgctaccctaagaattaaggaaacatcattttcattagaattgagttcctatttaaacttttggttgtttttctccagaatggggtggggaagggaggagggatgcataattaatactagcgtattaaacaaacacctgtgtccagataccaaggtactagtcatcactgatgtagtcagctagattcactctgccttgccagatccaggaggcaagcttcttgtccctcgagcatttcatttcattcatgtgtagatgactaagggctgacctaatttgattcctttattgtggatcagcagaagtttatatcaacttggcgtggctgatgcgttcattattcagcggtgctgcaggatggtggacatgtctcccagcacttcagctctctctctcggtaagtgttctggtgcacctggtctctctcatatacccctcttggggatgtgcagtttttatacactactagtacagtaaatcattatcctgaaactggggttgccctggtctttgccacaacatgtattcatatgcttcaaattgctgcaagcattgtgtaatgcaagttgtggctacaaaattgggtgattgactaaacaaagaagtagcaaaccataaatgctgggatctaatgtcgagtcgacggccccggttttggttcatcagaatcacccttacacgacgtgcaattatatactggtacaacaaaatggtggatctatagtttggactgaacattagtcatcttgtccagtattgtattataccttggcaacttactctagattccaaaagaaaaaaacattttcacgttgagaattacattatatatttgtgaattgtgagaatattctagagaagatgagatataccctattggggccgtatgatgggagacgaatagacgattggggtggagttggggcaagactttttttttgagaaccagttggggcaagacttgagagggtgggtatatcttgtccatgttttttgcacatcttttcccacttttcaccttgtttctagggatgtcatatgtatatacgagaaaattgcatcttgcaccaggtctatccgcatattttggatgacaatgtaattagtatttgaaaacaaaaattcgtaaagcaaactcttcggtcagtgtaccaacgtacgtacagtgtataccgttgtcagttaaaaacttcaagataagtgctcgggggtaagccaagaataatccaaaaaacacttcaaacggttttgacttaaaaaaaggttctggtctacaacagctttcttggtcagaaagcgtgccaactggccaccatctatagtacatcgtctcaaatctagaaattgttttctagcatgaaactagttgaatttgccgcaaaaattgtttgaaataaaattgtatctcttctgcaactatatttctatttctaaattatatttatgttatgtatagacgagctgatgtcaaatgtagtcttcgccaacaaatggtttgtcaccgtattttttttgtcacagagtaaggctgtctttagttccttaaaaaagttggaagtttgaaaaaaaaaagttgaaagtttatgtgtgtaggaaagttttaagggtagttggggataaactaaacacggcagtagtcgggtggctaagcggtgcctacctcgcctagcacctctttttagaaacacacacatattatgtagtcaacagtactctcctgtttcaaaaaatgtatgtctagattattttataggatttgagtttttttagacaaagggagtacttcctccgtacctgtaaaggaagtcgttttgtacagcgacacgatctccaaaacacaactttgacttcttgtttctataaaaatatttattgaaaagttatatatgtatacttttatgaaagtatttttcaagataaatctattcatataatttttacattttcaaacttaacaactttagagttattcatgatttatattcctaaggtttggcttaaacattatcctaaacgactttctttacgagtacgaaggaagtatatatcattataatttgcacctacttgttataaacgtaaatattgtgatttgccactcgaatgacggttctagttgcatttttgcaattttctagtggtagttttgcaataacgattcaaagtagtggtaaatttacaattgcccctaatttttagaccttgattggcttctttcaggctgctcaagtgattggattttctctaacagccctttcccatatggagctgattttttgggatagtttggaatatcccattattcaaacatgcccttagtatctcctgttcgtgcaggtagtacatcgtatctgctccgtgagttggtttcgtgcgcatcaattacactgtactccttctatagtacaagaggagattcttttttcagaacaagctcaaattctaatacaagtaggatgatacccaaggtccgatacaaggagggtggcgatactgctgaatctacatgtctattctccacaaagaagccaatcaaggtttggacttaggaatctcctcaactaccatcattaaaaagacaaagtgggcataaagaacacgaaaaactcaagtcatgtatcaggcctatttattttcttttccttcaggacaaaccaagacatgccacatctatgaagagaagaaaagttttaagtaaaaactaaggaagaaaaggcgcatcacgccacacacaaccatatcccgtgggccatcttgcgagaaatggctgcctccggcgttgactcggaggctttggctaccctgctcccctcgccatttcattggccgtttcgtggccatccatcacgaactcgatcgattcccctcttcgagcccgtaccaattattagctagtttaactcgtacgatgaatcacgccgaaacacaatataaatggtggagtcggctcgctgtcaaacgcgcgggagctcgcgccacttgtaatttttcgcgtctcctctcgtccggcacagcacaggagcgcggacttgaagacctcaagtagcgattcgtccgtgcggcgcggcgcaagaagggaagggaaggggactaggggagggcgagatggcggcggcgggggcgtactcggcgagcctaccggcggtgccggactggctgaacaagggggacaacgcgtggcagctgacggcgtcgacgctggtggggatccagtcgatgcccgggctggtggtgctgtacggcagcatcgtgaagaagaagtgggcggtgaactcggcgttcatggcgctctacgcctacgcgtcgtcgctgctggtgtgggtgctggtcggcttccgcatggcgttcggcgaccagctgctgccgttctggggcaaggccggcgtggcgctgacccagagctacctcgtcggccgcgccacgctgccggccaccgcgcacggcgccatcccgcgcaccgagcccttctacccggaggccacgctggtgctcttccagttcgagttcgccgccatcacgctcgtcctcctcgccggctccgtcctcggccgcatgaacatcaaggcctggatggccttcaccccgctctggctcctcctctcctacaccgtcggcgccttcagcctctggggcggcggcttcctctaccgctggggcgtcatcgactactccggcggctacgtcatccacctctcctccggcatcgccggcttcaccgccgcctactgggtacgttcgtctctcgttttttttcctttctttctttctttcctctcctcagttggatcacatgtcattgtcggaatcatgacgtcacccaccccggtttttttgatccggcgacttcactgttccggcgtctcgggtttgtccaacgcgtgttaggtactggtactaccctgtaccatttgtttgacccatcaatctggattcctcatgagaatgcatcacactccatgacaaaattctcaatagaatttagtcgtagtacgtacaatgtctagaccagaaattacttcatgttcaaagtcaccatgggggaaaattagtagaaaataatggaaatcaatgcatcagctggttgtagatttttttttctaccctttgggaagtcacatgatacgtagcatcacattgccgctgataggctgatagctgcacccaataaaagggttaaaacaccttttaccacatggaatgtgtgaacattggaccgcgtccatttgcttcggctggtgggcggcggtgatggctgccgctgcctgccgtgcccggaagacttcgttggcgcgcgctccattttttttccttccttttgttcttgcggttgctgttgtgtttggggtcgcaatcgtgtgtgccactttgcagcagcaagcagatacacgcgagcttattaagaaatggtgtggttccacaccaacaccaggaaattcagtctagcgtcgtggccggaaatttattatctcgatcgttgtcgtcgatagtaactgcacgctaaaatatctggtgatattgcttctcgtgttatccaacttgtgtggctaatggtttgggtcaagaatagagaaaacggcaagttaaaaatgggcttattttctgagtttcttttgtgatcggactatctgaattttgcaaggactgtactagctaggcacgtttggaatgaaaatctttttccgtaataatccgaaaataaactttttctacaaagtcgaatagaatcatcttgcgcgttgaattttgcaaggactgtactagttagtagctttttcatgcacggatggttttttacattaaaaattttgacaccttgagttacctaccaaattttataatttaaaaatgtatgactcctaatatattttcaaagatgctaaaaccaccctttaaccaatcgtccattaagacttctaatgcgtgtggctggcaggtggggccaaggctgaagagcgaccgtgagcggttctcaccgaacaacatcctgctgatgatcgcgggcggcgggctgctgtggatggggtgggccgggttcaacggcggcgcgccgtacgccgccaacatcgcggcgtcggtcgccgtgctcaacaccaacgtctgcgccgccaccagcctcctcatgtggacctgcctcgacgtcatcttcttccgcaagccgtccgtcatcggcgccgtgcagggcatgatgaccggcctcgtctgcatcacccccggcgcaggtaccatcacgaaaaatctccactccttataatttctgaatttatcatgtcccatttagaacacggagattttatatatttgaaatgataaaatattaatagtggtaatgttcgttatttcacatcatccctaatcccctattactgatatttgagccttacaatcaacgagtctatcaacgagtcttcttccattttattattggctctttctaaatttcgaaataacctaattgattgtgaatatgttattaattgacttagtaagctataaaagggagaatagctaatatggtccttaatctttcatattgtacaaacaagccctttaattttgtcatatgtgttatatagtccttggtctcaccaaaatcgtcacatagatatgccatgtcacattcctatgcaaaatctatatgatttgtccaatttaccttacatatatcataggaaaataaaaaacaaaaggtaaaatataagagcaaaaatatacctcaaaagggtgaaaaaaaggataactattttttcctatagttatgtctaattcacccttatatttatttttctacgatatacacgtaagggtaaattggacaattcatcatagattttgcataaatgatgacatggcatatccatataatgattttggtggatccaagaactattctagaccttatgacaaagtttaaggatttctttagaccatttaaaaggttagggactaaactgatcctacagaaaaactttagggactaaagtagctattctcccgctataaaaactcttctttcttttttgcaacgcacggttcctggctagtcttggaatgattctacatttatatccgaggcaaataaaaagaagtttcgtatgtttttaggtccggtttgcaattgttgtcctatgctgcgttgtgcttgtgcttatttttccaaatgtcagcagtaatttgttggttttattcacaattgtgtaagcagggctggtgcagacctgggcggccgtggtaatgggcatcttcgccggcagcgtgccgtggttcaccatgatgatcctgcacaagaagtcagcgctgctgatgaaggtggacgacacgctcgccgtgttccacacccacgccgtggcggggctcctcggcggcatcctcacgggcctcctggccaccccggagctcttctccctcgagtccacggtgccgggactccgcggcgcgttctacggcggcggtatcaagcagatcggcaagcagctcggcggcgccgcgttcgtgatcgcgtggaacctcgtggtcaccacggccatcctcctcggcatcggcctgttcatcccgctgcggatgcccgacgagcagctcatgatcggcgacgacgcggcgcacggcgaggaggcctacgcgctgtggggcgacggcgagaagttcgacgcgacgcggcacgacctgtcgaggggcggcggaggcggcgacagggacggccccgccggcgagcgcctctccgccctaggcgccaggggcgtcaccatccagctctaggcgcgccacgccacgccacgccgcgccgcgccgcggcctggcctctaattacacgcgcgtttgtactgtttttggacgtgttattgtttaggagtagtgaagtgaaccaacgattgactgcaaggtgaagggtgagaacgcgagagaccagaccactatagtctatagtacatatggatgctgtaatgatgttgatccgagttcgtttttccaacacgataaaggccgacatgcctattaaattttccaatctatcaggtcgtgcttgctacgtgcaaccgctctctgatcaactagtacgcgacgtgatccaatgttgcaataacgtagtagatgcatgctgtattcaataacaccaccacccaagtgacttgttttttattggataaaagttcaacaagtttgtgatatggtacaagctctgcaaagaacagtctcacaggggtgtcaaaatgcagagagctcgcgtcctagaagacggccatgagctcggcttctcccagcacatgcccctcgatggcgtccatcagcttgtccttggtcacctgcaagcaatcaagaatcaaccaccgttaaactaatccttaaaacagcacatgtaatcgcaacaagatatggttcgatcggatcaaaacttgccttgttgccgaggtgcacctcgtcgtcgagggcgtagagcttgaactggatgcggtggccgcgggagggagggatggggccgcgccagccgggctgcttccagtcgttgacgccctcctggatgccgccgtactcgcgggcggcggcgccctccttgccggagaagccctcggggaggcccttgacggagggcgggatgttggcgacgacccagtgcgtccacggcacgatggggccgtccgggtccggggcgtcgacgtcgtgcaccaccagcgccagcgaccgcgtcccgtcgggcaccccgtaccactccaccggcggcgagatgtccttcttcgcgccctgcccctccagcgtgtagtgccgcggcagccgcccctcgtgcgccgcgatcgggtgcgacaccagcctcaggctctcctgcgccatcgcggcacaaacaaactctgttcttgcttgacgaacgcttcgtgtgttcgcttcgcgctcgtggcgtctcttggttgatgcgagaatggatgacgatgacgacgagtgccgcggcgtgcgcggcgcgggggtttaataaacggaggaggagcgattcgagcagcgtggcgcggcggacgtacgcgtggcgagggtggtggagggggtacgtggaggtcggcgccggagtcgtgtcgcgttttccagagacgggggaaaaaggcgcgttggggtcggccgcgtgacgaagtttcgagaggcttacaggtttatcctttaaggcccgtttggttggagggatttttacctgtttagaaggatgaggttattacctgttttgtttggttgggagacatgaaaattttgatgggatggagatggggaattgaggaaggaactctttccttttcaataccttggtaggggtggtaatttggagggaattcctcatttactttacctaaacaaatctcagctaaccgttttcattaatgacctaatctctaactaaactctatgtcaatttccaccacctctgccaaacaagatattgggaataaaaatcaaattcccatcttaatctcaccatcaatttcctcatgtaagctcccaatccccttcacttaagttgccaaacaaaccgtaagcacttgttaatcggcgcagtgtttttctcttctctgtccgtctaggtgtctcccgctcccccgcgcgcgttttagcgcggaggaaagagagagagagtttggatttctcgtaggaactgggcctgaattattatccatacaaggcctgagcccgttccgattatattatagatgggtttaggccgtgacaaaattccttcagctggaaaaaggccgtgaggaaggcctgtcactgtaaggaagtccgttcggattgccttaaggagtaagtccacttggagcccctcaaatatccggtgcaatatagctccctcgaagatatcggtatcacgtacggatgagggatacgaattagatttgacctatatttaagggagttaaaatggacttattccttttccttatgccgattatatacgggcccaatcatcaatacttctaaagctagatggggacccagccagctgattggtccacttgtcccataagtttttcgacacgtgtcgcttctagactctcaaatcgatcgcttcagtaggcaccggctgggccgtggatccgcgcatacttgtgagctaggccacgccggcctaaccagctcctgggctgaaaaaaaatataaacaaacaagagagctgcccctgctcctaaaaaaaagtgagagaaaataaaatatgaaaaacatatccaaggaggatgtaatgataaattacatcagtttactgctaattaatactaccatgaactagcctatactgtgagcttgggtatttcttaatcctctaaaaacgttacattcaatagtaacttaagaaactgcacatgttttaaagtagcgagcgtgccgattctggatatacaggaacaatatggttctctgcccatttcaaaataatttatgttgaattactatgaaaattttgtattacaaattgatcattcaatgaaaaaagtggtagctgaaagtcatttccccagaaaataataatgaatctaattcaattcaatttttctaagctgaattgagtttttcaatttttctaagccacacactacagtactgactatccacgatttaacccgtgataaatactaagttgttttttcctttgacgaccaatatctaccaacttctattctaataccattttcattgatttattcaatatttaactatctagctagcacaagttcataaacgcaacaactattttagtcaccagcttttacgaatccagaagaacgaaactataataaatcaattctactatgaaacaagcaggttataaaatagtaggcgtgcctatcggcacgctaattttctagtttagtttaaattcacaacttggatatcaggtcattaatggatttgggtcgtgattttagtcttaatttcagcctacaaatacggatgggtgaaaatttcggacactaactgaaccaagttgggctcggcctggttaagactacgcactaaaggaggtcttttttctcgtcgcgtcctttacgtggaaatccaggccagttggccattccttgactcgtaccgaactaccgatgagaatttttttactctatgagaaactgaacaaaaagctactaaattggcttattttttacgtataccaatgagaattttgagtaccatttgcatttttttaaatgaattgaatgaagaagaactaaaagaagaaaagttttctcaacacgaggagagatcccttcaaaattgcattattgtaaagggattttaagtatttatctagggctaagctctgggcctctagctaggttgcattccggctaattggcgcctctacttctctgcactacactgtaacactatctgcacgccacaggatcaaacggtgattctatcatgagctaattagtagattaactgtactcccttataacttaagacgagaaatgatacattctaacactatgaatctgaacatacacatatatttgtagtattataatatatcacatctctctctgtttttttttgagtagatcgctgcttgcatccatccatgcatatatcattcgatggtcacttcagctttgacaacagtgccactctatattcagaacaccgctaaacgatgcagtcatgcaacagggcagggcctcgctgctttcggcggttcggcccccgccgcaatacatttccttgagctgataacagcgacggatcaatgaaccgtacatgcgagccatcatccacctgaccggaccaccagtcctccaccacaaacctcctcccttcctcgaggctcgatcgatgaaccgcacgcgatccgtcgtcagatcgatgcaacaccatcgtgcaacagtggtcacaggaaactgatcagctcgctttagcatcagactcgcactcgcccagccacaattagcccaagtaggctacctctttttcgcgagatgttatagtacatttaccgtgcatgcatctgctcatcgtttctgctggacagctgaatgtgggcacagggcaccgcacgtcgatcttgcgtctactctccatcatcagctgcgagaaaatcgatcgatccaaagcaagctagataggagtagcaattatatgatccatcgtccatccaatcgcatgacagcgtactccgttttctaacttgcactgcgtgaaaaaagttgtcacttcactgatatgatcatgctttggctaagtagccaacaactactggcaagtacgagaacagcgagtagaatgtagccatgacggaaaccgtacgatggggatgagtgggatcaggggactcatagtgcgatgctggtgaagaagatatggcgcttttgcagtttttgtccggttggatcgcctactttttccgcccacagcttagctagttcgcactttgccatatgcaacctgggcagggcaacgccatatgcgccttttacccgagcaccgtgcctaatctaagcttaagctcagcccaatcgtaatgtgcactaggtgcaacaaggcaacaacaactgcactgcactagacgtaagcccaagaaaggaagaaagctaggaattggtgatagaacgcacggaaagtagcctggacagccttcgtctccttcctccaggatatttttcagaaatgatgatagataatggaagtgatcagacacatggctttctggctttaattcagtcattgccccttttttggagctgctagctaagctagctagctatctgtttctctgctttaatttgtgtgtagcggtcattgttaggcatgcaataatctattagcaaaaggagcatgatagtagattagattgggaattaaagggtggtgtgtgtgatatatatgtatgcagctagtgatatgtgtgatcgaccactcaaagcccggccggggtccatggtgtgcagcgagcttttcgatcgggccacagccttatctcgatcaatcgagctcaaagcgatctgtgatttgtgaccgctaccgttgctgcctttgatctcgcgcgccgcgcgcgcgcggtcgagccgagagatcagggtggatttcacgtaacgtcgcacgccatgtgtcttgttggcttcctgtctcggtggctagaggcgtagtgcacatcagaacagaggcgccaaactgaacagttactactattggtattttctccttttctttatctttcgagatagagaaaaaaacaagtgctggtattctttttagcggtctagatattttgttttcatgttttctgtttgatttacattattcagtttactatcgtagattttctacttgaatataggaacaattcaattaggtatttttaaaaaaaaaataaaaacaagtggtctgaacaaacaaaagaagaaagtttttttttgagaaaacatattttttttgaagagcagaataaataatccattttaatgattcggtaaataatatgaaaagattacttaggttattgctgcatgagcattgcttcaagttatttcaagtgttaactactgaaaattgcttgaaacaagacggtatgaaggcgaaaaaggccgcactacttttgtcttgctcgattttattatcatccggttcaacttccggttgtaaataaaatggtcatgttaactcatgtgtctacttgtaccagcagctgttaggcgcatagcatgaagacatgtacactccaatcatacaaacctgcgtggaaagtcgtctaccggatgcaataatatatggagcagtacacaccaacttatgtacacaaacaatttgaatatttacatgacttttgtggctcaaaaccaacgccctccattgcgacttgcgagtcaataatattcccacaagccagcaaacgtgccagcgacatcgctcggtcaacagctagcgaccaaatctttccaagtcgacgcgaaaacgagcgcgcggagccagtcggccgagcccgaaaacgaccggatcgctccgaagcttagccagccggccgagccggatgcatccgttcgagcggctgtcttcgttgctgcccctttcccggaaaacggagcggttcactagtacttaaaaaaaacatatcgtttactccctctgggttgataatacttatcgttttggataagggcacggtctctaaaaaataattttgaccattattttttattataacatgtataaaagtgttaacaaatatatgattttattaaagtactttttaagactaatctatacatgttattatcatgtttgaaagataaatattttaaaaataattcataatcaaagattctaaaatttgacttcactcttgtctaaaacgacaagtattattagcccggagaaaatagtagtttgaaaagcgtgagcgcgaaaaacgagagcggggagttggtaaccaggggaaatgaactaggatggactcctccgttttcatattgtaggtctttttaacttgtttttttaaacatttttagttcgagtaagattatgaaaaaaattagtaacatcagttttattaaaaatatattttcataatatgtctatttatactagaaatattgatatatttttccataattttagaaaaaaaattaaaaatgtttaactaggaaaaaaatgacttataatacaaaacagaggggtatttgagaagacggggaaatgagaaaatttaaaagatgtgagaaatgaggtgtgccattggtgtatgattaattaaatattaactattttaaatttaaaacaaaaattaatataattttaaaaacaacttttctgtatgtttctttttcttttcttttttttttgaaaaaacgaaccttttagcgtttaggtgttcgactgcgcgcgcggcagccacgcctttaccaaccttaaaagggacggccctgccgccttgaatttgttaaaacccacacgacacccatcgcgtttcgcactccggtacaccacggtgctcgcgctcgcgtcgctcgccacaccacacgccaccaccgcgcgggcacgcgcgccacttgcgcgcagacgcgccgaagcttcttcgtctcgatcgcgccgcgcgcgatcgagcgcgacgtacggctagctgccgccaccaccaccaccacacgccggccggaggactggtcaatctcccatgtgcctccaccgcatatagcgtggagagctagctagctctactactgtggctgtggcctgtgggagcagggagcaatggccgcgcaggagagcgccgcggggacgacgaaccaggtgatgcggtggcggtacggggacgtcgacgacagcaacttcgcggtgcacggccgcgccgtgtacctgctggtcgggctgctcgtcgccgtcgtggtgttcgtcgccctctgcctctacctccg

SEQ ID NO: 68568 - DNA, 2780 bp, Oryza sativa
ttctagtttctgcaattggcccccttttctatgaacaatttatcaaacctatctaacaagctcaaagaaacagcacaaaacagcagaatagcttgttctctaaagaaacagcagaatggcatttattcactcgtgagcattaaatactgtgctagtacttgtttttgttttaaggtccaaatgactgcctttttaaagtaaaaacagtcaggagctaaatgtaagcatttgctgccaatatatctgctaaaaattatatctgcacaaacaggaatatgggggcatcaaggggcccaggtaaaaagaactctgcctttctcgattgtgccttgacagttgcagttataggcaagtagctaagctattcgtataggtaagaaagccacagcacgtttaccattttggaataggcaggtagttaatatgttcgtttagagaagaaagcctcagagtcatgttttcatatttgctgttacacaattacagtaactcagtaacataccttctgccttgtgatatcccaaaatggacctaaagcaggatgaagaaatataagaaaaggtggtccagaacgcaagtattcacagttgtctttgacctgaaaataggaaagaataaatttaaataagccattagaaaggtagcccacgcacaatataagtggtcagtgctcactaagtttgtcttttgaccagacaactgaaaaaatcataggaagttggaatccaattggcatctaatatttttcatatacagattttatgttccagcagaacatgtcaccaggaacttttactccctagcacatactccctccatcccaaaatataagcatttttagcatagtgacaagtcaaacatttttaactttgaccattaataacaaaaaaataaaaaagatcaatcatataaaattaatgttattagatatatcattaaacaaactatcataatataaactctttttatttaaaacatcttacttctatagatattgttagtcaaagtaacatcttggagaccgtgtcagtgtcctaaaatgcttatattttcggacgaagggagtaagtgactaagttgcaatgttgccattaattgactaaacatcaatatggccccacctcaagatgaggcaatggtccaggaatccaggtatttgaaactacatagtatttttttttaatcttttcattattctatctaacagcagaagtaaatcagataaccatatctatcaaacaaatttgagtctgttgatttgttctcatgtgaatgtaatattgtttcggtttaatgaaatcaatacgaaatagaaagttgatacttccaaatatagatattcatgttaccttactggatgacattttaatgaaccaagttttaaagtttcaaaatatcaactaaaatactattgctaggtagaactacaaccagcgttaaccaaccataacaccataggttctgtgttactgaagtaggctagcattacatggaatgtcgattcatgtcacatgtaaaaaaataaaattaagaaaaaaaaacaaaagtaaatctaccttgggaacctttacattgcagctagaaaggagatcataagcattacgcataatgtcaaggagtgaaccctctggagtctgtaaagcaagcaaagtgtatacttgtgacatgcaagtttgagaaactttcagttgctcaagttattatggcaagttttagaagaaatagcgaattgcacaaccaagtgcatgccagaaagatctagaatcaatgtcatcatgctatgcacacttttgagtcccaaaataaattaatgaatcaacagttttatgttcaaaacgggctcaattacagggtagaaaagaaatattattataacaataataaaaggcatgatatagagttctagacaggcaaacattcatgcaagcaccagcatataactttgaacgcttggcactttggcagtacatattgctaagtgctgatccaccaaatgaaattctcagtaactgtcatgacaataatcagatttcacaatcaatataaacaagcaattttgtcatttctgattcacttatttggatctgcagtgtggtcaaccagacatcaggcaaattgtgaaaatataccaacttggggatttttggtggtggtggggtgtgtgtggtggtggtggggaggttacagaagtatactaccaggcttcgcccagtagttgattttataaattaagaaaacatgagaatccaataattggattgagaagcatggtatactaacctggtgcaatgacttatcttctgatttcagcttccttttagctgacgaagtgacttttttcctttcgttgtacacaatgaatgtgtctagctcacctgtgacatgagattgctaaacatcaagtatcccaacaaacaaaggggaaagggtagtttgatggatacacgatgaatatcacatatgaaaacaatgacatactttctattcctttactgcacctgtagttatatgtgttcataaaattatcgctatgttttgcatcgtgcattctaacctgcctccagcagcactgtaagagaggaaaagttaatcattaaagaagagagatactataatactatcgtagtaaattgaataaactaaacaagacttggtaatatctttaatgtgcctccaatgcccaccttacacaagaaatggagtaatcaatactacgcaaaatgagagaaatatattctacatcattgaacccatcgctcagaagcatatctacactgaaa

SEQ ID NO: 68569 - DNA, 5653 bp, Oryza sativa
gggactaaagatctcctctctttagtcccggttgataacaccaaccgggactaaagatctttagtcccgggtatttgaaccgggactaaagatagcgatctttagttccgaattggtagtaccgatttgaaaatcgggactaaaaagcacttctccaccagtgcaatttttttcccaaaaacattatatcgaatctttggacatatgcatgaagtattaaatatagatttagaaaaacttaattgcatagttagggaagaaatcgcgagacgaatcttgagtctaattagtctatgattagccataagtgctacagtaacccacatgtgctaatgatggattaattaggcttaaaagattcgtttcacggtttctagacgagttatgaaattagttttttcatttatgtctaaaaacccgttttgatctccgatcaaacattcgatgcgacatcaaaaattttgttttcgcaaactaaatagtcccgcgaaggattacggccggagtgatctcatggctactagtaattgactacccgtctacccgcccgctctctgcacaaatcaccgcacgtttttgctgcggcgccacctggtacgttttcaatccgtggccccccgttgccattcagcgcgcgacacgcccccatctccgtgcgaaaaggcggaccggccccacgccaccgcttgcaaaactggccggcagtggcacacccaagttttgactcctcgacgtacgtcggcgcaacatctgttggactccaaccaccttttttgcgccgcgagatggcgagagaggcgcagcctcgaacgaagattctaacgaagattctcgcggaggcggggattctgtgttctcgatacggagtccacggaattcggttcccttttgctgcttggtttggtccctgattcctttcgccggcaggatgtccaatgcgcgcgggttgcttcctgcagatcccattgccacccgcacgcactgttcaccactcatacacatgtgatttggacgcatacccatggaacgaccaatatgtggttaactaatgctagaaccaaatctaacagtagcataattcaaatcacgtacgattgctcgctgttttgaaaggtatttggggtgttttaaactttgtaattgacgaatctgtgggtcgcaactaggcttgcggagtgctttttattttcctcataaaggcaggcatgcgcacctgatagccaacagcgagaggaatactgtatgagatcgtttggctcctttcccttttgctactacttgcatatcaaattattaagcactactccattcatctaccagagttacccatattacttttgtcatcaagactaaggagaaattaaatcatcttagatagtacaaaatcaaggagtgaatgtaaacatacaaccgataagtatttagatgactcattaggttctcatcaaatatttaatttatttcttcatttaagtcttaaatgcataaaaactacaaataaaaacaacttgtttggaaaaatttaaatgtgaaatatgtctaatttttatggatagagcgagtacgaatcttgcatcaaagcctcaagaatatcccgttatactagtaagagcgaatcaaccaaccaaccaaacccttggacagttggactgtttgtttaacattgtgcggggagcgagcgacgacagcgacgtccttctcactttctcacactgcaccgtacgtcaatttaaatttagtactgccgcgactaatcactgaggtaaacccggggacgcaaataatcaatctgcgttacggcgtatgtaataccgaatgggaaactgaagccttgtttggatccaaaaaattttgataaaaacgtaacatcaaatgtgtttgacacatgcaagaggcactaaatgtgaaaaaaaaatccaattacacagtttacatgtaaattgtgagacgaatcttttgagcctaattacgccatgatttaacaatgtgatgctacaataaacatttactaataacgaattaattaggcttaataaaatcgtctcgtaatttataagtggaatctgtaatttattttgttattagtctatatttaatacttcaaatacgtgtccgtatacttaaaaactttacaataaaaaagtaaacacaccctcagaattcagggtagtacgacgcactggtgcactccgcagtcaagcatgcgaataacgttgcaaaggtatagcaaaaagcacttatgtgcaagcaagcgcgagtaaaacatggtgcctcaaagacggtggaaaaacggtcggcaagcacgtacgagagccgagagcggtcacgggtggacggcagtacagcacggtgcacatcgctgttacacggagagaacccaaggcggcagagcaacggccgcctggataaacaggctaggcaggctagccacgggccgcgcgcgcagtattacgcagtaacgcagtaaacccaggagcttcatcggcacacgttactgcgtaatactacagtaatacagtatgatgagaaactgacaattcactaattcagggtagtactacgcactagtgccctacgccgtcaagcatgcgattaaccgttgcaaaggtcgtggacggcagtacgtacgcaacgcggtgcacatcgctgctaaacggagagcgcccgaggcggtggagcaacgggcgggccgcgccggcagagatctgacctaagggggagcgcggacgagcagagcttagagcaagtataatagttagttataagcttactataaatttagaaggaggaaagaggtagtgaaaaaaaaagaatgttggctctcatacaagagctagcttatcacaagctccaatataaatgcattaaatgtgtaagtgagagataaagagaaaaagaaaattgtagctaaccttacagctaatttattatatatattggctttaagatggtctaatagtaggaagtgagctctattattatccttgctcgagcaagtttaatagtgcagcccgttgccggctctaatttcacacacatcatctgcatgtgatataagagccaataaatacaataagcgttggcccatctgctataaaacaaatttactttattatatgtagggcccactatttcagccttttactctcagcaagcctgtgttacccacgtgcatgtaggtttggagtttatgccaagcctgcgataaaactagcgcccgttttacactctctctacttttccatcttccacgtatgatatagccagcgtatgggtaactattgtacctgctcttacctagctaggcgttacagcgtagccggcgacggcgcccgcgtccaggtgcactgcgcgcagttgcacatgcgcgggcgggtgggcgcgcggcggtgcccggtgcacgaggtggcgaaaaccaggggagccgagacgagccagggggcggggatccaaccgcgcaacaagtccgggcccggcttgtcggctggactgaatgaccgatcacactgtgtgggaaaacataggcttaattcactatcagcaattcagcagatggattattgaattactagcacgataatgaattggagcgtatacgcgtcgtgtagcggtgtagggtgttcgagttgattgttaaattaaaaaaaaaacggcgcctttttcccagttgatcaagaacgcctattctctactcggatacaaaatgaaatctttacgtagagtagcataatactcctccaaaaaggtatatgcatacgtatataccagactaagagtcatgaggtctagttagaacttagaggcgtgttgatcaaatgtggcactaataaaatgctaaattaacttcacatcgacaacaagggtttaatttcgcattgcttatttagattgagagtagtatgtccacatcgcatatcttcttagtacgatttgttaatgaaaagatggacgatgattcgatgaatgcattctagactggaggttccagttccagaccggttgacggtatacaccaatgcatgacgcacaaggtttggccagccaaaccacggcgaatggagcacgcgaaacaagtcagccgattcccagtttgccacccatctcaccagactacaattctgcaagcagcaacggcgccaaagacggttttttctccttcctctatataagccccacaatgcccaccaccagcttgtcacaactcacagccaaaacctcgtacattttcagctagccacaagcaacacaagtccaagacaagtcaagcgttcgcaccaagtcaaaccgcgcctcactgccaccttcgtttgcgcaccatggagcttgccctggttggcaacccttcgaatggcgtggcgaagccgtcgtgcaactccgtcggctcgctgcccgtcgtcagctccaacgccgtcatcaacccgccggtgaccagcgcggcgggcgccacgctcggcaggcacctcgcgaggcgcctcgtgcagatcggcgccaccgacgtgttcgccgtccccggggacttcaacctcaccctgctcgactacctcatcgccgagcccgggctcaagctcatcggctgctgcaatgagctcaacgccgggtacgcggccgacggctacgcccgcgcccgcggcgtcggcgcctgcgccgtcacgttcaccgtcggtggcctcagcgtgctcaacgctatcgccggcgcctacagcgagaacctccccgtgatctgcatcgtcggcgggcccaactccaacgactacggcaccaaccgcatcctgcaccacaccatcggcctcccggacttctcacaggagctccgctgcttccagaccatcacctgctaccaggtccgcgcaatgagccctgcctctcgtctttcttttgcactggatgtctggatgaatttcgtcgaacacctgagctgaacagagtgcgttgcacgcatgcaggccgtcattaacaacctcgacgacgcgcacgagcagatcgacaccgccatcgcgacggcgctaagggagagcaagcccgtctacatcagcgtgggctgcaacctggcaggcctctcccacccaacgttcagtcgcgagccagtgccactattcatctcgccaaggtagtgaactaaacatacatgatacatgcacgcatctcgggttaaaatcttcttttctccatagtttctcaattttgacatatgtcctatcaggctgagcaacaaggcgaacttggagtacgccgtcgaagccgcggcggacttcctgaacaaggcggtgaagccggtgatggtcggtgggccaaagatccgggtggccaaggcgaagaaggcgttcgccggcatcgcggagtcgagcgggtacccgttcgcggtgatgccgtccgcaaagggcctcgtgccggagcaccacccgcggttcatcggcacgtactggggcgccgtgagcaccaccttctgcgccgagatcgtcgagtccgccgacgcctacctcttcgccggcccaatcttcaacgactacagctccgtcggctactccctgctgctgaagcgggagaaggccgtcatcgtgcagcctgaccgcgtggtggtcggcaacggcccggcgttcggctgcatcctcatgacggagttcctcgacgcgctcgccaagcgcctcgaccgcaa

SEQ ID NO: 68570 - DNA, 11041 bp, Oryza sativa
acggctccaccccgggcttgatcccccctcatggggagccacgtgggttgggaggctgcccgaccccaagctgggatggggcagccgccgcaataccccgggctcgaccccccccggggagagccacgtgggtttgagggcggcctcctccctctagctgggaggggatagccaccgctccaccccgggcttgatcccccctcgcggggagccacgtgggtttgagggcggcctcctccctctagacgtgatacccccgggcccatatcaccgacagatataattttggatacaaataagaacattttattgctaaccatacatctgtcgatatttttttcttttaaaaatttattaaatgtaaatacatgtagttaccaaagtgtagttacgttataacttgtatataactacaatataatttgtttacataatgataaaatgtgacctttaattcagcagaagctacaatatcttattacatagttctctattgagaactaagtataatggtgtctaagaagggaatatgtcctatatacacaagcttcccgtgcccattaactagcaaatgtcatgaaaaaaactacaaaaaaatagacatttactcataatagtattacacatatatacaaagtctcatattcaaattcaatatattttatctgtaacaaaaaaaagttaaaaatctgacattttaaaggtaaaactctgtcagaattttttcttttttgttacggctaaatataatacatttgaatgtaagatctcacacgtaggtgtaatactattggaagtatgtgtccaattttctctagaattttctgtgatatttgctaattggtgtgcacgagagcttgtgcgcataggatatattcccatctaataaaggatggagggatgacacttttcatgtggttttgagtctttagttttgcttcggtattcatgcgtatggatggggggattctatcctatgtcctcggctcgcggaagtagtgtattaccgcggcgtttctgaaagttactccctccgttcaaaatataaacaattataggattatcagaaattatacataatataaaatataagtgtttttctaggcattgattctagcaaatgtaaatatatacattttccgtcaatgaaaagcttgggaaggaaacgtaagcaattcaaaattcaaaagttggccactgaacagaactagaagagaatatttttcatctaccttatttttcttaaaaacttagaaaagcttatattttgtaatagaggagaaaatatgatttatattgtatagttaaatgcaagttactctgtacaatgtaattacattataattatatttatttgacaaatgtttagatagtcgatctgtttgggtcacaagtgtaggaactaatggtctgaatgcgggcctctttcaatcggaaaagagaataattacactatactatgtgtttttagtttctttgagtttaattggccctatgctgatttattcgtgtaaaggtacatcttataggttgggctgaaacaattcttcctagtcaacttagcccgagcttgaaaccttgaattctagtagtagaccaaaggccgatcttctaagagaccgacgcaactggtctgcatcatttagcccattatggcctgctacctcgcatttctaacaaaggaataagttcaccggaggtccctcaacttaacaacgagatttttttaagatcccttaaccataaaaccagaaatatgtaccctaacctcacacaatccgtgcactcaaagctctatagcagtatatatgggtggtttcgctgacgtggcatcctagtcagcaaaaaaaaaatttaaaaaaagtggggcccacatgtcagttgcacatctcttttttttcttctcttttcttctccttctcttctcttctcttctcttctccagtgaggaaggccgacggtgggcagagcggtgatgagcgagcgcgaatgtggccagcgggcctaggaggctacgggcggagcggcagctctgcggctgcggcggtcactacaagataattgagctatcgccaccaatttattacaacgaaaaataattcatggcaatatattgtactatcgcaatgatattttttttcgtggcaaataactacattttgttgcaacgatttacaattgttgttttattcaatatttttgttgcaataggaaatgagctatcgccaaaaaaaacattactattgcaaaaaaaacatgttctatcaccacacatttaatttttattgcaatttgcatagtacatggtacttttcactattttctattaccatgatcaacaaattcattgcaataaaaaaattatcatctcataatttaacttattcttttcatatgaacacgaattaggacaaaatttatatgaaatttataactctcgatgagatctacaacttaaatttttcatttgaaatcttttaaatactcaaattcatgattcaaatctcagttaggcagtctcaaatggaattatatgcatttttaaataaaattgatacgtaggtgagttggtcatggagagcgcgcgtgagggagagatcttgggttcgaatcccggccatgacaagatatcaaaagaaaatagttaggttgataaattaatactgaaacatttaatttggtacgtagaactaatgccacacatggagtggtggcaatagttatttattgcaacgatgttaagtgttacaatatatattttttgccacatccattttatggcaatatcaaattttattacaactaaataaaaatcgttgcaataacttattaccacgctatttattaccacggctagcaacgatttaaagattgtggcaacgattttagcattggtgctacgctatttctattgccataattttagtattgatgttacgatttttttcgtgacgataaattatttttctagtagtgggtggcggcgaccggctgagcgcgctgagtgacggcgtgatcggccacatcttgtcgttcctcccggcgaatgaggcggcgcgcgcggcggtgttctcgccgcggtggcaccacacgttcaccgccgtccacaccgtctacctcgtggagcccgacgcccccgttgtcgaccacgacgagcttgccaagtacagcccagggtggggccctccgtccgaccccaacccgccaccgccgctgttcaccagcgccatcagcgccggcctcctcgcccgccaccgccgcctcgccgccgtctccttacgcgcgctccgcatctccatggtcggactccgacgacgacaagaagtatcccatggccgtttacaggcggcagttcgagccacagaagtacagcgtgctgagggggctattcacctgcgcggtgctgcgctcactgtcgctcgggtccgtccggctcactctgcccgcggccatcgccctcgcggtcctcgagacgctgctcctggccgacgtcaccgaccacgagaggaacatgcagcgcctcatctccggctgcccgcgcctcgccgacctgacgctcgaggcctgctatgagatggccccgctctccgtggcagggctggctctccggtgctgccatggcctagacaccgtcgtcctcgacgacatgtcgtcgccgtcggagctactacaagccttcgagctacaagccacggctctccggtaactcatacaaaccatgcggtccatgcaaccgacgctctggccgagggtgaagccggtgatgccctcgtcgtcctcgttgcggtagcccgagcggtagcttcggtcgttggctgtctagttggtccaccacgtttgttggtgacgagcgcggtggagcagccggtgcggaagtagcagttgaggaggtgcttgctctggtccttgccgttgtaccagccgacgatgacgatttcgacgctgacgacaacggcgtaggagagagaaaattgaagaaaaaaaatgtgcagctgtcatgtgggccccacttacttttttctctgactaggatgccacgtcagcgaaaccacccatatatactgccatagaaccttgagtatacggtttgtataagtttaggcgtatgcatttatggttttgtgattaagggacctcaaaaaatatcactgttaagttaagggactttcggtgaacttattcctctaaccaatgcagaaaccacggcccacaaccgccactgtcaactggtcatcctgcaattccccctggccccatatgttgttgcaatccatttactatatactccctccattcctaaatatttaacaccgttgatttttttaaacatgtttgaccgttcgtcttattcaaaaaatttaagtaattattaattcttttcctatcatttgattcattgttaaatatacttttatgtatacatatagttttatatatttcacaaaattttttgaataagacgaatggtcaaatatgtttaaaaaagtcaatggtgtcaaatatttagtgacggagggagtaccaaaaacagtagatttttttaataatgaaaagaaatatatctcccatcctatgtaactagaacacaattgataaattctaaagtacaattgataaattctgactgaaataaaggatatgaggttatggggtaaaccttcatatccttctaaatgataacaagctaaactgatggaaagaattcacaaattttctataatgaaattccatagggaactacgcaacccaaaatggaataaatgatctttggctatcaactacaagattagagcaatattgtgaatagtatcatgcttctcttgtgataccattatagatcaagattgggaagatgcttcttctcggacgtccggacccaaggagaaaaatgagacgggctgcctctgacatacatatgcagctacccaagcctatattaatatctccaatatgacacgcatgcacctttaacgatatttaaaacgatttttttcataaattacttattcaatctacaatccgatcataccattatattcgttataattaaatctttacaacaagatatcgcatgattatattctgaaaaaagataatcatatgtttcaatccattatcactttttgtttcatacgtgatagggatatgtttcaatatgtgtctttagcgtgtttcacaaaattcgcaaaacaaccgatcactattctccctctccacctcatacatgcacatgcatgcatgtatgcattttagcgagtttcaaaacgatttttcttctaaactaattacccaatctacgatccgataacactgttgtattcgtcgtagttaatctttacaagatatcgcatgattatatttggatgaaagaaaaacatatggttcaatccattaacactagttgtttcacatgtgatagcgatatttccaacgtgtatctttatcatgtttcataaaatttttaaatgttttagctactgatttttttttcaccatgtataacttgatgtttcacgcgttgatcaactgaaacatttgactgactgaatttttttgggcatcgggcgtccgatgggaagtttcgcaatgcccgtgatcgagcgtctgatgcacaatgtttcaatcagaatttgactatgttgcacattttaaattttatgttgccatggatcttttaaaaatgttgcacatggcattattttgatgttccaataaatattttttttgatgtttcactagcttatttacgaatgttgcacgtggtattattggatgtttcagtaagtattttctaatgtttcactaattcatttataaatgttgcacatgttgtttgggatgttttgatgaatattttctaatgtttcaatacttataagttgttgtttcacgtacaatataaagatgtttcaattagtaatataattatatttataaattttatcataaatataatcaaatgagatattattgtaaagatttaattgtaacgaacataatggtgaaattggatggtaaaacggataagtaatttagaaggaaaaatagtttaaattttattggtagagaagaaggagagagaaattgcatgtaaatatgcaggagggtagcttataggcttgcagattccctgtgatagttttgtttgcacggactgcattcgattttctgctaaatatcggacgtctgatctgtagcagcctcttcaagattggagctggtaagacatgaaaaaaatctgtattggaaatactaaatctgactaacagaaaacactcgctccaacacaaagtcatttctaatcatttttttatggaaacaactatagatgcaacttgtatttgaagtgtttatctagatggtttttttcatattaatctacacttttattagatataaattgactaaactttgaacaaattttagtcacctgaatctaaggtatcatcttcaacctctgaatagagagggaagctaggcagaaaagaggcggtgggtagtagctcatcacgacaacaactatgcaaatcacattcttctaactagcattggtggctctttgtctttttcggcattgtgatgacaactatcaatttctggaaccgaagttagaacggaggtgagtaggggccaatgaggatggaaatagatggaaggctgagatagtagtggaccaatggcagatggacaagcgcttgattagttatgtactaactattatatacttaaaacaaaatattgtttgattttttaaatggaaaatctatacataaagcttttatacgaaacacacattgtttagtacctcaaaaatgtgccaaaaaaacctaaccgagggaaccgttaagctaaacagttaaatcaaatgagacattcgattattgagtggattatcaatttaattataggaataagttaataattttaaaaaataaatttaacaaataacttaaaataagtgatataaagtctaaaaaataaagttcaagaattttagaaaatgtatttttcaaagtgtaaagcaaatgagttgaagaaacaagagggcctttggcccagccggcatgcttgagtttggacctttgcctacttgttctttggacttgctgctcgtttgcttctaaccatgactacactatgggcctatttgtggaagttttagattctgataagcagctgtttggtagccagcttctgagaatctggaaaagctctgaaacccagcttttccagcttctgacttcttagttcatttttcagaatctgtaactacagattctcagaaactgtggactatttggggcagcttctagtagaagcagtttttgggaaaagttgcagctgggacaagctcccccaaacagggcctacatatacatttagcctgcatcaaacggatcatagtgcgccaatttgtggtttttgctacaaaacaactaaaaaaacgtgatagggctgttgagcaccataaaaaaaggataattagctataggatgcaaacattattttattattccctctctaaatggagagaaacatttaaggaaaagaattttgcagccgttgtgcacgccgtcggcatcaccaccaaattctagggctttgaagagggaatcggagaagagagagtggcttgggtttcgttcaaattaaacaagacccagtcaggatacaagcatatgaccccacaagggtaaaattttcttttccatgtggttctcgctatatttggattaaaaataatataataatggcgaccagttttttcagtgtctaacagtcgtatcatgtttttcatgggtgtcatataacaaattttaccaattaaatttcatcatttatggatgcacccattcttaggtctagcttccgctggtaaaaacaatattttaatagcaaaatttctaagtatatttaacagaactttccatctcttttaggttggagtccaaccaaacgattttagataaaaaaaaaaagtgagcgaagcaagctgaactaatctaaacaataaattagaggagtggagtggggtttgtaattctatagctatacagctttatttcagactacactttaaaagttagatttattaattgaagccctgaaactcaaaattgtgacgttgcgagcaagtttgagatacttgagcgtattgctctattttaaaggttatccttcatgcaatcatgctacccctcttatcggcagaaagcgaccggaaaacgatggacaaagggcttttctttgacggcacttgaccataaaaatacataatactttcaaaggaataccttgtgtgtgtagcttactccaggacaacctaattaatctaggagccggacgaatattaatggtcggcatgacgatattatcgagctgcaaaatagaaacaacagtaatttgtcacattgttggaaaaagcatcaactgaagttctgattggctagatcagtaagatatgaatattaaagtgcacagtcggtattcaaacttgtccgtcggtgctatgtactctgaaaatatataagaatttattaaagtgtgttattctgatttatgttgctatgacccctataggatcatttgtagcttaatgtggcatgccacatgaacaatgagatggcatcatcaccaactctataatgactaccttgaaaacaaaatttctttcctccacttccttttcttcttccatctcttttttcttccttttatcttttaagtggtgatgctacatcaacatctatgtaatatgccacgtagaatccaaaaaggtttgtagatttgtgataatttaggatcattataccatattttgatagtatgagaacttagatgacatatatgaacaagttcaataactaccatacattttactttgaataatacttatacatttgagttgtcacggtataacataaataccatgatatattattgtaaaggacttccctcatctacaaatataagtattccaaatgttcaaaatttatctatctctattattataaaaaattgaagatgtttttaccggtattttggtacgtcatccatgtataagtcggttattaagttcgtttgcttttggaaatacatattcgtatttgagtcggtttttaagatcgttcacttttggtaatacagaaggaatcatataagaaatatgtttaaaaaaactcacatgctaacttgagacgatcggactcctaactgcatctcatggttttctatctctactattataaaaattgaagatgtttttactggtattttggtacgtcatccgtgtataagtcggttattaagtttgttttcttttggaaatacatattcgtatttgagtcggtttttaagatcgttcacttttggtaatacagaaggaatcatataagaaatatgtttaaaaaaactcgcatgctaacttgagacgatcggactcctaactgcagctcatgattttctaaaaatatatatatccaaaagaactcccacagtaaattttatcttaactatacaataaaagaataataagattaaaatagacttgactcgttgcaacgtacgggctttttttctagtaatcataaacattcaaaaatactacgtgtcacgtcaaatttctttctgtattactccaaccgtacttccagagtatcttattttgtgatagctagggcgtctactatgagtgtgtttgaaggaagatgaaagaagacgattgataaaataggcaaattgaggtaagacaccagcgtatgattaattgagtattaattattttaaacttaaaaagtagattagtataatttttaaaagcaacttttctatagattttttttcatgaaacacggtgtttagctaaacagttcggaaagcatgtgcttggaaaacgacgagttttcttccatcgaactctccttaaaataacttaaatacttatatttagggataaagagagtaaaaggtaactagaaattcaaaatgtaaatgttaaagtaaggtcctagctatcatagctctgaatcgatgattcttggagaattatatgtctagactagattcacaaatccatatatctgaatctacgattatgttaatattatttgggaaaattatactatttctattttaaataaaaatataaattttaaatcactataattttgaacactacaatttaacatatgaacttttaatccgtgtgttttttttaaaaaaagaaacagtgcatctaggatccgaagctacgtcaaagtaaacataagattactacaagtaagagaaaactatacattcgaatgtaaacgtctccgtgctacaagcctgcaacttcaggcagaagaagctgggtaaggcctgatttggtttgagttttaaattaggcttaccaatatttagtaatttcaatagtgtttagtgtctatttagtttaaagcctaattttagcaaaataggtcatttcaatagtgaatttaagctattttggcttcaatgcaaatatctttgccttaccaaaattagtcatgccaaaacttgtcaaaatttggcaaatttggcattgataaaatttggtaagacctatttaggccacaaaccaaaccaaccctaagttttctccactgtgggcgacgccgatgagaagataaccgatacggtagtggcaggctggcctggtttagttcaccaacactggtggagaaaccatctttggtcggtcgaccaaattccacaatagtcccggttgcaataaaaaccgggactaaagatctttagtcccggttaaaaatctttagtcccggttaaaaaaattttgatctttagtcccggttggtaacaccaaccgggactaaagatcattttttagtcccggttcaaataagttggtgggtacagttaagctccaattatctactaaagatttatttttagtcccggttgtttataccaaccgggaccaaaataaactgccgatatctcctcggtatcccctcccctttttttctctccttcgttaaaaaccaccaagacttagtctcgg

SEQ ID NO: 68571 - DNA, 103860 bp, Oryza sativa
ggggggtggaggagaggagagaggaggagtcaagactgagaaagagggggcttcggtgcgcttatataggcagcctgggggccgaggcgtgagggtggagggttccgtttgtccggtccggtctccggtctggctgcggtcggtcggaccacgtcgcgtgccgaacccggctcggtgcgtcactgggttaggcaccccggcacggcatgtacggtcggtgtggtcagaacgagatcactgatattcaggtcccacttatttcaaaggctactttttcatccatccaatatggagatattgaattatacgctacttttagatgtggcaattgactatttgccactgaatccacatgtcattaagataggtgtgacaaatagttaattgtcaaatctaaaagtgacaaatagttaattgtcaaatctaaaagtgacaaatagttaattgtcaaatctaaaagtggcaaatagttaaatgccccaatatggggtacggagtacttgctactccctttcattttcatttaggcggctgtattgagttcctctgccaaaacttttttaagtatatggacaaacatttgaagtattaaatatagactaataacaaaacaaattatagattccacatgtaaactgcgagacgaatttattaagcctaagtaatccgttattagcaaatgtttactgtagcatcatattgtcaaatcatggcgtaattaggctcaaaagattcgtctcgcaatttacatacaaactgtgtaattggttttttttcccgtccacatttaatgctccatacatgtgtctaaacatttgatgtgttggaatttttgaaaatttaaaataaactaaacacggcctcactttgattgtcatatttcaaaaaatcagattttaaaatttgatcatcacattttaaagtgaatggagggagtaatacaaaatcaaaaaaagactaaaataccactatttttatcaaatctcaatttaattattcttccttttatttactcctagtgaatttatctcatactttcacaaactccgatttgagacaaaagagaagagcaaaaaataaataaatttactctaggacgaaagcagtacaatttattactacatccgtctaatatattagcaaaatcttttatattttaggatgggtatagtatcgtattgaagttgatcattgcaaaactgacatatggatctcactttttctagggtccatgcctgactcctacagtcctacgcaggagttgcatccggcgtggtttgcaccgggagactagtttttgttttctgcatattggggaatctccttttctgttgaattgtactactgcggaccagcttagaaccgtgtgggaaaataggaaatgcttgtggaacaatcaggttggattggatttatgggtggattgggatcaaggataaatactctgtgaataaattttggacaaaaaaattggtatcagcattagtaataaacaaccaagcatgtatgttaaacaactttccgttggctgcttcaactgatatgtacaaactactagtagcattcagtgggagtaagtatgtatgcatatatatatatatatagttcactcttatcatatttcataagatttctcatgagctgtaatcaggcatggggtactgatgattatatcttcgtaccccaacttctataaaaaaaaattacggttacatagacaactagacaagcacaacccgtgaacacattagtacttattcactcacctgaactggacaccctctacctcttttacatgatttatgtgctagtactacagagaccgcaacaatggtaccagcatttatcatgccatcgatcctgccattgatcataatggagcaatacaaggacatgatatgcttaaagtgtgaagaagatgcaaaggacaatgaataaacaagaattatagagttgtatgcactctagggttcaaaatctcggcgaaatttgagcatctagagccggctcaaaatgcgcatctcgaatggttttattcaaagtttattggagttcattgaaattttgctaaaattcgttcaaaattaacgaaaaatcacttgtagttggcattagattatttttatttttatagtttgtataaccggtgaataaatggtctccagtactaatcaaatattatgatcagaaagtgtagtgaaaaaagaagatgcaggaatatgtgagaaaaaggaactgaaaccaaataagttggccaatctcatgttacttggccgttaatactagtactactccgtcgagtacacaatgaatgattcactgctatctagtttgtggttctaataaatcgaatacattatactcttcatatgttccttgtataaacctgtttgtttgtggttctgtgaatcaaatgccatatacatgacattcgtgtttgtgctcctcatcttgcaatttcatagcaacatttttctactcagtatgcctagttgtcatggtgttttcacttgctgaattgcttttctacatatttttggctcttcttgtactgtatgttcagacttgcctttaacatggataattgaagtattgaactaacatgaaaaatgtgatgtcctatgcttcttgatcaacattcctgcagagaaccaagtcataagcattgactgatatttacctgccaactatcactgagcattttcagacacatacctttcatgcttcaacttttgtatgtttgtgctacaattttcttacaccaaatcgcctgtctctgctctggaaggagcaaagcgcttcgaggtaatcagcctccccgaaatcaggccacagcgtgttggtgaagaagagctccgagtacgctgactgccacagcaagaagttgctcagcctcagctcgccgctggtcctgatgagaaggtcggggtacgggaactcgtcggccgcgcagctcgtctcgagctcgtcggcgaacagcgcctcgtcgatgtcctccgccgcgagcgccttgctctgcaccttctgggcaagcttccggcacgcctgcacgatgtccctcctcccgctgtagctgattgccagtgtcagatcaagctgtgaattgttcctcgtggtctcctcggcttctctcgcaatcttctgtagagaaaccggtagccttgagctgtcaccgattacacgtagccgaattccttccctgtggaaaaaaaaaatcctcattttgttgtccacatcaccacatgacatgtacacattagactttggcaggaaattatactggctcctgtgaaaattgaatctttttcctatgaatcttgcaagaaattcctattacaagctggtaattgagttgctggtacgcccggagcactgtgggctttgagcatctattggcgaacttccagttccacaaagccaagtgttgtgaacgcgtgaggcattaactaattatttaatttgcaagtacggatgtttacctcagaaactcggcgacgctatcgtggatcacccgctcgaacagcctcatcaagaagtccacctccacctgcgaattccaacatggcgaggacgcgtcaagctcggcgaaggcagagatttcgaaggaatcggcggcgaggcgtgtgtaccttggggcggctccagttctcgttggagaaggcgaaggcagtgagcgcgcggatgccccaggcgcgggagagacgcaccgtctcctccagcgcgcgccgcccggcctcgtgcccggccgccgacgggagcccccgcgcccgcgcccaccgcgcgttcccgtccatcaccaccgccacgtgccggggcagcgactccgcccgaaggcatccagggaggagagactcggccgccggggctgcgccggcgcgcgggcatgggcatggtggtggcggcgcggggcgcgtgctgcggcgaggggaggtgggtagctgatgggtagcagctggagagtgggagggcagcatggtgttggcggcttggcgcattgcccccaaactccgacaaaaggatgaaaagctctgcatttattaaccttttagaattgtttttttcttttttttatgatgttgtgatttcctggggaattctaaacaaattgcaagaaattgatttacaagaatactacgggacgatatctcgttcgaacggtatcgtgaccttagggtacggacaaatttggggatagacggggaagtatagtttcccgcctatcctgagagtgagctcaaaagcaaagtgagtgaaaagtatttttctctattgaacttgtccctgcttacaggatctaggtcggcttaaatgactctcaaccatacacttgagattacaagtttgcccctgagggcctacatattatcatactacccttataaagtttacaatcctaagagcattttactatattttagtggtcttcaagtaacatccagtgagagtagttggagtgatccctgttaccttcttgagacatgttcttttgtagttggagtgatccccagttaccttcttgagacatgttcttttgtagttggagtgatcccctgttaccttcttgagacatgttcttttgctcaatgatactttcccttgacttcaatcatccgggtagagtaatgtctctctcgtgagggcttgaatacatttttcccatcttctggcttctcacctgctaagtgaagagaattgtccaaacacgttgtgttgttagtaatataccccatcagtccaaaaatataacaacctttaacactcagtatttgttccaaaatataacattttttttcaccaacattctcttcccaacaattcacaaccctccatcgttcacttttcctaactacctccacttcttaaccaatcacaacctttccctatttaattctaaagaaaacccctgtgtacccctgaaagttcacctaatcccttctataccctgaattttgctcaatcccttacatacccctaaattttagtatggatcccttccatgccctttccgctagttgaccgttaaattcttatgaaaaagtccattttgccatttggtataaagaagtatataaattaatagagtatattgttggagcatagaaatttattatatgagactattatgtttatgagatagttatgcaccatattatttgcgataaatatacttttagatatgacataaaaaattaatacttatttatttttttagcatatgtgttctgatagtaataaacaaatctgttgtattactatgaaaacacatgctacataaaagaacttttaataactaataaataagtattaaatttttatatcatatgtaaaagtaaatttgtcacaaataatatggtgcatcacagactcataaatataatagtctcatccaataaatttttacattccaacaatatacttcattaatttattatgtttcttcgtagcaaagggcaaaatggactttttttcaaaagaatttaacggttaactaacggtcaactagcggaaaaggcatggaagggatccaaactaaaattcagaggtatgtaagggattgagcaaaattcagggatatagaatggattaggtaaactttcatagatacataagggattttctcttaattctatctactttcttaataactgtgtctaactctaaaacttcttatattctgagatggagggaatactgatttgagcaagtgaaactactcaaacgcactttccttggaataaacatttcttgggcaaatgcaaatgatcgatcaagggttgttacaggtcaaaacttcattcgagcagattgcatggctcaaatacgatttccttattgtgtgtgtttttgccgaacatagggatggcgttcaccccctactacaacaaatgggatgatactagttaggtataaggtcctgatatccctaaggtattagataatacttgagatctgataactataaggtattatacctgatacccaaccggtttcatcccgttcgaacgggatttcgtcgtacaacaacccctttatattcctttgtgaaggtgtcaataaaactgaaaccattgacacgtaggcctttttcctcttttcaagaaggaaagctctgtagtttaataaaaattgaaaagagtaaattgtattggtggtacacaaacttattaggtgggtgcaatttagtacgtaaacttgtaaaatgcttatttcagtacacgaacttgtctagttcgtgcgaacgaggaccaaaataacttagcaatgttaatttatgatgttcattaggatgtgacgtgcatacgtatagtgagtatgcataagacacgtaatatttataaatttcgtcttaactttatccttcagaatggaaataacgaatctcatatgtttctaacccttatattagtgctaagttttttaatctttctgatttttattgaatagatatgtctaatggcaaccttcttagatatatgtttacatagtatcctaatcaacccctaaattaataagattaaccatgtagtgtacttttcggttttctccgcacgcacctagacaaattcatgcaccaaaatgagcattttacaagttcgtgcactagattgcacccatctgacaagttcgtgtaccggcgatgcaatttactcaattgaaaaccattgacgtatataaaacgctgaatagtgtatatcctgcattcttgctctgaacgttgccttggctttttgctccatttctgagaatacggacgggcagttaaaggggcgttcctagtatgtgcgtacgccgacgcggtagcctaactaactctgttagttaaggataatgatggtaattaacaatagattttttattttattaggagattctttttcctaatagattgaaaaattttaagttacatttgaaaacttttgacttaagatttaaactttaaactcaaattttgaaaactttcaactcgaactttgaaagttttcaatttgcaagaaaattttttaaaactttcaactcgagatttgaaaacttttaactcaaatttaaaaactttcaactcgagatttgaaaactttcagctcaaaatttgaaaactttcaactcgtatttgaaaactttcaactcgaatttgaaaactttcaactcgagatttgaaattttttaaattaagatttaaaaatttttaagtcaagatttaaaaactttttaaaaaataaaaacacttgctgctagaagattaaaaagtaatcaggaaaaaaagaaaaaaaaaggaaagcgaaaaaaatcagggaagaaaaaaaagtggaaaaaaaaaagagaaaacagcggtggttagatttcgcgggcgcacgccgagtgggccgtatggaaaaaaaaagagaaaacagccgggagtgcgcgctgccggcgcgcgcgaattaggtttctcgcagttaaagcacgtactgtgtgtgtatcgctagacagatgcagaacggctgaagagcagtctgtctcatgccaatgtgcaaacctgcacatatggtcgcacgcataatgaaacgcaaactgcgcatgtggttgcttactgagaaaccagaaacgggagaatactgtgaatacctatagctgatcgaatattctgccctccccacgggccaccggacaaaagaaaaccccgctgaaactgtatttagtcaaagtaaaagtcacgcatggcacgcctgataaatcatgaagttgttaggacatgcttttcaaacttttgcaaacctgattacaggggatcaaccaatacaagaaataaacaaagtcaaacaatcaattatcagccatactgataggagacgaagaactgcaagtctacaacagctgacccacatcacaagaaaatacaaaatgagaggggctccagtagaattcgtcagaaatgttagattgctaagaggagctaatggcctttaatttgatatttgtgtcatctgtcaccggcatgctaggagtacaagtttgttatgtgcatcagactgtacagagaaattcgtgagaccttatcttcctaataaagaggactcatacattgtcaacctgtccctgcaagttactagaagatgtcaatgttttaaatgtgactaccctgattttccatacttccatgtgcaagccttccatactaactactcgagaagctgtcgcatgtgtctgtttgggaaccaatagtgaacgggtggactaaattccatacacgattgacaactccatctgacataaaggaaaacgcatcttttgcggctctttgacatgcttccagagctctagaatcaccaagcagttgttttagtgcttccaaaagttcatattctcctttgacctgaaaaacatttgcattaatcctcatagaatgaaaggggctgtagctccttgcgatgtttaggtgtaaaaaaaaaaagaatcacccatgcagtaaagcagcatacccacattgcaagcataatttattgaaagagcaagtagaaggcaattcatcctgttaccgtccaaactaatttccagaagtagggacaaggccaagtcaataattaacaaaatacctcccctaagaaggccacgaaatagtagtaatcccactcttaatcgaacatagtgcacaaatgatgcggcattttttgtgtcagttagataaataacaaagtacaagacagattatcacctgcttgacagctaaaggatttatttgccacatttcgaccagcatatgatagaagtgcccaacactaggacctgaaagacaattaatgaaactctagacattccgattttgtagaaaaagtcattcaaaatagtcagatgtgtcttgcactcttgcgtaccagtcataacagcgcaaccaactgcagcagcctcagaaatattatgtccagctaagccgggcaaaaaagaacccccaataacagctattggagtaaccctgtagagcattcttaattcacctattttccatggtatttcattcattaactaacattcaaaagaatatacacagtccatactccatactgaaaaaatgtgcaaacttaaggcataagagatagcacaaacctaacgtatcaaccacatatatactggtgtttgaagacaccacttctcttgttgacctcagcacaaaattcactttctgtttcttcagggtctaaaagaagatgagtaaagaactaaagatgtggcccatacatattatactatcagcattgaagtgagaatcatatgctacatgctctagaaccataagaaatttcaagtaatcgtatacaaacagttataagcaattaatttcaagcttcatacagtgaactaagttagttccctttttttcattacaacaatgctacacctatagattacccaatatgataatgtattaaaaaaaactaaaagataagcagtacaacccaccaactacttcatcaactaaacaggaccagatataaaagggtaaggaagacaattgacatacttgagaaacattcttgctgtcctcaggatgccttgggacgagaattaaaagtagagtaggatacgccctggttaactcatcatgaacacggagaatgactgaaaaagagaggaagcttgtcaacattgtttttatgttgagaacataagcatagtaaggcaaggattcaattattcaggaaagcataaagaagtcagcaatgactttagggatatcaatggtgatcatcaccataggcaaaacagctacatatatacagttttagtcctgcacacagttccttggaagagcagataatactgatccaataaaaagaaaaggtgggtgtctgaggtgcttactttcatcttcccctttgtggatagaagctgccatccagatgggcctattgctgaactgctgctgaagatcttctattgcagctacctctttctccccagcagcaatgtcaccaacagctaggtaaatcacatgaatctctataaattattgagtttgtgaacctggttatctttcaagctcccaagataatccttgagaaatgcatcactcatatgtttatttcaaacatactctcatgaacataggaagccagagaaaaattggcatggcgcataccgtattttaaatcgccagcaaaatggatgatctgtggtggtgcatgaagtaattgaaaacgaacagcttgaatagtactctggaacagatagaaatgaatacaatggcaataattttacatcaaaataaggtttagaaccccaccactccataccaatgggataacaagtgatagtttggagagcatcaaagagactaactgcaaccctagaggcaaggaccaacggttgaaagacttcaatgacatgcgcgcatttaaaagaaccactgcaatctgaaaaataggaaggtcattcacagcagataattaaatagtgaaagaatgtactatggaccgaaaatatagctaatctgccattgcacatggaaaaaacaagggtaacaaagggaagcctaaccacttagtagaaaatagtcattatgagaaaaaaaaaacttacccctttctctgctgcagacaaaatgaggtttggccagagttcactttccataagaagtatcaaatttggtttccagtatccaatgaaactttctattgcatcaggacagtcaaggggtgcaaactacacacatatgtatttcagttatgtaaaacaacaataagctaccgtagatgtatatagggcatatcaaacatttaaactatccttctgttagcctattcgtgattcccttcatctaaacaagttccatctgttcccaaaactttgcttgatctgtgtctgtactatcgaatattaccaccttaaaggtttaatattacgaaaccttactatcatagttcaacgagtataatatgaccttagtttaagggatacatataatgaacagacaatatctatctgccttgacacagttcgaacctaaaatgtccttttttttcaagaacagtccatcagtaaaaatttgttgtgcatacgccatttctcagaaaactaaaccggccgtcacgacagggatctgaaagtacaagagcaatttccgagctcacctgatatatgacaccatccgggagcaagtctttcatcacttcgctgcattgaaatcaaaacaaccgaaatagaatatggccacattacacggaaatgagagagccaggcaactcgtatttgcggtaatgggggaagcttacaaggatgagagggtagtagtggtgaggaggatggggagaccagggtggaggcgggcgcagtggcgtacgaccgggagcgcggccatcccctcgccgagggatacggcgtggaaccacacgagcggcgagcccggacgaggccgcgccaccgacggcctgcccagccgctcgggccaacgcgacgggtgctccagtcctcgtagccgccgccatagaagcgccgccggcgccgccgcgcggctcgccgccctgtacagctcgtacagcgcccggccgccgcgcgccgccgacgccggcgtgcgggccgtccgcatcgagcctggcccgtccaacgactcacggcctgggtcgctttgggcttttgttagcggcgcgtgaggtcgcgtgctttcagtaccgagcccaacttacctctcgtttatacgccttcgatataagaaagcgtctccggtgttgagtctctccgtattcatagacagaacacacatttctgagcgaaactcaggctatatttctgcctcgattgatttatgcttatgcatataagataaaaattaaagtttaaaactcaattttggcgttgattttgttattttctcgttgtagtttattttacagtatttttttttaaatcactaaagacatgctataaattatttttagttgctaataaatgattaataaatataatataaacataagtgggaagatgacttcttttaaaaaaaagaaaaataaaaggaaaaaaaatcttcttcctgcattgatgttcctttgtcaagagttaaagcataataacatcacacgttcgcgaacagtttatagctattggcgtccagaatgatctgccggaccgcggcgactgacgcgacgacagcgagcgcggagaacacgacggcgatggtggtgttgagccagaacacggcgcccttcttggacggcttgaacgtcacgttgtagaacaccgccggcacagcgaagtcgagcgggaggaagccgaatgcgccgatgagcgcgttcatgtcgccgaagaagggcaccatggccgcgatggtggtgcccagcgcgacggcggcggtgcgggagagcacccgcggcgcgacgttcctcgcggcgtactgcccggccttggggtcggacaggaggccctccaggacctcgttggtcggctgcaggtacaccacggccaccgccgacagctgcagcagcgtgaagagctcgatgatgagcagcagccactccgggatgacggccctgccgcccaccatgaagttgctcaggagcgtgccctgcgactggttgccgaacgcccagtaccccgagatggccacgctgaagaacgtcgtcaccaccacggcgtagcacaggcacagccccttgaacatcttccccgtcaccggcgccgccaccgtcgcctgtatctcggggatgattccattgccgtacgtcgtggcgatgacggcgatggcgttgaacacgccgaacacgcggtcacgggtgttggcgccggcgatcgagtagtccttctcgggcgctccctttgagcttcctgcacaaaattcgtcagtccaattttaatccgtcgcgtcgacaggccaaattaaagcccaatagctaatctaaataatgggccgggtcgccgggaaacctaccaaggtagatgcaggcggcgacggcgcagaagctgtaggcgaggcacagcacgagggagatgaggttaacgtggcggagagagtggaacgacggcatctgcgccaggatcatcatgaagacgccgaagattgccacgaacacgtacagcttgatcgtgccgcccgggttggcaatcaggtagatagcctgcaacgcgatcgagtaagaaatgtggattcataccatgtgcaattgatgaacgcgatccgatccgatccgacacgaaatcagttcgtggactaagttctgatgaagataccttcatgctctgaccggctaggagagtgcacgcgacgactgccccgaagcagaccaggaactggatcggcccgatgtagaagcgtccccatccaggccctgcatgcatcaccgtggaaaaattaaccatgaatctcatctcagtgacagtgattttgtcgcggtgatgaagatgaatatccctttcgaaacattttttgtcagatgcgtgtgtaattaaactgtatgaatctgctgccagatggcactaaggacgattcctttttcccaacacgtacgttaaacctgtgcttatctgtccaatgtcgtatcagctaggatgctagtatatgactgattctactacacctggtacagtgctactccctccgtcccaatatataagaatctagaaccgatgggacattttctactactgtcctgtccagattcgtagtactaggaaatgtccaatccagttctaggttgttacatattgggacggagggtccagttctaggttgttacatattgggacggagggagtatttaagattgacatattgacaagaaacggcgcgcggtgctggtttttttccttcgcaagcagtatcaatcgatttagacaggcaatcaagtggaaagctggaatattaaattccacagcaaatacttgccgacaaattcgtcaaactcgaccaattgcatgatctgtagtactaatgtgggaatactatccctttcgaccaatcaagtttttctctatatatccgccaagcgctaactggagttttaattagtattatctaaccagtggggattctttccctcgtcgactcttgacagtgacaaaatacgagccctagcagctggacttttctaacctgtactgtaccgtgttacgattttattgaatgctgcttagtcagttactgaaatcaagcaacatgtcggcttcagacgctgcactcactccggttgaagagtttaccggtccgatatagtatggccatacccattgctcatgaatgctgcagacacgtacatgtcgcaaactcgcaaatgcgaaatgggacttgatttggccaaataatacagctgacttgttccgcacaagaaaagggggcgggcagctgactttcttgtgaataaaacaggacatcaatgatcagtcgctaaacctgtcacgtctacaagttggtgttccttcctcccttcctttcttttctgaaagaacactgcacttggcgtttctgcccctatattcaaggtgacgacataggtgttgatgtattgactcatcctcatgtctcgtttgaacgcaagaatatcacaaactatgtaaatgcttcgaaagaaatggtccattacagaaaaataaatcccgtgttataatcagaggttgttttctccaaattctcaattcgggcctttaggagccagggctaagtgaagacatgggcgagagaatcttacctgcctcgtgatggatactagtacccactactgacttgtacagttgtactgtattcgtttttttgggtgaaggctgaatgccacgtccgtccattgtgaacgcccttactattgtattgtaatgcttttggtattgcacgtagtatgagtttgcgagacagttgtcagccaatgcaattttatatgcagattctcctccatctaccaattagcttggagttgctacgtgccttccttttaatcacttatgtactcgagtttaatgagtatattagcatcaacctactacattatttccattttaatgggaacctaactagtaaatagtaatagggtgtgttcagtacctattcttgctatagcggttacggctgtagcagtactaaaaatggctgtagtttacagcagcgtttaggctgtgtttagttcagtgtaaagtttagattttggttgaaattgaaaatgatgtggctgaaaagttgtgtgtgtatgacaggttgatgtgatggagaaggactgaagtttggattcaaactttgaatctaaacacagtcttaattgtggctgaagcaacaatccctgtcgatcaatctcattgtttaactgtaattacggatagataggtatacgagtgattactgacctaaaatatcggtggccatgtccctgaagcggagctggcggcgtccttgctgcgcgtggtgctcgaggacgagggagatgaggttgtacgagtagaaggtcacggcggcgccgatgacgaggcagatgagccccgccgcccaccccagcgacgcgaacgcgaacggcaggctcagcagcggtggcgccacgatggacgtcgtcaggtggtacccgcagtgcagccatgaccctgcgcatttatacagcagcagcatgatcagtttttttctgttaaactagctaaaggtactgtgcattgcggcgaatatcataagagataaatataaaaataaaaattacaaacctactaacgtagttagttaattaggcatattatgtcatatcaagtgcaaaaatactcacatttgaggatcttatggtctaatatgttaacttatggtgatggggaaaactcagacaccctcactaatatcattcaaagtagtatatcatagatatagaaaaagaataacattactcctgctagtagttagctaatctgttaatcctactggtattttttctgtttgtattagtcgctggatgatgataagctgattgggagaggcttccgcagctccactcggtcaaaagttgtaggagatgaaggattggcaaaagaaagttcacaggttagctaaacgcttggaagttggaatatggcgagtaaacacgtttctatcagtcgtttcaaaaaaaaaaaacacgttgccatcggaagaaaccccatccctccatcaaacattgatcaatcctgcacaatgcccatacctactttccaaagctgtatgtcttacacatgtagtactcctcagtcactaaacttgctttgacaatcgaaagataaaaataaaagaaattttgcagtcattaaaaaaaagtacatcgagatacctaaattttacattaaaatttttggtacttctagatacatttttaaggatggtaaaattatcctaaaataaagttgttgatactagtatgtttcaggggtcagcaaatcaacagggaactatgaggcattgggggcagtgagcaatttgattttgttaagcctgcagtctcacacctaattcgattttcctttttccaaaatagaccaaatatgatttgattagtacattactcctaccatattcctcactccattccaaaataatcactacgatgagtttccgtgtacaattttaattgtccgtcttatttatttttttaaaaaaaaataaaaaaaatataagtcacgcacaaagtactattcatattttataagctaatagcaataaaaatactaattaaatttttttaataagacagacgattaaaattaaaaaaaaacttataactgcgcttattttgaaacggagagagttctagctaaccaacctcccgatgccatttataatttcctcgagtcaagagtatctgcgctagtgcgcatgataatcaacgagatggtgacctgtaccagttctcctatacgatacagacatcacgctaaagactgaacgattcatgcctaatttatttttttggaataaaaataacaatacatcgttattatacttttatagttcacttaggtccatatattaatatattttctgtctgcttcaacaagaccaaatagacgtgtaaccatttcatggagcccgaaaggttgactaatacgagtactgtatcgtgatatgggggatcggctgagctagcagcctagcagaacaataatatgaattgcccatgtttacaactttacatgcattgctattgataataggcttgatagccagggagcccatcatccctgaagtacattttctcttgtctcttctctgaatgttgaaaaagaatagatgtaggcgtgcaggcaacggatgtaggggaacggaaaaaagcgagcaaagaaagaagagagtttttgttactacatccaatcttcatagggtaaaactgtgaaaaagtagtgcaaaaggatagatgggcagggaccattcaaacatctacatctgtccaagaacttttaatcagagttcaggagacgcacccagtcattcaagtagaacagtaacgcagtacccctcacaatggctgccgggtacatgcgctgaggaaaattaaccgaaacaatttgtaaaccatcatttttttcccgttatcttggtagtttgtacagtttttgggtacgattattaacatgagccaaatcatttacatacggatcatatcaatcgggatggcatagccaaatcctgcacaacaacacttcatcaaaccatcttgatatagcagccagaacaatctattaactcgtacatgttagttggctagttgctactgattagttagccagctcttttgcttattaatagctggggacaatccatcaacagtctagaatatacggcctccgatgctcccagaacacaaacaggttacgcttatatgtgcagctagccaaacatgcttgctgcctgacatgcgccaaagaggaatcaagaaagaaataacgaaagaaagaaagaatagtgggtgatcagaagcgagtaagcgagaaacaagagagctcatgtcagacacgaacgcacctttggactgaaggacgaagagagccccggcgtcgagcttctggccgacggtgtcgccgccggcctccatcttcttcgcctcctcatcctccctgctcggcgcccccatgacgcctctgccgtcgaacgattcggtcgctagctcttttgtcttgcaggtaaaaccaagggagcgccaaactacgggttgatggcctgaaactcttgggggactcggacgatacgatctacagttctacacggccgtacgttgtttgtctctgcctctgcgcggtgtttctcagcaggtgagcgggctctggttttgccttttgcgcttctactgctgaagctgaactgcgtactccatatatagagaagaagaagcaagcgcgctcgcggaccgggtggacaccgtatgacgcgcgggcgaaagggacagtgcggcctgtgcgcacgcggcacgtcgcgcgtgccacggcgggagaatctcccgcgcgctcgctcccgcgaccaggccgggcagtcggcagagaatcgctaatacgttaagatcacgaaaaaagtcatactttggaaaccaaaaataaaaagaaaatccgtcgagaacccaaacgaggaaaatttttattgtacattgtaatgcaagtatgagaaagtccatctagtactactaggattttaagccaaaggccgtccagtatcgtaaacataaaaaattgtcaacggactcaaaacttcacaattttattcgtgtacaacctttttgacaggcatggatcctctgcattacggcaacagagaagagctagtgctacacacactaatttgtgcctgctacattctttggtagccttggcttcgcccactggccactaccctctccttgccaatgtcacgtggccaccgaaaaatagaaaacatgtcagggaggggataagtacatactccgtggctccgtcccacagtgtaggaacctctaagacctattctagaactacaaatatggacatgagttttatcataggttgctatattgtgggacagaggaagtactacatatttaggtatgcataatgcatgtactagtagatcctattgtgtatgtgtaagttgtagtgctaaaaaaccttggatttttttatggtataaacaaagccattgtaaatctcattttgcattagcataaatgctactccctccgtttcaggttataatatgttttgactttgatcaaaatcaaactacttcaaatttgactaaatttatagacaaatatagtaatatttataatactaaattagttttattaaattaataattaaatatatttttataataaatttattttgggtcgaaaatattactattttttctataaacttgtttaaatttgaagcagtttgactttgaccaaagtcaaaacatcttataacctgaaacggagggagtaatatttgtctttcctagccatgttgaagaccggcagtttaggccggttagctgtatatagcataggtgcagcagagctgcgagctataagaggctgttcaattggtggagcattgcggtggtgacgataagtgcgaagagggtgttgtaggcgaaaacctagcctgaggtttctctgagccatcaacgccgatgcctacggacattattatcctctcttagagcattgttaagccatcatcgacacctttccactcattaacatcattcttcatgtcaaaacccagtccgaatggatgggcggtggtggcgtctaagatgtcatgatctctttggtggtgttgtttgggaagtttttttcctcgctttaccgtcttttcttagctttttcttggcaaatttttggttgacgtcatctggttaatgtgagggacgagcggatcttcttctctctcgccctcttcctcaaccactctacatgaggatgattaggaactcatcgatgatttgtctgagtaggatcttgcaggtctagcagcgatcggtcaaacttagcggcggtcggtttgttcctagtgtcttctccttagttgtgtagggagctgttagcacgtggtggttgtgttttgtttttttttcattggtcacaattttttcgtcatgtaactttgtaatttttctatgccatatcataagaaatttcacgttgtcttgtgcgggatcgttaaaaaaaaatcctcgtggctgctaggagtcacttattatcatcgaaaggcggttgatgtcaattatcgttttctaatcatgaaaatgacgttgtttccctatttaatgttacaaaatttaaaataaaatacaaaaaataaattcagttaattaaacttttgattttgattacattattttttgtttacactgtgaacagtactttatatttcatattgctttcagtttataattttcaaaataatttcaacgttttgaattgcaacagattctcacagtaaaagatggcattaaaatatactccagttttctttgtttcgattacaaactccaaatatactttctacacgattatttactttgaactatcggttccatgtataacgatcatagtattttgattaatagtctgcatacatttagaagacaatatacataattaacttagaaaaagtaaatagatttatttataatacgacacaactatatccctttgaaaataaatcaacaaaaattagttgctgaattttgccatatctctatctctgcaaagatgctcatccaataagccagatcgaactgttcctagcctctcatctcatcgtctgtttgttggtttgtttcaatcgcaaccaaatttgagttccgaagtttaattttagagttgatcttttttctttcgtaagtttatttaaactgctaaaaataccgttatttttttttaaaaaataacatttttagttcatttattcgtttacgacttagccgaaactcaactaatcaaaggataacatacaaaacggttaaaaaaattccttcggattatcgtgtggtttgcaaggtgtcgaagtcgacggatcgagcggcgagaccgcgagatggacacggattaaatggtgcgcgcatgtagcgcggccgagaggcttgcacgagtccgtggcccatgaggccttgacgtacgagtggcttatatgctcgccaacttggccaccatatatagcacagaagtgctcgtagagctcagagtactcgttttccttaccgactgatgcacctaactaatccgccgattggtgtctcgttctcatctctactagtgctgtgaccgtgcacgtcggtcgtcggagggcgggcgccttcatatcgatcgtgatcctgacgggacgtcattcccgggggtcagtactgttcgttttcagaggagcaacagagtacttcctccatcccataaaaaataatctaatagtatgaaatatgacacacagagcctgcttaggccttgtttagttcgcgaaaaaaaaaatttaggtatcacatcggacgttcgaccggatgtcggaaggggtttttgacacgaataaaaaaactaatttcataactcatctggaaaccgcgagacgaatttattaagcttaattaatctggcattagtatatatgggttactgtagcgcttatggctaatcatggactaattaggctcaaaagattcgtctcgcgattttcacgcaaattatgtaattagttttttattttatctatatttaatactacatgcatgttgtcagggttatggataccgcatacctaatagtagtcgactaaatctcggcaggacccaccaaatatcatgtcttatacggaaacaacctccggatatagaaggagtttcgtataaggaaggatgaatagaattctacatgtaaacgacatgtactactcggattgtatccatattggttttcttagttctatttggacaaggggacacctatgggtataaatacaaggccccctagaaggacaggggacacgaaacaatagatcaagacacaagatcaacatacaagccaacacgcctccaaatatcaacatcaaaaattagcttagacaaaccctatctggtacctgcgggggccggcaagaggggtcaagcactatctctgatctcgacgagttcgtgctcgaggaagaagactaccctgtcatcgactacgagttagttatctagccgtcaagtcgacgacagccagatatgttatcccacatgttgtatttgtgttatccagatgaataaagagcaacaccggtttcggccaataggatgtagggttattacctgacaattcaggggcccgaacctgtataaaaatcctcacatccgtctcttttacctaagtctcgcatatatcctagtaccaacgatccccatactatgcaaataccggaatcgcgacatcaagcgtcgacacatgtgtacaaagattcaaattgacgtttttgggaaaaaaaatttaggaactaaacacggccttaggctctgtttagggtctgtttagttcgtgaaaagaaaatttttaagtgtcacatcagatgtttgaccggatgttggaaggggttttcggacacgaatgaaaaaactaatttcataactcgcctggaaaccgcgatacgaatcgtttgagcctagttaatctgtcattagcacgtgtaagttactgtagcacttatgactaatcatggactaattaggctcaaaatatttgcctcgtgatttcctcccaactgtgcaatttgttttttaatctatatataatgctccaagcatgtgtccaaagattcgatgtgatgtttttgggaaaaaaattttggggaactaaaccaggccttagtttccatgcaaaaacttttcactttcacatcgaatgtttggacacatgcatggagtattaaatatagacaaagaaaaaactaattacacagattatgtgtaaattgcgagacgaatcttttaagcctatttgcgccatgatttgacaatgtagtgctgcagtaaacatttgctaatgatgaattaatttggctcaataaattcatctcgcggtttacatgcggaatctgtaatttattttgttattagattacgtttaatacttcagtgtgtgtctgtgtatccgatgtgacacgccaaaacttttcacccctggaactaaactaggccttagttctcaaacaaagttttttacgctgtcacatcgaatgtttggacacatatatagagtattaaatgtagaaaaaaaaaccaattacataattcgccagaaaattacgagcctccaatctcattcctagcgtgtgttagggacgcgcacgcatgtgtgtcgtggtgtgagtgcagtgtgtgttagtgtgcgtcctgagttgttcccttcttaaaaaaaagaaaattacgagatgaatcttttaagcctaattgcaccatgatttgacaatgtggtgctacagtaatcatttgctaatgatggattaattatgcttaataaattcgtctcacagtttcatggcggaatctgtaatttgttttgttactaaactatgtttaatatttcaaatgtgtgttcgtatatccgatgcaacatgcaggggcaaattttttttgccaactaaataggctctattggggagatactgtactctctccgtccaagaaaaaacccaacctagaagaagatgtgatcccgtccagatttattgtactaggtgggatggagggagtatgcacgtagtactataatattagtattagaatgtgttgtattcagttctaatatttattttttatgggacgaagagagtacaacaacatatatgtacggtgcacagctacggccatgtatatggatgcaattaatacgtcggaatcagaaggccataggttgtaaaaaaaaaaaaacgaagcggcacaaaacaatatatggttaaactttatatatatgtctcattaatagtttgatgccaatacttaaaaatatacaaatagaaaaatagaaatcaacttttaggtttcgaaatttaaattttggatgtagctaattaagctactctatccggtttgataatactctacttgttattttggacaaaactcatatcaaactttaaaatctttaactatagataataaattctaatggagatcatacaatatagattagtcttacaaaatactttaacaaaatcatatatttattgatgttttatatatattattaaagcctaacgattaaagttgttttagatcacgtttttatcccaaacgataaatactatcacggaagtactctctccataaaaaaaaactaaacttaggaggagacgtgacatctttacaatgaatctggacaaccctttatccagattcgttctactagaaaacattacatacttgtatagtttaagtttttttttaaggatggagggagtatggttgctttttctttttttttttaggggggcggggtttgatcgggctgtcaatctgtcaccacctactatggcgcaacagcagttgagaagttgagaattgttcagatgaagcgagtatcacgagtatcggggtttgtgatgcttactacttatataatataaaactgtatttttgggtagcagacagataataaactctttagaaaaacaacacctgaattaattattgcagctgaagatgacagcatatctgagccaactcgctgattaattagaactcaggatccaaccaaggaaaggattattaatccagaatacatgaatgcaatcgcagaaactgcgatgcagtcactcattggcaagtggcaactgggcatatcattgtatatttgaagtttcatatgataagtttttttttaaaaaaaggggaaaacagtaatagattgtgccttttcattaaatatagggagaatagctaatttagtccctaaagtttctctgtaggatcagtttagtccttaaccttttaaatggtccaaagaaatccttaaactttgtcataaggtctagaatagtccttgggtccaccaaaatcattatataaatatgccatgtcatcattgatgcaaaatctatgatgaattgtccaatttacctttatgtatatcatagaaaaataaatataagggtgaattagacataaccatgggaaaaaatacttatcctttttttcacccttttgaggtatatttttgctcttacattttactttttgttttttatttttctatgatatatgtaagggtaaattggacaaatcatatagattttgcatggaaatgtgacatggcatatctatgtggcgattttggtaagatcaaggactatgtcaacccacgtgacaaaattaaaggatttgtttagacagtatgaaagattaaagactaaaatgtcccaggagcgaaattttaggaaccatattagctattctcccttaaatatagcagaagaaaaaacagcacaagtttcatatgataagttgatagcgctgtagttgctgacttcgtaagcttgcatgctcctatggtttccacacttcagcaaactagatggctgctaaataaattagtaaactttttgatccgttccaggctccaggctagctagatccacgtactttgtggcagcaaagacttttttgcgtaggtcgatcgaacacttgtcgtgtatgcatgaacgccatcggttctaattctaaactaacaccaactaatcgatcacgggcttctagctatagataattaattagtactaatatggagtacatgagtaatgtaatcctaacaggaacacgcctctctggtgcctgaaacttcacgctgctcgccactaatcgagtactctatttggtcagaagagaaataaaatggtatagcaacaacacatattttgcagcatcgtctttctatgacgtctttcacagtaacttactctgaaatatgaatcaaacgacctcgagtccttgacaagtccaagagggagtaggcgaaagaatgtgacgccatttctgttcttccgcataaatgggcaaagctcgcgttatttttattgtaaaagaggaaagagatattgctgtttgtctaaagttggtgatccagagataagaaaagttctggaaggctttggatttgcagcagaaagtgcgtccaccaccattagtggggactggtaaaacactgcattgatccccttgactacttggctactgcatccagcagtgaacatttcaaaggataatcatgtggatagatgtgtcggagtacggaagcgagaaattaatctcagtttcggcgactctcttcattaaacttctgcgtgctggctgcaattttcttcacatggaatgcgaatttcttcatatagagtaggagtaggcatactgctactgtgctagcgaggaacggtctttttttcctagtccagtccatcaatgacatggggtgtgtccgtgtgtgtcggtatgccgtgaaatgcagtatgcaagcatgttcaggagacaagaggtacatgatctccatgttctcaatcaggtctgtccctgttcactatgagacattacggcgaaaccgcgaaagggcgaaagataaattaacccttgatggttcatattgtaatacacgagatctacctttcaattaccacgtgactttgtgtgtcctgaaatcgaccagacatagcttggcatagagattgcataggtcatccacatcttaaaagcttggattcaacattttcaactagaatagtagtgtggacaaatatatatgtgggcctttagttctgaaaaaaagggcctatccgggcctgccatttggcccatatcccttgttatcatctccaactgggcccatgacatagttgtgacaaggaaaaatgtgggcctttagttcagaaaaggcgggctttcgctttctgcaagaggcccgtttgaaatgttgaaatttcttactaagtcatttttttattcaatgaaattataaattccaatctttagtttgacagctctcagccgtatcttatttttacctaagttcagcattaagcaaaccttacagaagctgaaactggaaagtctaaacacattaaaagccaatattgttttgatgaaataattataataacaaactctaatgctaaatctctatctatgttcccgagaatttgcatagggtaagtccattcgaaacgttggtttttttttacatattttaatctattttatctgaaatggtttagggctggtttaaaatggaatattgaccaaaatactgtagtggattatctacgcggttatagatataaatctaatattttgataaataaacataaaaataacttaatataggcgtaacaggccctcacgaaaaagaaacctattctgatttcaccgcgtagccaagcaagcatcaggctctcttagccagtcttagggcaagtataatagtaggctataagctggctaaaagttaaggtggagaagagaagagagaagaagtgggctgtaaacttacagtcggcttggaaacaagatctaagaaactctgtgagagagacaagtggaccctatattaattgtaaagagctaactattatatgggtagactgagagaatgctacaaagaaccttatagccaacagatcggttgtattattagccttgctcttagaatagatacaatagcaggctataagctagctataaacatattttaaagagataaaagaatagagagaagagctagctgcaatacggactccaagacataatgtatgtatgatatgtagtatcaggtattactagtatatagtaaccaaatattgtataaattagctattatatgactatagataatttagagttagtaattggctatactgttaaacttctcttagcatacagcagtagcacccgagctaactgaaaaacatcagcccctcagccgtcatcctatctcaccaaaaatttcaaaacacacgccgcacaatcgtgacaacgccataacgtccactggcgccgcgggccccacactgcaaaatctccgcctccccttccccacgcatggattagtacgcgtccagctcactcactgcttgcttccgccaccccgcaccgcttccccctcccctcctaatcaccaccaccgctcaccggcggtgacctccccccctcctcccccgcctgcgccatgtcatcctcctccggcgcggctcgccgggcgcgccccgggccatggccccccgcaccgccgccacagccgcaggcgcagcccctctcctgggccaagcgcactggcttccagtcccgcgtctccggcgagtccgtcgccatcgtctccgcctccagctcggggcaggtatcgctgcctcgccccgccgaggcaccttccgatctggagtccggcccaccggccaggcccaactccgccctcccgccccctcccgccgccgccgcggccaatgcggaggcaaagccgcaaccgccgccgccgccgcctcctgcgaggacgcggaggagggattcggatggcggaaggccgaatgggcaggcggccgcagcgccgcttcctcagctgctggaggaggaggacgacggtgcgccggagcggcccaagtacgagctccgtgacagccccggagtatgtaagtgctcaaaagaggaattaaatatcccacactgtcatgtgcgagcgcgctgatttacgaggttttacgatgtgttgcagttccaatagcggtatatggatttcagcattacatctccatgctcggctcaatcatcctgatcccacttttgatggttcctgcaatgggcggttcacctgtgagtgtggcttcaatttagtagtagttctcacagcatgtttggttttgtaggtttagtacttaatatacgctgttggatgcttaggatgatatggcagcggtggtgtccacggtgttgcttgtctcagggatgaccacattgctgcacacattctgtgggacaaggctgcctcttgtgcagggaccatcctttgtatatcttgcccctgcgcttgcaataatctactcccctgaattctttgggctcaatcacaatgtatgtttatatgtataaattttatttgtgttggcgtgatgcaatgccacatgttgtcatgtagggattgcctcatcattgctttagagcgtttgttgttgaacctaacacgttgtatttcattgcagaactttaagcacatcatgaagcacctgcagggagctatcataataggaggtgcattccaagtgctgttaggatatacaggcctaatgtcactatttctaaggtgtgcagctgttgctgtttattagatacaaatacattcatctttttctcctagttgtctgctatcatgtggcttgttgacatggcagtatatttctctatttaccatggccacatgattgggtttggtagtaagtcgatcagatttttatttggaatggtgcatactgagtactaacacattcttaagaaaacaaatgatccaaaatttctactgtactacagagatacatctcgtgatgactgtgaacaactttctcttatctatgtggtgtttgttaacaatggtcacgatatgttaataaacaccgattatgatacaggtgttttactatggtctctattggtattttatagaatcaatccagtctgttcatactctctaatctaatggattgatctatttatactaccacctcaactacttgtagaatattttttttctactggtagtagatatcataaatcaatggttgatatcgcttctactggtgatgttagtagaagaccaccatagaggtattcaaataataaaggaaactttgttggatattactagttattatacatatttcctgcttctgagcatccctgttatgaattaatttctttgcataaaccgttgtttctcggacaataaacatacttttgcatgtcttataaactgatgaatccagatcaatgaaacattagtaagcctgcctctatttcttctgactgtaccatcaactgtatatttttgtgacaaatagtaatacatatgtatctccatcttcactgagcattttgtcattaactacctctgtttcaggttgataaatccagttgtcatctcaccaaccgtcgcagctgttggactttcgtttttcagttatgggttcactaaagtagggtcatgtatagagatgggcctattacaattattgattgttgttatgtttgcactagtgagtatgcagtaaaccaacttgttaaatgcattgtaatattttgtgcaaataatgtcttaagctgatgatctgtctatttctgtgacagtacctccgaaaagtaaagttatttggctaccgggtgtttttaatttatgcggtaagatttgggctaatagttatttgagctaatacctccatctatgctagtcattagtgtgattatgcaattctaattgctgaacttttggtgctgccttcttaggttcctcttgctctagggatcacatgggctatcgcttttgttctaacagcaactggagtttatagctacagaggttgtgatgcaaatattcctgcctcaaacaatgtatcagcctattgccggaagcatgtactgaggatgaaatcttgtcgcgtagacacttcacatgccttgcgatcttcaccttggttgagatttccatatccgttgcaatggggcactccaattttcagttggaaaatgggtcttgtgatgtgtgttgcatctgttattgcatcagtcgattcagtaagtttataattgctttgaacttagatgatgcttgtttttctttcttttggtttgtttacttttcataaatttggataaacaatctagtacttactgggaaatgatctacaaagcatattgttgctccccctgctaagcatcaacttaacataagctttcttctctgacaatattgttaaatgcctgaaattggatcactcagtaagtaggattctagaatcaaccattcattgctcttcactatccaatttatttttgtttcctgacaattcatttatgcattttggacttaaggttggttcctaccatgcatcttctttgtttgtggccacaagaccaccaacagctggggttgttagtaggggcattggtgttgaaggtgtctccacagtcttagctggcttgtggggtacaggagttggatctgcaacaataacagagaatgtacacacaattgcggttactaaaatgggcaatcgaagggcggttggatttggtgctattgtacttatactactctcttttgttggtaagcaactatttgcactttttcccctgtgttggaagagtagacatcatttaactgtgacagcattcaggttcttgctataacaattcttgtgtccccattgtaggaaaagttggtgccttcattgcttctattcctgatgttctagttgctgctcttctttgtttcatgtgggccatgctatgtgcccttggcttatccaatcttcggtatagcgccaagggaagctccaggaacagtattgtagttgggctagctttgtttttgtccctgtcagttccatcgtactttcaacagtacagattacagcctaattcaaactcatcagttccaacctacttccagccatacattgttgcatctcatggacctatacacactggatctagtggggtatgtattcatccgttcttttctaacactatgctgtttgcatactagagtttcaatggaaatacataaacaaaagactggtgatacacatgcagagtccatattatagtgctcacattatttatgaatatagatagtttgccaactgtaactcttcatgccgcttgcctggtacaataacaaatatctggtttctttcagtaacaatattgttgtggagtgtcttatggaagtatcctgaacatttacataactatattgtacaactggagaaagcagtagaaagaaacataaagaaaggaataaacaaatcctgggaaaatagtcggaattagaaaattctcattaaatatagtcctttttactcctctgttttgatatgaaccctggaactttcatttttcatgtatatactatgcttcaactgaaattagtcaagctataaattcctagtggtaataaactttatcgagtagaagtgcttaggttgagttccataacttacatatggttccagcatagtttccttcttaacaaagaacacaattatttcactcttatataccgtgccatgatattttcaatcccattcacatgaatgatatattgctttctaatttactgcgtaggcacatttgcagtatataagaactgttctcattttatttgtgaagcctgacaaattcattcatataagtctcaaaatatggcaatatttttgctatatgtttatgttaactatttgatttgcaattcctttatttccttgctctcaggtaaactatattctcaacacgttactgtcactcaacatggtcattgcgtttttggttgccctcatacttgacaatactgtccctggtggtcgccaagagcggggtttgtatgtatggtcagaggcggaggcggcaaggagagaatcagctgtcatgaaagactatgaacttcctttcaagattggacacgcattcaggtgggtgaaatgcgttggcctatagcacagttttggtgtggtttgtagccttggccaactgcacaaaaaatattctgcagcttccaagaatgaaaaatggttactgtgcaaaatctcaggcgaaagaaatggttagtcacgaatcatgaccgactgtttcccaatgtttttcaaccaaggtatcgactatcgagtgtacatactgaattgctctctaggttagttgtcttgtcctgatgcagatgctagatgcatcaggggcttcccacatttttttggactaccttttgtcatcacttacagattttgctcttctcctggtactatttaattggtgttagggatatctatttgtacaggcggtaaatgatctgaaccaaacctgagctgtgcttaattgatctagttatcttactttcaacatttcctgtgtgtggatattttactttcaacttagctactagtgatagcgagtttcaccgtgccaggttttcctgctgaattatctcatcctcgcagtgctaaaggctggcatccatgtcaactgttaagcatgtaaagctgcctgtctgaagtacatgggcaaggaatcaaagagtctgtaatgttacggggctatttttccagttgccacctcccaactttggcataacccagcctgtacacattggatctttgctgacttgttggttatcatggctggctgacttgttggttatccccgtaaccacgtatatagcccagttctgagaccactcaggcactctagagggccttgtcgtggacactagaccctcttttctgaggggtcaaagccaatggacctcgccaccggcctgtaccgatgacgaggctgacaaggaccttcacatggaacggccgtgccgggcacggcggcacgggtggcttctcagcacgctccttccaaattccaatgctgttgcttgtctacggctagctgcgtgcacggctcgaatgtcgcgtgtacagcagttagcacgtactacatgaggtacggcaatgatgccggttgtcaccggatgcagcacaatatgcaaaacattatgatgaattcactgggataaaaatgtgtagcaagcttgattccgaagtcaagcaacactccgctatcatgactgctgggcatgccacataaacaaaggacaagaactggggcatgccagtataaattgctagccgcaggccatccagtggcgcaaggctattgcttctttgtgacctgcaaggctgcaagtttgcaaatgcacttcaacatactcccttcgtcccataatataagggattttgagtttttgtttatattgtttgactactcatcttatttaaaaaaaattatgcaaatataaaaaaacgaaaagttgtgcttaaaatactttggataataaagtaagtaaaaaaaaataattccaattttttttaaaaagatgagtggtcaaacagtgcaagcaaaaactcaaaatcccttatattatgggacggagggagtaccaattgtcaaaaagtggcgcacttcccatgtcttggtcaaattatctcccctagtaatcgaacgccttcttcacaaggatatgcagccatgagaaatactacttgtcaattatcagtgctgccttccgctagtaaaaaaagcaaagagaacaaattcatgcatgttacaagctacagcatccacttattagaaatagtgtaatcgcagccacgctgcatgaacaggtctgcatctgcaaggggccttcccttcctgaaatcttcagcaagtccgggaattccggagaggaaagaagctccccttattgtaaaatctgaacttggagtgctacacctaccagaagtaggcacagacagcagcccagaactgtgtggatcgtaacatggcctcgttgaaaagccatgatcatctcttatctctgacggagctaccgtgacacgatcagcagtgttgctcacgaaggcgttctgaggagcagctgcagttggtctcagattgagctctgaacctccatatttgttgcaagttgagaccatctcgtcctttggaaatgagtctgttggcaaccgaaacaagccggcaatgcagataggtatcttgatgtcatccactatctctctgtggtaatcatctaccggagccgggagagccaggatctcctgccggtgtgggcttgaactggtctgttcctctgtcagtgaaatggtagcgtcgtcattggcaggcaaattctccctgtcatggtaatcctctggtgcagggagagccagtatctcctgatcaggagattggcttgagctgcagagctcatctcttgcagaattgaactcgtcgtcgacgggggagtagccgtcgtcttctgaatgttcatggtcccctggtgcaggaagcgccagcgtcacctggctgggtggaactggcttgctcagcttctgactcagggaaatcctggcaagctgaagtgcctgaagaacacactctatgtccatgttgctcgttggctgttgatctggccctgcatcgacctggttgtcgccatggtcatggaagcgtgatgagctccaatcagagaccttgctgttcagggtggcatcactcattgacgggctcccatctgatggcgctttgatgtcacagtagcttgaacatccatccggattctcgtttccttgttcttgattcttccctgtcattgtgccggcgacattagagtttccttgagactgtgcatgacagtggccgtgaagctcctcgtgcgagtcacgttggtcggctgctgcttcttgtcctgatgtgtcttggggtgattcaggaagggaaccattcaacagaagtccagcagagcggttgttgctggcgctggggtgatttttaacgcctggttttgcctcttcgttgcaatgaaccgcttgatccgcgagcctagaatgctccttgctctgctcccaaccattttctatctggcacgccttattctctgcctcaacatgaacctggagctccaaagacaaaagtatgagtaaaatgtcaaattttgaaccaaaacaaccaggtttcactcatgatactaactaacctgtgggtagcactctgcagtgcattttgttattaaaaaaaagcattttgagagagcaaattatttatacttatcaagttggtggtacacatttttgtactgcatgtgcactaaatttggtagcatgtggaagtcaaggggaagttgactctctctgtggcgtagttcatggtacaaagttatgagattatatttttgttgtacacatgtactactgcagaagttgcttcatgtgaaacattttctctggaagtggaagaatttggtatcacaactctgagcagtgtttctgtgtaactgtgtttggttgcttaccttggctgagctccgattctcgttgaactgcttctcccactgcctctgagcttcttcctccgcctcatactggccgatcagctcggcctgcctctcgagcaccctttccatctcgccgtccttctcgtacctgatcacatactgaccaccagcaacctcgccgtccatgtccgcctggccgtcgtcggtgcaatccgatccatcttgctgccccttctgactccaggcgatctcctcgacgtcgccgcgctgctcttccggcgccgtcgacttgccattgctgatgagcagagccgtgggatgttagaattcgacaaacaatggcgtgtgcggtgtgccagcgtctatggcgggacggagctcacctgagctccttgcgcttgttcttgcggcaggactgccccatccggtacttgggcgacgggtcggaggagaggaggtagaagtagctcctccggtgcttctgcttgagctgcctcgccttgcgcgggctcacgctgcggcctttccacgacagcccgccgccgggctcggccgtcccggacagcgcgtcctccgccgcttcgcactgcgccggcggctgctcctccccgcgggagccggccgtgtcgccgtcgctcctcgcgtcgcgtgggtcgtcatcctcctcgccgtcgcggtcggagcccgagtcgagcacgtcggagaggttgccgccgaagccatgtgactccagaatacccagcacctccgtcgccgcccgctccgcctgccgcctctgcgccgtcaccgcctggacctgctcctccagctccgcaacctacaaccaagtgacccaacacacgtaatcaatggcgcgaacgacagcgagagtaggctgcccctgcgcgcggtggctggctgaccctcttggcgagctggtcggcgcgctccttggcggcgcgggagacggaccgctcggagagcagccgcgcgcggaggaagtcgacggtcatggccgtggagtccgccatgcatgccaccgcgcgcacgctcacgcgctccccgagccgagccgcgagtgacgttgctgcgtacgtatgccgctccgcgcactgtcacatgccggcggtgtggcttgaccggcgccgcgtattaaaaacggcttggtttcccgtgagccgcgcacggcgcacacgcagcgcgcgtcgtactcgcggccgcgggcgcacggcgcaccgacagcccaggacagggagtacgctacctacgcgcgacacaagcgccccgctgcagcacgagggccacgggctgacgagaccaccgcaacggtgtagttagctaggctgcgccgtccattttcaagggagaatggcgatgcctcacctacctgtatcgactgatctgcctcctgccctgtccggggtccagtggcatattgtcaatttggcatcttacaaaatcatgagagtttggatttatggtgtactgtgtacatgaactccagtagcacttgtttatgggggtaaattcgtcgaggacaagagtagtgaacgtggtacagctttgccatgttcgagcaacgcgacgaagccagcaaaactactcgtcttctcttgtgctactgcctactgctactggtgctgctccaaaaatggccgagatctcaggctgtccttgcttggaatctttctgcttggatcacgaacttctaccgcacggaaacatttgagtcttgcaacggtttcgataaggtcattcaaagcaaagtcagctcatcgtgcatagaacaatacgtcttcaaagaccatagcggcaattatagcatcgagtaacagatgtttccattaaaaaactttagaatacacatatgcagggtgttgaggccgatgatcaagcaatgaccatgcggcagattaatgcagaccgtaaccacaatctcaggtacttaaataacgtcatacccggtaggcgggtttacaaaacgttttcgtaaacgtttttagccgaaatttcgctcaagaaacattatgtctgcttagtttgacagattcaaacaagataatgacgatatctcaatcaccgctggcacagcctctgcatccacagtgaacacattctataaccttctcctctctgagatgcttggggacccggcagacgcatgtagttgcaaagttgtggtctcgtgtctgtatgcatcgaagacagcaaaggcgctcataacccggctgaaaacacacaaaaagaagcaatgatacatttgatataagaatgcctgacaaactcttgtgacaaaaaagcatcttctggatttgcatctaaaaagtgactgaaaactttgacagttgaattcgtcacgtacgtctcacaatattcttagggcaatttaggcccctcgttatcaatgttcagacaagtatataaagtagtaatatggaacacaagtattgcatccctcccaaatctgccaacttttatcagatgtccaggaaaaaaaatatcattgggtgttagaagtctatccatgatttgatttctggttacatcagctgctagtatgccaataaaaatacatagcggaaaatatataaacatcttttagtcaactgccttttctttttgctcccaaaatcttatttttcatggtgcacccatataagagaatatctagtccataaatccccacgtcactcatgctgcattatttcactatttcctacggttcattgcaagaaatccaataaggcactactcaactttgacatacagctattaatcgcaggttcatacatatagattagattctaaaacaagatttatgatgtgtcatgtcaaactagatcagtatgtgatagcttaacccaatataattgatttactgcaagaaatggtaggatgcggttagtttagtgttttatttttcatagtacaagtacaaaaagtatggttcaaggcttcaagcagttaagttacattctaagcatggggaaaaaatgtgagaaacttagcggtgtatccaggggtctatggcttcatctgaattatctttgtacacaagttaattaaagtcttaaagattatacaaggtggataaggcatcttactaaactagcacagagtataaggaatgatgggcatcttacagagcaaatcatgggtcgaatactaacctttttccactttgcaatcagattacggtctgcataaccctggtccaggcaaaactcatacaactcttttgatatctccttccttctgtaataaagatcatatatgtagcgacttctttgatgggaaatacggaaaattggccagagggcttcgcactttctcttcccatcatgtgtgtcattttcagctacatgagtagatgatattagtatccatataagagcagaagtatcaataaacatctgaaaggggagcatatgtcataccttccctcattttggcatccaactcacggatagttggttcaataagctcccatcctccaggatatttgacacggcttgtctttattttaggcatgttctgtcaatgaacgtcgagcggctaaagcttgcaaagaaaccctgaggacatagagtaggtgtaagattcacaatgcaatacatttgcacggtcaagctcttccatcgaactcaagagattataagaacataatacacactattacatagaatttagccccacattgaagccttacatcagatatgctatatattccttactataaaggaactgtgttgaacacaaatagcacaacttaaacaggtattttgcatcttcaggctaacagtcttgtcgaaccatgatttaaccctattttgcaagtacaaaatatgtgcacctcgaatcggtgaatggacggtctaatacctaaagaactaatcgacacgatgataaaaatcgtggaaaaggttccccaaaccctaggctactcggaagttttttttttgagggaatactcggaagaatttcgtcccaataaccacatacgcgagaatttcgtcccaaggaggagacgaattgaacggatccaataaacagcgaggtagaaactactaaagcatccagcgaatcatcttcagggaaaaaaaaagggaatcatggagcggaagacgaataataacctcttggcttgggcggccttgcagtcgccggatggaagctgtggcgcgcgggggagcggcgatccagagggggcgcgcgtcgtccacgccgttggcctgcgctgcgctccgctccggtcgagcaaagacggccgaagaggagacgggcgggtttggagtttggaccggagctaccagctatatgtcgtgattctttttcccctccttttttttttttgagaggagctatgccggtttgacggttttctcctctggtagcagtagtatttgctacatcatgggcctcaagaatcaaaacgggacaccaactgtgctgaaatccaattcggcaaacaaggttggtttggtttgtagccagggtatacgattccgacatgctctttcgtttcggacaccggtggaattcgaaatttttgaaatccggtggaaaaccggtaaattccgaacaaatttcataaaccaaaatttgaatacaaatccttgagtttgccggcaagttctcgaaaaccggtcggttttggcgaaattccgatcgaaatcatcaaaatttcgatcagtaatttgttttcttttttaaattctttattcttttctttcttgatgtaagtttcagtaaatatacataatacatcatttttcgaacatttatatcccaataggttctatgaatatcatactccctccgtttcacaatgtaagtcattttagcatttcccacattcatattgatgttaatgaatctagatagatattgtcgaggagcgatcctctctagtaggtggtcgtgagacccccttttgtgagttcggctgggggaaatggcgcgatgacaggagtttacttccgctcgcagtctagctgcttgatcgttgtcgggactgtatgggagatcgaggattatacaggttcgggccgctaccgagcgtaataccctactcctgtgtgtgggattatggtgagtttttacaagggatttcaagctccgacggggacctagctgttcttccttcgagcttgagttctcctcgagtcctccctttttcccggtggtaatggtcctccttttatagttcaaggggataccacatgcaccgtttgcacctaccccccacgaaaaggggtacccacatggtcctaatcatatcgctatcctttgcttcaaccggaagcaacatggtcgcctggcttcaggtggggcccaacgccgtcctccgcctgacacgggggacatccctatcattctctattaattgtatgaaggcttcggcggcccatcacgcgcgtggggcgcccctagcagcgtgccgacgggacagggcacacctgcccccactccgcctgacacagggtggaacgtgggggcactgccctccgtcccgtcgcctgtgaccggtcacaggccggtcatgctcgattgacatgggtcaatcgagcggcgccgcacgtcccccaacgccgcattgaatacggcgtgggacggttggggtaccgcgcattaaaggcgcggagcatcgtctttcgccccgcctcctctccccgccacgtggtggccaggtgagggccccggggtagcacgccccgaaagcccgaggggtgcggcgtggcaccccgaggctccctggccacctctctacccgaggggcggggggaaacgaggccgtgtggccacgcgaccagatgggaaagatatttccctttactgtgcgtacccctgggcccatttcaccgacagatatatatgtctagattcattaacatcaatatgaatgtgggaaatactagagtggcttacatcgtgaaacggagaaaatagtatttataagattttttattttttatcaattcaaatttgaatttggatgaaactcctcaaaatatctcagacggtttctactttcgagtctcgtcgaaacatcgaaattccgacgaaatccgatcggatttcgtcggaatcgtaaaccctgtttgtagctcaactttgctaagtcaatatttatgcaatgttaaactatatagaatataaaacgattggcatggttgaaagccaaatgcaattttgataacaaaacaagcaaatgcctagtcagttttgttaaaaaagaaatcaacaacaccttattcttaaccatgataaagtttgataaagtttattttaacaataaagtaaataaaatttaactatattactccctctaggtcttttaatgacattggctagtttgaactagccagcgtcatatatacgaagattatggtggtataaatttagttagttttatttcaataataaaaggaactaagcgaacactctttgtttaacttatgatattctatcaagcccattcaaacaatgatattataacgaaacacttctctatctctgctattataaaaattaaagatgttttaaccggtattttggtatatcatccatgtttgagtcattttttaacttccttcgcttttagaaatacatatatgtgtttgagttagaatttaagctcatttgcttttgaaaatacaaaagaagtcgtacaagaaatctcttttagaaaatacccgcatactaacttaagataaaaatcggactcctaattgtagctcgtgattttctaaaagaaaaatccaagcaaattcctaccgtgaattttatcctttctaaaccgtataacaataataaggttaaaatagtattcacccgttgcaacgcatgtgtatttttttatactaaaaatgctcgtgcattgcaacgggtaaaagctattttaatcttattattgttatatggtttagctaggatgaaattcactatgggaattcacttggattttttttagaaaatcatgagctacagttaggagtctggctttcatctcaagttagcatgcaagttgttttaaagaaatttcttatacgacttcttttgtatttccaaaagcaaacgaacttaaaatccgactcaaacacagatctatatttccaaaagcgaatgaatttaaaaacctacttaaatacgggtgacgtaccaaaataccgaccggtaaattttttttcaatttttataatagcagagattgtaaatcctatcttagtataaagttatcccccactaactccttaagcttaacatgcaaagatgccacatcatcatccactaattaacaaaatgctacatcatcatccactaacaatcatcacatttaaacatcatgcaaacatgctatatctttatagtttttataatttaagagcttttcaaatacaaatatgttaaattatcatccaatataattcacataatgtttcaatgtatatctttattatgttttatgatatcctatatacttatatagttcatccttaattagttagtgcttaaatgattaatctatggtccaaattatctttctccttttttcctctaattaagtcatatcacatcaattgtttttagcctttagatgattaatctacggtccaaactatctttctgcttttctttttccataaagtcatgccaccttactttttacgtttgaatcaacattctacatactatttaaatttaaattatcataaaccatattaatttacttaatttgatgttatctaactatcttgcacgttatttttttattgttatcatactaaatttccgcagcaatgcgcggggtttcacctagtatctcaatgttcacaccacaacacattcagagacaaacatccaccaggtgcccccatgagcggaaactctaatgggcgatcgatcgcccatcccatcgggtagcaatcgccccgcgccccctcccccctctctcccttcacctggtttccatttttttcaccgcattacttttctattttagtaaatttatgcatctaaagtttatacaccttaagtttacacatctaaagtttagagacccaaagtttataagtcaaaaatttatgtatccaattcaaatttgaatttgaattcaaatatttttttttatatatagtatttttatacatctaaagtttatagacctaaagtttatagacctaaagtttataagtcaaaagtttatatacccgtttcaaatttgaatttgaattatatccaattcaaattttaatttgaattcaaatagtttctatatatagtatttctatacatctaaagtttatacacctaaagtttatagatccaaagtttataagtcaaaagtttacatacccgattcaaatttgaatttaaattcaatttaaatttgaattcaaattttatagacctaaagtttataaactttttttatatatatagtatttctatacatctaaagtttatacacctaaagtttatacacctaaagtttataagtcaaaagtttatatacccgtttcaaatttgaatttgaattatatctgattcaattttgaatttgaattcaaatattttctatatatagtatttctatacatctaaagtttatacacctacaatttatagatccaaagtttataagtcaaaagtttacatacccgattcaaattttttatatatagtatttctatacataaatttttctaacttttgtttttttaaaaaaaattagtggtgtactgtaataggaagagaagaagggaagaaggaaggggagaagtaggaggaggtacgtattgcctataggcggaggggtggtggcggatgagtcgaacatggaaggatccgagccgtctgcccaatttaatggaagcttccaagcgcaaccgccgaatcctcctccatcttcggccagcatagctcctgcctggccacccccaggtttgctctcgcggctcttccctcaccggtgcgccgcaccgtccaccgcccgccggagtcgccgtcgtcgccgccgagaagagggacgcagctgccgtgcgcggccgagtggatgtggtgtgaggcggtgaggtggagggaacacggggagctgggcgcacggcgcttcgagaccgccgcccgggcgcgccgcaccgcctcgctcgcgctctccaaccgcaaggagttcaccaccccgcacaacggcgccatcaactccctccaggtccacccccttcttccccctcactccccttttccttctctcaccttagaggcttagatcaatttgatttgtacacccccgtagatggaatcttggcgtatttgatgtgcaatgtgtgagtcgctcccgctggtgttttgtaatttcacaatatggtcaggttgatttgacagagcggcggtacctactcgctggcgcatcggatggatcagccgctatattcgatgtgcagaatgcaaccgaatacgaagccgggttcattgccaagcacaggagcattctgcttgtggacaagcagcatgaaaatggccacaagttcgtggtatcgatggccgtatggtatcctgtggacactgggctgttcgtgacagcttcttttgatcagtatgtcaaagtgtgggatactaattcgactcaagtatgcattcatctgctttgtggattgcttatttttcttttctcttgcctcctttggtggtggcaacggtgtgatcctgatgttctgatttttgccttggctttcttttcctaggtcgtaatggattttaagatgcctggaaaagtgtatagcgcagcaatgtccccaattgcaacaacacatatgctgatcgctactggaagtgcggatgttcaggtccatttatgtgacattgcttctggagcctttacccacacgttgtccggtcatcgtggttagtttcttacttctagtgcagtgatgaaaatatgcttgctttgtttgtatggttaccaccttatccttggtatctgacatgtcagatggtatcatgtctttggagtggtctacttcaagtgagtggattttgatgagcggtggttgtgatggagcaatacgattttgggacataagacgagctggatgctttcttgttcttgatcagtcacggtctcaactaggaaggcggcctccttttcttgagggcacctcagataagatatggtcaccattatccatcacttacatttgttttcagaatatttggttgcaatgctaaagctggacttccactattattttctgcaaaagcttcaaaaatgttacagcttcaagtaaaatattatggctgtaatgctagatcaatacagtcagccttcaagtaaaagctgatttctgcggctattaatttataggtttgtctcacatattagtgtcagtatataggtgctatggtatgtttagtgctccaattcttacaatataaggtctgcatacattgtttcttgttgattgttgtgtcctagaaatgacgcgcaaactcagccttccactctagttgtgcaaatgatcaatgtattcatttttaattttgaccaggatcctttgaactctttacaaccttcatcttcttcaaagatttactctgcacagcagaggacaggcaagagtaagaaacagtcacacaaattgcacaaaagtcaaatccctggacatggacatatccaacagagattgcaccctggtttgtcttctagtcaaaattgtgcaacggcacattatggtgctgttacaggattaagaacaactacagatgggatgtaccttcttagctcaggttgattgaatttaattgctatttctatgagcattcgattgctattgcttgaaaggaattattgtctatggctatcttcttgttatgcctgtatgcagtatgcattaatgattgttatcctctctcttcaggttctgattctcgcttaagactttgggatattgattcaggctgcaatactttggtcaattttgaagctatgcgattacagactagcaaaccgctacaattagctgtcactgaggatccatcacttgtattcatcccatgcatggcaagcattaaggtgtgttgtcattttttagcttctcagtttggacgctgaattttagacttcaccttgtgttgccatattcatgtaggcgtacaatttatggtctggtatgacatttcaaacattccgggggcactatgaacctgttaattgctgctactgtagtgcacaagaacaagtaagtcttccctgtactcctatcctctgttaaccctgaatgttcccgcatcaataccactgctgagtcttttggaatccaggagctttatactggcagcaatgacatgcaaattcttgtgtggtctccatcaactccagcgtttactgaaatggtatattttctatttcttgttatcatatatctttctgtagaattttcctatatcctatcaaattcaaatttcttaggagtagtcgggcatattaggatattatcgcataagcttttttaggcatttgattgttagcacttctaagcctctgcaagaagatgatggcaagaggcaaacggattttgtagtcgatgacgataactggagcgactgagaattattcatgaggcaaacggattttgtagtcgatgaggataacttgagcgactaagaattatgcatgtatagttgtattatacactgaacattgagcgactaagaattatgcatgtatagttgtattatacactgaacattgacattagggatgttaacaggccacgtttttttttctttttttctttttttaaggggagccacgtttattactactgtacagtacttcatcctgcagtttcacccgaaatatcactttgataaagacagctaagtgaaatgtaaatatgccagattctctctccgataatgaaaatgctcctatgtgtttacccaactgttatgatatcatgttaacaaagatacatcagatctctttatctggtaaggagcaaggacagaaatgctcctatgtcgtagggtcgtgctccctacgagaacttgagcacagcagcgaagaaatgcctcaacacgttgctgttgatttgtttaaaaaagcttcgacagcctaacaactcaacaatccttaaaaagagatgaagcaacaaggctgtatgacttccaaaacttaaacagcgatgcatgaaattccacctaatatcgtgcagtttttcagctgcatcaataatatgtttaaggaaatgaataagaatagctatcaattataattacaattacaattacaattacaacagatttagcgaatctggatcgccaaaggcacttattgcacttatttcagactaatgtcgaggaagaatcgcatggagtgacagtattttctattttcaaaccaacctgcaatgaattgctggtcccaaaacgcagagaacctcgcagctcaggtaaagcttcagtccataaggctatacagctctgtcgggagttccaaagataatcagttatattgcaagcacattgcaagaagtcaatacatacaacccaaaatggacacggtgatcagaataacagtagaggaaagaaacggatgaaacataccacagcatgcaacagtttattgtgtagatggacacatgcagattttcctgatatgcaaggagattcctcaagtgtgctcttgtttcttagatcctctgacaccggataatgcctgcagcacctccatagcacaaccatttctcgctacctttattcatgttccatctcaaccgatgcaatgctacagctttaggaggaaagacctcaaaattttcaggggattcactacccctgctggtgcttgtgtcaaaattctcttgcattgaaggagcagctaaaactatggcaccggtttcttgtccttcatcaggttcatcttgttgaccatctctgatgctcggatttatagcaccattgtattctgtatggtggttaagcaggcatgtcaggtacaagcaaaatgatacaagttgcaggtgacagagattacctgagttggtaagaagtttcccttcttctataacatgcaattgagctacatctttgcaagttttagtagcccgtttggtccccagaggaacatttgacaaaggagagtttggtaatgcgataccaattttaatggttgttccctcctctgataatgaaccacaaagaaaatatggtacacggttcctcccaggttccttttcccagaatctcggagtaagctacagtaagttgaatatttctttagcaatgttatagagaatcacaatagcatgcataaatcaatagtatatgtgctgtttagtttacctcaaagcaaacagcagttccatcagccacacaataagccgcatagcctggatatcagcaaaacaaaattacaaattcatgaattatcatgaatatttgacatttttactctgctcacatgtggggaactaaatattgatataggctataaccaatattccgatacttgacatctactatggttggacatgaggtgaaatgcacctgtaatttctgaggcatggacactccagatcaaatattcagacaattgataggtagaaacaccctgagttttcgttccaacaaatggccttccagtaaaaggaacatcatttgcgattcttgacaagctaacgaactttaatgtgccatcttccaatgatatgacaacacctctgaacacaaagataaaaatataacagttaacattaccattctagtaaacaaaagggtatgtctggcctatatacacacaatatcaccatgaatgaaacaatgtggtctatgtaatcacgtctactttgatccagttatacatcaagaccatgtccagcgaaggaagcttgcatatttagaaggtacgtgggcaaatacaaacatttatattaataattatgtaaacaagtgcaaatagagtgtttgcaaaaaaaaaagtgcaagtagaattgcttaaaaaaattctgatgatttaatggaacaaattatataaacaaagacaatatccaccttagcacacaataacagagaagtacaggtcctatgaaccacgggctaagaacataaattacatgactaaaacaattgtcaatagcaaatatggtttctagtatgtgttccaacattaatgaaaacatacatctccatttaaaattagtgcagtgtttcaaagacaaggaaaacagcgtaaacaccatgttagtgaagaaaaatcttgtgtaatgaagaaaaacaagtacatttagtgcttaacaaatattaccttgcatccttcaaccattgaagacttattacggcccttggagcagtagttaactcccaaagatgacgatatggatctctgcagcaaagaaatcttatgagatgcactaaaattcccaaatttacaaaacaaaaacagtagaaaacaacagcaaatccaaggcggctgtgacaggtagtgatttaaccataacaatcaatatatctattagacaaacatactgcagcttctagaacaagtttcttagcgcccattgaaaaattaaagaaaaaaaccgtatatcgcactggattcataaagaaactcctactgacatcattggtccatgtgataataacatattctgcatatcgtgcctatcttttgtttgttaactcggaatttttaccattaggaaacaaacagaaacaaatatgaatggttcagaaattggtgggtgccacgaattcagagaggaagggggagagactaccctcaatgttaagacctctgaggacccatacataatattagaaattcatgcaggataggagagtagtttgaaagatgctttaaacattgcttcagttcacaacaaggccaacacctaccttaaatcccagaatttcagaccatcctctccagcagtgacaaaggtattcacgttttccttactgacagaatgacaagagtcaaaactcaaaaattatcttttggaatagaccagaagtaacagtacaactggctacctcacagatggtgcccacgacacggttctgatgggagcagattcagcagttacacacataaaaggttttgaacctgtttatcaacagaacgcatgatttagttttgtttgcaaacagaacagaataagaaatgcgaagatttgggaactccagtaacttgcttttaaaccaataaagcagttctacagtcagacatgttgtcaggcaaagtgtaaatgataactgataagagtgacgtcgttggcaaaactatctaaataccttgaaatgacaggtttgcagagaacttccataaagcaacctggaatataaaaaaaagtcaatcacagaactttcagaacagcaacttgaaagactcaaaggtcacaggatttatgttaagaaaataattttgctgggtaaggaaaaggtaccgttccatcgtgacatcccgccaatatcatatcatgagagggtgaccaatcaactgtcaagggaatgctgtttaccattataaagaggcaatggcttcaaaattaaagttcatgctgaggaatttagaaatatatccaaatcttccacctagtttgagctactactagcaaaaaaaaaagtctacaggtccaatacctttgtctgttcccgcactttactttggcagagctaaacacaggcttcagctttaaaaatcgagggtcagtaccctcctttgaagaagaggaatatattttctgaatcatgcttggagatggaacttcccatctgtgcacaaaaatgaattacaagatgataagagggggtgatagatatttaaatgagataaataaggatctacaagagcatacactcacacttcaagcgagccattccccaagagtactgcaagaaaacccaaacatgatttatgttctgactgatttgctgaaggaggtttccattttacgtcccaagcaacttttccattatgagctaaacataagacaacccttggtagagaaatgtcttttgggacacgagaaagggtcttttctgcagaacaaatcatattatcatctttagttgattctttgaatcgagccacttctgtatcttttagttcatcaataacctgagcactgttttcggaaggaacagatacagcctgatttgtctctgcgttttcaaagttacaagcaggagtacaacatgaagtatatgcagttgatgcagaagatccgtccatgttctgtgcttcaacactaagcactactgaacttctttcatttgaaacagatttctttttatcttgcactctgccctttccgggacatgattctttcttgcaattttcaaccaaggacgcattgtcgcttgacttgggaattgtctgagttttttgttcttcacccctgcatgctttagaacaaccgcattccgttgaaattggctgctttctaggtctgcctctacccttcttggcacttgattcttccttgcattttgcaagacatatgccctgtgctggtgttgcagcatgagatgttccaacactcaaatggacactgttctctatagcacagcttgatggaccaatatcatttgctaaaatgtcacaattactcttggccaagaccacgagattatttgaattggtcagagtagaacctttctttggggtctcagtaccaggaacaaatacacaactggttgtactcggaaatggtttcttcctaggtcgtcccctccgcctcagaccagttgagttactcttgttgcctgattcaggtaaaatatacgtaggcaacatggatcctatgtcagactgtccagattgcatggaattctcaatatgaattacttccttttctggctgttctctacccctctgacctgacaatggaactggggaggctgcatcaactgcagcatgagttatattagcaccagacccagtattttcagtgggacccaaaccaaaatcaattgaaccaggctgacagacagaatcatttcctaattcagtatcagtgcctggaagatgcttgctgttgcttggagcaggatactttcggggcctccccctttttttcttgggctccatgcaggttaaagctattggagatagagctgtagacaagtcttctgttagtttaatgccagacaaaccttttatttcaacaggttttttcctaggtcgccctctaccttttcttggagttgattccacaggattaacagttggcatgggataagctattgcaatgtcacatgaaacaactgctggactgacaagaggataaataagagcaaactcttgacttctgtcgttttgggatgaatcttccactttggcaattggcagtggatattttcttggtctgccccttggtcttttgacacttggttccaagtgatcatcagaagttgtgatggtctttcttggtctacccctttgttttggttgattggatggattatatttattgcatgcaaccaatgactgatgaggatgaccctcttcagatggtgctaggagacaccaaacttgaattatacctctcccgattaacggcatgccaattttatggtaagaagaaccaggagggtgagcagcaacagcaagatactgcaatgtataggagacgtgcaaataaggttatcagctctcaataacttgtactcttagtcatatactttttttcaaaaaccagcaaatacttgaagatataaaccataaaaagaacataatactaatttcatagacaccgcacattcaatgcaatcatgcaattagtctgcatgcaaagatgtccttgggaagaactcccttcggtcattttcttatacatgctttatctcagcgcaaggttttattaagtaaaaaagaagtaaactgccattttatcgtcctgcaatgcacagcacatagaactggaaatgttgaaccagattcactgctttaacaagagttggaaaagatgagaaattttactttgattcctgtgagcatctaaaatgggaaaaacaaatacagaaaaccaaatatgcctaataaaagtaaacgtggggagtactgcaagagatgtctttaaattcatgtcaccataaagtatgtcactcagtgaaacatgttaattttcccattgacatatgaactaaagagcactcatcatactcatagtcacagcaagtagtggatattggaacaaaaaatatgctgatgcataaacaattttgaagccacaacaagagaaaactttcagtattatcatagttataacctcacagtttatgggagaatgaggcctgtcacacaacctagggcaccagtccaacgcccaaacattgcctccggcaaatataacgaaatctgagctgcaaaagctaaaaaattattaaacataatttaatcaagatggcttcatagagtcaaatgggtatgaaaagcaaggagaagtgaaagaatatatacatggcaggtaaaaaagtattaacagtgtttatcacactgtgaggcaggtactaaataaaatgagaagtgcaaaggcacaaaaatagtattagatcagatctattttcatcaatcacaaaaaaaaaaagcaaccccccacaacccccaaccccaaaaaaagaaaaggaagaaggtttggcacgtttgccaaacccaatgtacgattgttcttctggaccaaaagaatgacccactactcccaagttgatgtggttagtagttttgaagtgtgtgcagtcaatttaagaaaccttaataactagcatactcttagtagttttggagactgtactgaaatctttaaacaagtttggagggctttcaaaataagattcaagtcccgcatctcgtgtttcatagaagacctactcaaagagatcaaaggaggtattccctgaaacctgaaaactactaaccaatagcaggaatacaatatatgttgacaattagtctgcttattggtcatgttacagcaaattatcaactagtgaattgccaaaggagctaaaataatacataagcagacatcttgggttattcctaatatcaactgagaaacttaacatagcctatctccactaacagtatgacctttattgacaaatatggggaaaaaacagacaacaagataactagattgacaagattctaaagtagtacagaaagaactccataaacaatacctgtctgttttagccttcccattgtctaggtgtgtgatctgcagtgtgatccgaacttaattatgagaatatggtccaaaaggaacaaaagatgatataagaaatctcattcagctgaacacaacaaaaaaatagcctcaagaacttagcgcaaggcaccaacagcaactgagtaataacctgggggacagatgcagacgagaactgtggtaagtttatcttgtgtgtgtcaactctggatggagctgatctggcgtcacaagtgaaactaacattttttggctcataagagaagtgcctccattctctgcaaagatatgaaataactagcagattaggtactaaataatattgattttttttttaaaaaaaaagaaggcaatcagattagacaaatgaaaaagcagcttgtgaattccatttaattgatgctcagaatgactgttagaactttccacaatctgttactcttggtgctgaaaggagtcgtcctcatgtgcataagcgagctgaacacggcgaacctaaaatctgacccaactatagactatactatgccaaggaaagtggtctaacactatcagtggacaaattcaatcattgcagatagtctgtttggacaaaaggctaatggttataataaatgcagataatttatctaatgtgaactgctaatagttgacacttgacacatttggataaaaaccaatgcattgcacttagggagcaagtatatgtgacaatgtagaaattttagtcagtaaaatttaaaatgggcatggaggagaaccaacaatgcagcacgttgaaactatgcagttccaattgatgcaaatcagcttacagtgagatggatgatactagaaagctaaggttctgagcagcctttgtatggctgtaccagctgatcagtctcagttgagtttaacatccttatattggtgggtgctaaaacacagtgagtggtgctttttaaaaaaaaaaatctttctggtgaacactgggcacataaattttttcttctactttaattggtgattaaatcaaagagtactaactagttatagcatgctactataggttgctaataactaaagctgttactgaaactgccaatcctgaatacaaagtaacagctaacaagtagtctgcacaaataaaggtggggctcactgacttagtgacttatagataaaggggatcaagtttcgctactcctctgtgccttaaaccataacatcaaatggtaagctagaaagtcacaatgtgcataaatgatcatcgatcagagtcatcaaacaacaaatgagtacagattaaggaaatatatctaccagaacaaaagtgacttaaacttagtgaattagtaataaaacaagtaacagtgcaactgcattttgttcatgacatgaaaaaaaaaatccttgtatcgttctaatcaatagaaaaacagaattgtgcattgagctaatattgttacctaaggacactggaagtaagaatatggccaattgcagtggcaaaagccaaatgaattctaatagccacaacaggaataatgaaacggcaccaaagcattcctgtgacaactgctttttttctgtttgtgtggcagcgatgtcttaggatctaaattaacaaattccaataaaatttgccaccgtgtgtggcacataaggcaatgaataaactacagagagcttacatgccacataaattttcccattgaaagctccgtgaaattgcatcaatgactaacaaattaatgctttgctgataaacgctactattaaacacaaattcgtccactccacccagctaaataggccaacaacagaaagttaccaattttgccgcggtgattaggtaccggattagacagagcaaggagggagtttctcacctgaggaaagttattgaggaggcgagccgctcgacttcggcgtcagggaagttcggctcgtgctccccggttgtgagctccgagatggcgtgcaccgctctggagaagacctccggtgactcgtcaaatacgcagacctcgacgccatccttaacctcctctccttcagtctggggcggcgcccccgtcgcctccggcggcgccgccatcgccggcgaatcgagcaaagagagagagagagagagcactatctagggcttgatgagcggttgagccgcgggaaacgagaatataggagggaatcggcccaattatgccttgtttgggtttttgggtcgagaagtgcaagttccgccaagggcttgagatcggcccaattaagcagagcacgccaaatccggtggcgagcaacgccggtggaggcctccgccgtggtccaggctctcgcgagccccacacgacggaggcgcggagcagcagccgcccgctgcttgcgtgcggagcgggagacgacggcgagatacgtgtccgctttgtttcttctgtaacgtgccgcgcgccgccgaccccgcgccaccgcccgcgcgcagccgccgccgccaccccgcgcctccgcccgcgcgcctgccgcccgtggccctcgccgccgcgccacccgtccgccgctgccgacgccaacgacgccgccgccgggctaccgaggaagacggaggaggagagagaactggaggagatgtggtatgaagggatagttcagtggcattgtggtgaaaatctcaatctctatctctatctctatctctactattataaaaattaaagatgtttctacggtccgtcatccgtgtttgattcgattataaaaattgaagatgttttcgcggtttatcatccgtatttaagtcagttttaattttatgttttggttttaatctatatctcttctctattatattataaaaactctatctttatctttatttttacctatattatataagtttaagatgtttttgccagggatttttgtaagtcgtccgagtataatgcgatgcgcagtctgattccctccccgtgcggttttttgcgatttttctaaaaaagataaaagaatcggactctaatccaaccaaataaagtcagaagagagatccacaagaactcaaatacaccataaaaaaaatccacgagtagatcaaccgattgctcccaacccctttgcccaaaaccacaaaatcactcagttgcaatcccaaatcaaaatcaagaatccccacaaaatcaacatcccaaattaaaaaaaaaactagccgcctcccacacccgctctcctcgtcgtcattcgccgccaccgtcgttgccgttgtccgcatcgctgctttcggccgctaccggctcccgagcccaccgccgctcctagccgcgtcgccacaccggggatggggccgacaccgtcagtgccgtcagatccaccgtgggagggaggcgagaggggtcggacggagccgccgccgccagatccgtcctcggccgccaccaccgcggccggatccacccgcggtcgccgtcgccggacccatcgcacgagaggcgagagagaggatgaggggaaggacggtcagaggaagagagagggggagcggcgccgctggtgggtggagggggagcgacgccgctagggagggggagaggcggcgcgctgagagagagggagggaggtgggtcgcagtggggaaggaaaggggtcagcgaatgagggttagggttagcggttttgatggattcagaatcatccgagccatcgatgaaaatgaacggctcaggttgatcccgtgtcgggccggcctctcttcccgggccgcaacactgctgggctgttgggccactcgcgcgaatgcactagcagaccggcgggtctatactctaaagaggccttttctttcttttttttaaccttcattatttctctagaaatatattttcttaaaggcccatataatgtaaaactcaacataataatataatattttatatttggtataattttagtttacccgttgcaacgcacgggtattttttctagtacactaaaaaattaaatagtagtgggtcttttggggtggagtggagctgtggagcagaaaaacccagctccacccccgtagtacaattttgtgaagtagctatgccaactctgctctaaaaatagagaatccagattgtttggcacagttttggttccacgtaagttggagtgggagctagagatggccaaatggggccttagatactcatggcatgcttttcaaactgctaaacggtgcgtttcgtacgaaaacttttatatgaaagttgttttaaaatatcagattaatccatttttcaagtttgtaataactaaaacccaattagtcacatgttattatcacctcattttgcgtaaaatacttaatcttcatctttatcttcaggagattcaaacaccaccgtagctagagtttaggaaagaaacggagaaatagctcgcttcggtcttgttcggtattgagaaggattgagcgggaataattccacaccacaatagatgtggaataaatccgtttcaattcttccctgaggctttgttcggtttgaagtggattaaagatgattgaaggggattaagagagaataattccaataaatttcctttaatctctgtctcaggattaaccgaacggctccttcgggggagggattccgtcgccggagtcgcggaagaggagccaaccggcatccgtatccctggacctcgcagatggggttgttcaatcgagtcggtggcccgccatcctcggatattctgtcggtttcctattgagatctatacgggcctgaagttatgggctgaaagcgtaataatacattaggcccatatagcttctgactttctgcaagacaatgaacaatcaatcggctagtaaacttcctttagagcaaggataataatacagccagctgcttacttgtagcctatctatcagctcattcatataatggttaactcttcactataaatatatggtctacctgtctgtctcacagattttcttggttcttgtgcctaagccggctgtaaacttacagtccgcttctcatctctctcctctcctctctcatccacatcagcattcagccttcttatagccctctattatatttgctcttatcttctttattattatcagcgctgtatcatcatttcgacggaatcttagccaccatatagtactccgggtgccctttcgtcagcatccaaagtcgccattagcgatagtgtaaagaaaaagacagacactaagggcacccacaatggttatctatatgctctctacaagagatccatgtcagcatattttcctacttggaagagattaaatggagagagagagcaaagttatctactaacctagagatagtctatagagaaaaacgaggcaatggattagagagttatagatacccatgtagacatactattgaggtggtttactattaatttagtctattgctgagatgtacatgttttatagataacatcttactttaccattgcagtaccaatgtgctcccgcttttccgtcactgcatcactgcatgcacgcagaattcctctggcaaatagcgaagccggtttgctggaggatgtggtccgcgagacagcggggtggtcaaatctcctcctcccgaaattaggttccaacgattagttttttctttttttaaactcatgtactccctccatacataaatattcttacaccgttgactttttaaaatatatttgatcattcattttttttaaaaaaataattaactattaattcttttcatatcatttgattcattgttaaatttaattttatatatacatataattttacatattttttaaaaaaaatttaaataagatgaacgataaaacatgtttaaaaagttaacgtcttcggagggagtatttatctaagagaactagggtcaagttacacacttacacgagtagcagggcggaatggcggatatagcacggtttactggggtacaaccagttttgcagaaagggccctctagaatgaccaaattacaaatatgtacaacattttgtagaaaaagacctacgcataagtagaaaaaacaacaggtccttctcgtcgatctgctgtcgacgccaaccgccaacgacggtagcttggagctcagcttcggtggtgcttgtagaaaggtgagctgcatgatgtagatcccacacacaaaccttggaggggcctcccaaagatgaaggttgaagcgtcggaccgaaaagagaaaaacttggcatctccacagaagatttccacttgagttcttgaaagaaatcaacataacaataggcacaacgaaaaacagctatatccaaaacaccagcaaagataacaataaaagcacagtgggagccaagatacatatccaaatgggcctccttgaatgggaggttgagggcctctcggcaaacttgtggattccatcaaccatctctttatgaactcttgtcggaatttggggaagaggctgcttggcttggatagtgcttggcagagatgaaattgtaggccggtgtaaccttcttttgtgcaaaaccgatgacacccacgacggctaggggaagaacccaggtgcctcagctcaccgacgacaaggaccaagacaacaggacgagagtagccagcgccggtgacggcgacagcgaccaccttgaggagagggagcttcgagagagagcaatagctgagttccaacgtttagttgaatacactttccgcttgacgcacacacctgaagcctttgttccggtgggctggactgctggactagatcggccagaatctacgccgcgcctagtgcccggtgatccgatcgggaccgatgctccggtacgcactagcccctcgtgcaggaaaaagaaaagctgccggcttcggtcagatggagatggttgggctctatgattgcctttgcacgggaagcgaatgatacggcaggagaggcataataagcatgagttgtcgaagcaataacggtgaaacccaacgacgagttgtcgcgctagtgtgtggtacactggtacggtatagtgtagtacggacgcgacaccgatcgttaacgagcaacacgcacgggatgtgactgtctgtgagtctgtcggagtttcagtgcagagcttggacaggaaacccaacacaggagcagtatttccgggtcttcatagttcacatacacacgagagcaacgagccaatttgtcatgaattcagttcttttacacagctcactgccgctcgatcaaaacctcaaaggtgaaaatggaacgacgtcgtcatcacacaagtcgccatcgccactcgacacggtcaaaatattcaaacagtatacggcagagcagcattattcaaccattcttatcctagattgttggctcttggctgtcctcggcacacctgaaaactactgctatagattttaaggagcagtgggtaaaaattcagctggtgataaaacttttagttcattttctaaattctatcactacatctttctaaaatctggatgaaaaactagattgtttgaaaaaacttttaattatgaggaaactgcagctttaacctgaatcctgaatcctggcacacgcattgtcattttcagccgatgaaaaatctacagacgggaccaaacgaaatggatgccggcaaaaaccatttactgctaccagtttacagtggaaatgtctgacaagaaattgtttctgctggacacactgaagattgacctggtccatcttatgagctttgatgcgggaggacagggtcaaacgcaaccatccaacaaactcgtgtaaaaccaatgcaaggtgtgatggcgcactccatctctctagattcgtggtgcatgggtttcgagattggaaagagtacgaattacccgatgcatgcgtgacaatccagtcagtattttctcgttttttaatggtggggcccacctatcatatatataccctctcatctccttctcctcttcccctctttcactctctctctctctccctctctcggcgagcagggcagctcacggcgacgggtggtcagcgcgcggcggcggagccggacctggcagctacagcccacgacctgggatgcggaggcggcggcagcgtgggacacagagaacacgcgcagaagcaacgtcctctcctccggcgacggcgctagctcgtcttctccggacgacgactccggtatgagcaaatccagcgtcggcgtacgtccaaccacgccacaagccagccgtcgtgtctgcgagacggccgggtcgaaggcgatgaacgcgccgtcgtgtctgcggggccacggggtcgccggctgcgtcaaggaggcccaccgccttgtcgttgggttgcacacgtacgccccgatggtgtcgctgtcccggtcgacctggaagcagagcaggaggcctcaaggccggcaccgcctgcgccgtccgcatcggcgacggcgatgtgatgcggaggaatcacattttagatagtgatatgatggtgttgaacatgcgcgcacgcacacacttgtccttggaaggcattgggaattctggttgaagttacagatcgagacgaacaccgcatggcttggagaatgtgttcatatggaccagaacaagtaaacgttcatgctcattttccttggtggtcaagttgcaattccagccgaagcaaatggggattaacacacgatttgatcgataaagcacacccaacgtttcgtcaatcacagcagttgcggaggcggcggcggcggcactggatgcggaggcggcggcggcggcgtggaccggttcaccctcccagccacctagctacggcagctgctactcggacctggatacccgaccggcaggcgcgctgctccgccgacgccctggacaccggcgcgacgagaaacgactccatcgctgtgcgcgggttgtacggcgtctcggcgtcggcgatgttggtggcgagcaccaccttgcgcgcgcccgccggcgctggctcgaagatcttggcctgcagctcggcggggaggttggcgtagatggggcagatcactagctccgccaccttgccgctggctctgtcccacgctgccgacgcctcagcatcccaggtggtgggctgtagctatccaggtcgggctccgctgccgcgcgccgccgactgcccgcctccgcgcgcgctgaccacccgccgtcgcgagctgcccctgcttgcagagagagagagagagtaaaagaggggttgtggagaaggagatgagagggtatatatgacaggtgggccccaccatttaaaaaaaaagagaaaatactgactggattgccacgcatgcgccacgtaggacaaaaccgctctggtttgggtcgaagggggtaaatcgtccggtattgaaagttcagggtgaaaaatgtctggttttcgggttcaggggataattcggtcaaccacaataattcaggggggtaattcatactttttccttcgagattctcttctcaaacttttacttatcacatttgtcttaaaacataacaactttttacttatatgtaacttgagagggaggtaacaattttgacgggatcgatcgacagtcgagctgaccatacagccgatgaacggaatcaagcgtggagttggagtcttattggcacttggcatcctaaccttttggcatgtggaaatctcaggtctgccttcttcggaagcgccatggaatttgcctagcttagttcctgtagatcaagaaggataataagtaaagggagagagtccccaccttacctatcttttactgccattgcgtccttggctgctctggatgcaaaagaaaacgtgcacccgggcttcttgcagctgctggtactgcgtactagtttaatggcacttggttggcgagaggcccagacgaagttgggacggacggcaggaccacgaggaggatctaacacgagcagccagcggccgccccacgagcacatgtgcgccgcgttggttcttctccccccgagacccaccccgaccaccaagaattagcatctgtttatgtcgccgtactcgaacatatgcgtgcaacgctctgcgcctctgctccaaaagcctgctcgtcgcatactatactcactagctaccacgcctagattctgtgccacggccacgcctcgcatttcaatttaccactataataatcgctaaattgatctctttccacgcagaggaaatcatattagatttgcgccgcgcgcttagctatagctagcaaacgacttcgagtctactctactgtctacgacagtgttgccgttcgctgattcctcttctccagttccatttttgtcccgtatatgttcttctttgaatgaaccgatcgaacggcgccggggattgatttgatcgcagacgagtcgggctacgcgcgatttggtctgataggttcgcaatcgatcgattcccagaatctaccgctccatctcgagtggtggaggcaactgactagtcgtccagcatcaagtttggtgctgccaagtgccaacgcactcagccactcacgagtggtcacggagtcatcgatcataatcgacatgatgcatgtaacctaattaatattccagttcgaaaagaagcacagaagaacaaatcgtgatgacacgaaccagtttgtttgctctacctattaaattggcgggttgtgcccgctcgcacgtgctcgccgccggcgcactctcaccggcaagccgcctgcgaacgtggcggtcaggcccggcgcgaacttgggccgccgcgagctccgcgcgatcgcctcgatgtcgaagctccggacgacggcgacgatgacggctttcatctccatgagggctagctccttgccgatgcagacgcgaacgcccgcctggaacaccgggtaacggtacgggctctccgggacgaaccggccgtcccggagccatcgctccggccggaactcggcgcagtcggggccccatacggactccatccggcccatggcgtaggcgtggtaggtcacccgggtgcccttcgcgacgaccgtgccgtccggcagcgtatcgtcgccggcggcaaacttggaatcgaactgcactggcgggaacaggcgcatgctctcgtacatcgcggcgtgcacatagtgcatgtccttgagcttgtcgaatgtggcggccatggttcggttgccgtcgcccgtgacgcgggcgacctcgtctcggatggcggtggcgacctctgggtgatcggagaggagcagaaagaaggcggtgagcgccgaggcgatggtgtcgcggccggcgagcatgaagctgacgacgatgtcgcggaggtacttgtcgtcgtcgatggagcccatgaagcgtgaaaggaggtcgctgccggtggcagcgccgccaagcttccgccgttgtcggatgacctccgccgcgagcgcgtcgaccaaacggaccgcgtcccggagcttcctttcgtccccgacgttcaagaaccgcttcagcctccagattatctgcatgggcaccgtcgcccgccgcgcggagagtgtcgacgccgtgtcgaacgcttccacgagcgtcgatacaggcatcgacagctcgaggcagccagggtcgaggccaaacgagatcttgcatatgctgtcgaaggcgaagcggcggaacatgtcttgcaggtcgagcaccttgccgttgccctcacgtgaagcagagtggagcagagggatgaggcggcacctcagctcggaggccacgacacgcgccgcgaaggcgcggagcgccggagaggcgagctcggcagcggcgagcttgcgctggaagagccacgcgtcaccgtcgacgttaaatatcccgcggccgaggaagtcggcgaggatggcggagaagggagcgcccttgggatagttgtcgaagcgggcgcggagcacgtggtcgacggtgaccgggttggcggtgagcacgttgcggaggacgtgcacgtgcacggtctgcgccggcgaggtgcgcagcaggtgggcgtaccagtcgcagaggttgtcgaactctcccgcccacgacgccgtcaggaaggcctcgcacacggtgcagtcgcaccaccacggcgggcgcaggcgcaccacggcaaggagcgcggcgagggccaccgtgcacgccgagaacacgaagaaggcggtggccacgtgcggctgcagcgacccagccagggcctccaccgccccatgcaacgcctctgcctcgacgacacccatggagacgagctgcggcgcctgcgactgcgtgcgtgcgtgtgtgcgtggtgcgcgcgggctttcataggcgggggcgcgtgcgtttgcttgtgacgatcgtggcgtcccgggagggggccgttttataccagcgggacgtctcgtcgcccgtgataaggggtgggttgggtatatatgagtgagagattgagaggtcgcgtgtcacgtccgtgtgcgcgcgcaaggacgttttgaccgctcaattgttccggtaggcccccattcagcacgttgttattcccctcctcccatgtttgattcccgccatcccgtgtgggggtgtttcagttggcgaggcggagcatgtgcttgataatttcatctgcatgattccgtcgctgcagtggacacatgcatcgcccctgcgccggtgggtttttacccccgagccccattaggatgttctcttttggtaataaaaaaataagtaaatttcataaaactattggtattttgattaaattatcacaaaaatacaaatttaaaatgtgtatcataaaagtacggatttaacaccatatttatcacaaaattacatatttaaggttaaatatcacaaaactatatatttaatattgaagttatcacaaaattatgctggagctataaacattattgttgtgtgactaaattggttctaaacttgtagttgtgttactaaacaagtagttttgtgacacttcatcttaaatgtgtagttttgtgatacatcaagttaatctgtagttatgtgataatttgatcaaagtatatgtactttgaaatttactctaaaagacaatataagacaatataaaccattaatctcattggatcgaagagtatagatctatttatactattattctagttagccgtactacaaacgtagagggtattattgtaaaaaataggtctagatagatataataattatttaattgtgacaatatttttattcctttttgccttttttatagagacaacagaatgaatggccatatatcgatctagaaaaaaattataaataacaaagttatccctaatccatggattagtaaattaccgatttacctttaatagcaaacgatttatattatttttagtgatagtagagagctccaaagcatcactcggcagagaacacaactgaacggaagagagagaattgaaaccacgtactccctccgttttctaatataagggatttttacattttacttgtactgtttaaccactcgtcttattaaaaaattagaattattatttattgagtaaattgcacattggtctaggtatttttacctaagtttcaacatggaccatcctaaagacaaagttttcactttgggctagtttcttttaccaaaagctttcactttggactagatgctctcacatgtcagtagatcaggagataagggaggacgccggcaagcttgtgatggagatgattggattgtggacgtcggcaagcttgtaatagagattattgcaatgtggcaacacctagatatgcgaaggaagttctgcacgcatgaaacgatagcacacatctccttctttcgtcatgtcatgagtgggcttagccatctctacctaaaccgtgccacaccgcgcatcaaaaagttgtttgaattgagtgccatcacaatccaatcataatatctacggcgaggtcagtcacacatgcccaggttgtaaacataccctaccccaaagtgcaactcttggcaattggcaaagaaacatggtgtaaagtgaaaatcttgacttagccctagcccaatatgaaacactggtaaaaaaaatatagcccatgatgaaatttactcatatttattttatttgtgacttactttattatctaaagtattttaagaataacttcttgttttttatatttatataatttttttaataagataagtggttaaacagtggaagcaaattatcaaaatcacttatgggacggagggagtaccttcctgctttggccagtggccagtgcacgtagccttcagtgtcctcgtccctatgtgacgatctacgattccaggggagataaatagcctcgctctctggtcgaggtagtaccagttcaaatgaaccaaaaggatcggatcagcacgtgtggtacagtgcacctacacgagctaactaccgactggccggtcgagagagcttatcgacggcagggcgcactgcaggaatttactcgtgtccacgtcggatatatatcatgactaaagagttgaccgtacagttgtttgcacatcagtatattttaaccgtagtctccgactccgaggaactctttggacagcatcatattttgccacagaaccttcagaaaaacttggacgcaacacatttttacgggctttatattttgccacaaacttttttaatatgacgagtggtcaaacagtacaaacaaaaactcaaaatcgcttatattatgggacgggggagtaatatttatgctgcaaagatatgtctacgtatggatttattggctaaaaaggtgtgacatgacatagttatgctgtaagctaatggcctattggttgtcctaaagagaataggccaaagcaaaatttaaaatttaaaaaacttcacttgtttcatattataagtcattttgattttttttctagtcagatatttttatatttgatcaagtttagataaaaatggtaacattttcaatacaaaataaacataacatcaaaatatattcaacgttgcatctaataaaactaacactactaaaaaaagctttttttgttggcggacaatttatattttagctagcggccagcccaatcgctggcaagaaaaggttagtgaaaatagagtattttcataggctggaattaaccacttacgaaaatattgctggtgggtccgtaaagagaaccgccagcaaaaatcccccacacaaatccaaaataccccactccaaatccaaaatcctctcccaccctagtccattcacaaatcacaaattaaacacatatccattcacagatcacaaaaaaatatgaaaaaaaaatccatccactccaaccatcgccttggccgcagcagcacggccttggccaccctacaagccacgccagctttggctttctgtcgaagaagaagatcatctggttggaggagaggagcatgaggatggcatccacatcgagcaccagcccgccaagcagcagcgcgtagatgatgccatggtcgatagggaggatgccggtcttgtcgaggagcgcgaagaggacgatgacgccttgctcgtcgtcatgtacgcgcccttgaggaggaggaataagcatgcacacttctctcctcagtcgccgccccctcccggcgtcgaatcttcgccgcccgcacttatctccgccgccgccacccctccctgcgccagatccccgccccccgtgcttctcttcgccaccaccgcttgcgcgagctaccgacggtggggagggaggaggagagggagctgtcgccggtgagggaggagggctgggtgggtctagaggaagagggggagttgggaaaaggagctgaggaggaggtgttgggtggcggtggattttttttaatgtggcgatattttcactagcaatgctctctagtggccaccaacgaaaatcgaatttttgttgacggctgtttaagtgggttgccagcgaaaagttgtacatattcgctgcggctaccagcgaagatccattttcactggcggtccatagcccctcatccctcggagtattttcattgacggtgatcatgtatggctgttagagaaaaaaaataggttgacaccatgaaaaatcgattttttagtagtgataatatgatgttgtagatgttgctaattttttctacaaatttgatcaaacttaaagaagtttgactagaagaaaatcaaaacggcttgtaatatgaaatggatgaagtagctttgaagtttattttaagatatttttaatctagtttcttttttatcattgacttttaagttgttaaaaacacatatataaaagttttacagaaaaaatattttttatcactaataaaccgttaggattataattaataagcttttgggcaatcaataagaccctaaacatttatctcacttgatcagatttggttgtcaaaagtataacaaagtttagccaccaaaacaacccgaatttagctggtccacgatttaacaacgggaggatgttagcaatatagttggaaatgtaatttcataagctatatgtctgcagcggacgattatttagctaccccacgataatagtataatttggggacattaattatagtattattttggagatgtaattttgaattgaaattaaaaaagttagctatattttgagacagatgcagtgaaattaaacagttatatcgttctaaatatgcatgggaagtttcatatatataacatcactgtcatcaaccgacgacccaccgaatctagtgcacaaatatgatatcttgacttgatcagatacttaaatctaatcaggtatgtcgcatgctaattaatagtttcatcacttcagtattttatcctatcctgcgcaacaagattcccaaaacgtgcatggtggtgtagacacgtatgtacagttggagcaagccatgtgagcttgtgttggtcagttggtactaaaatattgtccaatatatgtcttctatggataatttaactatattacgttccgactccgttgcccatcgccagaccttcgccactctaagcttccctctaaattactagctcggtttttaaatatttaacgctgttacttttttaaacatgtttgaccattcatcttatttaaaaaaaattatgaaatatgtaaaaatttatgaaatatgtaaaactatatgtatatatatttaataatgaatcaaatgataaaaaataattaataattacttaattttttaataagacaaatggtcaaacatgtttaaaaaaatcaacggcgtcaaaatatttaagaacggaggaagtaccagagaactattcccctcttcattccctctcccctctcccccaccccactcaaaccatgacctaacccacagaaacctaaccatataggcttgttggagatcatggagaacacgttagagatgtagtctaaggtactggcgcactaggtggtgttcttttctccattgagtttgaattattacaaacttgaaaaatagattaatatgatattttagagcaactttcatatataaagttttcgcacgaaacacaccgtttagcagtttaaaaagcataccataaaaatcttaatattcatccaactcttgttggacaaaagaacaggacgagtccgtaagattttacctcatgttttgtatcgaatgtgaagtagcatatctgattttataatttttagtctagttaaacataaccaagaccaaaggattgggaaaatcgattactaacactacatttataaatattaaagtaaatttcacaaaactacatatattttgaccaaactattacaaactacatcatgaaattatagatttaaaatgatatgtcataaaagtaaggattactaacaaaattttcacaaaataatactactccctccggttctatattaattgacgttttggacaaggttgagttcaaacttttataactttgaccatcaataactttaaaaatatttagattaaaggaactagaacaatatatatagatttatcttttaaagcactataataaaagtaaacatgtatttgtttattatacatattataatagaaaaataaggtcaaacatatatcttgtagaccgtgtcattatccaaaacatcaattaaaataaaaccggagggagtaggatttaaactctaaatctgttgttttgtaatataattgcttaaatatagtctgctgtcagtttgataaaaaaaacatacgtagttatgtgaaatttttatcatgatgaccgaagatagctagaagacgccgtcatgacagcgcaatgatgcaaggtgatatacgtgttcgtgaatatttttagtctacttatttatctggttaccttatcaatctaaaagatatctactcagggttggtgagctgtgcttatatatttctgtcatcatgctggaccagagccaagccaatatatgttgcggcgaagagagatgagttaatgtagacacgtgttgccctggcaccgatatcccacactatattgcgagatgcgtactacatgcaatgcatggtgagtgtattattagattcctgaataatagtggttctaataatcttaattaattaagttctgtttttcttcaggcaaaagtggttctgccttctgtggacgtatctgattgaattacgaaaggacccaccgtttgtattctatatagttcttgtccttgttgccattcaatgattatttctagctgtgccttgaagatgtactatatagatcacatgtacatattacgtcgctgtcagtgtcaaccgcttaagacaaagattgttatacccgtcatctttgaaatagttgtcgcagagggacctgatagtaataacattggcagcagtaggcctggtgtgctcgaccaatgtccggatggaccggatgtctatcctactggtcactggagataaaaggagggaagatatccttttcttaccgctgttcaatgataggcccttcattttgtcgttttatgtcccgattatctgtactgattttgtgcaaatttgttgctttgggcgcacttttccaaaggttatttctatctgaactgttgcacttttactagaaggtgttaaagttgtctgaaactctgaatattcataccgcaggcgttactccgtacatgatccgactgagaggatttgtagccaatcagactctcatgtcatttgctaataatccctccgtcccaaaaaaatacaacctaatactagaatatacacattttaatacaacaaatttgaacataaagtatatctagattcgttgtattaggatgtgtcatgctgtagtacgaggttgagttttctgagtactcctgtaagcacgccgattgtctattcttgttggatattgtagctagcgcaatgtcatatttttttttcaaaatatttttctctcataaatcttcatgaatacatattttaaagaaaattctaaaaatatacctgtctcgtcacagcaagtggtgataccctcattgccgccatatggcgataagtctaacgaccctacaaagcccaactagcttgtcatgcaaatgtcatcgcagctagtgatgacatgggtatattttctatttctttaaaggtatattcttaaaattttgttatattcttgaaattttgtatgaacagtgtacgtatttgaatatttaatccaatatcatgatttcaggaggctaaacgtcatctatttagacttgggacctacaactatggaattgttaacttttttattgttaaaatcatccttatcaaaattttatatataataaatattggtgttatcaaattttggtaccgatggacgtgcttggtttggaattttggaattatcaaattttagtacagtggcaatggctatgtttagtttattagaattacctgaggatactacggcccagatatctcatatttgcgaaatattgaatggtgcttcaaaacatataaaaaaaatcagatgtttcatcgctcaataaaaaaaatgttttgggtgttttatcacttgataaaaaatatttcactgcttgataaaaatgtttcgatcaaatgtaacactggtgaaaaactgaccataacacaaagaccatattttatgcaacatatgtatatatttatcagaatataatcatgtgagatcttgataaaaagatttaattgtaagtaatataatgtataatcggatcataagaaaaaaaataaaaaaattgctacacataagtggttggctgtgtgcagaccgagtatgcagcagagaggagaaagaaaccatatagatagagcattgggtatttagtgggttggctgatattgatattttcagcaagccgtctgattttccccttcgcattggtcggccagactaaagcattttcaagaattacacagtacaacgcagacactcacaacgcacgcgcactcaccccctataaacacacgcacgtaaaacttacccctatgagtatcttcgaagactaggccggcaaatccttgagagattgacgaagtcaccacaggcgccttgttgtcgacggttacgtcgcttaccactgaaagcacaacgccgttaaattctaaaaaatccacttttgtggggagtcgaatcaaggaccacatgtgctactgagactcttgtaaccattaggctgttaccaaattttagtagaactaaaaagccgtctatatcgatatgcctaacctggaaggatgaagccgaggacgaatccggatcacctgtctgttagccctagaccggcggcatgcaggtgtttgccgacacgacagtcgacgactcgtctcttttccccgtttcgggcaccgggggcgccttgaccctgacatcgccacgattccggcacgctgcggttgcgctgccaattccccccgtggcccgcccatccatccgcttcctttcgaccgcgcccggggtccccccacctccggccaccaaccgttaaacgatacggacaaacgcgccaaccgctgcacgcgcgcacgcatggccctgccgcgcgcggggctccgctccggttgagttgatcgcctcgcgcgcgaggtttacggccattcgcgaccgctcggagtcaacctgtgcagtgcccacacaacgcaacgagacgcgcgcggaccggcggcaaggcaatgccccgcggcgccggtaatcgatcgaagcgagcagcgagggacgtacgccgcatggcaaccgatccgatcctcccagatggcgcggctcggcaaggcgacagggatggataccgcgcgcgcgccgctgctctgattgtgtgtgtgtgtgtgcctgacagggacgtgcagccgacgcgcggccggcacgtctagaaggcacgggttcgccggcacgtgacagttgacacacttcaggaaaacgagcgcaaccgccgcgctcgcctcggccaattaatccacgcacggatcggtcgcgcgcagcggtatgcgcatcaaaacacgtacacaattacacaattacagctcccgatcgtggtagctagcttgcaatgacttgacgcagaacacgaccggcgtatatgtatccatagaaacgacgacagtacatatcgagacaaagagaagagaagacggtagcacagatggcaccatcacggaggtgtggcacgagtgcaattcggatttgtcaacaccacgggcggagatcacacgtcgtcgatcgcccacttgcaggacctacaaaaataaacactatgattgtgtttatacgccatctaggatctacgctcttttgtcgctcgtgctcactttctctccctcgctcgcttatcctccaaacgctatatatttttcttttctaacgtccagaagcattcgattaatggtgacctttcttgtcctgttgcgtttttttacaccgatatctttccgtaaaccaaatgatttcggggtcttttcgtggtgactggggaggacgtactacaccatgggcactgcaccaacaaccggtcttactgtttgctatttgtgagatgggagagttgaaagatgtgcaccagatctcggcatggccagcaagccggatcaatttagtgataattaaatgccgcactcaaaatctatttcttttcctttgtgtcgtgtacacgttgcttgaagaagaacggccaaagcaggggccatcttatggtgtagctaggtctgccttcggccctctggtaggtgatcaaggtgtgcctttctattcgaacttggtagtcttggtgtaaagctcaatgtagctaactaaagtaaagcatggttaagaggggcctccatggtatcaaatttcacaaataaaatgtcatttagaaaagtctccagggatgatagatcagtggaccacttcttttctctctgattattttgtttgctatcaaaattttggaacagcttggatggcatttttaggttacggataagttcaaaataataacgggagcaacagaaaatatttttgtatacttatactttgggcaattaaaaaataaaggtaatcaaatagaaaataccaatttttttttctaaaattaagctctataagccgcaactcaagcagtcacctttcatcgtctgcttgttggtttatcatccataatttttttttgaacttttagagtattttgatatttttcttccattgtagcctattcttttgttattgacatgtaaatcactaataacaaaaatatataaaaaatacttataaattatttttgttgctctagtcattttccacaacttaattattagccatatatagcacaaacaatcatagaaccatgattgctagcacgtgtcatttaggtagatatgcaccagctaaacaatcaaaacaagctaaacaaacagagttctaaaatatatataacagagggatgtagtactgcaagatgacgttattttgtttttctctccagttccttttcagtagaatatatgaaagattcagacggttgatgattctagattttagtattcctggcaggcagaaactttggactggacaatggctataccttaattgttttctcttacaatattgcactgcagtacaacacctacactgccctgaagaataagtgttttttttaatatcacacctataattagcataagaataaccaagccacgtcatactttaatcatccgcctgcaagcatgacacaagaggacaagcgttgctgtaagcacgataattataacaagaaaacgaatgatttgaaccgtgataggcacatcagacaaaacgaaagagggtgaaaacctgctctccccctcgtgatggcgatcggtcagggcttgaaattctcatcaccaaatggtgacacatggctttgtttggtactcctacttggcatggttttcttgatactccctccatccctaaatatttgacaccgttgatttttttaaacatatttgatcgttcatcttatccaaaaaatttaaatgattattaattcttttcctaccatttgattcattgctaattatacttttatgtatacttatagtttcatatattttacaaaagtttttgaataagacgaatggtcaaacatgtttaaaaaagtcaatagcgtcaaatatttagggacggagggagtatgacccactatgtgatgttttggagagcacaaaagatattatcgagaacatttttttcattttccgtaacattttaagatgtgtttacataaaagatgtttgacataaaagctcatacagaactaatgcgaaataatgccgcttgatggttcccttgctgttctagatagatctagttattaggtgtatttataaaaccaattggttttaaacatctatatcacaaagctccgtgtgtaaaatttatttcaagaaaccacaaattttagggcaaagtgttccacaaacctcatacttgtacaaaatactccaatttcattataatatccaatattttcaagcatataggccgagaatacatatttctataccatttattctttttacttcctaactcccccaatttactgtatcagcatcacgtgaatggagtacatagacccaacaatatgtaattggtaattgacgtttattgagaaagtaactaatatatgtatctacttaaaaatatgacattatttttatatacatgtattatccataagtataattgccaaacaaaagatatatgcattaatatggggttttatgaagcattttgcactaaaacttaggttctttgaaacaagttgcaaaatctggggtttttgttacgaatgtcccagaacgtatggttttgtaaaatttactcaattattcaaatttgattagatataactcgtgagatacggcaggtgagattttccacagttgtgtgcttaatctaaacccaatacggcaggtgaaagcattgcctggtcgttgagccgacaaggatgatgtctcttggcgacgtgttccctcttaagggcattgtcgagacgcctccctccctacctgattggacttcatagtaaaaacctttgtcatgatcctctagcttgaagatctggacggacgacaatgacactccctatgttgcgtctgtcattggaggtgtcgtctaggaggcccctttactgcctcatatgcttttcaaacagttggtgcgaagcccttagatggtggcaggtcgcaggtctgtgcgagggagagggatatttcttaccctctccttctacaacctttcgtcttggtgatgttcaagaggctaggtgctcgatttttagggagtggtgctaggcgcgtggcacaattgttgctcctttgttagtctagcggtggccgatcctgtgctagacctttttcttggttgtgtgtaggtgctgtcggtgcatggtgacagtattgtgtttttttttcttttcagagtagtagtcttgtaatttttacatgcactatttaaacattgtattgtcttgtgtggttcctttaaataaatttaagcccatgcaaccatgcagcctcaagccctggaccaccatttttttatctttgatatccttgctccttcggtcttagtatatttgattggtgtttttacgtaaacatagtattgtactatgacatatttatatttggtctaagatgtatatatatacaataagggttttgattcaagattcatgcaaatatatcgagataaccgaggctgagagagagagagagtaaaggtgggcatacatcatgtagcattggcaaaaacacattgtatagtgcttgtttaattcccaactttttcttcaaactttcaacttttccatcacatcaaaactttcctacacacataaatttttaacttttttctttaaactttcaattttagtcaaactttcaattttaacgtggaactaaacacagccatagttgtatctgatctcacatggtaggaactatgagtactacgagaacagtgagacagatctccagttgagtgctactgctgcccgtgcctctcagtttcacaacttaggcttagtttagttcacactaaaattggaagttcggttgaaattaaaacgatgtgatggaaaagttagaagtttgtgtgtgtaggaaagttttgatgtgatagaaaagttgaaagtttgaagaaaaattttagaactaaacacggccttaaaaggtgcccagccgtttaggtattctataccacgtcaggcatgataatctgataaagaaatggcagcaagaactgagccatcttatgaaaagaagtcttgtactctcgcctagggggctattcctgcacatgaactcacacatggacgtctggggcctgcttagaagtcatttattaagtcctatcgcaaaaaaaaaatcatttattaagtattaggctacggcttataagccgaagatacatgaccaataaaaaaacaattgtataaaagcgtgtgatgaaaaaaagaaaaaaaacacgctgaattaattttaaattaagttctaaaaatcaaaatttaacatttaacgtggcttataggtcacatgtaaaaaataaacaagttataagttaggtgtggaaagaactgtccactgcatcattggacgtggttgaacagttccattgggtgggacgtgatgactgatgataccatgaaaccactgtgctcataaactagaggcaaaaaccagccataaactacactgtggaagattggttctagatccgtcataaactgttttaggaacattttcttgacgtagatacctgcattttactatcttctaacatgtttaccgtcgaattccttcggtctttttcggtccgaatcggagtgctattccacacgtgaaatggcgcatcttggctttataagctaaatcatcctatctatacgcaaatcaaagaagggtgcatgtgattgttaattcctcgactaatgtttagctcgattaagatcgatcttaccagacagcatgacaataaaggccatattggacatggaacagggacattggggcctccccggcagggatttgtgctcccacaagatgattagtttcactcattggatggtctaattgtgttagttctgtctacataagtaccaacttatgtgcaatcaaggctgggtcacggaccatccgcattcaatcgatgtttacttctcttcgctctgaaatctgaatgcaattatatgctttgcttcatcacgctgcaacagtcaggggcatttaggtagtcagactcggaacgtgtactaccagaatggtaatgactggttcagctaatggcataatcttataatacgaattccatgcaagaaatcgcaaggaaaattatgccacatggcaacacctatttcgtggaacaggctcgatcttgctagcgcgcgtgcagcaatccggaaatgctcgtgtgcgtgcgtgcaacgggcgtccaaaattttctggagtatcaatcaagcaattagtagatgatttaggtacataggtcatggctcagcgggctatgtgatggcacaagatgacaagaacacactaggtgaaacgagatattatgtatgcatgcaaatacccgatgcatgttgatcgatgcatgaactagaaaaaaaaaagaggcaatggcaaatttatcactattttaaatcgttattgtaagactgccactagaaaattacaaaaataccactagaactgtcattcgagtggcatccttaccaaattgaaaaaaacaatggcaaatttgcaaatgccccccctaaaaaaaagttgtgggagagaatgcgctgagaccattacgaacagcctgacatcacttctggcactatcttttcatctacgtatatgctcaaccgcttatcactaattaaaaaaaatacaaaagcaaatgctacaatataaacttcgatgaaaaacaaagcacaaaatcaactttaaaattaagttttaaaatacaaaatttgacataagcttaagcataagaaaaaaaaggggctattcatcccaaccattttcagggcttgttcggattattggataggaaaaacatagatagaaaatgtatcgaaataggaatgataaataaagaaataagaaagttaagggcattcggattgcataggagtataggacttgtatgttggaagaaaaaaagaaagagagagatagagcacttgagatggatggggcattcagattacatgaagttgattacataggatgagagagataaactcatgagagactttttatgatattagaccttgtcggtgacatgggaccgggagtatcatgacttagagacttgaggcagacacgatcacccacgtggcctaaccccctcggggggggggggggtcgggcccgagggtgatacggccgcccttccctttgtctccccgaggggtcggaccgctcccgtctcggccccgagggccgaggcaccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcaaacatgcagattgatgaactgacacgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaaaggggatgatttttttttgggatccagaacgatcagagagggagagggtaagagctctctggttctccagctcttttgtagcttcttcatacatagatccaccaaaacacaggagtagggtattacgcttctcagcggcccgaacctgtatacatcgcccgtgtcttgtgctttttccaatctcgcgaactttccacagactaggagcttagaacctcacccagggcccccggccgaaccggcaaaggggggcctgcgcggtctcccggtgaggagccccacgctccgtcagacctcatggtaaaaatctcaaaatctaatatgaatttgggcattccttagaaatttgataggatttaatagttttcaataatcctttggttcaaaaaatcatatagaaaaaatttctatagaaaaaaatattgttcctatacagaataaaaaaatcctatattttcctttcaaataaaggggtaccatgcgtggcaaagccacgcggtttttctagtagtataacatatttacgtataagcaccaaactgggaggttgacaaatactgcccctatttcatactataagtcattttaacttttttaaattaattttttatgtttaatttaatttatagaaaatataacaatattttcaatgcacaataaaaaatataaaaaattgttcaacattagacgtaatgaaactaattttatgctatagtgttgctatatatttttttataaaatggttaagcttttaaaaagtttaacttaacattttttccatcatacttcttccattgcacggcatatgaaaagctatggaaagttgaaatcggcgtaaactaacgagctgtatcataaagaataaaaataatgttagcatcgcaacagcacattctaagatgagactagagactatgaaagcctcttagtactccctccgtccaataaaaaaaccgaatataaagctagatgtgacacattttagtacaacgaatctagatagagatgtgtctaaattcatagtattatgatatatcatatccagaactactttaaatttttatggaacgaagaaagtagtaatcaacgtacaatttgcttcaagtaacacaatcgatgtctgaatgaactcaggtccaaaggcaataaacaatggggccttgccggttggctgggcgataatctctggaagcatctgtctttatgttcaaagttcagtgtaggacccgacccagttgacaagtggatttaaactgctgtccattgtatgcatgcttttcttgataggtatcaatggcggagtgagcacatctaaccgtggtccataaagagagacactttaggctgttttcgggggtgagtattgggaacccatctcctatacatgaaaaatggaacagtacattaacacgtgattaattatagtggcaaatacataacaaaatgttggtgtggtatcgatgtccccctgccgtgagtgaccactggcccaaaggccccaaactcgagatggattcgactctttcgaggctcattcatcctcgtgtaaagaggtgggcttcatgtgatgctgccgtacaagctacactgttccttgtgctggggcggacgaccgaacgtgtgctacgctgctactacgacggacggatgccgacctccgacacgagatggccacaacaaccaccgccgagtttatgagccatcatcctttcgtcctcgttccgccgtacgacaacgtctcgcgccatcagcagcggagagagacgatggacgcagcggcagcgagaaaaacgcgcgcattactactacccacgtgtggcgcgcggagcagaggcgagtggcaacagcaacgtctcactagccgacagccgggcggccggccggaaggttttctttggatcacggcctcaccgcgcgcatcgccgtctcgtcgtggcgagcgcggggcgcgacggttggcgcgcgcgggctccgtcccgtcctttgtcaccgccgcgagaggcgcctcgcaccggaaccggccggccccgggcccgggctgcctgcctcgccctgtgcggatcgtacgcctgaatcagcgtggcggtctgtgtggccttcgtttggtgagagcctgagaggacagccgttcgctcgcaaatcgcaatgccgcccccgccacggccagcctccgaccgattcgtgagcgcgcgcgcgggggcgggcgcgacacgtgactgcacgagataatgtctccaactctccagggaaaggtaaggacagggttgatcccgcggtcgatgtagccagccagggaagacgacgaggtctggtggtttccgcgcgcgccgaggcggcctcacacaagtcacaattggcggggaacgatgggtggtggttcgcgaggggccgcaccctcgtactgtctctttggaacaaagcgatcgccatcgtggccgaccggtcgagagcgaggcagcatcatcagtgaaaacgtcacggcctcgcgacgcggtaccgttgaggcggtgacgccgaagatgacttgactgcggcgagggtacagtcgtacagatggacacctgattaagcgacgttcgtggatggaatcaagggaggatgcgggtcaccttgcagcatttgtagagcaaaagcgacgtgcaggatgggtgttctgcagtgaggaggacggatcaaggaagatatttatttctgatgacgtgactcaaatggctagaatcctaatattggttatttgtagagaatcaaatttaggcaaaagtccaaacggcatttcttctctgggcttagacagaacagagtacatattattggtttcacggcaatgagtagccaatgacagatcagttgacacaagatagggtcagacagaagtaacgctccactccaagggagtgactggtgagcagctgttggccgctgccccatagccaggcatcagctatagaatgactgttcgtctggggcccgatgtgattcccaatttctcaagcagaaatcctgaattggagcaccatgccattgcaagttttgagtattaccacggctgaacggttgcaacttgcagctgaacccaaaataactgaattagcatttcaatagatctactcttcagaaaaagcatttgtacatgtaatcttgcagtcctactaacggtcccaacagttgtacagtcctataatacaacaagccaatgccaattagttgaagatgtactacagcacatatcgtccaaacaccgaatatgatgacaatgcattgatggctcaggatttggagggtaatcctattgaatttctttcatggagagcctgtggcaggtggcttgggtgtctgatttttctggttagctgcagcttgcgcagcagagccctttgcgttactttcgctggccattgacttcttgatctggacaggttcagacaaaacaataacatatcacaccgcaagcaaagacaacaatcaaatggacgtatcggcagaacgctgtatttggtgatgagaaatgaccatcaataggttaattttgaaacagcattgagaatagattaggatatttgtcaattcacagtttgtactactttgaatagagggaatcaaaacaatatgtttccaagatataagatgggaagaacagttaccagagtaagcctctccctgtgaatatcattgacatgctgcaaattgtaaaggaaaagattattacagttacaaacaattgtgagaattcatagcaagcaatcaaaagcgaagaaataagtatgcaaatgtatgaattaccggcttcttgtacagttttatttcatctccactgaagcctggcaaggtaatattccagcttctctctgcaatggatgacaattaaatcatatgaaaaatgcaattgaaaatttgaaatgctatgacttgatagcatcaccacaaagattctagaagaacaaaaatattcaagttacctgcatggaggagtacatcttttgcttctaaaatgcttgactttctatgttttgctaaagaacaagcaaatgttgcaacctgctcaaaacagctaattaaaaaaaaggtacagaagacatcctagatacaccaggatgacaaattcacatgttgctgatgattaaagggtgacaactttcttctatatctaaagacagcataacttcgacccagagcttctaggcctctagcaaccattaggcagtgtttactatttcctcacacaagaagaaccagagaacacatccccgtaataagcatacttgcaaaaagaaactattggagaacagcaatgatggtggagggaaggggcttacagattcaacaaaatcttctgcaatgtcaataagaacatcttcaacttcaggatcaagcttttctgaaggatcaatctgttggaagatcacagcatgagaaagttatgatgacacttaacttttgcaaataataaaatgcctatttctacttaagtgatgatgatccataactgataaatattggtaaaagaaccaactaaatccatcacaggcagtggggtttatgaacctacaatacccataacatccgtgaacccctatggttgcagcccctacactcaacaactctagacaatcatgacccagataaattttatgacaaagtattagcaacagtatatgctatcatatctaacatacttattacaggtaacagcctacttcctctacctgttcaagtacactggaacatagatttcacacagatcatcaattatcgtaagcacttctgaatcaacaacattattttgaaaagatttttacttggtccttaaccaatgtagattaaacaaaaaatctgttaagatagtgtgccctttttttttttctgttttctattgcgtggttttctttggatattagatatggtttaactgtgtttttttcattactaaagaagggtatactttcaggtttcagttcaggaagttgtgtacctgtgcaactaattcatgtatactcctcttggaaagcagtcgattaccagatcctccagcatccacatcgactgaagccatgtctccagattgcacattagtagcttttagtacagcaggagaatctagcttctgagccattgagacaggggtacgagcagtttgctgctgagaaatttgttgctggtttctgagtgttgtagtctgttgactttgctgcgaggaatgttgtggctgattttgttgttgctgctgctgctgctgtagcttttgttgctgctgctgctgctgctgctgtagtttttgttgctgctgctgctgctgttgctgtagtttttgttgctgctgctgctgctgctgctgttgctgcaaatgttgatgttgtggtagtttttgctgctgctgtgttaaaagtgcattctgtgggtgcgaaattgcaggagcatggtatggtcttggatgtggcctatgttgagggggcctaagtggagcagatacatttggcggagtttgctgtaaaggcatcgagggggaagaagccatagatggtggtcttgccaaagcttggatgggggttttctgttggaatatagttaaatgaagttaggtttaataagaggagtgttcccttgtaactggattgaggaatgaaaaatacaaaaaataaacaatggtgcaagttccaattgatctcattattcacagaacaaggtaaactcataaatgagttacagttgccaaggaaaaatgacaaaatatgtacaaggaagcataagttatattgtaaataatcttattcacataattaggtacatcatataactgaaacagaaagcttatttgcctatagatagaccagtctttgctttttacaagtgaaagtttcttacttgtgaacttgcaatctggctatcagatggagatggtgctgttgaagatggaaaatttggccttgtctgctgtggcagactagagattgctcctggtctcacctgagatgtgttaatggaaccaactgtcccaatattttggatcccaggggaaggctgcctaggctgaagaccataatcattactaagaatcttcactgaattcaaaacaatagagaaaaggtgcaatatgtttcaactaacagcgtgcatgtactttgcaatggaaattggctctctttatactggattatattgaacaacttttcggactatatatgtttttttttgtatgtacatttgagttggctgcgtgggaactgggaattaatgatctctagagaggatgaatgtgttggtgtaaaaaattttatgcgagaggagatggagcatgtagggcctgttcactttgatgccattttcaaccataccattttttggcaaagttgccaaaattttggctacgtttagtttgttgccaaatttggtaaatacataagaaatcctgccaaaattttggcaatattgccatcttgccaaaggtttattttggctacaatctgaacatgcccgtaaccaaccaatcatcattagttcattagcaccaactaaaatattataagtaccaaagatgaagaagtattaacaactatagtcgtttagaacagtagtaattagtaagtcacagaagaacaatattagagttcaataagctccacttaatgttttacgcagctgaactgtcagatgcatctacatttcttctacgcacacaaatgtcagctggatttgacaatttctgggattgttggctgaaagaaattagctaaaacatcagggggtaggatttaagcagccaaatcaccaaggtacagatttcgcgaagacttgttggtctccatcccacattcagacccccatgctgaataaggataactaaaattgaaaaatgggttccacaaaactgcagataacaagcatgtgacatcaagcaagataatcctactaagtcatggtttcctcaagaaatttactaacatgggatcagatatcgtgtcattattatataaaagaatgtaattcttgctgtcatccagatcagttatttcctgaccaaatgaaaacctcatactaccgagagcttaatcacaccagaatataaaagtgcggagctaagcatcagatacagacctgtgtagaggatggtgggggctggtcaggaccccgatgcatcgagccgaactgcgcggcgagtgtcggcggcggcacgaacccggtgtagccgacgggcgtctgcggcgcacgcgggtgcgctggtagcccaagggctacacctccccgtggcatggcagatgaggacgcagaggtggcggccggagcggaagcagaggaggaagaggccgcgcccgtggccggagaggaggacatcgtgatgggcgaggccaggtgagtgtacggaggcctcatgcggggcaccggcggccgcgcactggcggggcttggagctggggtttctagggtttggacgggggctggggtgggattgggggccggggcaagggtggtgtcgggggtgggcggcgcggcggtggaggcggaaggggtgggattaggctgtggcgcggatgagggggcagaagccgaggtcgaagtgggcggcgccgccggcgccgccgcggcggcgtccggttgcgcgggcggaggcgcgtccatggtgttcgacggctcagcgaggcgggggtgtctttgataagatggcagaaatacagatgaaggggaggacttgaatgcaaaatttctcttctgaaaaggtcttcctaaacccctcgccccccgctcgctaaacacactagacatttccgatgggcaagaacgggaagaagacggagtcgcaccggcaaggccgaggccgccgtgcctcacgcttccgcggcggcggcggcggcggcgacgaggatggtgacgagttgccttcatctgcctatgatgctccaccgccacaccacgaggactccgacggtgacgacaccgacgaagcagcagccgaggacgaacacgaagggggtgtggatggaggtgaccaggagcagcgggaagtaggttccatgccttccaagttccacctgtaccaactctccgtccaggtaatctcgctagcttcactagtgggatagatcggtgaaattaagtctccgtgcaccgaacctgttcgacgaaatgctaacagtatgcgtctgtgtttagtcgccaaaaggggacattagctacctgcagaagttcttccttatgtacgtcggcgggcgcgtccctctgcacttccaagaggatttctgtggcacggccctcctcaggtcaatgcactaaacttttcgatgaagtccatgtctgtcatttttcacacattgcatgtgtggttgaagacttcagcagttccattagcaagaaatgtgccaaatgcttgaatggttattctttggagaactttgatcaatgatgctcaacaatcaagagatcagttaactttagtgtgtgactgtgtgatgcatgtgtttttggcttcttggtcatgatatattgtttgatttcctgttggcagtgctgagtggcttcgtactgatgcaaggcgtacagcagttggcttagatttggaccttgagtcacttgagtggtgtcttgaaaacaacctgagcaagattggagctgatgggtattcaagaatgctacttttccatggaaatgttctacagccaaatgtagctcgcctagtcaagcaaaagatctgtgatgccatgcaagatctgcacgtaaacaatgataatgactctttagcaagtaacatctgtgatcagttggatcctgctagcccaaaatgctcagccaattcaaccatgtcggatttggttttgccggcaagagacattatttgtgcattcaactacagttgctgttgtctccacaggagaaaggacttggttttgtattttaggcatgctttcaatgcactgtcaaaacgaggtggtatatttgtaatggatgtgtatggtggcacatcatctgaacgcaagctacgtctgcagaggaggttccccagcttcactgtgagtgatgttgtgttagttattagcccttatactagttacgaatccactaaatgctatcttcttgctcaccagatagaaatgtggtaggcatataatgccctgaaaaaactgcgttcttttttatgaaaattcacactatctgcttgtagaatctgcttattccaacataaagatgttgcagtagtagtagtatgcaacataaaagaatgttttagtccgaaatacaattttctattgaccatgcctcctttttatagattctaaagcggttagctatatttttatacaacttcaatctagctattctgaaataattgtaaagtatatatgctatgttgttaccctttatggtgagattttgtgcctcctttttatgactcgatgtccatttcacttatcagtcatataggtttttcccttgtgtagtttattctagttgaaataaacaacagatagagttgtccaattatcaatggcgtgcgatttggagaatgagaatgagattatatatagatttatattactgttcttacatacaagatacaactatgcattcagtatttctgggagcaagaagagttcgatatcataagtcaccaaacaaggatcagtctccacttccaagctggaaagaagcaaatgttacggcatgctttcacgtaccattggcgcctgtaagttgatcacatactattgagaatggtatatttcataattattattgctctcctgtttccttagtggatcttcaccgtgttatggaaaacctgcaaggttgtaactgtcaaaaagaactatagaaattcttattaaaatataaagttgaaaatattttgcttagtccggtcctccggtctacaggttcaggggggaaactagattggtattaatatcatgtgcaaggtgtttagaatacatgtgtattagtcaagggtattgtagtcatttcccgtttctaggccaatcttgtaatctatattttccctttaggcctaactcaagataacagagagttcattacccatttacatcttcttcccaaattataacacagggaacaaccaaaggcaatgccactttattacctctgtgatatattgataccaaccacttctacatctactatatctctgaggagatttttcacgtgctatatctttgcactcttcataatgaagagtatgatgtacgggattgtttttcaagtgctgtgtgtaacacaccctacactacctgcatgacttcctcgcatgttaactttgttttagagttgcactggagtatcaggacatcttagtcctgtgcaaagaggaaggataccttcaaattcgaaattcatgttgctcctttgtaggtggtcgataccagaaatcaaagactgcttggaggaagctggatttaaatcaatccatgtctggatcagggagatgccaaatacccaatcaagtggaaatgctaaagaatataatgccaaccgtgatgtgaaatatgaagaattacagcatttcaatcaagcagatgcttggaatgcatatgttgttggagtagcaaatatctagatgattcatgctaccttctttttttagagagaagatgttggaaacctttgcagttttccgttctgatgctatccggtcagtttctctgatgctgcctgccggagtagtatctttttatctaatgcacaagtgcttaacatggattcccttctcgttgaaactagaatgtgtaattgctccactctatgccaggaaactaggaaagttgtatgtcttgggctatgatgtttgttctagatgagatgctagctaacatgtagtatcatcatatctgtaccgatcaaatagagagcagtcaaaccccaaagacaatctactgaagatggtgattcactatttcttgatgcagtcatacaggggttgtatgtccagtcagtttcatgcagcataaccttttcaggtttgcatgccaatggtgttctgtgctgattaacttcctgagccactgagtcccctaagatatgctgtcaaatgtttgattaaactggccgagttaccagatcatttcctctccgcaataatctctgcattgtgaacatctcttctggcagcagatgtcctccacaatagaatctgtgaacctgccatcaacagcatccttcaaatcatccatgcccattgacaattactcgcaaggaacgggggagatctaagaaaattgttagaatagatgtcgaatatactaattctatttggttacagttggatttaaagttgtaataggtggtagggggtagaggtagagtcggactctataacctagcaactctcttaaatagagaggcatggagatgatggtggtgtggccatggacttgtagcggctaggagttatatgggttgaggagcgcccataatcaaaaccccaggacataagcttcggctaaacctcgttaacaaatattgtgtgttcttgtgtcgttatctgacgtgtcttgggtgatcattgattgaagcgatcgagaagattagtcgtcgttccgctatatcgactacttcctccgtttcataatgtaagccattttagcattgcccatatttatatagatgttaatgtgagcaatgctagaatgacttgcattataaaacggagggagtaacttttatatataaaaaaggtctctacgagctgcaaacatcctaattcaatcatttccatttgagttttcagatataccaacacaaagtgctttgctggctctgcagagctgaagccgacgacaagccactccgaacagttaaaaaaacattacggtaccttatgcatctgcattaaagttttaaataatataaataattatacgtgtgtctaaaagttcatagtgttatctattagaaaacggagtgttctaaagttaagagcgttatctcttataaaacggaggaatacaactttttcaggttcaggcagtgtccaacatggcgtgtccaacatggtagtagcgccattccacacgcctgtatataaccgcgcccattgctccccaggacaacatggaatgcatctttctaccagaagatagagctttctctgccacgaaatattcagctttactggataccgtctacagccgtctccattcatcgtttcctttccatgatggtgtgacagaattggcttttgtatcgtgttcgttcgtccagtcattttcgtgtgctaagcttcgcaggtcacagacatgcctcgtcaaatttggttttagtcatagacatcacgtaaaatcgaccaactgctcggcaggccaacagtaatgatctcatgatcacccagctgaaactaatcttggcgtgcaatgcattcgcaacaacactttacgccagctaaagagcgagcgagcactgaactgaaggttccgatttccatatcaatcctgagctgatcaaagtgcttgaaaaaagattcttagtgcttgccattgtggatcccgactagattagaagatgcgaggccgaggattatggcgggggaaacacactgcaaagaataaataatcactggagttctagttgtcgtagtggtggacagagacagattaatccagcggcaaacgcgacgactccacgttgccgccgtgccaatgataatccgagaaatcgagctgcacggcggaacaaaggagagcgacgtaaaccggattaatccaaacggcttcgaccatctgaggggatcgagtgaacaatgttaaacatgtgatatgtatttgtgtgatgcacacggcatggttagatggatagatatgattagataaggctagattgagtttgttgtaacagaataggagcatatctatccatccacctgcgccgatctctgtaacccacagcggtggttattatcgctaatataagattaacaaaggtgcggcccgagagggttgaacgcttctgaacctctgatgtttgatatggtatcagagcctttccactaaacaaatcccgatccaatctatggccagctcgtcgtccaagatggcagccactaatcctttcggaggaaacacaatctcagagaaattagccaaaaacaactatgcgctatggaaagcgcaagtcctggcgtcggtgagaggagctcgtcttgaagggcatctcactggcaccacagcagcgccggccatcaccatctccgtgccaggcgagaaggaaggcgacaaggccaccagggcggctaatcccgcctacgatgaatgggtggctacggatcagcagatcctagggcttctactgagcaccctgtccaaagatgttctggcgcaggtggccacctgcggcactgcagctgccgcctggagcatgctggaggagatgtatacctccatgacaagggcacgcttcatcaacactcggatcgctctctccaacaccaaaaagggcgatctctccatcacagaatatgtcgccaagatgagagcacttggtgatgacatgacggcggctggcaaggtcgtcgacgacgaagatctcatctcctacatcattgccggcctcgacgacacgtatgaaccggtgatctcctcaatcgtcggcaaatctgagccgatgtccttcggggaggctttctctcaactgctcagctttgagcagcgcaacaatctccgtcacggcggcgagtcgtcagcaaacctggcgaatcgagggcgcggcaccaccggcggcaacggaggccaacgcggacgcggtgggaacaaccgtggacgcggcggcaatggaggcaacaacagcgcaaaccgcggcaagggtggtcgcgggaatggcggcttcaatggaggacgtcaaggaggtggcgtcgacactaggcccaagtgccagctatgttacaagcgaggacatacggtaatcaactgttggtatcgttatgatgaggattttgttccagatgagaagtatgcaggttctgcagccacctcctatggtatcgataccaactggtatgtggatactggggcaactgatcacgtgacaggagagttggagaagctcatcgttcgtgatcgctacaaaggacatgatcaagtgcataccgctagcggtgcaggtatggaaattagccatattggtcactctattgttaaaacccccagtcgtgatattcatttacgcaatattttacatgttcctaaggctaacaaaaatttagtttctgctcaacgtcttgtttctgataattctgcctttatggaactatattctaaatatttcaatcttaaggatctagccacgaagaaacttctgcttagggggccctgccgtggtcgtctctatgctcttccatctacaccgccacatgcacactcaaccaaagaagtttatggagtctccaagccatcttttgaaaggtggcacagtcgtctcggtcatccctcctctccaattgtagagaaggtcattagcaaaaataatctcccatgtttagttgagtctaataaacagtctgtgtgtgatgcttgtcaaaaggcaaagagtcatcaattgccttattctatatcatctagtatatctagtcatcctttggaacttatttattctgatgtttggggtcctgcccccacttctgttggaggcaaacagtattatgtgagttttattgatgatttcagcaagtttacttggatttatttaattaagtttaaatctgaagttatccaaaagttccatgagtttcaggctcttgttgaacgattgtttaacagaaaaatcctagcgatgcaatctgactggggaggagaatatgagaaacttaattccttctttaccaaaataggtattactcatcatgtgtcttgtcctcacacacaccagcaaaatggctcagctgaaagaaaacataggcatattgtagaaatgggtcttgctcttcttgcttactcatctatgccattaaagttttgggatgaggcttttacttctgctgtttatctcattaatcgtactcctagcagactcttgaaatatgcaacgcctttggaacgtctgtttaaacaaactcctgactataatattctttgtgtatttgggtgtgcatgttggcctcatctccgaccatataatgctcgcaaattacaattccgttccaaacaatgtacctttctaggttacagtccccttcataaggggttcaaatgtctagatccttccaccggtcgcgtttacatatcccgtgatgtaattttttatgagaatgtttttccctttgcctcacttcatcccaatgccggtgcaaaattgcgttctgaaattttattattgccatcccatcttgatattcctattattcctggggtgcaacaaatgagtaccactgtggctaatgttcctactaatcctgctaatcaaatttctggagatgaattatcgctacaggaaaatttggcagcaaataatgcagctccagatggtgcggacgcagccacagctgccacgaaagatccagcggctgactcccctcacacctctgacgcagcgtcttcgagcgtcctccagcgtcgtgtggaggccaccgtagagtcctcctgctctcctgatcggttgcatgtcgagctcacaccggcgcactcacccgtggccatgcaatctccagatgccacgtctcctactgcttcctctgactcacaggagccatccacgtctcttgatgcttctgttgcaggggaggtagatacacagcaacaacagcaccaggtaatatctagaccggctacgaggttgcaaagtggcattattcgtaaggaaaaagtttatactgatggtacagttaaatataggactacttttctcactgttactggagagccagaaaatttagatgacgctttaaaagataataattggaaaaaagctatggatgcagagtttatggctttacaaaataataagacctggcatttagttccacctcagaaaggtagaaatgttatagactgtaagtgggtgtataaaattaaaaggaaacaagatgggagtctagacagatataaagctcgcttagttgcaaaagggtttaagcaaagatatggcatagattatgaagatacttttagtcctgttgttaaagctgctacaatcaggattattctttccattgctgtctctaaaggatggtgtatgagacagttagatgttcagaatgcttttcttcatggagttctcgaagaagaagtgtatatgaaacaaccaccaggttatgaggacagttctttgccagggtatgtgtgcaagcttgataaagctttatatggcttaaagcaggcacctagagcttggtactctaggcttagcaagaagttatatgatatgggattccaagggtccaaggctgatacttctttgttcttttataacaaaggagatttgattatatttgtactcatttatgttgatgatattattgtcaccagttctagacaggaagctgttccagccttgcttcaggatttacaaaaggagtttgctctgaaggatcttggagatcttcattactttcttggtattgaggtaactaaagtgtctggtggtatagttcttactcaagataaatatgtcaatgatttgttgagaagagtaaatatgtttgactgcaaaccggttagtacacccctgtctacaagtgagaaattgtctataaatgaaggagatcctttaggaccaaatgatgcaacacattatagaagtgtagttggtgctttacagtatctaacattgactaggcctgatattgcttttcctgtaaataaggtttgtcaatttttacatgctccaactacacaccattgggcagctgttaagagaattttaagatatttgaagcaatgtactagacttggacttaagttaagcaagtctagatctatgttagtaagtgcttgttcagatgcagattgggctggttccctagatgacaggagatctacaggaggttttgcagtattcttaggagataatcttgtgtcatggagtgcacggaaacaagctactgtttctagatctagtacagagtcagaatataaagctttggctaatgctacagcagagattatgtgggtacagactttattggcagaattgcaagttgagagtccatctatggcaaagttgtggtgtgataatttaggagctaagtatctttctgctaatcctgtgtttcatgccagaactaaacacatagaggttgattatcattttgttcgagaaagagtttcaaggaaattgttagaaattgattttgtgcctacaggagatcaagttgcagatggttttacaaaggctttgtcagttcgacagttggagaattttaagtacaatcttaacttaggaaagttatgattgagggagggtgttaaacatgtgatatgtatttgtgtgatgcacacggcatggttagatggatagatatgattagataaggctagattgagtttgttgtaatagaataggagcatatctatccatccacctgcgccgatctctgtaacctacagcggtggttattatcgctaatataagattaacaaaggtacggcctgagagggttgaacgcttctgaacctctgatgtttgataaacaagacaagaccaagaccaggacggctgggggcggcaacatcagggcgtggattaaccgaggcggattggttccggccaaagttgaccccaagtctaccggcctaggctggctgagttggaaagaattcaatgaatcgattgcgacgagtttaaattctactatacagacacgtaaaacacaacgaaatttctctgtttttgtcatagcttacacgccgaaaacatacgctactactagtagtactagtttttttgaacgtgtagcttgcacacgtaaaacactggatgcaggttgttaatactccgaggaggccgtataacaatcataaaaagcgtcatgtggcgcgaggtacagagttcattgcgtttctgcatgaatcacacacatcgaacgctacgctggacaccacgtggccacgccaagcttagcaactcataccgacggccccacctgtcatgcgtacaggcttgttgtgggacccacgcccgcagccctgttccctgcagagaatcattatatactccctccaatgcacgaacccaaccagagcacattggatcccccgttcccccgaacccaaggtccaaccaaccgcaaactgcaaacatatcacgctccctattttagtaccacctcgcgaaccggaacgcatcgcgtccgataaaaaactcgtcgccccacaccgcgcggcactcggagctcagctcgcacggcacggaacggaacacaaccctccctgtgtctctctccctgatgcgccgccccccatgcggcggccccgacccacttagcccgcggcggcggatgctgcggcggcggcggcggcgatgaagcggccgctgcggcgcccgttcgcggtgctcctcttcgtcgtgctgtgcgccgcggcctcgttcccctccgtgttgcgcaggtcggtgggcccggctcccgtgctcgcgccgctgccgccgcttgatcccgcgcgcctcaacgccacgctcctccgccttgccgcggccgatccatcggaggcgccgctgcgccgcgacgtggacgacctcctcgagggccgcctcccggcgtcgtccgcgcgcgcccgcgcgtggcgcctccggggcgacaggctccaccttcacctccgccaccaccagttccccgtctaccggcgcggccaccacccggatcacgaccacgaccccctcctccacccgctcccgcgccaggagctccacctcgacccatccctccgccgcgcgctccgctcctggcaccgcctccgccggcacgaccccggcgtcctccgcaatctcccttccctcctctccctccccggccgcatcccctcctgcgccgtcgtgggcaacagcggcatcctcctcggcgccagccacggcgccctcatcgactcccacgccgccgtcttccgcctcaacaacgcccgcatctccggcttcgccgccaacgtcggcgccaagaccaacctctccttcatcaacagcaacgtcctccatctctgcgcccgccgtcccaactgcttctgccacccctacggcgacggcgtccccatcctgctctacatctgccaggccgcgcacttcctcgacgtcgcctcctgcaacgcctcctcccgctccctccacgccgcatccatctccgtcaccgatccacgcctcgacgtcctctgcgcgcgcatcgtcaagtactactcgctccgccgcttcgtcgccgagacggggcgcgcggccgaggagtggagcagcacgcgcgacgcggccatgttccactactcgtcggggatgcaggccatcatggtcgccgtgggagtgtgcgacagggtgagcgtgttcgggttcgggaaggcggccgacgcgaagcaccattaccacagcaaccagaaggcggagctggacctccacgactacaaggcggagtacgccttctaccgcgacctcgccgaccggccggaggtagtccccttcctcaacgacgccggtatcgccgtcccgcccgtcgtgttctaccattagagcgcgtgcgcgcaaggtgctcgacgttatgccacttttttccggtggaggattgtgttgtattagtggctcagtgtaaaatgttgcttcgtaaggtgggttattttttgtgattagattgatagacgaattgaaatagtagcgaaattttgatatgatggtgggattggaggtgtgtactaagcattaggatccctccattagcatacgaggacgatttcttccgcttttggcactgtaactgtaatttagactgatctttcttcgtaatttcatgaagaatcaattgtacatcttctatacagccttgctgcaactttgctctccatgtttcccaaatggcaaatacaactttagctttgcattgtgtcatctgtgtaccttccaaattccaatttgactgctcatttcacctcggaaaataacttgtgcaagtccttccctgccaatgcacttcttctacctctctaatccgattgctaaccgaaggctcg

SEQ ID NO: 68572 - DNA, 14028 bp, Oryza sativa
cgataccgacatattgttggaagtcttgtatatcttgctgttactcgaccggatatctcacatgctgttcatgttctcagtcaatttactagtgcccctacatctgtccattatgctcacctattacgagtgctccgctatctacgtgggacaccatctcgtggtatatttttctcccgtgatagctcactagagcttcaagcttattcagattccacttgggcaagtgaccctgttgatcgatgctctattactggttattgtatcttcctgggatcttctcttcttgcttggaagtcaaagaaacagacagctatctctcgttcaagcgctgaggctgaattacgagctcttgcaactacaacagctgaagttatatggctccgttggctacttgcagatcttggtgttgtcctctcacaaccaacttcattgttttgtgataacacaagtgctatccaaatagcctcaaatcctgtcaaacatgaactcagcaaacacatagggactgatgcttcttttacccgatttcattatcaacacaggacaatctgtcttcattacttgccctctgaacttcaagttgctgacttcttcaccaaaccgcaaacacgagaccagcatgattttcttctttccaaactcaaggctgttgatccacctagagtttgacggggggtgttaatgtatacaccatatatatatttctgttttggttcagttggtccacttagcccatttggcccatgtatatgtatataaccttcactaccatctagggtttactgctgaatatatttttcgtgatttcccccaaatgttgaacatgcagatcatttactgacaacctgaggacacggcacgcatttgcacctacctcgaagttataacttttcaaagttgataagtgaagggatcctttgtaatcaacagtccatatatgagttgatgactctcgggtactgatagaagagcacaaagaattgtgagcaattgatattatctggtaaggaaaaacaggttaagagttaaggatttagcggatatataccaaatgctttcagcttggcattgctccatcgcattgacccgtacacttctgcaagacaatgtttgtataattagcaatgagtgtgatccaaaagatatagacagatgaacgagaattacaccttattttattggcatgtaaaagacaacgatgcactctgtgtgtactgtcattttgcgcaaatccatatgctgaacatcgtttgacaatccaagatgggtatgttttgtcaccttttttgctatgatagtttcccttgatcctaccatgcccagacttgtcattttcatcatcagattgtgaatcaatttgagcatcaaagctcaagggaagaaatttatcatcgaatggtgaatggtcatggacttcaccatacaggattcttattatatcacatgctttggaaacacatttgggagttgtgtaagcaataggcacataatctcttctttcatcaatagagctaacagtttcacatgaaactcttttccacctttgcagcattacacggcaatcatctccaagtactatctgttctgtgttgtctggatgaaatgccatcagtgctttgtccagcacatcattgtttcgtgatgtgtcccaaaggtgcagaataatgattgtaacaatcatgtcaagatagtccgcagaagcagacaactcacctattacatacatatagagacttttgcaagcttttctgaagcctgctggcccaaatgcaaatgtagacaaccggcgatggtagttccctgatataggtatatcacttcttgtccgccctgtcgttgttatataatgtgtcggttttgcaacttgttttggatctccaggtggcttcttaataaatctatcactcttttccctctctggcgttgttatataatgtgtcggttttgcaacttcttttggatctccaggtggcttcttaataaattcagcaacaaacccctctgtgataacaccatgtagccaacttgttgaagcattgcctacaaagcacatcacaatcccatctacttggacatactgtagatagtggcccttttggggtgtggtccaacttctggattccggacaatcgaagtcataaacattatctgagtgagatagagtccagaagcgatgattgcctatgcagtccatcatattctcataaagtaaccaaggatcaggttcatccaaattcaggaagtgatagttctgtaaaaagaagcaacaagtataaacgataaggaagaagtgtcattaaattgcactaaaaggttgcaacggatagaaacttactggtggataacggctgcagccttctaattcacttaaggggatgtcatttaacctagtcttaactggagtgtttgccaacttcttcagagcttcaagaaactttggaaggtcagggtaggctttgcaatcaacacgaactgttacagcaggggctctcatgggcataaccttcacacttgtcaatgtagagttcttcttaattaactggtctgaagtaaacacatacacaatgtttccagtgactatgattttctaatccctgtttatgttccatacaattaactgtagtgtatgtggccttgtcaaataagtctctatgaccagggatagaggagcaagaagaaccctcaactaactcccttttatctcctatccaaataagggaactcttaatgcatttgatatacaaatcttttctttcaccaataccatagctgggactcaagaattggacattcattccagatgtgactttcccggagaagacacgtcctaaagcaaaatacctgcctttgcctaatgctagggtcatcttggaacataaagaacaaggggcccttcagcatcacaatttctaacagaggtatggtaaatgttgtcaagatccacccaaaattcccaacacaatgtctttgcgccttcctctggagaggggatgtggtacatcatcatctcagaaagtgcactgcatgctggcagccaagcttggatcagatactttacgagttcaatgccaacaagttccttagctggagaactcacagtgacatgaatcttttctagcataggccacaatttgtgcttgctattcatgcaggcgttcatgatctctctgataggttcatagcaaaactgaacaaagcccctcttgcatgtagctgtgccagtgttcttttttgtccatttctttgtggccaggtcaaagaagttctcaccccataatctgtctatcatcttagattcctcaactttgaatttggaggaatacatcttagcaaaattagaaattgcaactgcccatccgtgcagaccagatgagaacacaacagttcccttagtgggatacacctgagcatctttgtgtgaagacatggtagcattgacactatcaattagactggagagggtctgataagctttctcaccatcaacattctgctcaaggaagaatctgtcgatcttattcagagtaaaaacaggctgaatcttcatattaagagcctcacgaatagaagtcttggtccataaagtaacaccctcaaaactgtccactacaactagagcaccatccattatgcaaagggcaggttggacatcattagacaagttgcaacacacaggagagtcaataagattgatcaagtgtccgttaccagctctcttatccttgtagcttctcagagaatcttcaggcatttcatagtacagagaaattaggctattgctttcagtaacttcctgggaagtaattccagcagttgctaccagggaatccaatattgcagtttttcctttaaaaatggtacaagacaaaatattagtacaaaaaatattttcacaacaaaattacaaatggaagcagcaaaaaaagtacaagagaagtacatcctataacgaatagtagaagaaagacaagatatcaaggttacaaactcaaatactccggacattatgtagtacaacagttccataccaatctcaatatatactagacccaccagaaatcgatatttacatacaggaagataattccagcgatacaaatcattcagattcaatatgttaatggaaagaaatggctgaaaagaataactagaaattctactaagatgccacgtcgtaaatgtgagaattaatgtaatttcataaacaaacaagtaaaacaaccacattttaagaatctcacaccactacatttcaatcttaccatggccagcatcagcaataaccaatacattccgaatgttgttcttattgcacataatgctgtgaagttcttccgctgtgaccaccatcatgtcgatttacttcatgtatccctgcctgtgccaaatgaacaagtttgataagaacagagaaaaattgagaaataagccatcaagtagtaagcaccacaattaattaacaatttgtatttaaaagacagtccagtgacttctcatcccttacatcagggacaaaacaggagttatgagctccggcacaatgacatgctcttgatgtgtgaggagtgaggactacgacgcctaccagcatgcaccaggacctgatccaaacagagtatgcaactcacaagatctctgcaggctgatactaagtgatcagaggcaagatatctgaagcatctcccagcaactcttcacttctcaaaatatcaagtaggaaaccctactaaggttggtagatgagagggcttttgaaccactcctgttggactactctttggtttcttccaccgatgcttagttttcactaaaatccgaccacattttcatatggaattggaagaatcctcctccttccccgtaagacaaaggtcgtttggattggattacgggtatcagcaatagcaaaatgagctcccaacgttcaactgggctccccgtcgctctcccgccgccgcggcgacgcaccccccccccccccccatctcaccccaccccaaccaagcacccagttccgcgacccagctaactcacgagacgcaccgaacccccatatcggccattcgtctggcaccatcgcggcgttctcagttcctaaccccatctgatccagtgagagggtttctagcttggatttcatatgaagaaggaatcctaatcgccatgaaagcgggcttccctctatcctctagtctcaacacaaaaacccaaagtaagcaagcaagtaaccaaatgttcgaggagtacagcgcgtgggggtgtccgaggctgaacctgcggagacgacggcgagcctgcggccgacgccggcgcggcagcgcgtagatgggcgtcggcgaccgatcgtgggcggcgccgcagatgcactgcgacgggggagcccgcgctggcggagaggagaagggggcggccgccgccgggcggcgaggaggaggaggaggggcgtgacggaatcgaggaagaagaagacggccgctgctcccgctttgggaggtggtcgtggtctcgtggacttggttcacgcagctctgaggtggcggcactgtgccacagagctacagtagagagcagcgtgcacctggtccaccggtttctctcctgagcacgtgctcagggaccccacatgtcagtgcctatggtccactgagacggaggcacggagaaaacctgtgctactgtaggagaacgcaggatttctctttccgtgatccactccgatactacgtctagtttcccgccaaaaagttgtagtgatggcccattttgattggcccgcttaggagataaggcccagaaatgagtcagatgaccctgggccgagagagggaactgatgaaaacaaacccaaattctcagtagcacgtttccctcaaaaaaaaaattctcagtagcactagttcattcaacaagaacgaatagtgttgcttatttcttaatgacgatacgcaaaaacttatccctcgaaattgcacgatcaaacatgtcgtcttacaagcgaagatagtttaaatgcttatgagagataagtgtcctgaaaacaaacattgggttcataggagtaccatgcccagcttctacttggagatactcattctacttaaccattcaacaggtatggaagaaaaggaaaaatacgaaaatatgttaacattccccggtgtttgtccaaaacgaaattcaacaagttggaccagcaaagtccaaatgcgcatcaaaacccaaacttctcacagcatcccccaaaaacgagagttcaggtacttcaggaaactgctaccatctaaacaagttctctcgaacatctcttccagtcagtcccaaggaacctacaaagcagatgagtacacatcagtctccctatctcataaacagagaagagaacagaacagatgaaatgaacaattgtcaaattaagttgattcagtctcttcggatacatccgataaaaaaagtagttgattcagtataaccacaaatatactgaaaccagagcatccttttggttttgttcctactctatcagtcaaggatgtggcattgcatgtctaagtgttgactgaagcaaaaattacaacctgtctagtgactactagtagtaaaggagcaggcaacaagctttagtttactcttgatcaacgggttatagaattttcgggaggacagtgaaggcgaaattggttaagacgctgagtaactttaggtttgagatagttcatgtctgctggttctgacagtagtgaccatcctttagcgaagtgacaattctcagcagtcggcagcactaacatctggcacttcagatgtatgaacagagcaagtacttcaccacaatttgagtataagatttaaaaggtaacgccaattttaggaggcagacaaatgtaacaactatcatttaagaacaacaaagaattcaaccaaacaatatgggattacaaacatcaatagcattgagataccccctctagtaaaaaaaatgacgctaggagaacaaaattcagttctccgggagtattaggtaattacgagagactactgaggatgtaacaattagcacactgaacgaattgtttcttaaaagtaaaccattacccattgcattgactacagataatgcatgagtaatccggacagaacaatgaaatacggctaataatggataataaaataagggtacacagacacaagttagacgagaaaaataccaaaagatgaatcgactgatgcagttcagttttaactgcctctatccacacgaaccagtgtgtctgccagagtatttctttcaacatcagtcttcttgctcgaaagggttgctgcaaccatgtgtacaagaactttaacaatagtagcacagagatgatagcgacaggaacgatgtatgtatccaataattgcaaaagacattggcaatgaacattgcatcaaaacactcgggcattaactacacatgaacaacataggtgttacataacagacattccactccaatgacaaaaggatgtgaggttcttctgccaataccaagttctggtgctgatatctgtccatgatcatcactgctatagtcaatttactgtgtaagtgtaagtcttatcagggacgattgactctgcttaacatatcagtagcaccagtgcaccacttaatttgagggcatctacgcagcaccacttcaatggaacatttgaatagtactgcattagactatttgagaagataggaatcaaggaaaaccttgtgaaaaaatcgaaattcgcaaactctgcataaatctaatcccaatattagacatgctgctatagtttgaagcagaaaaactcgactctttctacagtgatgacaaacagatgcactcccttgagaaaccacaatacggatacagcaggtatgtatttatcaacagaaatccataaattgctcaaatctgcaagcacgcgatttcaaaagaaccgtatgtgcaatccaatgattgcagcatagtgaactcctgcacttccaatactcggtgcaatttaacaattacaattgcagtatagtacctcaatactcaaacatatcgaacatacgaggatatacctgcagaggggatctgacatgattcgagccacggtggtaggatgcatggcacaactgaactagagttgacgtcatcaggagaactcctcccaatcacctcgcccttggccatgtccacggcaagaacctcgtggaggaatatcaggtacacaacgttggcgttcagtggatcgatggcgccgatccgcggcttctcgggcaccttgagctcacccttccagcttggggtgatctccatcctgtgctccagcgtccagctgctgccctcatcgtcgagcgagaatgcgctgaccacgaacggcttcttcgcattggacacctcgacgtaccggagcttcccctcgctgacccccatccgccgatacaagccaagaatccgtctccccccaattccggtcaggtccggcagtacgctgcccttgggcagctcgacgaagcgctcctccggccggtcgctgaacgggtcgacggagagggcgccccagctcacgtccacccaccacagccggccgccgaaggccaccacctggtggtccaggtgcatcacccgctcggccgccgccgccctctccgagcccgaggaggaccgcaccgtcgccacatcgtcccactcctcggtctccgacatgaaccggcgcagcacgctgctcccggactcccccctggtgagctccgcgaccacgtacctgtcgggcggcccgtgccgggactcggatcgggtgaggaggccgcgccccgtgctgtacttggtggtctcgatggcgggcgggaggcggtacatctggccgctgagcgggttgcagacgaagtgcgcgacgtccgggtcgaggacgccctcgctcgtcgtcctggacagctggagcgccacggcgaggcggacgttggcgacgacgggggcgtggtagcgggtgtcgtagaacttgaggaggaggagcccgtcgccgctgccgccgatgacccagccgacgaagccgacggcgtccccttcggcgtccgggagggggccggggttgacgaagtgggcggggacggagaggcgggaggagcgcgggggctcgacgaggtccaaggacgcccgcgcgctccgcgacggcgcccctgacctgtccagctccgcctcggttaggatcatgcgccacggagggcgtgacgcggccgtggagagcgcgcggcggagatggcggcccgctgcggcgccggcgaggcggcggagcagcagcgacattttcccaaagccggcgaggaggagtcgaggagagggaggagggtgggaaactatttaacagctcgagtgatgtccacccgtttatttcatctcatctaaatagttatgaaaaaaattaaaaatatatgaataagatagataaatatgtaatatatcaatccacaaacatacaagttaaaattcaacttctatagattgtaacaaaaataacaaacaaaactcaaaatactatatgtatatttacagttaaatttgttatttttgttacaatttgtagaagttgaattttaacttgaatgtttgtggagtgatatattacatattgatctatcttgccaatttttttgaaaatttttcatagccatttagttgacatataataaacgggtggacgtccactcgaactattagaatccatttccggaggagggtttatgtggacccgagtgttatatggggtccacgtgtcagcgagcagtactgcatgtgccgtggattgggatggagatggagttggggttttttcggttcacatggactcggttcgcgcaggtctgacagctggtggcacagctaaagacacggtggacatgtgccacgaaacagtttgggtgatggtccgcggagacgagtattgtcagttactgtaggtctatggaccttgttcacagaggatgggcaacagatgtccaggaggcaggaggtgagtttgaactttgaatgtgctttgactgtttgagctgcctcggctttagttggaatcctgtttataacacattaatgacacaactagccattaatttcccgccaaagggcagcgccgagccgacgagcatggggcttttgccggcttggcaaagcaccactgcaccagtggcgacacgtgattgagccttcgatttgaggcaaatatgccctctatcttaaaatataaaaacataatacgaaataaacatttcttagtattataaatcttaataaaagatccgtcagattcatagcactatgaaatatcatattccatactaagtttatatattttatttttatattttgatataaagatagttaaatttcggggtggcggtagtagacaacaacgagagtgcttcaaaaaatatcctatcccctactaggtttctatattttatttttatattttgagatgaaaaataaattttggggtggaggtcgtagacaacgacgagtgcttcaggcttcatcaatggcgaggcggaggccgtcggcgaacaggtatacggggagccagagccatccatgtcaggtctgagtgtctgaatgatgcataaggtgacacaggttcagattgatggttaaatatatgaactgagatcatgtgcaatttatactagggctgcaacatacagcttcagattgagttctgcgcagtggtgttttgcgatatatcctacagcttcagatagacattcagaagctggctagcataggattgtcactctcctgcattccggtttccaatttcagcgctgtctcaattctcatgcccgcttgagcatgcatagaaatttcccagaaatacataatgcatacaagtataaaacagtatgaatcacaccaaaggtgacgaatactacaatattttatcaacctctcagaaaataaacaggaaatgatgattttttttgtggcataactaataagttcatacaattgagtcactatctcactctaggttatcctttacaagccatttaattgaatagtagtgttcacagacaagctgcagagcttccaaactgctcgacgtcaaacagcaaacaatatagtactaccttgatagcaagatgtcgcattggcatgtgatattccaatgtcattgtctaagacaaggattttcccacatttttcccaaccagagaatctggtaatctgctgttgatgagatcccgcagttcaaactcactagggaacctctgctcagctaattttgagaaaacctgaaaagtgtaagcaattttcgttaaggaagaagtaaggaggttgtttactgctcaagtcatgatcgtaaatcaaagcctctttccatgtagcagttcttagtagaaaggtacaaagaaacatggagaaaaacatacatgctgaaacaaagtattcacatatctctgtacttgcatatcaaggtaaaagtaatttttaattggtttaatcctagaaataaaattagcccgtaatgtaaaaatggcagataaaaagaagttttacaggtgtgtctgacatagaaagcataccaaatctccattgcagtaaacttcaaaggcaccagaactttgtaggaaagattgcgcaaaattgccaaatagccagattgttgccatggttccaaatctattggcacgcagtgagtagtaccatgggggtggaaccattccaagtctggggaaaatatgatcaccagccattattgttgcaatggctccaacctgaagaattggcacaagtttgccaagtacacgtttggggaagggtggagggtaattgtgcaagataacatgaatgcctggaaatgatgtttccagcatgcgcttcatagtcattgcagtccccctacaaaatgttactcaaactatcagtgtaacctgcagatgcaaagcatagaatctattgaattgtcttttggatggacaaaagatatttttataaattagaaagaagaggagaggctatttaggcacacaactttaattgctctttcaactaaaatccattagtaatcaaggtaagacaacaagtaccaaagtccacagattgagaaatatacatatcaaactttaactataataactaattatgttctatgttataaatacaaagtaaattaagtaaatactcatgctttcagcttaggagatctatatccatatataacaattttttatatggtccatatcacattttattgcatgcaatatttcactgtaacctaaaattcaattgtctggtaacagtatacaaataattcaaagagttcttttactgcctattgagcatttttggaatgtcctactactttgtcatagcatgatcttagagcaaacttgtggtatttgtctgagtaatcaaactttccatggaacaaataagcctcctcaggtgcataactaattccatggaacaaaatgtgttttaccaaaaaaatagagagtgtaggaacatcgcaacaagttaagcataaaaagtaaaatctgcaaatatctattgatccacaacgaatccaagctaaaactttctgatcccaaagctataagtagggaaagtgtgatattcagtgaatgcacaaataccggcatttcatactaactgaatcacacatactcggcattggcatgtaacatctgaaattctgaacgcaagctagaggcttatatgtgcaaagcagctgaaagcatggatcagcacatatatgcaatgtatcatcacaaattgtctcatctcaaaatagaaagagctaaatgagatgagtgtcataggcggtgggcagagagatcgaggtcttagggacgggatagagtcggttggataggattagactgggtcctcccctccatccttatataggtgattcacactgtgtatgactgttatcatttacatttttctttctaatatgtccaacagatcattcacactgtgtattaacgataactgcagaacccatatcccatacaaagttccccactactgctaagatgtaatcgtgaatttaagaagcgaactggagtgaggcttacaactaccaagcatggagtgttatgagtgtacatatgaacacaggacgtatggcagtaatcgatcatatgtagcactagagtggagtaccaagcaatcccacctagcaaatctttgtgcggagtagatttttttttagatggttttgtgcaggataaatcgaactgaatattatcaactgtggcaagcacacaactaagccgcttggtgctcgctacaacaatagtatgctcatttaatctgcacagaaataatccaacgaaccaactgcggccactgataccacatgaacgcaaaacacactggactaacgaaactcacttgtacgagcaggaggcgcagaattgcagctcgacggtggtgccatatccagctccatcaacgttagcctgctacaaccgtgccaaaccccccaaaaaaaagaaaatcagcacgccgcttagatcgcagcaacagaaactcgggctagggttcacgacccacccacctgtatggcctccgcggcgggatcggggtgagggtgggggtgatggtgcggcggatgcgggtggtgaggcgggtgggggtgatgcggcggatgcgggtggtgaggcgggtgggggtgatgcggggggtggtggtgaggcggatggggatggtggtgcggcgggtggtggtgggggtgccggagatgcggcggcggcggcgcgaagatgtgggagaggtcggagaggaagaggagggcggggagaccgacgaggaggagctgcacgcggtccatggcttaccactactcacactgctgcgctccgcgtcgcctcctcctcctcccaaccttttgagaggacgcggaacggaaggaggacgacccgcgaccggcgacgcgatgcgatgagggagcgacgaagcttccgcttgggtcactgacaggtgggccgcggatatgcgggtcccagttgtcagtgggagtttat

SEQ ID NO: 68573 - DNA, 1750 bp, Oryza sativa
taggagaagtcgtgatctgtataatgcccctaaacaggagcaatgtggattcccatcactgaaaattttcacttgtggattgcgtttttctcctgagagtcgcacgcccacagtcctgcacctgtggaaaatcatttcagtggactatatcatttgcgatatacttcatcgtttggtcatagcgagtagatggggttgattttctagctcaagcacctgaaaagtttgtcactgtactcactgtttccataaaggagtatagtgtacgcgtttattggacccttgtgtttgtatcatgctcctactatttaagttgttttgtggagggagtgaaagcttcacctgaaaagtatgtaataggaggttgaaatcgaccaaggcttttgttcccacagagctaagcaacgtacttgcaattgatgctacatggttttcttccgaggaaatttgaatgctaggataaatcccccttatctttgaggggggggggggggataaatccttttgtataaatcctaaactaaaatctaacaaatgaaactcctgttagacattttccacctttagccctttaattctcttctttagcacccctgatgattgcagaatctgttttcaggaccatgcatgtggtggataattgtactgtacagttaatacaaaaaagccatggagaaggtaggtgctaaaaccttttaagtgttctcttctttgacactatgttattacatgcttctttggctttgtgctctctgttcttttctttgcatgaagctaacagctctgtaatttcagatgttgtagtcagagacttggaaactccgttatctcttcagccctgcccaccagcggttattcttgtctgtacacttctcatctctgtttggtactatttttgttttcatattgtctgacagtaggataccatgtagttgtcagctataaggctatatgactaactgtcatggtcaagtaatgtccttagtttttgagggtggtcatttatcagaaagatcaacttgtgtgaagtgtcaagggttttgaccaaagtttttacaaccactgtcatctgagtctgactgatgctaacatagaactatgcaattttaacatgctatcgattttgttagccaaactgagctcatgtatattacttacatgattcccttctttaggttgcaagtgcaggacaggatgctgaccatattactgcgatggagctccttagtgaagtgaaatctgctggtaagctggctgcatcaatatttttgaagcccttttgttttgagggacagagacgacaattagaggtgggatacttctgttgtaaaagttgagtttattttcttggtctatgagttacttcctgtcacctacttaaaaaacgtatgactgtatattaagtttaagatgtctatttgtttttttggatttgcttcttacaaacaattatggttctgcaggcaactgatttaattgacaaacttcaaatgtgctcaaactttcacattggtaatgcgtgttatcttaaatttttaacttcaaatatatagcttatttttccattagagcataaataaaatatatatactttgaagaagtaagcttttcacttcttccagtatgaaccgtatgctctttgcttcattttggatcttggttgagtgaatcattacaccttttgctgatttcctcctaggtagaaccagtgtaaaattaggaagatcaaattttattgtacatatgctat

SEQ ID NO: 68574 - DNA, 1915 bp, Oryza sativa
tgtttaattacaaggatcttgatccaaaccatgtttaggggctaagtggatagattatttcccactgctcctatctaggtttattaaccataaccactctttaagggtagaccaagcagttctcagtgcttattgggtacagttcacaaacacatgctttggggttagtcaaatcaacttccatcctttccatcatcagttgtgatgatttattttgggagctccgctgtatgctactgcaatgtcctaacctgcctaacgtcgatctgaaataactcaaatttaatacactataaggccctttttaaaaattttgaacccatgggtgagccaaaaaagagcatatattttatagtttctttgatgcaccttatgactaaatggaatacttgatattttacttcaacaaatatgatattaatttctctgtatcagtagttggagtcatttttcttgcctgcagccattatcttttgtatttctgaaggcctatgttttattcaggttatcctcttcaaattatagttgtaatgttcatattggattcacatcacaggtttccctctgggatggcattataccatcaaaagagcacgccaagtttttgatccatacaacaaacaagtacagatttattgaccaggttagcacatttctttgattgcatgttaatttagtgaaattcatctaacataattagtttgattgtggttgttgtttagcatttcaaagtagagggattattccttccatgaaaaagataagggtcattttgtgttgagtagattgtttaaaatatgtctacttgatgattgaggtgtgcttgttctgaaatatttatgaatgagaacattttctctttttcgcatattgtgttttggatgggctatgtcaattggtcctaaactcgtatatattgttttgtacttgaaaaaaattctgaatgcatgaaggctcactttttccttagtgatgttttaacatagggtagagtggttggtcctaagcaccgagcacagatttttcaccaacagcttttgggtggtgactcctgctatatgccttgactgtattagtctcgcctttttagtttttttttcttttgtgaagatatcctgttctgttctttgctgattacatactgaatgtaggttgcaaccatttatctaaatatttgcaatggcacattattcattcacacagttgatttcataccctcatctttttatttgggttgcagggaagcaacctcaaaggaaaggattttaacctgacaatgcactggcatattatgccaaagaccggcaagatgtttgcagacaagatagtcatgacaggttatcggctacctgaacagtacagatagaagaacctgagttagctcaatggatgctttgctatacaaatgcagtggttattgcggggagcagacattgcctatgctaagttttttgttctaatcgtagcaaaacatgtaatcttttgtgcttgtgttctaactgaaaccaggcgatacatatgttgtttgactcgtcatccagaagttgagaaagatgtaacagtgtagtgcccttttgatcgagaacccaggcgttgcaaacttgcaatcacgttaatttcaatgtttatgtagcaaatcctagtatttgcagagtcgacgtttgaaggaagagtgcattggttttttctttcccgtttggaatgagagagctttgcttttggtttggatgtccacctcgaattgaaatggcatcttctcatcgatctttctgagaaaacggagaatataccactctatacgtggggttttgatgaaatgacacttaataagatgcaccggataaaatatcactaagtacgttgccaaccggatgaaatgccactttgaggaatttttaaccatttttatgcccga

SEQ ID NO: 68575 - DNA, 3084 bp, Oryza sativa
cttatccattaacaacagcaggtcaccactctcctactctttcaacgccgaggtggcgccaccgtggtctcttgctgccctggccacctacacaactagccgctactgtcctagccatccttctaagtcgggcactaccttccgccctcagccccaactctgaaatcctaaccacttgggggattgtcggagatgaggaaggaggccgtggagtacaaatcttgaagtggatctgaaggttagaatcacttgatttttcctctaaaatcgtgcgcacgatgtatagatttgtttgatacgtacgtacagacttgatttccgtttccttttaatttgtggaactatgatcgtcactgtaaagttttactcttaacctatcagagaaacaaaaaaaaatttgtttctaggcactattccaagatctagcaatgcatcggaggaatcagaatactagtatagtagatgctacgcagacatatatttccattcggaggatgagattaattgtggcattggcatgttcagacttcagaacattgtcgcttgcctgtactgatggatgatcgttgttgctatgttggagagagttcacaatcacaatgtacacgttgttggtgtgagcgtaaggcatggattacttctgatactgaacagtgaaattgatgatcatagtgacgtctctttttctctagaatggtgcaaaacattttcttcaggattcctggtagctggcttgctgctcgtggcaaacgtttcaattgactggcagagctactgctgacgtttcagaaaacaaaaggaagaactttctgcacgaaaaatatacatccaacattgctgcaatccgatagatggtgacatgaaaagcctaaactggatagatggtgacatgaaaagcctaaactggagaaatgcttctacttgacttaaatctgatgagctgggcgattatataaatcattctgaagaaaacttgcgctgtcgtagcgcttgaaattcggccgaagattgcagatcctttacacgcagtgatcagaagctggattctatataattccctttttcatcttctgtctgaattcgtccgtgtaggcgacatttgatcatgcagtgcagagcatatatagcaggggcgcagtctgaatttcgtaatgccttttttttgtgacatgctccttccttatatttacaccttagtaatattaatacgtgacattatcagggcaagcagaatacagatcttatcttatagagaaatctcgaaagaaaaaaaaggcctatagagaaatctcctctataggctttttttaggcaatcgtccttagagaggcagcgcatgcagtgtacattatatgcaaaagagaagagagaagagagaaaggattagaaaagagaagaaaataagatatgcagctgacatgtgggtcacatgtgctttgtttattttttttttgctgactaggatgccacgtcagtgaaaccacctatatatactgcctagggatcttgagtgaacggttttgtatagtttaggggtggagatttctggttttgtggttaagggaccttaaaaaaatctcgctgttaagttgagggacctccggtgaacttattccatattgggaacagcatcgtcagaccttggttgcatatgggccgaggccaacattatccagggcccaaggccgattaaacatctacctagacttggaggcccaatggaggacaggtaccaatctacctgggcccaaggccatcagctagcgcgcgtgcgtgacaaagacggcccagcaacacctaggtgtggatcggccgcagaatgcggaagaaacgagatgcacttcatactgtgatgacaaagtgatgtgtggtatcaacatcgaggttccgtattcaatccttagcacatttaaagtttttttaaaaaaaatatttagagtgacgtccctctctttaaatctcgttttttaaaatgcagagaaaaccatgagcaacgcagcggcggaagacggccatcggtggtgtatcaatttgctagtcggccgtacaccgtctggcgggtcgttgtgtttggcatctgcggttctgcacagtactcttttctaaccgtccgtccctagacaacttctttttttcaccgtgtttggcaatgcatgcatcgtacttcgatcgatgtgagagacatagtacggcactgtctgggacgaccgtctcagtgatcatcggccgtaccgtacgtgattattccctgaacgtaagtacgcactcgtgtgaaaacgacgaattgcccgtccttccgcaagatggcacatgccagatgcaaagaaatttttatgtattcccttcatcttaaattatagggtgttctgtttttttaggataatcaaactcagtaacttttaactaataatcgtactaaccatacacacagtattatacatgttatattataaggtttgtattttaaaatactttcatttgatgctaattttatatttgttaggaacataacatgaaataaattaatgtgttatttatgaccatgtaaaaaaatataatttgggacggagagactaacacactaaaaaaacataagctagtaactcgtgcacaatactgttaggaggtgaaccaaatctctaaggtgttatcttagatggctaaaacaatccaaaacaataccattctcatataaagtctagaacaataatataatttgagaacttttaggtacaatacgctggtagtatatactgctatataaacaattcaatggtgaagattgatttgatcttccacttaaatagatcatagtataaaatttataagggtaaatttatcttttactttgttattccacaggtttatttatgctaaaaacaaaatagttgatctagataaaaaaatttggtaccatcatcgggattgtataaatatgtgtaaacctagctagcaagatttggaatgtgtaaggcttttcacgtatatctgctatggtacaacctaattatttgatctgtaaatggtcatttataactgacgtatgtatgtagatttttaatgatgatcagaattgatcaggaa

SEQ ID NO: 68576 - DNA, 2999 bp, Oryza sativa
gatcgatcgatcgactctctgatcaaccctgcacgctgcaatatatatgcttagctgctgttgcgtgattccggccgatttcggcggtcaatccgtgcatgattcagcgtgcagactacagtaggagttggtactatgcgcacgttgctttggacccactcgtacgtgcatagtatatgtgcaatgtacgtagtaacgcacggcatgtttcgctattgcccgacacggccgcgccgtgacgcgcacatacgtcgtaccgtgctaactactctcaccttttcatgtggttatcatcatgcatgggacttctctcgcataaaaccatatcaaccagattaactgtagcattagtttgtatactattattataagttgaggcaacctagttagaagggatgtgcagatttattgtactagacttctatgttgtttgatcgagtaatagctatatagtgtgtatgaacgaacaataaaatttactgaaggtagctgtacatgttagacgaccggggtgacaggcgaggttactactctctccgttttacaacgtaagtcattctagcatttctcacattcatattgatgttaatgtaggaatataaacgtgagaaatgctagaatgacttacattgtgaaatggaggaagtagctatgaagatcgatggaggaatcgaagggttggcaggtggggataggagggagaagacaaagtcgcgtgagcccactctcgtgatcggctaaacatccgatcgatatccgtccaagcgacgcgagacaaggtgcaagaagaacatccgccccggtacctgctcctgctgggcaatcccatggcagccacacctcccctttttcagcgcaacaaaggggtcttgctttcttcagctctctctctctctctctacctagctagtacaccatatatagctagcttcactcccatctttgcctcctcctttcttcactatgattaaccaatgctgcatgtgtgtatgtgactacggttgtccaattgtattttttaactagtttgtaattgcactctgttttatcggtggactatattccgttggctttcttaaaaaaaccagtttagtaaaatgaaggtggatatgaaagaaagaccacatacatacatacatacatacatacatacatacatacatacatacatacatacatacatacatacatacatacatacatacatacatacatacatacatacatacatacatacatacatacatacatacatacatacatacatacatacatatatatatatatatatatatatatatatatatatatatatatatatatatatatatatatatatatatattgatgtttattaagagataatgaggctcaaaccttggctggctagtccaccaacttgtggtgctagctgataagactccgagtctttctcaagctagatcggtgaagtaatcttccatctacaagaatgtgactatggctgtttatttcaacaggtttccatatgaagattgtaaaatatacgaatgcgactctacgtacaataggccatgtgtatattgtcacatatcgattcaacacgataagttttagtataattgaaaacgaagtttcaactctggtgagattattgtctaatgtgtgtttcccggttgactcaaaaggcattcttcgagctaaacaacacttcacatgtcttaattttgtatttgtacgatacttcatgtcaacatcagacatgtatctttcggtgatggttggcttataggtatagtaataacgatatgtttgtgacatcaaggcaagatatgtatctcaactaaaagaatatccagggattgggtaatttcaaagatacgactaagttcacacaaatatacataccacgggctagtttgatatcaaccgacgacttaacttgtatgtgactagctagctagcagtacatgttacttggtgagcttagcaattcgtagcctacaacgatgaggacatgaccaactttttcgtgggagaaaggagaggaggaaagtaggagtactacataattgattatacacttggtggtccttttcatcttttgagtcatcttgatttggcttcttctcccggcatcatcagggctcaatcatcactccagttgggccctttctccatttattatgtaattattaatcaagtagtactctgattgttcccattgagccctaattttgaaatgacatggagatggtctctgtcgtccctatgttcaatttgactgcagataagttccatccacatagatcaagaggtcgatcacagcttttcgatctgaagtgaaaaaccatcagttcttcagttagtcatgcatgcagcatgcatataaatatgtgatatgccgttgcatatatatagcattatagactaatcgattgatcaatcaatccgctgtgcaaaaagtgcaagatcactcgaattaaactgtggtcctagtaataattaaccggcaaagctcaagtacgtactatatgtacgaagcctgtctcactcaatttattgtactcatgaatgaactcaaatcaagctctctaatcaatcgagctaactttgcatggcatagcatatggtcagcttctagtagtcaaggtttttggtttcaaaaaaaaaaaaggcaagatgtacatcccgtacggcgacgtatatatacacacatgtatgttgattctctaatgatctagatcactctgattattgctattattagtgtagtacacacattgacgtgtgagtcacggtttcacctaagttagctcacacaaaggccgaccaaggatatatataagatgaaaatttgttatttttctttatatgaatatcattaattaattaattaagcaaacaccaacaactaaagttgatcctgtcgcaataacaagagttaattaattagttgcatatcttatcctaccaaaaatgagagaatggaatgtacactacgaccatgcatgtacata

SEQ ID NO: 68577 - DNA, 623 bp, Oryza sativa
ggtaatgggcctatcaccagctagagatttatgttctggaggcccaatttgaattggtagcaatccaattttttatgggccagatgggccgaccatttcatttagactcgactgccgatgttgggtgggcaaaaccgacggggcagagaagcgccggagctccgccggccgcgtcgtggccatcgatccgctttcgccggagctccggcggccttgagccatgatgttacgcctgatctgctgctggacactgttaatcctacctgaatctcacaccagctacctagctagcattgccattgaacctccgacgacgactagctactcgaccgatctgagctttttcatggcaggccaaccggccgggcaaccccgctggcgcagccagagggatcagtatcagatactctacagtcgacgcctttatcactaacatatagagccgatgctttgttactgacatgtggacccagaactcatcgaactcacatgttagtgataaatctaattaaggtaaggtgcactcgactacagaggatctcaatcccggccagaggcagaatccattgtattgcggttcgcccgaccgtgggtgactcgtcgatctgatacgtgcgatccaa

SEQ ID NO: 68578 - DNA, 13683 bp, Oryza sativa
gtccacgccgtcgccgaagcacgtggccacattgagcgcgaacagcgcggcgtacaggcagtcgcggacgggcaccaccacgcttgcccctccgccggcggagcgcgccgcggaggccgagacgtcctcgacgagcgcccgggcgcggcgcgcgcgaggccatgcaccgggtggaacgcctccgaggtgaggttgcggcggagcgcgacccagagcgggccgtgcggcacggtgttgatgttgtgggcgcggccgccggagacgatggaggtggcgccgccgccggcggggcggtcggagaacgcgtcggcgcggcggacgagcgcgtcgaccgcgacggcgccgtccctgacgacggtcgtcggcacgtcgcccaggcggacgccgaggaggcggagcacggcttcccggctgatcgccgccgtcttccacggccacggccgcctgacgatggaaagcaccgctgcaatcatcaagctcgccatggaaacagcgaatagtgaggcggcgtgaggtagcaagctgcccatctccatggtcgtcgtgctcgtcagctctgcatgcatccaatccagtgtgtgattattagctttattagtaaaagaaaaaaaaagaccgagacgttgctttcttttaaggctacttggccccggtcaatcgccagctaatttaatcatcgccctcttgcatagattcgttgaaatctatcctatcagcatgagctataaattgtgatttgggagtattttgtattgttaatcatgcatatggcttcttttcttctgagatttagtcactgcaacaacttgcattcgtcggttgttcttccagtaacctgtcaaaagcttgtactttcatattataaatgtctagtttttttttcaaatttctttaactttgataaaagcgtaacaacattttaaacaccaaacaaatatattattaaaatatatcaatgttagatttaataaaactaattttgttgatgctgtagatgaatgttattactttttttctctatatggatgaccgaacttaagaaaatttgactaaaaaaatttaaaatattttataatatgaaacagaggcaacagtacaatagaaaaataaccctgttctcatgccacctatagttattgtcgtttctctaaaatacagagtaattgacttgttgtttatcttcttcttttcctttcacaatagcgaaaattttgttggtccggcctagtttaatgcactcaacaggttcatttatttggacaagtggaatggacaattgattatttatcgtaatccatttaatattcaatcatatagatagatgactagaacaagttgggttatcgtcacgttgaaggctttaataccgatataatctagaataagttttctcatgagtttgtttgtaaaatgagttttacaaaagaatcaaagatacagcaactacagctcaatcctctcctattcagtcccatataaacgcggggataaattcaatagagaaatcgagacaacgagataattaagaagatgggattaaaacatgtaggtctaatcgaacaaactgggcctataactattttacatctgggcactacacataacacaagctccctttgttgtttctatgggtaattaattaacaagatatggacttctatccttagcatgaagcgcatcatgagtttaacaaataggttgcaaactcatgatgtcatctgctttcattacccgttttgccatctaattagtccgatcaatgatcaaatgcatgtggcttccaaaatcagacgatgcattgacagcttgggtatatcacgctctctttaaaaggaaagtaaaatgcacgcaaacgtatcatgttatctctatattgagagcgctctcggtttagtttttatactaaacaatatcatatatcctcctcgtgtatattttaacatatttattcatttgcatctgtaattgtcagaaaaaatctaacctaaatttattcggaagacgattaaataattgcaatgatattctatactctcctttgtgcataaaacattagttcgcacttttactttgcttgttttttcgagattcaactccctcctatgatagcctccctgaacaaaggctcgtatgaaaacggtagaaaaactatattaaccgttttgtacttaatattttccccgaaaacagaaccgaaaattgtagagccggaaaatttctcaccggagaggttcgtggtgggcatggatggagttggaaccgctcctcactgacttaatgaaaactagtaaaaccgatagaaacaaagctagtcccggttcgcaactgtttttagtccagttcagcaactgggacgcacaatctgggactaaagatggggattcgaactcaagatctctcacctgagaccttacgcgcgttaccatcccacctattacacacatataacatataagttagatagagatgctttctttttaaactaactctgaagacatttttagtccgagttggtaacaccaatcgggactaaaaatatctctagtctagattggtgccaccaactgaaactaaatatcaatttttagtccgagttggtgttaccaaccgggactaaatatctttagtccactaaagatcgttgggggcctgacatggcctgacagctatgaactgtggttaaaaatgatttttagcgtcggttcctatttgaatcgggataaatatgatttttaccatccgagtaaagattagttctttggtagtgaaaacaacaacttatgttcaacaccgtacggaaagtggtttcgatcggttttgtgaccatgcaacacttgctccgtgcatctgttgtgtcacaaacgatgaaggcggtggactggtggcgtcatgatttagtgtgtaagatctttttttttaaaaaaaaagggataagattcccatctttttggctctatagaagttataatcaatcattacaaagtctaacaataaaacattagtttgtattgtccctggcgtggatcgaggcagctccctcgacggcgcggatcgaggtcgactcccacacgtcgacatttattcttcttaggatgccggcggcgacccagaagcggctcggagtggtggcccgatggcagcggtgggatgtaaggttgcggcagcctttggtgaagacgacgacagcggcgacggctgcaccctcccctccgtaagatctggcgtgaggggaggcgccgacccagtggcggctcggcagcagcggcggcgtgcggaggcggtatgattcggacgccgcgggctctgggcgacctcctcacggcgcacagcggtcgcggcgggatcgaggcggcttcgtccccggcaaccacctctctcattctttgatccctggcgcgtgtcctcggcaccttcgttggcaccgccagtggggatcgaggcggctccctccccggccacagccatcagcgcggatcgaggtcggctccctccccaaccgtcgtcatttcttcttcttcggatgccaggcggcagcgcgcgtcccaggccaccgctgccatggatcgaggcggctccctcccctacagttgcggatcaagtgtggctccgtccctatccactgccgtgtcctcttcttcggtcaccggctaacgtccgtggccgcgtcagtgcggatttggacggatccctcttttctttattcttgtggttattttttctaaaaagccccttcattttttatgtttacagcgctacccctagaagcggaattttctcttctttgtgttgtatttctatgaaagacgaggggttttcggtaagaaacatgataggtatcaaacggtccgagaacatatgcgattttccgtgcaaacacgaggagcttttcgcaaagttgctaaccacgtgtcaaattctccgaggagctaaaaaaattccgaaaaagaagaaaaatcgtagccttacggctttaaatgattgatgatacgtcccaacacttcaattgtgcccccaccaaaaataaaggagctcagacacatggtgaactccagtaggcaactggcaatgtctgcaatcctagtggatgtaaaaggaagacgtttcaaataaacatggacgacgagttagcgaatttgtacacatatatatcttctactatataccaattaaataaggcgaagcttttgtctttgttttcatttaaaaagcaccttgtttttcctttaacgagcaatttgaattgaattcctatagattatatgtgttctctattcagtatttcagctggatatcattagcagggacccataatctcgagtatctgttttttatcttttcatgactcattgatcgtgtgcttgttggtagcagaggctagagactcattcatcgaatttttgtttatagtttaaatttcttgaaaactgaaattccccgagagatcaacttttgaaccagctcgaaatcacggaatgtctagatcggaaaccctgcttgcacattgtatttctccgatagccgatctaatagttctcagaaaaaaaaatgatagcctgtccagctgggccttaattaattccatccgtccacgtaaggaataagttcactggaggtccctcaacttaacagtgagatttttcgaggtcccttaaccacaaaatcagaaatgtgtacccctagtaggtcccatagcagtatttttgtccggttttgctgacgtgtcatcctagttagaaataaaaaattaaaaaaattacgtggggcccacatgtcaacgcacattttttcctcctcttttcttctccttctcttctcttttctctcttctctcttcaccggcagcgggcagcgatgggcgagcgcgggatgcgggcggcgggcggagagccggcggagtgggtggcgaagctggagccaagtgtgcttctagcgacgccgccacggtagacgaaacaactaatcggccatcgctgctccgcctgtctgctacgcccatcgaccgctcgccatgcaccgtgctcgcccgcccccgccgacgggagcgaggcggccggccacgccggcgtggaaggggcaaaggagggccgagagaggggtggaggcgacggcggtggcgctgccgggttccttcccctgtcgctggtcgctgaccggtcgggggacgacatcgacaccgcgttcaacccccaatggcattgtacgattctactgtttgctatatagctcaacggttataaagcttgaaggatgaattgaagcttcgcttttcttgagctatggtgtttctttgggttttcttcttcgcagggaggtgaccaggcgctgtacaacgggttcggggccgccggaatgcatggcgccgccgtcatgcaaccgccgacgttcgggcaggtacgcggccaagaaccagtactcccgtgggttcaacttcttccccaattcattctgcttctttaccagcgttggaaacaactacctgccaccgccgccgcgctcacctacccccgccgctcctgcctgctttgcctgccgccgcccccgcgctcacccgctgttgccccgcccgtctcggcctgtcgaagaagagagaagagaagaaaataaaggacaaaaagagaagaaaggggaagaaaaaagtgatgtggggccacattattttctctcactgacatgttggccccacatatttattttattatttttgctgattagaatgccacgtcatcaaaaccagccatctagatttctggtttaggggtgaagatttctgattttatggttaagagatctcaaaaaatctcactgttaagttggggggactccggtgaacttattcctctacgtaaatacgtaggatacttgggcttagaatctcggtatgttcgtgaggatgggccagaactttttggcccataaacaccttagagagccacacccaggtgagatccaaaccgggggaagacagacatcgatcgcacggtgcggtgctaaacgcgtgcggccaaatcaaaaaggagggcgcgagccgcgaggcgagcgaggacgagtccccatccacaccgccgcaggcccgcagcacgtgccgccaagccgcgtacgtgcgcgcaggcgcgagcaccgcaacggacaagatcgccaaccaaccgacgagacgagacgcgggcgcgcgcggcgccaccacgctagcggcaacgcatccacgcagcgcggcgcgtacgcacggcagcagcagcagcaaggctgccggtgtttcggctgtgggcttggtgggtagcgcgcggccgcgctcgcgctcgccttcccgcagcaacaaatccaccacgagacgcacgtacgccgcagcattctcgcggcctcgcgtggtttgtcgcgcggttagctcggtcgccttcgcttgcttgggagaccagaagtagagccgtaacagcgctgctggttttgcgcgcctaactctcatcggtgacattgcgaaccgaattcggagcggtttttgcttggtcgggggcattggacaaccagagcgtgacaccaatgcgagtcagcacggtacatatttttctgtatcataggcctgacgatgacgaggcggcttgtttttggtcaagggtatataggcaggtaggggttcagttgcctaacccggcctttgattttggtttggtacatgaagattcaagggttagaacttaggctgcgttctttttatgaagttgagaacttctcttctccacccataaaacgggatgattcattagcacgtgattaattaaaatattagctaaaaaacttttaaaatagattaatatgattttttaaaacaactttcaaataaattttattttataaaagaacacctcatttagcagtttaggaagcgtgaacgcgaaaaagaggacgtgaaagttgggaaagtaggggaagaatacaacctatgtggattgggaactaaacccccatgcaaaaaaaaaacatgaggcatattagcgcatgattaattaagtaacagctaaaaaaacttaaaaataaattaatctgatttttaaaacaacttttctataatttttttttaaaaaaaacatcatttagtaatttaagaagcgtgtgcatgaacaaggaaatggaggttggaaagcaccacaaacgatctcaaccttagagcaggtttaatagcttagccaattattagcttcaaatcatctgtagttaatctaatacatcatttatacaatagtcatctataaatatatatactacatcattaatacatagttccacatctcatatacacaatatttttcgtactgcggatgactacaaatatgtaatccgcttttcttctctctcctctcttatctactacacgtgctcataacccacttgttgtctgctgttgtacttgctttgagaagagcatccaatctactactccttccgtcctataatagaagggattttagaggatatgatatctcctagactagaaatctagacagaagtctgctcagatttgtagtaatatgatatgtcaaatctattcgtaatcccttatattttaaatttaaaaaaaagaaaaaaaaaacatcaactctaataatgtgatggtagcacagtaaaaaaaaaccagaaacagtaccggtcttctccttgaacgaatccctatcaggggtcccaggcaccgctagctagctgggcatgacagcatttctagtacagtttaaggcgttgcctgaccacgtatcgatcgatggatatatattcgctccgtcatctaaaaagcagaaacaacatgtccgcgattcctctctccctctcccaggctagtaccaatatctatacaccatgtcagttgctactagttcagatttcagaaccctcgatgtacacacatactactctactgccgcgccgcgaaattcccaggagaactcgcacacacatactcctactcctacgcaggtcatccagactgcaagaaacgaacgagaggcatcagtcatcagctgctgcgcctgcgttacttgcagcgacctgcacaacgagcagcagccagggtcggtaccaccaccacgacatgggtagaaacaattgggacgacattggtagaagggtaaattgtaaccatactattataattttgtaaaatttaagatatgacatcctgacccacatgtcattgactcatgtggatcctacatgtcattgagataccgatgacatatctcaaactttgaaaaattataatggcatggttccaaacttggtagaaacaccacggtttcacaatttccgaaccggggtaaaaaaaacccactcaatttttcggtaagtttagaaataccaaagtgaattttaatttgtttatagaatttgtttgggttttatcgtgtttttttttcagcatatcaaccgattacgcaaaatccgatgataccgcctgtgagcggattttgatccgctatctgttgtatcgtgaaccctgttggaaacatttggaggtgttctgctcctctcgccccgacgacgtgtcaaagctgttgctcctgcctctcctgccacacacgcagacgcaggcagtgcaggcccgagactgagaggctgtttggttgctaccctgagcaacatgcctgagtatttttcatgcctgaggataggctgagcttgcttacaaaagttacctgaccaggtatggcttaaatttaagatagtgtttggttaaagccctgagaacatgctatctgaaaaagtgctctcttttttctagtagctctcacgcatagagcttagctccaactgatggcaccagattttagtggaggaggaagcagacggccaccggatctgcaaggtggagcagccccttagtcgctgccgccgcagccatggatggatcgatggggattgttttctcctcctaaccctacggtggtacagtgaggaggagaagtggtagaagagaggtgattctactcaggcatgttgggggaaatgccatggcttgctcaggcaacctttttgctacgcctgactcaggcaagtttcgtcaagcaagattcctcaggctaaaattcttagggtagcaaccaaacacgtctcagacagattataggcttgggctcaggccaggctggtttgctcaggtagcaaccaaagaggctctgcctgcctgcctgtgcctcgctctctcttctttcgcagtgcataaaaagcaatcaaaaacagggtagatgctggccatcaggccatatccctccgtcccaaaaaaaaaatataaaccctgattttcgtgcccaacatttgaccgtccgtcttatttgaaaaaattatgaagaaaattaaaaagacaagtcacacataaaatattaatcatgttttatcatctaacaacaatgaaaatacgaattataaaaaaatttcatataagacggatagtcaaagttggacatggaaactcagggtttgcctatttttaggaaggagggagtatattacttgtactgctgcattctctgctcagagcctcagtaacaaacagattacagatcactatactaagggcatgtttaattggtgaaataaaaatttttggatgtcacatcggacgttttaccggatatcggaaaggtttttcggacacgaataaaaaaactaatttcataactcgcctggaaaccatgagacgaatcttttaagcctaattactgtcattagcacatgtgggttactgtaacccacatgtgctaatcataggtaattaggctcaaaagattcgtctcgcgatttacatgtaaactgtgcaattagtttttattttaatatatatttaatgctccatatatgtgtccaaagattcgatgtgatgtttttgggaaaagtttttgcgaactagtaaggtggtgtttggatctagaaacttaactttagtccatgtatttagacactaatttagagtattaaatatagactacttacaatactaattatataaatgaaagctaattcacgagacaaaatttttaagcctaattaatccataattagataatgtttactggagcatcacataggctaatcatggattaattaggctcaatagattcgtctcgcgaattagtccaagattatgaatgggttttattaatagtctacgtttaatatttataattagtgtccaaatatccgatgtgataaaaacttaaaagtttcagtcccatttaaacagggtctaaacagggcctaaacagatagtactgtagcattaggcattggtccttgattactgcatgctgttgctactgcttctctccggtccagtctttcgcttgctgataagttctgaagagatgccgacatgagtggttgaggtttaacggtttcaagcttatactccatatgagtaacaagtatattctagtactgtaacaaaagaagttgtttagtactttgtattatagtactttgttgaatatccaatgtcgtagtacgtgtgttctggagctgcctggtcctgcaatgctgtagcttacttccaagtcgagcaggacaagcagattcctgggatgatggtgccggttgggctgctccggggaagacacaagaaattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctggcctggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacagaaattgccccattgatcgtgaccaaaactaattataaattgtaatggtttattagtgataaaaagataattgatgtattaaacttatatatatatatatatatatatatatatatatatatatatatatatatatataagctcttagtagcttaaaagctaatgttttttttaaaaaaagactacgttgaaaatactcaaaaattaacttcaaactaaaatttagacagaggttgataaggttgtagagtaaactacgaggccccaatgtctcctaccggtaacgaatgaattactgctgaaatcgcgactatttcgtgccatgaaacagtcgagaaaattaaaaaaaaaaaggcagagacacgtgcagctagacgtattaagctgtggcaattgatacgtgcaaacgagtaggtgaaccaaaccggccaattcggcgtattggacaggctgatggccataaaagtggatgcatcgtgccatcacacaccaccagaaatattcaagacgtttcgtgttaattaggagtaattagtactccagtgtactcctacatacacataataaattgaagacattgagagcttttgcaatcttgcatagattaatctgtcgatcacgtacgtacgtgtatatatatgcgcattaagtcatcgatcgaaatggacgtgtacgtacacgagctgctagctccatggatcgtacgtagacttctgtctctctggatatatacatatggatatatgatggatcgtcaaacacacaatgacacaaagctaaggagaatttatcaattattcctgcgtgcatgagtcacgctggccgtaaaacgtacacttcaaaataaatgcggcaatattatatagaattaatactacttcataaaataatcccagttaattaactaagtccatgaatgcggcaattgtgtctaatatggagtaattctatccaattcagcactgttgatccgttctgaataaggttaagaacactgatgaaatcagagtgagaatttctctcaaaaaaaaatcagagtgagaatcatctggctgtagcaacatcaaaagcaataattaatgttcctaggctgcaggtgatcacgtgcctaaccatctaggttatctcgttaaccgaacatattaacttactcattggaacctaccattctgatcctacgaccaatcaagattaccaacatcactatactgtctatgactgcatctaacccaatactccctccatttcaaaatatactacaggcttgtgaccaaagtagagagatcagatgaaccacaaatcgaaccacaaacctctcagagcttccattaagtctgtgttcgggaggaggggttgggaacccctccttcccggaacacaaaacgaagatcgttttattgcatgattaattaagtattaactattttttttaaaaaatggattaatatgatttttaaaaaacaactttcatataggaagtttatgcataaattataccgtttagcaattttaaaagcgtgtgcgcagaaaataagagagatgggttagaaaaatgagggaagaacacagcctaaatctagtagcagagctagctcccggggagattagacggtcactcgggcatcgccgttatcatcttcactacagactaccataacacccggtaaaataagtcgatcacccaaaaaaaatactattagttagagcaatcaaattccaaacaattttagctaatcgctagcgatttgccgcccgatcgagtagcaacgagagctgaaacctgaaaagacggtaactgcactgcggctgatcaggaaggagtccggttttgactctgtcgaggattcgaggctgcgcatctgcgctggattttttttttctgacattggtcttgttggatcctccgagctactccctccatttcataatataaagcagaactacttttttttaagatgttccataatataaagcacacatgcatgtaggtaattaactaagatccattctctattaaattattacttttttaaatccttcactctcatgttctctaattctattggatacatgcattatatttattaggatgatctaaactacaagatgataataattatttcttggtttt

SEQ ID NO: 68579 - DNA, 13730 bp, Oryza sativa
tgccggaggggataatccagccggcgatggactacgcgtgcggctccggcgccgactgcgactccatccagccgtcggggccgtgcttccggccggacaccatgatcgcccacgcctcctacgccttcaacagctactggcagcgcgccaagtccaacggcgccacctgcgactttggcggcaccgccatgctcatcaccaaggatccaagtaagcttcttcttcttcttcttcttcttcacgcaatccagtacaaaatgaacttcttcagattgttcagagttcagactttcagtgaccaaatggtgcagcaattatctagttaacagcctgtaactaatgtgaccttttcttttctgtaatttgattttgtttacaggttatggtggctgccattacagtacgatgtgatcagatcacaccaagaaatgcggggttttggatgttggacaggaacctctgaaagtttcaggcttcagaggtactttgttctgatgttgctaagggtgtttattgcagttgatcactgattttgtatagagtaaaagggctcaatcaatcctatttagagagattcttctaacttttctttttgggcacttcttattgttttgtattgttctgaataaggttatgtaatttgccatcttagtaaattatcataaaggcaatcgaggtaacatctgatgaaagtacaggtaactgcacaacagtgatcactgaaaaaccatcgactgtatgggcaacatttttcagtgccagatggtaatgtttattctggcacatagcacactttctcaagccttatctgcagcgtaagatttacatccatgcgcgcataaatcgacctattactaacctctgaacggttgccactgtgccctccttgctcatgctggaacttcatctgaagaagggaatgactcaagaacataaactggatcgccgaccttgatgatccttccttcatcttttgccgacagagattccttgcagactaaattttgcccaaaatagacctacagaaacagaaggcgatgaatatggtcagttcttatgtacttaaactactctcagcttctcatagtctcaagtctccctaggataaatccgtgacagtttaatgacaattacccggcgtttatttttgtggctcggccgcaacacttcatcaaaccggagtgcttgtagagcttccgttggttcctcaccaggaatcccattatcttgattaatagtaggcacctgaagtagagtacacaaaaactaaggcaagagtatagctacactagctgtctagcttggcagttcaagaagtgcaaagcatacagacaaactctgatggtttaactctctagcaattttacataatttttttttataaataactgttgtctgaatgactccagaatcatcccttagtttgtcggtgctaacttcattgcaaagttaaacatggcagatctggagtctatgaaaaagcaaactacacactttatgctcatgcagagaacaactgaaatatcaattacataaattaactgacagtatagtcgttaatagatcatacagagaacaactgaaatattctaagaggcagaacaactcattttttttccaatcttccatcatgctgcttccagacaggaaccagtactttaaagccaccaaagtgcacaacactagagctgacagttttaccttgcaacgatcacataacttgacacctaaaaatgtcagtttccctatctttatggtcttccacagatcctccgagtatggatgacatccatcaactataatactggccaaaagaaagcatttgcaaagaaaggcattattacagaatgacaggtagatttatgcaagtaggtatatagcaaaacaatccaagaaataagctgtgaaaaaatggccatactttggtctgaagcgattcattggtacaggttctttaaggatactgtttagtgcatccactgagccctatagtttcgatatgaactgtcaagtgtcaactagttacagtattgtgtttagaagaaaaaaagaacttttgtacagcatagaaggcctttctccagaaaccacagaacagcttaatcatacctgggaggccagcaggaatgggaagtcgtcagcaaacagaactttgtaaccttgagcatagtcaggattggtctctctaatttctgatgctgttgaaaatatcacaaagagatatatatttcataagcaaagcagatcctttttaagtcaaaatagaactttgtaaccttgagcatagtcaggattggtctgcctaatttcttgaaatgtataccttcattaaaccgtacgagtcgagtcggcttcccaaagtaactggaaaaccattcggccgcctcatctccttcatcatacgcagaaccagaccactcccagatagagacatcatcaactgtggcacgtttcgcgccaagagggatcttcagtggatccaatccgggtgctctgataactgcaattagcaatgcctcagataaaaatgatatccttagcacacccactcgaacatgaaagaaaaatggcatgacattgtgtgattgagcatcctgccaagaacattttagaaccaagaaaacttctgcagaggtaactggcttattttagcaaagaaagcaaaaaaaaaaagaagaagaaatagaattagtaaatcttattgattggcagtcaacctatcatgctgacacaaaagataaatcaaagtagcaccactgcactttacaacctccccttttcacatcaatgcagtatgcaacccatttttttttcacacaatcctatagcaattaatcaattgtattccatgttaacaaatcaatcaagttcacattataattgtacatactacatagaggtacaacatacatggattgtaaacagatgatgaaattgggaaatacccatgtgagaatcaggcgttggctgccactcagtgaacgcctcttgcggcatctccacctcaatcagcgcgagcttgggctccactcgctgggtgaaggctctccctgcggagttcatcaccagccacggtcgatcccacctcaaccctgcccatccaagctcatcatcaaataaatcgaggaaaattcccaaatttcaagaaaggggagtaagcagagcagagaagcaccggtggaggtgatggcggcctggggcacggagatgcccctgcatgatttgatggggtacacgacgattgacttcaccgtcgccgccgccgccggctccggctccggcggcgcctcgccgctgccgcctgccttatccatggctaatggcttgctgatgatgccaagcctcctgccatgcagtggcaccacgattttttaaaatcatgtccaatttttgcattttattagtcggattggttcttgaaattacaatactgacccctatctctatgatttgtagtactagtatataggagtatgtgaaattttacgacacgtgtccaggattcttggaattatgcaactttagtgtaagctactgtagtaaaatctgaactttactgtgcacaaagtgaatacttcctccagcatgggatgggcatatgaaactgactgttcttgtgattctctacattctctgaaagttttaggcttcagaggtacaggccgttatgatgttgctaagggagtttattgcagttgatcactgattttctattagagtaaaagggctcaatcgatcctatttagaggggtcttctaacttttcctttgtcacttcttatttgttttgtattgttctgaataaggttatgtaatatgcaatttgctatattaggaataactatgatcactgaatatcaattgtatgagcaacagttttcagtgccagatggtactgtttattctgccacataataaaacacattttctcaagccttgttgcagcataaaatttacaatgatgccgagaaattcagcattctacagtactactaggtctctgaacagctgccagtatgtcctttgctcatgctggagcttcatcggaagaagggaatctctcaagaacataaaccggatcgctgaccttgatgatccttcctttgccctttgcagacagagattccttgcagactaaattttgcccaaagtagacctgcagaaggcgagaaaacagggagttctcagtgacctatatgttctgaacctggttcatgagcaacttgaaattgcagattcagcacatttgcatttagtaattgcataattcaggactccaagagtagagtaggttgcaggaattgattacctgccgtttgtttttgtggcttggacgtagaacttcatcggaccggaatgtcagtagagtttctgttggttcagtgccaagtatcccattttcttggttaatggtaggcacctgaatcagtgtaacagagaaactaagcaagcggtacatgtatattggattaccaaagtaaaatgtcagataacaccaaaaaaatatggtgatgtgaaatttaagtcagactccatttcacatacaagtatataacctcaggcttcttcatttaatgaaaactacccatggcacccatcccattgtagaatcacttccatgattcaaagttatatctcaactaaacaaaggccacatgccaaaactaagttggtgaccattctatgtatctgatagaaatgaagagagtatggaagattcaaaaatccatgcagaatggttatatatactcagagagttatgatttaacagatcacacaaaagatttagtacaagtaataatattaaccggcagaaccatcagttatcaagtatccaagtatcctctcagacagttttattcaaggttaagagagtatgggttgataatttgaaaaaacagggtcatatttaccttgcagcggttgcataacttgacaccctgaaatgttaacttgtttatttttatggttttccatagatcctctgagtatgggtggcatccatccaccaaaatgctgccaaaagatatcactttgtaagaaagcaagtgcaacaattgtcaaactaacggtcataatttaatgaccgaacagtaagttgtccataaaataaaagcgcacagatgtgcgggcttactttggcctgaagcggttcatcggtacaggttctttcagaacctcatttagtgcatccaatgaaccctgcaattcaacatgaactgtcaactgaacttttatgttgagcagcacttgctcaggacatctatcagcagaaactactgagcagtctgatatgtacctgggaggccatcagaaacgggaagcaatctgtaaacataattttgtagccttgagcatagtcaggattagttggtctgatttccgaccctgccaagaaatccacaaaacagacattctcaataaacaacagagaaaggaaatccgtactctggaaatcagaaaggttccaagacaggaaaaacagtactagtactactaagatataaaccttctttgaaacgcactagacgacttgggttcccgaagtaactggaaaaccactcggccgcctcagctccttcatcataagcagaaccagaccactcccatacagagacatcattaattatggcttgttcagcactgagagggatcttcaatgggtccattccaggtgctcttccaactgcaatttagtatcgcagggtagctcaataaaatggtaatttaaatggcatgacagattgacagtgaagctatcctgcgtgtgcggtgatgtaaaattcaaaaggcccatacaggttctactttttttttaatgagggggcaaaatcaacatttgtccagtcctacttacggatcaactattaacattcaactacatgtcaagataaaactaacattcggtaggcgactaattatctaaagcaattcaaacgttatttaacacagatgaagggaaaacagcattggctaaacattcttcagattgtttaactgaaattaatcaacagatggcatatacagaagtggtagtaaatgatgagataatagagggagaaggcaagaatacccaagtaggaatcggcggtcggccgccactcctcggcgaatgcctccggcggcatctccacctccaccagcgcgagcttgggctccaccctctgcgtgtaggccctccccttggagttcaccaccacccactgccgatcccaccggaaccctgccgatcgattgacgccgcaaccatccatcacaaaccacttctagctaattcagaagaaagattcttaatctttggagaggatgagcgacaggtaccagtggaggtgattggggcctggggcacggagattcccctgcatgacttgatggggtatatcaggatcgacctcaccgtcgccgccggctctggcggcacctcctcgccgccgccgaggagggaggagaggaatccagcggccttctccattgttcggctggcttagcttagctttgctttgcttgccgcaagcaagaaaacgaaaaaaacaacagtgataatctctttctcgcctagtgaagtgcgctcagtgccagtgaggtgtgcatttggtttggcggcacacggcaatgccaagttacaaaaatgcccctgctttctcagcaaccccagatagtataatctttgcacttggtagatgtatactccatttatcccacagaaaagagtgacatattctaatacaataaattcgaagaaacatatgtttaaattaatagtaatagaatatgtcacatctaatatcaggttgggttttttatgagacagatggagtacttatcataggaaaaggtataaaaaagtgaactttcagttttgctctagttgtggttgtctttatctctatgcatatcaacttcagcaatgaaagtttcagttctatacttccacttaacaatcatcttcatgtggtgtctttaacaaatggggcacctggaactcccaaatttgcactttgcacagcactcactgtattaaaaaattctttcagcaaccatgtctgaatcatgtattcctaaaagaacatgtttgaagtttgaactagtacatcacaagcaagttcaattacagccttacagataacacatatgtacacatagtagtagtatagcctgtctaacatttatcgtatatatacagaacaactaagaaatgattcccaaaatccatggtccaaaaagatccataacattccatgcccaactgctcaatcatcgtacaagtcgagcaggagtgtagtgcagcgacagatgctcctctctcctgaaaaccaacacattaacacaagaacgtcagcactactgcatctatcatctcgcaatctcatcataccaatataagaatccatgaacatttcatgaaggggatgaagaactgagggtttaattctgcagttgcagatactgacatggggaagacgaagtagagcaatgcgagcagcagtgccagcaggaagcaggccaagccgacgatggcgtaggcgcggccgaggaaggcgttcttccctccgagccacccggcggtggacagcaccagcgacttcttgccgttgaagctgtacgagttgtagttgttctgcatcgtcacctctacacggtcaccggcctgcagatccatgtcgattctcccgtacagctttctgaatgttggcagtgctgctattctcatccagacgatcagatcttcctgctcactcagctgttgaatttgcagacacagaggttagcatgtagcaagtattacttcgatataaatttcaactcaatcttgttaactgttcttggcaatgtgccttggaaagttagacaatcttacactgtatattcctgaaaatagttctgaaactcaaaactgaacaactattttgctttgaaaatggctatttacgacgaaccgtagagaatggacgcatgacatttcagtcgcaagttaccaaaacacttacaggtttgcttggatttaactgccctccaccaatcaaagtcccattctgaaagtttttaggatacacgttcttgccaatctgcgattcctttcactcttccacgaaatgccatccttgttcactctcaatgtctcgttgccatgaccacgagtgaagctgtatgtgtcgttgaacaggctccaagctatgagaccacaaggaacaataggtctgccattcgcagtagcttcagggctgcagtattgcgtgtcggccaccttcttcggatttctcagctgcatatcgttgaggctcttcacatacctgcgttcccaatcagagtgattcaactcagacagataggttttacttttgtatgaattggtcaataaaattattagccagatttctaccttctgtggttctggtagaacttgtcaagttgataatatatgtaaatcggcttcttcatatctttagggacctgcagggaaaaaagtcgttgttttaccttatcgatgaaagacacaaaatgtgttgttttcactgtgtactcaaaggaaacagttttaccttgaagactcttgtgcaagtcttatctattgatgagttttggataaaagcaactttgttgcgaagcatgttccgtggcacgcattttgtatcgtaacgatcaaccaattcaacgacctatttgaagaaatccaaacataagatggaagaaaaagcattcatttaccaatttgaataataatagcaagcacaattcaaccttaccttatttgaggctgcaatgcaagcaagaccaattggaatgaaaattaggcccacaaacactagtacaagaataacctgtaaattattcaaaattatgcagacagtcatcacatgttaaacttcccagccatattcataccgagaaaaaaatgttgaacagtgagattgtagcaaacaactgaacttacagtctggggtatcagtataggcttgcatgcttgaagttcttgctgcgtaaaccgatggtcttcaaaatcagaaagagtggatgcaaataagcacttgtttcatcagaagtaaatttcatgtactataaatttatccccaaactccggaagccattccaaaacaaagataattgcaagtgttgctgcatatactatacagtgctgaaatgaacacccgatagaacagttaaagatccgaagcaggtgaaggagtatacttctcgaaccaaagcggttgtggttaccataaaaattcaagtggcagcagaaagaaacataaattcaattatctggggagagagaaagagagagagagagagattacacttaggcctgttgcgcttcttcacggcggctgcagagccatcctcgccggagcttggtcctgctccgtcgctattcactggtggcattcttgtctccggccaagaacttgcctcagtgaagaagaagactcctctcctgcaactgctcttgagaaatgcaaagagaataggtaactgcccaaaatgtcagacaagaaacaaatagcgaggttataccggttttcagagaggatttcatcaggagagtacagaaacgagggaaagaattaaagaaggtttaggagtagaggcaaagcaaggaactgaaaggctactagtaagagtgacaacctgtcattgttgagagcgtcttaaacactggaaagttaaggatcacctaaccggtctgcatcacatggccctttcctctgaagattttgttggtgtttggatagcattggctggttgaacctgtgtatgtacctcgaatccacatgaaaagtcttgctttgctccgatatgttcatcaacaagacaacaacctaagtgtggggcccatgtgacagctccaatttgctaaggacataatttggatgccacacaataaatgaaaaaaagggtatatcataggacatgctccagagcatgaagtgaaatgatgcaaaatatccaaaaaaaagagagagtttaacctgacaattttaagtcactgtaagcaaagtttgccaaagttttggacaagcaacacaacatggtacctacttcaaccccaatataaaacttcacccctttttaagggaacagctcatgaggtcaacattccattgaaattattgaggtacaaacggctgcaaaaaatgcattgttgagtagtaaggtaacgccatcctcagcacaaagcaggctcaatgaagctcctgacgatcgcctcttacgtcttttctgtacctcaatatctcaacgcctaaataatcgacgattccttgtaccgcaacatgaggtttcccaactttcactctgacggctgagatttgagggaatttcagcaatgtggcactcgcgatgcgatgagctactgcttccaaaaggttccgcgatgggctttcaacaacatccttggcaatcttatagagcatgaccaattgaacatacttcagttttccaatggttggaattggtaagaataagcaaatagcagccaatgactttaccattcttaggttgcggaaatgaataagcaagtttaaatttttaaaaagtattcatccaagccattttaggaatactttacgaagcaagaaggcagaatttggttaccaataatgccattaaatccaatagaggccctttattttattattgaatatttaattacctggtaaaatttggggaagctactggaataagatcgcggtcagtttccccagcagcactcaaatccatccacgcatcaacatccacaacaaacttttggcccagagtcttctcttcttgtttcactccatggaaaccatggaactgcaaacctctaagtataagtttatccttgtcgattagctccctttctgccataacagtacctaaaacacagaatggattactcagtcagcacatggaacaggaggggcaatgaattacgaatgcgcctagatgataagaccatatttctgctaaccaccaacaacaattctgtcacctagccaacttgaatgaatcgatctgaagacttggttgaacttgtactaacctgacctatccgtgctcaattgattgtgttgtgaactgaaggaagctgtgtgaactgaactatagccaggagattgccgcctgatggcgaggaagcatgggagaccactggagatggacacaaaatgtttatatcctgaacttttagacttaggcagatgtgcagtctgacccccaaagctagtgcgtgcaaatgagagcataagctgcagcataacagtagaaggaacacaactgtcttatcttattaagtgtcagataatgagaaagagcaacagcatattcacacaacaatttgatatgcttcacagaattagtaaaagcatcgtgattacccagtaaaaaagggaggcatgtcatacttggagtgctaaacaacatcaatcaccaatcatccaaataaaaaacccccagggcctcaagcaagtaaattacagattgatcataggcgctaccacgaaaattgcttatgaaatttgcgaattacaatatcctccattcttcatacatggacgaatactgctaaaacaatcaaatcttttccgttgtaatactaatccgtccccaagaatttcccaactcaaaaggatttctcataatcggtttaaagattaggccagaggaacgaagaaccaatcttcaggagaaaccattatcatcacaagaaaaaaaaaagaggaatctctggagggagatatactaaacaagaaccagcgaagaacttgagggagatgaggaaaagaatacctgagaggccgtgaatccttgcgggagtggatcaagaaacacaaaaacccttctcctgggcttgtcgatggagaaggcggcgggagacgacgaggaatgagccaagatgcctgcttcccactgttcgtccctcccttatcttatctcttcccctttcctttttcgagcttttctcctttcccagaaaaaaaaaagtctttgcagcccaaatggcaatagaatttggccgtcatgtcatcggcaagattttcacagctttcaggttggtcgacttgcgatcagcttctgcacttcacagattcagctaagctacgctggatgaacaccaagcaagacgagagaaaaaatgttggcagtaaaagtgcagtttctggcgacagtaaaagtgcagttcagagaaactttttagcgcaaacgatgattgttctgcttagaaatggagctcaaaatttcccctttgaaaccacattacaccgcctcgaaggcttgaaagaaatgataacgcgtaataattcagtgactagaaagagaagcataaaacatttgctcggttattgagcagcaactgaaatcaggtttcctgagcaaagttatagtaagacccagaaactacaaaattttggtcagctcaactctttaactacagcagcagagcatctacaaattcgagatcagcaactatgagtacacagtctcatccttcgtgtcacagtattcaaaaaatatttcagtactcaaatttacgaaattaagacatgcttgtgctcagccggacctaatccacgcacatggccttttcttgtttatcagagcaggacttttattgtttcttgctgatgctgaactttgctgatcaagactctccaatttccaacaactgggtcagaaggctctaaccagtagaacatgaaccagaatgaactcacaggttagaatgtccaaactcgagctcctttacaaactggaaacacagaagcattatttctcattttgttgcctggagactaaacacatggcatgcgaggctcctattgcaacagaaatgacacgatgagggcccaaatcctcatcaccgtctgtgagaaaattaactttaaccggtagcggctgaatttctggcaaaccagggacacctaactggcaatctcttgcatttccccacatgtacaagtcacctttctctgtccagacaattaaacaaaagtaaactcgggttagttgcttagagcaaggaaatttagctgcttgcatgatgtagaacaagattaaggaaaaccaagctaaaacatggcacagagaaggaatctttgtacagcaaacttcagcattttctactgacctttgacacgagatattttttccattttatttaaaaccaagattcccctttataccatatttagttagcaaaactacaagagatgactaaaaacatctcaagaatcccagcacatcaataaagctttcacctgatattgcagcagaagtcgaacctccacaggctatatagacaattcgttcttcagacaaagctttgatagctagtgggactctatgattctgaagggttggatgcccaagttggccgtgtccaccatgtccccatgagagaacgacaccttcatctgaatacagccaaagaagcaagacgttagttgtgtgctacaataaccaccatactttcttctataaatgcaatttatgagtgaaaaaatctctctaactattattgccttatactgtttgttgcagttccaaaagaaacttgactcattatcagacatggtatctgattgaaggtcatcattgcatggtgcaaaactggcattaggtatggtcaacaactcacttagataatattttaaaatgcaaatttctttatttttcacttctgtatgaatgttcgtcgggaccttggttgcaaatgcttgtttcaccagtataatacagttttgaatttag

SEQ ID NO: 68580 - DNA, 2038 bp, Oryza sativa
aggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagtaccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggtgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaaggcaaaaggaggctgcatctgcgcaagggtgaggagccaatttttcggaccattcgacgcgtacgtcgtgcacgcgcgccgcctgccctgccaggccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgta

SEQ ID NO: 68581 - DNA, 1419 bp, Oryza sativa
ttcatgtatcctgccatggaggagggcagcagctacctgcgtccgttgcatttcttctccatcttcgttgcattcgcttccttctcacaatgtggtatgctcgtaattccccatgctcttcatcccaattcttgtctgtattttgtggtgatttaaatttggatcatgttcattgttaagcacaaccaaggcttaactacgtcgtgttcagatactctgaccgtcaaaagaatatatatccttcaataagctagtctagtgccacaaattggtttttttttttgacggtttttttctcaagcatcaaattcgttgacccctataagctgacaatcaaatgatttgttggttgaacaggagcaagagtgttaaggccagatgagctactactcgatcactactactaccactcgtcgtcgtctgatccatactacagcacaccgatccttccaccctacggcgacgcattctcaccgccgaaccctcctccccctcctcctccgatgtcacccagctgcctcctccctccgatcattccggcaccaacattcacatacagttctcctccaccgccgccactctactaccctccaccgccggatataagcccaagcccgccaccgtctgttacaccattgccacctgtagtctacccgagtccaccggaagtcacacctagtccaccggaaattgcaccgtatccaagcccacctgaaattgttcctagcccaccagagatcacaccgtacccaagtccacctgaaatcgttcctagcccgccggagatcacgccatatccaagtccacctgaagttgttcctggcccaccggagatcaacccgtatccaagcccgcctgagattgttcctagcccaccagaaatcacgccatatcctagtccacctgagattgttcctagcccaccagagatcacgccatatccaagtccacccgaaattgtgccaagcccacctgaaatcgcacctagtccaccgatcgttacaccgatgccacccataatctacccaagcccaccggaagtcacacccagcccgccagaaatcacaccttatccaagcccaccggaagtcacaccaggcccgccagaaatcacaccttatccaagcccacccgaaatcacacctagcccgccagagatcacgccgtatccaagcccacctgaagttgtacctagcccaccaaagatcaccccatatccaagcccgccggaagtcacacctagcccacctgagatcaccccatatccaagcccacctgacatcgtccccagcccgccaagctatgagcctagcccacctagctatgaacctagcccaccggagtacgcgccagaaccaccggtgtacgcgccgtatccaccggggatcttcccgagtccaccggagtactcgccggagc

SEQ ID NO: 68582 - DNA, 1639 bp, Oryza sativa
cggcgtcatacattaaaatacggagggagtataatttactttaatatttcactaatcaaactttacatatatataatatgtttgtttcatatcaaaagtattaatatttttttaaaaaatattaaatttgaataagtttaattaaaaaattaaaacaacttaacataggaagttaacaaggaagtagttaactgaacaattcaaaaggagtgtctaaccgtatatacattgcaggagtaattcaatactccctccatttcaaaataagttatgtcacatgtccaaatttttagtattataatatgttacatttcgtattagattaacttattctggaatggatgtagtggataaatactaccacctccatcccagaatataagaatttttagggttgaacacgtttattaagaaagttggtagaatcaaataaaagaagatcgtgatgggatgaaaagtgaagatagaatggttgtgattggttggaaagataatgttgataaaaaagttattatattttatgaaaaatccaaaagcctaaaagttgttatattttggatggagtgagtacatctctattctccatttcataattcaatgacgagataaataggtaaaaaacattatattttactatagaggtagtatcgtacagttcatccggataacacgtctcttgttacaattactactattagagcaaatttaatagaatagccaactattgactccaaatcatctatagttaattttataatcaattcatgcaatagttacctgtaaacatacaccacacaattaatactggtctcacttgtcatatacacatatattttagagtctgtgctgtagctagctataaatttataaatttatagtccgctacttttctctattcttttttattttttcgaaatatgtttataggttggttatactactctgctactgtaactgctcttaaccgctgtgaagaagccgccaaaagcaggggtacgtacttgccttctgcggtccctgccacagcggcgcaatgagtctgaaatgtctccagctttaactgagccacgccatactcatctctcgatcgatcatcagtgtcacagcgtcgcagtacaattgcaaaaccccaccgcatgtgattgttcaaccaggctgctgcagggccagcttggttcgtgttcgctcgggcgacagcttttgacagtgttgctgcacttgttgatcctttctcatcaataacaattattgattcagctgaacaacagtagatcaatggatacccaaagattggtctgcattgacgatggagtaaacaggagtactctatatcaaaagttcagggtaacccatgttacctaataaatcaaaacggtttattaggaaataaaacttaatttatagttaaaacttttatatatttgttcgtagcgatttaaaagctaacgctaaaaaaattatgttaaattttttttaaaattaagtttaaaatttcaaattttggcttttgttgatatttttttcaacaaggcgtttagattgtggacgagcgcgacagaaaaaccgctatgcagggctcggccgtggcccaggcttgtcacagcatgctggggcatgtctgaggctctgagcagagagg

SEQ ID NO: 68583 - DNA, 3260 bp, Oryza sativa
tcaaagtggccaacatgtggtttcctaaacaaattggcaagcctcgcatcacaaataatttgactttttctgcgaggatcacgaagatttttttgctttacatactcaagcagaagaatctgaacatcaaattgggaaatataagaaatatcaccatttctcatgtgcccaatgaattccaagagctctgatgatgcccattgtgtgtcacctataaaagtcattccttcattttgcactctcttaggtaagctttcagcaccattgttttggcgtttccgtccccttttccctgaaaaactattccgtcttcgttttcttgaggcgccatcagaactggcatcaaggtcaaaatttgcatcatagaggtcattggatgaatcttccttttctctcctagcggaagtgctacgaacagtccaacagcttttggcattgacaagttcttccaatgttagagagtgtttccctttaagatccaaccaatacaacttgaagagatattcccaattatttttatcatcgaagtccaccttagcctagaaggcacatatcaatagcaagtcatacaaaatgtctgagtatcttatcaacaaaatggagatttctaatatttgtgcaactaaagtagaagagaagtttagcttgtatgtttgtttcagcaagtcctctttatttatttttaccaagtaaatataagcctaaaatcatttagaacttcaaggtaaaagtgtattgctacttgttttaggttgcctagttcatacaagatgtgtgaggatagaactatgttggtaagattacatgaagtcatgaagattacgccaatatttcctagttacagatgcacttgagctaaaagtacagttctgcactgcaacataaaccaaatcaaagccacacatcgcaacaacctaaaggcaatagacaacggaatggataaattgacccagcaaaagccaccaactttacattacaaaagctgatagttacaagcctgcaactcacaaaacattgtgccaatatattggatcaacaaaatagagatatagcaaatttcatgtattccatgactttgggttctgcagttattacttctcaaactactcagagaaatatctatgaccttaattaatcatgattttcaatatcaaatgaacttgaaaagaaggtgcctagttgaaccaaatgttaaaaatgagcattatgctgtccaaaggactgagaaaatggatatttgcacaactctatagacatatttgcatatagatggtcatataattcaagaaacacagagggaatataaggattagcagcaggttaccttggcacgatcatctttggattctatcaacagtatagtgctatagcaggtatcacagaagcccttattccctctgacaccaaagaatttgactggcttttgtttgatgcaacctttgcagagggagtatgtacaagtatagcacatgtactgtactgccttttcacaggtgctgcataggtgccaacctgaaaaacatgacatcaagaacaggataagtcgtattgaactattggtttgttagcggaccagtcaggacatgcaaatacccaataaattttaccacggatgtactttccagatggtaaaatggcaaaaagaatgacctaatctgctcattaaattcaagtacataaaattcatagcattgcaaagaagggaaggcaatcataccaaatgcacttatatatctagtatccacaaaagatgccttttttaacagcagttatggccaccattacgtcaactataattgtacgtcaaataagatatgacactaatcctagtcctactcggcacattctaaactccatttcggttttattaattcctcgatttccgttagtatgcttttcaaactgttaaacggtgtgtttcatgcgtaaagattctatacagaagttgctttaaaaaatcaaataaacccatttttctagttattaataattaacagtactcaattaatcatatgctaatcacatttgtcattttgcgtgcggttaatcatcagtttcaaaacgcattttagaacgcgccctcggtgtgcacagcagtaatcactagatgttaagtacaaagaagcagaagtccaacaggagagcttaccacatgtccatttcgcccgagatcgaaagaatgattcgtcgcgcttgatgcaagcaggatgatagacttttgtgcaacccctacagccccaaaatggaagacatttggttcagctttttacgagcagacgaaattgaagctacggtactataagcagaaatgcaagcgccaaccgcgcacacgcactttttatcgcagaccacgagattgcccccgtcgaagcagatgaagcacaccacgtcctcgtcgtcctccctcttcttcaccggcttgggcggcggaggcggcgccgctccatccctgttcttcggcggcctccctctcttcctcttcaccaccaccggcggccccacggcaggcggctgctggtgctggtgctggtgctggtgcgcgggcgcccccatgatcgatccgaggaagtgcgagtcatcaaacccctcggcggacgcggacgcctccttcctcgcggcggcggccaccaccgccgcgccgggtggtcccacgggcggaggcggaggcgggggcggggacgcctcgccgcggagctggggagtggatggcggagccggctcgagcgggggaggaggaggaggatgcggcggcggcggaggcgggaggcggagctcgggcggccactcggcttcccccggcgagagcagctccgcccccggccccgtccccccgtccatggatggaccactcccctcaccccacccacccactcgacaacccaaaaccctaaccctaactccctctctctctctcgcgcaccgcctccacgggcaggtgggtgaggtgggggaggggaggaagcaagcacggaggggacgggagggaggcgagctcgaaatggaaaaggcgggggaggaggggagggaggcgcggtgaaacagtaacaactcgccgcggtaaaaaaaagagaggagaaaacctcactcaagtcacggcctcctcctcctccggtgcgcgcgcgtggccccggcgaacgggcgaagcgacggatcggaggaggggaaagagtggccgcggccggtggtgggtggcagcgcttttggggtcgtggtccccggttttttctttctttttattttcttttttgggctgcaggaat

SEQ ID NO: 68584 - DNA, 7885 bp, Oryza sativa
ttcttttttctttttgtgtgagtgtgtctcggttgttttggtgcttcaattttccccggctccccgcgctgctcggcgattggggtggggggtttgatggcgtggttggctggctcggctggatgcagttattgggctcacggcgcgatggacgggtcgtggatataggtgtccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgttttttttataaaaaaaagcaaaggaaatgtataaggaaaaaaaattaaaaatggaaataaaatgtttaaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattatttttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcaaaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcattgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctagtcgtggaatactctctccgtaaaaaaaagaaaaaacttaacctatttagaggtgatatttttatacaatgaaactggacattgttcaaattcattatactagaaagggtctttttttatccagatttgttctattgtaaggctaagtttttttttatgaagagagtacgtggtggtggccgaggatccgctgcccttcttgagttttctgcgggtggctcggtgacgaggagattgatattatgtcgtcctcaaaaacaggtttcgttaaaatacctttaaaaagtggatttcgctacattactattgtaaaattgtcgttgctccttccactcatgtcattctcacactcacactatttcaggcatccagccgcctaggaagacaatggcagtgttcggtgagctcgagtaggctaggcgggatataaatcataccgttaccagtgccgtctatcctgcctagctgcactaaccctctcttttttttcttgccaagtcccaggaacatgacctcgtcgctagcgcggtgtagagcgtagctatggtatcgtgccaacgttccaacaacctcacactatccctgatcatgtgacgctagcacggtgtagagcgtagctatggtatcgtgccaacgttccaacgacctcacactatccctgatcaagtcacttcgccaggagattcacctagcatctaggaaggaaacgtctcatgaaactccttcaaccgtggaccgatcaaggagatcggcagcgcctttttttaactccggtcaaatgctaccggcgccaaatcctccgcaatcggtggatgtcaattacctgcagcagtgacaaccttaggggatattccacctcctgcattcgatgtttttggtgtgcatgtaccagattggaatgtccttggtgtcattgtcacctctgatgccggcatgccactcaccatcaccggagacgcttggagcttctctgcctcgggctgcttcctggtgagctccctcatgcctagtgtacccacatatatgcattcttccctcatatccagtgtacccatatgtatgcattcctgtagactagcatgcacggttttggtaggatatattaaatatgatgtttcttgtatatttggtaacaaaataaatggtaccatatatttatcaattttagcaaagaattgaattgtttaaaatggcatgaccgagaaacgtccatgggtctttcggctagctctataaggacagtcccaacccatagtgtccataagcagtgtctatggtgccatatcaataagacatcacaataaaaactacattctacaacccatgttttcttaaagtgatcattaataaatacatcatctctcttctctaccaatcatatttattcttcatctattatgaagacactattatctcccaatgcaaaacttcatagtgtctagtgcataggttctcgtgttgaaactgtgtcttgcatgagaccaagtttcttcctctctccactctctctcttaattaatatagtgcaacataagctaaaagtcctacatggcaatatagttaatgccatagacaccatcctaggtggagggttgagactgccctaaggtggtgggttagacgacctgagtttgaagcctcacccattctatttatttgatattatgtcattctctaatattctccactcttttaaaatggcatgaccgtctttggtattatttcagtttgataagtcatttttgacaataaagtaaacaagttctgcgagtctatggggctgtttggttcaatgcttcaacttgccacaccacaccttaggctgccacacctccttagccttgtgtttggttcattgccatagttatggcaagccacactttcttaccgttctaccccacatgtcatagactcaatcctttgcctaactttgccacacatgtggcttacaatttgtagcccacaaaaagtgtggcaagtcacacttgtctaacattgcctaaaatgagttatggcaatgttagttaagaaccaaacagcccctgcgaactcaagagctggtgataaggactagaaaatgggcagcacagcacgtgtaacatgtgcgaccaacacagtgagttgttcgtattctccaaccgcatgaagcgatttgcattgggccctgccgtgtctctgttaacgagtaaactttcactgacgctctttgttcggcattcatcatgttcttttgcaaagtcactttctctgaccatgacagcttatttgaaatattgtgttttaaatacaacaattttgattccaatactcccaagtaatattgtgactacttgatgacagtgatcggatttcatatgataaaagtttcggcgtttcggtcttatattttgaaaaaaagaattagtcccccgtttcatattataagtcattttgtttcaaacttaactaagtttatagataaaatttgactttgaccaaaatcaaaacgtcttataacctaaaatggagggagtaactacaagcccttacttacacgagagatacagacatgagactatatatatatagggcctgtttgagggaccttctagctgctgcagcttttcgcagaatcagaagctccctaaacagtacaacttttgatacagattctgagaaactgtacttgtagaatctagaaaataaattacaagccagaagctataaacataactttttcagattctcagaagctggctatcaaccatctaggtctctgaattttaatctctcccaaacacgtccatactactccatgaaagagtacaattatactctacatcgtataaattaaaacaatagtatataaggacattcccaacccaacgactaagatagtgtcatggcattaaataagttaccacctaggaaaaaaaatgatgtggcaagtgaataaatgaggaaagagaaggaaaccatgtcttatgtagacatggttttcacacaatatccaagacattatgtgagataagtagcattaaattaaagtatggaatagtggtgtttgcattagaagagtagtgtctagtaaaatttatagaaatcatgtatagtgttatgagttgggactgcttgacaaggacggaagacgaagacgccgcgagtgaggctgacgccccaccgccacgcagtgacgagagcccgtgacgcgtggcctgggctggtacgcgtgtggtggtgtctgcagctcgctcgcttgcccgtcacggcgtcacgcccccggtaaaaggcgccgacgcgccatgggacagcgatgagacgaggagccgtccagctccaggtccagccgcactggagagacaggagtccagctccatccgcagcacgacagaacacaggaggctgcaccaaaccaaaaggtactagcactagttaactgaacagtgaaaaaagagtgtctaactggccctgtttagttaaaaaaaaacttttcacatatatgaagtattaaatatgaaaaaaaaccaattacacagtttacgtgtaaattgtgagacgaatcttttaagcctaattgcgtcatgctttgataatatgcctctacagtaaacatttgctaatgacagattaattaggctttataaattcgttcgcactttcctagtggaatctataatttgttttgttattaaacaacgtttaatactttaaatatgtgtccgtatatccgatgtgacacccgaaacaaaaaattttgccatctaaaccaggcatgtatataagagtaccggcagaagttcagtagatagatagaggccatgtttagttcccttcaaacttccaaattttccgccacatcaaatgtttggacatatgcacgaagcattaaatgtggacagaaaacaataaattgcatagtttgcatgtaaattgtgagacgaatctttagagtctaattacgcgatgatttgacaatatggtgctacaataaatatttgctagtgacgaattaattaggcttaatagattcgtcttgtagtttacaagcggaatctataattttttttgttattaatacttcaaatgtgtgtccgtatacgctaattgtttttaccaaaacaactaacacggccaaaagctactccctccgct

SEQ ID NO: 68585 - DNA, 12055 bp, Oryza sativa
tctttcagcttactctcaataatctggattataataattccaagtctggattatagttatgggctttttaaattcaaatttcaggatgctaagtggaatttcaacaaagtttaggattttttggactttcagcagaaccgttctgattttttttttttaaatttcaggatattttaggcaataacgtcttacaatcgtgtgatgtgctctttgtagaggtgtagtaatacgaatgtttcctgtctcgtgagtcgtggctcaactgttcatgcatgttaaaaaaatattagagaaaggtctataaaatacatttatatcaaatcttaagtccaaacttaatttcttttaaaaataaaacaatttttaggtgaatagtgttgtgttactatttatctaaactttgtctttttttactccataataaagttgagtttaaacttaaaatttgatgtgaatgtatttaatgcttacacctatttctaatagctttctcatgaattcacggggtttttacgggtttttaagttttcaccggatgtatccccttaaaatattttacagttagtctcatatgtccccttaaaatatatccacagagaatctaaaaatcaacacatcatccacccacaccaactcccgatgattcttgctcaaggaagactggaagagctcgagaaatattccgtgtactaccatggttaattaattatggctgtgtttagatccaaagtttggatccaaacttcagtcattttccatcatatcaacctgtcacacacaatttttcagtcacatcatctctaatttcaaccaaaatctaaactttacgctgaactaaacacagcctatataaactaaattatggctatgttaaaataggcagcagcatttcctagatgcccgcccttgcacgagagatacagacaaaagagaagcccacgcaactgaaacgacctcccgagactgcaaggccgctgacggcaagctttggttcactcgggcgacagctttgacggtgttgcacatcttaatccttctcatccattaaaatccattattaatttaggccctgttattttctccaacaaaagttgaattaacttttggatactcatggcatgcttttcaaactgcaaaacggtatgtttcgtgcgaaaactttctatatgaaagttgttctaaaatatcagattaatccaattttcaagtttataataattaaaactcaattaatcacacgttattaccacctcgttttgcgtgaaaaacttaaccttcatcttcaggacattcaaacaccaccttaattgtactagagtagatcaatggataccgtagattggtctgtgtaactgtgtttattgtagccccgactcccgagtcatcatcaccatgccctgcgttcaggatggagcaaggggtcaaatctccatgagcactatcatcagatgttctacgggagctacgaacaggagtgcatcagatgttcaagctgttgatgttttcagaaagaaattcagacggtggacggccgcgacacaacggctatgcaaggctcggccgtttgcccagattgtcactgcatactgcggcatgtctgagcagatcagcagagaaccttgcacttgcagcgcagagagatgtgcaagaaaggcaggccacaatcgctgcacagtcctatcttttccgtgttgttattactggtgtgttattgggcatcgaagagatcaagaccctgaccttgttggttcttggcattgtgatagccacaagctgatgtggctggcgatctgcttcctcactgtgctcacggctgccggggatgagcaatttgaagggtcacctgataatgcaatgtgaaaaatgtcagaatttttttttatctaaacatacctcgggaaaaaggaagatttttcctctgaatttagtgcatatcgaccttgtgtaagtcactattgaaccatactagtaccatagacatagtaatgctactagagcatgcagagagctttgtatattcgtggtcctcaaaggagaaccaccaaagttaatcacaatataatactctctctatatttaaatacatggcactgttgaaattatccgatcaaacttttaaaactttgaccatcaataactctcaaaacatttagtttgaaaacataaaaatcatatagctagaattttcttgatagttatgtacttcacaatattacaattttgttgaatgttatcgttatatttcaatagaaaaattgtggtcttacacaccaagatctgaatatgtcaggagtgtcatatatataaatatagaggtagtattgcttatgtagttattttgtaacatatgtattcatcataccaagatactctagaaaacacttccaatctaccttcaatcctgaaagggagttgggggcatcctctcagatcagtgccatgtccgcaatttctacatttgattatgtatgatggcactacaaatgttggcgagcctcagttagtgcatgctgcaagtagagtagatacacaaagagcaaggctacacctaaacatggagatagcaacaagccaacatattagtagatgagaactttgaaagctcactatatttcgacgatttctgtttcgaggcatggcgccatggatcttgagagccatttgtgaacactattttagaagctgcaccatttttcatgcaaaatcgggaaaaaaatgtgagtatcaatttagcattcaggacaacagtgagaaaatctgaaatccagcagcgataaaaatctggtatctagaaagcagcacaaccatagtatgcagtatgcttacggttagtgtacaatgaaatttacagaccgtaccaaggtggcagctggactgctgaaattgttgattccatttcgcaggcatggataggccaatgattccacaaaaaaaatgctaatatacagagaataaaagctagctagagagacaaaccagcaattcttgtgcctccgtaatacaagtttgtcatgaacacatcaggataaacaccttcaccaaagacatttctgcataggtccaaatggtacctggagatatgcaaagcaaaaggcatatgtaatggtaaaagtattagctagtgaacttgattatatataccaaagagcaaaaacgtgagcaacagatagaaatcaaaagagtccaggatatctaagatacactgcattaagagattatcgaaggtgaaaatacagtcaaatagtatgctggcaatgacttcagtagaacatattgtggtgcaaacacggagtgatcacaacgagagtaatcgaaacatgacaatttcttaaacaggtacccaacccaaggcttgactgaaaaagaataagcatacagagatggaaaaaaaaacataggacattaccctgtattgatctctgtagagcgaatgctatcgtttttgggtgccacttgaaaataggcaacctcactgcaaacttggaaccaccaaagtctagaacctaaaaataaatggcaatgcactatgggtattacattcatggcaaataacaagaaaacgatgtcatggtgtaactgcagtttggtttcgctagcaaaagagaacaaatagaaaatcatttactagtatcatcaggagtcgtattcttcaagtattcctgatcatatgaagatacagttgtcccccatcttctaatgaaaaaatcttgcacatactgagcatatgtttcctgtaaaaccagcacatgaaaattcaagaaggctggaatcaatgtacttttgcaaatgtactgccagaatacaatggttacacgaggataaataaaaaataataggtggcctatgcaaattaaatgaaaaggtacaatgtttaaagaacataattatgacatgattgttgatatgtcaagattaagttgaaaacccaggcacaattttcattaaaaaaaactggcacggcacaattggggtgggtatccaaggctctactatcccacttcatatggtgtagtaatcttaggcttgcttcttgagtgttgaaaataaacctggatgtataccagacccgtacattttactttgattgttgcatcagtgtatgtgtgattgtgtaatgtgtccgactgcatccttgatagattcagaagccgggtatttttttaactaaatgaaactttaactttctaaaaaaaagtcaaaactctggctattatcaaaagtaacagatgaattaccaccaaacttctcccggtcttcttcgcattgattagaggggagcatacagcatcaggactcccatattggaactgcaaaatggcataggttttcaacaaccaaaaatatatcttaaagttacagtgatatcataattcacatcatgcatactcctatggccgccgcatctgccaggaagaacaggaaatcaccatcatttttcaactgcaaatcaaaagtggattaaagcatgcgaaaatcctggaaacagagagattgtattcatcgtgtagaactagaggtacttttatgttacaaaagtaaaaaatgcacatcccaagtcctcaatcacaaggggttaccttctctgctccaaataaaaccttcacagagcggctgtccaaccgaagctgttcatcgacaagtctagttacctcctgaagggcagctttgcattcagggccagctgaatcccctacctacacaatggtagccatacaaaaaatttcatcagatccaaagtggattacacagaacagcagcatggatacaaggatcatgagttcatgactcaccatgatccttgtccatagcactggtgaaactgtactcctaaatcataattcctaacctgcttgtcaaagtcagtgaaattgtacacagcaagcaccacccctgagctcgcaaggcttccacatgtcaagtgagggaacttgagcctgaaccatgcactaagagcacccgagtacgataccccgaagacgaaccaaggattgtcaaaccccgatgatcgattgtacctagcattcaagatttcctacaaaagcaacaaaaccacacagagagagagagagagagagagagatcagaaaatcacgtgctaaatagtttatccccatttgaaacgcaggggaatttcacatgaatttgaccataaacagttcgatttacacgggaatagggagatttttcatgcatttcgtcgatctgaatcctgacctggtaatgctggcggaaggcgaccaggtcgaacagtgcctgcttggacgacaggaacctcaggttctccgtggtgaggctctcgaacggggagctcttgccgtagtaccggtgctccggcgtcaccacggcggcgccgaacttcttggaaaggacctacacggcggaggaaccccaacaaatcagcagaaatggcatcggcaaccgtcgatgggtttgcgatgtctcacggccaggtagtcgttggggatgccgttgcaggaggactcgccgcagatgcgcaggaacaccgggccgccgccggcgtggtagtcggcgaactcgtagtaccgctgcttgaactggcggtggtcctgcacgccgccggcgacatcagcgcgagggcgctaaacccaaagaacttttttgtttctcgcgacattacatatcagcccctgatattaaaactaatacaatccatgccctcgacgagtgaacaagccagagccactcagggatcgttttgagaaacagttttaatccagggggttttagagtaaaacaaaactaattcctccgaggaggaagacgaggaagaagacgactcacggtgggggagaagtggtcgaggcgctggtccatccaccgctcctccgtcgtcaggtgccggccggcggcgccaccgccggcggcgatcggctcggcgccgcgcgcgaggaggaggaggacgacggcgacggcgaggaggtggtggtggtggtggtggtggtggtggaggaaggcgacgcgaggacgagaccccatcgactccgtggctgagagactcttgttcgagtgttttgtttggccgagacgaggactcgactctcgaggagtactacagctattatactattatagtggacttttattattcttaggattaggaaaaaggaacaaaacgatgatttctaagagggggaaaaaatgaaaattaaacacaggatctgaacttgttgacgacaaattaagagttgagcagttacactgtacccgctccattgcgaaatgtaaaaagttttagttttatactaagtcaaattattcaaaaattaattaagtttagtttatagaggaatattaattcatccctttgtttacaaagtatttacaaaccctaaaaaggtgccacattcttgaagtgtattacatcctaaatgtaagtataaaacttttgttccctttagtttaacgatttttttttgaaaatatccattttttttaaaacaaaattgcgtttatataaactagggcgaaaaatttgtgaaaatatacctattctgcagatcggttccgcgggagcgctaccaaagcgcggcgtggagcggacgacggaggcgctcgcgcggaatggggctgtgggaccgagcttgtcgtgaacttggaaccggctcgctctcgcagcaccagtgtgccgaaccgcggcgccatcttttttgttgtactgcatggcactgtgttcgacattgttctagtacttttgacactgttcgtgggtcggttccacacaatgaggacacggtactgatgtatgaacattgtcggacagtacttgaagtgtcggaacagtgctacatagggttgaaatcgctgggcaccgcggttccgtgtttgggaaccgcgggaccgtcgtcgttccgcgttttggagctaggggactgtgatggtcccgcacgactgtaccgcgggatcgtcggtcccgcgttttgaatctgtgggaccgtcatggtcccacatttctgtcctgtaggacggatatacttttgcaaaacctttccgtacatgtatataaaccatacatgtatataaacgtaaattattaaaaaaataagtatatttgcaatttttttctaactaacatcaaagagtaatgcatgatcgaagttaaagttgtcagttaattaaaaataagagattaacatctaccatgtcaaataacgaaacaatgaaaatatatttcataacggatataatgattttcatttcatatcttaaaaattttataaactgtcaaacttacgatagttatttcagaggaaaaaaaacatcggttttatatgttaaggatagaaggggcaccattcttgtgagattattggtaccggtagcctgggactcttaattagtaccaatcacccaatcagccaaccaaaccttgtgttatatattaggataattattcaagatagcttgtcttgttagcctttcttcagaaagctccacccatggacatatcggccaggctagcttcttgtgcgattgaaaacgatgcaggcgtctctcacgttaaacattcttttgtgtaggatatagcaggtgatttatcttgtacttagctcagtagtaacattttacatatcattggcactcttctgcagagaaaagcctgagagttacctgtaaggttattgacaaattataatcgacagtgattatctggtacttatcttatattttcaccggaagactgaacgagttcatccgaacgtattaaaaaggagaatagttataaagaacggtgtaccaaagtgtacgcccaagcaccacacgctaaccacacaagcacaaatcgctaagagtggggcctagcaccaaaatggcccccactaagtgtggttgatcgccgccaggcctatgacaacaccacaaagacaagacttcgaaaatgatgccaccacagaggtcacgacatcaaggatgttgccattgtccatttaagaaagatgtgattttcacccagagaaactcgtcgagaaaagaaagaggtaccctcgacaatatcccaaggggttacaacgcccgaaggcgtaaccattaccagcctagtgaactaccaagttaggcttttgcctggaacccctacaaccttacttgtagttcgccgcccactaactcagaaaccaccacacaggcattggcagcacgtggcctccaccacaccgtatcggcgccccctccaccgaccgacttccaaacttgccactccatccaccccccccactccgccccgagcgagagctggcccaggcccccttcgtcccgccactcgccagccttcttagatttggcccaaaagaatatcttgtagtagtagcagcagtgtttgagcaattattacggccgtacgtcctgagaatgtttgatcgataacatgagaatgattggaacactcaactgtctgtcttttagtgtgattgtcctggccttcaaactaacaaatggttgttggtagctcgagcagataatcagtaagcagctacgctccatccactctatatatgccctgagatattaggtagatcaacaatgaaattgacgaaaactgaattgaatttgaagggaattacagatgtgcttggctcaaaatgcagaggctctgagcaaattatatcgggagccattggttagaaaaaatgttcacgatcactatagctcaaatggtacaatagctggagtgctggacagctagcaaaactaacctttggtccgtcttgcattttttatgaacaatgcgatcgacaatctgctctatattttgcttcacagcttccgagatgcacttgacaacgagtgataaaggatatgtggttttaaccttgagattccgtatccaatcctcaacatactcataattcttagaaaaatattcagagggacatatctcctttcaaatcttgaaaaaaaaaaacttcacagcttctgaagatggacagttcttcactaagagatatcgatggattaccatattgcatcatcactcatcagtaagaaacatcgatcttactactccattaaaaaaaagtaaattttagctacgaatctggacacgtttgtagttaggattggattttcttttggatgaagggggtacagttgaaggatctggatgattagacgagcgatggatcaggtactaatccgaaggagggagagagaggccagggtttaaaggaggttttgttctgaggaatttctctcttctttttttttcttcggagaggggcttgttcgtttcttcttcctcgcgccgcgcgctccaatccgatccgccctgcttgatcaaaaccctagcgatcgaattcccccctccccattgcgagctagtggtggccaaaatcggccatggcccctgactgcgtcttgctcgaccgctacgtcaccttcctcgacgaccccgcaccggcaagcgacgaggtcgatcgccggcggcgaacccggacgacctcagagacgggatcgccgcctacctgcgtgccatgaggccgcgcgcgcaggtggagagaatcccccgcgggtcacctacctcgccatggtgcggccgccgccgtcgtcggatgacgatcccctcgtcccgcagttcgggcggcagatcgactccggcgtcgtcgcggcggccggcggcaacctcgtcgccctctacgccggcccgtaccgccccgcctcctcgtccatggggtgctacctcgtctacgacgccgccgcccgatcgagttcgccgccgctctccacggtccccggcgtcccctactccgactcccactcgagccccggccgcgcgaccgtcatcgcgccagccgccaccggcggcggattcatggatggccacagtgtactaccaccgtcgaccgccgagatcaccatcaccacatggacactcgatctacaggatgatcattcgacgtcaacacaaaactggacgaatcgggaagcataacttcaaactaaaagtgaacaagaacaggggtctgaagtaagctgtgacatgtacaagtaccacccttgacaaatgtacatgtgagcaggctattaaaatggaatgccttggaatatacattagaatggtatgtgggtgttccttactgttagaaactagtggtccacaatttgatatggaaataacaaattttggtacacagttcttgttgcagctagctgtcttctggctttcttttattctaaagttgttcgaatttgtagtcctgaaaggaagaagttgttatacataactccactttgcactgcacttaacattgtgatagggcagactttttttttttggaagtagataaagtctaaagagtcactctgatcaattttaacaaagtatgtgtgacaaatatatctgtttctgctagattgggcttctaagcagtggaggtaagtgcaaaaaggatgaagatttgatgatctacgatgcattgtcaagtgatgtgatgaagccttaatattatggtatgatttttcatagcttctgtggagaacaaggttgaatgtgttttagtttatctagaaggttgatcttattatcaagtagtactggtggtttgatcctgaatgtgtggttgtctaataaccatgcagtaccactggtggcttgatccttaatgtgtggcctaaatccttcctatatgacttcttttaatactgttccgtgcataaattgcattttatgtgttgcctgtactccccctagtcacaaatgctttataccattgacatttttggcctcctaggtttaactttgatcattacttttctattaaaatataactataatatctataagatgtatcccttatggtcaggcttttctaagaaaaaaagatgtagtcatatctcatgttaaaaatggttggagtaggatgtacccggttatctaatatcttagtctcatgaataaacaaagtttatcttgtacataattcagtaacattttacatatcatggtaatcttctgcagaatgggggagcctgagagcaacctgtaaggttattgacaaatgacagaggtcgtcaccatagtagtgtttgagcaattgttaccgcagtcctgaggataatgcttggtaccatgagaatgcttggaacaaccaactgtccgtattatttgagtgaatcatactagtctaaatgacagctgcattgtcttgtactcatggccttttgaacatatggttggtagctcgagcaggtaatcagtaagtagctatgctccatctactgcccagcaatggctcattgtcgtgtcctgagattaggtagagcaaagatgtcattgaccaaaattgaatttgaagtgaactgcaaatgtgtttgtcacgaagtcagagtgatcgagaaaagcagaagctcagaacaactaatatggatgtattagttataactttcttttttttttttgcaatcactatagttcaatagtataatagctggacagccaaaaccaaccttgctcttgacattctgataaccataaatcaatgtgatcgacgatctgctttcttactttgttcacagcttctggagatgaacaattagacgagtcacctggtaaacacaaaatacaaacatattatgggcttggtcacaactcacaactcaaactagagacttgatatatcttaatactagacgaggcaaagacagttatcaagtctctagtttaagttaaaatctacagctaaaaaggaaagtcacattttccctgcagtactgtcctcaagagaggcttcagcaaaggctggaatgttggatgtaccttcaatatgtgaaggagcttgagggcatccagatagatcactgcaatgtccgcaattgctgcactcaattaagtatgacggcactgtacccattgaaaaataatttgtaagcatatcataatgccataaaaaatgcattcacactatttaaccatgctcatatgagatacaaaaacagtgctattgaaacaaagaaatggccaggactgtacagatgctcacattcttttgatgatttctgcttagaagcatggcgccatggatacttgaggggctgcaggaat

SEQ ID NO: 68586 - DNA, 2042 bp, Oryza sativa
cacaaatccccttcaaaattctcgcaaaaatcggtacaaccgaggtggaatcgggtagaaatcccaccttcccgcggagaaattattggaaaaaacgaagccgcgcgaggctctgctcaaaacccaagaaggcttgaagaatcccccaagaagaggtcaaaggaaggaggggacaggaagggaacaaacacgggtggtcggaacgacggaacaggtggtggaagaatctctcgggacgctgcgtgcgatgcgtggaaccaaatcaacgaacaaaccgcaaggccaaatcagccagccaaagaaactcaaaattcttgagacgagacgcgaacgtgaagaagaggaaagcgtggggggattattttggaatttgatgatgcgtgcgtgcgctgggttttccgggtatacggcatcgggtcggcgggcgcgtgtggtggcagcggcgggagggggcgccgatgcgtgagctggagtgacgccgtggaccgtggtgggggtcgttggttggcgccgattatgacctgccaaaactggtctttccgcgtagtaatgacctggtaaaaaccgcacttgcttagcttctgctaatactactttccttcttcattaggttagggtttcgtggctgctttcggtgaccagacaccgtgagagaccacctctggtggcctggcccacctcatggaatcatgggccgctctagtaccggcctgcatatcatcaggcaggctactgggcctcttaccaggctaccggttccggcccattgcttcccttcggccggttctgaacgcaacccagtcccagtgattcgtgttcaaataggctttaattatgctgctgtcaatttcaaactcatcgtgcagagtgtgatagagtttttcttgtactacgtacacagccaagaagcacatagagttttcactccatcgatctgacttgtgtaaagtgtctgcgatagaaaatgcgtacccatgagcagaagaaaactgaaagaaatcgtaaactatttctacctacgtaactgcaagccttccttgatgaggtatcaagtagcagttagcagaacgacttcgattccaaacactgacaggctctcaactctccgtgtggtacaagcccgacgcttggtttacgaacaacccaggtgccacgcttatactgattaactacccagtgcagctataaatccatatgaacaacgcgaacgtcattttgacatggggatcgagtgctagcaaacaagttgcgatgaactttgcaacgcttgtttttatctcagttaactttaaatactctcagtatggagtagttggaacaagtgcaggcagtatctgtttaatgcatggttcattcctataaatatcagtaatctcctgttccggacgaagcaatttaattaagctcgatctcagattctcagagtgccaattaagctgaccacaggttcagatcgaggcgatgatttccgctaagttgcctctcattttcgctctactatcttctgctactctcatctccgttgcaccttctgttcgtgcagctcgcctaccatcttcagtccttgtgagaggcgccggtgaattcttggagcacatagggaaggaaatcgcgaatcagttgagtgggagcagagattatccgaacgaaggtgatcagtccaacagcacccggcggggcttgtcgtcgacacccggcggggtgcaggagaaacatgtcgagcctcatgtgttcctgggcattggcacgccggcgatgaacgtcacgctagtgttcgacaccaccagcgacctcctctggacacagtgccagccatgcctgagctgcgtcgcccaggcaggcgacatgtacgacccgaacaaaaccgaaacctacgcaaacctgaccagtagtagctacaattacacatacagtaaacaatccttcacctcgggttacttcgccacggagacgttcgccctgggaaacgttaccgtggcaaacatcacgttcggttgcggcacgcgcaaccagggctactacgacaacgtggccggcgtctt

SEQ ID NO: 68587 - DNA, 2180 bp, Oryza sativa
ggttgctacctgcgagatcggttcttccacactcctgagaattttcagacaattttatcgcttatcaggcccgttcatggttggtggaagctcttcagtcaccggtctagttgattagaatccatactgatcaaattaaggttcccaatttggtcaattttagcagagcacgtgcgagctcaaagtgcgacgtggtgtgtaaggcgtcaatcgcagctaacgcgttggttgcaacattcggggaagaaggggttaaagcggtcaaggtattgaatctttaatttccaattacgttggcatgcgttctttaatttcttggtctagtggtggtctgtccaggccgtctggaaaaattactcgcggtcaagagagtgaaatggtcaggaatttacagcagctatttctgcttgacgggggcatgcacgcacacattcaagtaaaaagttaaaagaggagattactcgtccacgtagaaacgtcacatgtaattatactttttttaagagcaggtacaatagcaaactataagccagctataaacatattttaaaaagataaaggaaaagagagaaaaacagcgggctacagatatgtagccaggtacagcacgaacttcaatacgtaatgttacgtaatgtgtgtatgacaggtatgaccagatattaataatgtagtaaacaactattgtatgaattggctattttattagctatagatgatttaaagctaatagttagctatactgttaaacttgcttttactgattctgaactggaagaataacatgaaacgatatcaatttgttactgcaaatgtatagcacttttgggccttttggaccttatttacaaacgaagaggaatgtatgggccgggcctacctcctcgatctgtacgtgggctgtatctgtaattgatggcaactaaaaaaccgagttcgaattggagtacgtgacagtgccaactgaattaatataaggtgacggaaaccgctctcagctcaacgcgccgccacaatggctagggccgcgaaccgccgccggcgacgtggtggggtcgtctatgcggtggtgctcgacgacaaggaaggcagcctggtcttccgcttccgccgcaaggatctcttctccgacgacgacgacccgccaccggcggggcggcgccgctttccgcgccccgtggcgcacttccctcgcggctactaccactacgtgtttcactccttcaccgtctccggcaagcagatcctcggggtgagccccttcggcgccaccgtcgtcatcgaagacgacggccgccccggtggcagcggcgctatgcgggccggcccggagctgggcaccaccacgtgccagcctatcctgctccctatccgggaagacatggtgctcgtcatggcctatcttccacagccggccggccggagtaacttcgccgtgatgcggcggctcccagacggcggcggtggtggcggcgggtggcgtgtcgtccctgttccggagccgccgctcgggggccccggagactactactgccgcaagccagcgcccgtcgtgacggcctacatgaccatcggccggagagcgtgtgtctccatagccggcgaaggcaccttctccctggacgccggcggcgcggcggcgtggcggaaagagggaagctgggagctgccgctccacgggcaggcgatgtacgtgcgggagctcggcgccgccatcggcttgggacgcgggccgggcccctacggcggggtggtgctgtggctgtgcgcctgcgacgtcgaggccaggccgccggtgatccgccggtcgtggaacgagaccttccccagggagctggtggccgcgcactcgcagtatgactgtcctggtaacctggtgtatgtcggcgacggaaggttctgcatctgctgggtcgccggcgtcgagcacgaccgccccgagacaaacgacatggtcgcgcgcaccgccgtcgtcaccatggcagtgcggctgaggcgctccgccggcggcgagctccagctcaccaagctccgctaccacctcatgtcgccgcaaggcagacgcgcctacttcgtccagccccacattccttaaatcgaaggagtgaccttggaaagatcgaagaaaacagacaatatgtcagtcactctatacgtgggcgatgaaataccactcaaag

SEQ ID NO: 68588 - DNA, 2792 bp, Oryza sativa
gatacagagaaattaatatcatatttgttgaagtaaaatatcaagtattccatttagtcataaggtgcatcaaagaaactataaaatatatgctcttttttggctcacccatgggttcaaaatttttaaaaagggccttatagtgtattaaatttgagttatttcagatcgacgttaggcaggttaggacattgcagtagcatacagcggagctcccaaaataaatcatcacaactgatgatggaaaggatggaagttgatttgactaaccccaaggcatgtgtttgtgaactgtacccaataagcactgagaactgcttggtctacccttaaagagtggttatggttaataaacctagataggagcagtgggaaataatctatccacttagcccctaaagcatggtttggatcaggatccttgtgattaaacagagcaataagaatgtgagaaactagtggtgataacataataatgatgcgtggtgaggcaaaatcatcgtggttctatgcttccagagtgacaacacacccactagtgatctctgtggacattttgtttcccgtacagaagaaagccatgtaaatatttgaagatagtagacaacagagcatcgaaaaataatcatcaatagactcacttgattcaaggcattttgtggagtctcatattcagctgcgacaaaaacaaagacctacaaacatccaaggaagtatcattaagaaagcagcagcaggaaaaacttctttagtatcgaaaagagtttagatggcatgtccatatgaacttcagagcatgacaacataaaactacattaaaacttatagaaaacaaaccaccgctcaaaatgcattgaggtcattctgcacaccagaatcactaaacaaattacactcccctggaaaacatagcaacaaacttccattttgtttcactctttcacccacaagatatgtgttggagaacttgccttcctttagttgagcctatttcacaattgccataagcccataactcataaactaatttacttgatccttttgtcagaatcctgccttgatgcattatagggagatctaagaagctcataaggtatcaataataatgcaatactagtacagtttacctgttttgtgttccacgtgaacagagacgagaggtcagccgaaatgttcagcgtcatgctgacctaccagaggaaacataattgtgtgagttcatggcatatcttaatgttgtttgaacaaaacttttagagtttcaggagagagaaaaaatgatatgaatcacctcgtcgttgccgttggcttccttctgaaaccagtttatgttcaagatctgcgcaattaaaacgacacagaataattagcagaacgaaagggctcgcgagagagagatcggacgagctaatcaagcagggagagcacgcagatcgagcagccggcggcgaattaagttggccgagatcggtacagacgaggcgaggcgaggagggggttgagagagatagagcggcggggcgcggcgcgggcgcgggctccggcgaggtttaccttgacagaggcggtgggggaaggggagttgaagtggtcggagaaggaggcggcgaagcacatggcggccaggatggtcaccgcgaacgtcgccaccgcgttggcgcggtgcccgaacgaatgcatcctccccctctcctccccgacgagctgctccctctccacggtcgggtagatcgccgggcttcgcttctccgcggcggcgccggcgacttcagttcagctctcctccctctctctctctctctctctcttttttctttttctcagaagatttgtttatttttagcgttggggaagacgaactgaagtcgcgtgacgggttggggacccacgtgtcggagagcgtgggccggctgagttggcagccgctgattggtcgcagcacgtcacagaggagcacggctgtacgcctgcaggtgggctagcgcattgaacggcccgtgatgagaacagtttgggcctgcaggtccatggtaggcggaagaacttccaattgggcctgtcactcacacggctcatctggcttttcaccctatggtaagcaacggcttgccaaaatttaaattttaaaacttgatttttgatgtttttttaacaatggcttttactactaagtcgcaaagaactcatattaaaagttttacctataaattattttgttatcagtaataagtcgttgcggcatataatcagccgtgagcaactgatggggacctcttttcggatgcgtggagaatggagatgtgccagtttaagatgcactttgtttaacaatgtatgacgagaaaaaaacatcgaaataaaatgatatctcgaatctgtaagttaagccaccagatatattactcaaatataatataagataaaaagaaaatttaacgacacaaaaaaggttcatacaaactatggaactatacaaacgtgccatctagatggccaagcttgcatgcatacagttacatcgatcataacgtactaaaaatctagctgcaaaatcacacacaatgacacaaaatcatagtacaaatacttggattaattccgtatagaagtcgtcgtacgttatcctgtggcggcgagaaaggccgcgcagtcgagcggctggaacgagacgacattcttggcgaggtcgtagagcacgagcgtgtccagcagcgcccagctacccagcaccgggacgccgttcgacgagcttggcgtcatcgtcaggcagatcaacccgcccgccgagtcct

SEQ ID NO: 68589 - DNA, 9160 bp, Oryza sativa
cataaaaaatgcattcacactatttaaccatgctcatatgagatacaaaaacagtgctattgaaacaaagaaatggccaggactgtacagatgctcacattcttttgatgatttctgcttagaagcatggcgccatggatcttgagagccgtttgcaaaaacaattttcgaacctgcaggcatgcagtatattgattaaaaaaaatacaagaattgattgcctgcagaataatgattataggctttggatgtcatactgcatacacagtacttcccacagaccattatgcacattcttggttatccataatatccattcaaaattcatgatatcgttataatatatggaacttgtttgtgataaaaagcggctattagcactgcagatataatcatataaggccatttaactctctagtcttctatttaccatcactcactgagcatgacctttacacacttgcattactagtgcagctcaatcacttgaggcacacaatatgatccagtaatatgaacatctagaaccttgtggttgttatttctctcttcatctcttgtctagtttttccatttagagaggggaaggggaagagtttcaaggttaagtaaaaaataatattgtagcttgctgcagactagcaccataccttaattgagatccaaacgaccatacttgaagaaacaaaacaggtaacatgattgaagctaattattcaaagaaaaaaatgatatacctgcaattcttgtgcctccatagtataaatttgtcatgaatacatcagggtaaactccttccccaaaaacatttctgcacaagtccaaatggtacctagaaagaaaagaggaacttatataaatacaatatctagaagcatagtcacatcttgaaaaagagaagattatagatagcagatctaaatcgataaggtaagatagcttccagtggaatatttatttgaggaaagtagatctagtaaccttgtgtcaatctttgcagaacggacactatcattttttggagccacttggaaatatgcaacttcactgcaaacttggtaccaccataacctatatgctaaataaaatcaataattaaatgcataggcaacataaacaattggccactgtctattcattaagtgctgcatttcaaattctcaaagcatgacatttggtaatatagaatatcagggttcgtaattaccagattcagcaggaggtggagttgtgttcttcaaatattcttgatcatatgatgcaactgatgctccaaatgttcctatgtaataatctttcacatagcgagcaaatgtttcctgcacagcagaatagagcaagcaaggtcaccaaaaggcatggtggaacaactaaataagagtcaagtttgacaaggacttatcacatgcttactaatgattacaaacatgttttttttttgtatgtgtgtatctggaattgctggcaactttatcctttcaacctatctcagatcattcttaattcctatcaccaaagggaggtattacttaccaccaaatctgtgccattcttctttgcttcaactattggggagcacaaagcatcaggattaccgtattggaactgcacatggtataagattttaatacaacaattgcatctgacagattataaagtcaaaataaatgtacatttagcataccgcaatagctgctgcatccgccagtagaaagaggaagtcaccatcatttgctaactgcaagcatccgaaagaagttggtaaataattaaatacactattagagcattcaaatgatattttataccatgcaaggaactaacataagtggtcataaggttgatggcacaagtgcacaatggcagtttaaggacgtggcggttcacttcaaacttagttctaatgaaattatagaaggtccatagacttggatactccataatatatttttgataagcagtttcttagtttggtataacaatgccagttgtctgaaaactgaacggaacccactagattattacatgatctccaaacaagtttcagaatgcaaagtcagggaaatatttaatatatttgagaagctattttttagcaccactactttacccttaaagttagcttgacctctttatacagttttctcctttcatgttttgtcatactgaaaccaggcaggtaatataaaaatcagtaagctgtcaaagcaaaagaaatatacttgcatatcacatagaggattaccgttgatgctccaaagagttgtttaactgcattgcgaccagactgaagttgtccgtcaacaagttttgttgtttcttgtagtgctgctttgcattcagggccagctgactcaccaatcttcagagatgtgaatcatgcagaaaggtagaacttttaggtgcatgccaaaatgcgataacattataacatgattaaggatctgcacctgtagttacctgtttgtcaaagtcagtatagttgtaaacagaaagaacaactcctgaactcgcaagacttccacatgtcaagtgagggaacttcaatctgaaccaagcactaagtgctccagcgtacgaccctccaaaaacaaaccaagaactgtctgctcctgagcgattatacttagcattcaaagtttccttcaaataagagaagccaaactcagatcagtaggtacactcgtttggacatagacagtacaaacggtcctatgcccacctgataatattggcggaaaacagccagatcaaacaaggcctgttttgatgacaagaaccttagattttccgttgtcaaactctcaaaaggggaactctttccgtagtaccgatgctcaggggagaccactgccgcaccaaacttctttgccatcacctacacacatcacacacaaaccatcccatgtgtatgttatcaaaacaggtgaagtaaaatataaccatatgcttaaagtatagatcacacctagaatgtgtaacaaataatgtctaattgctccagttggaaactgtacaactatatacttgagcatactcacagctaagtagctgttaggaatcccgttgcacgaagattctccacagatatataagaaaattggcccttttggagctcggtagtaatcaaggaattcatagtaacgctgcttgaattgccgatggtcctgcattgaaaataaaataaaggtccatgaatgccaaaaaaaaaaagaaagaaagaaagaaagaaagaaagagaacatctaacaacgatggtagaatgcatcaacattactccatatcacatcacatttgaaacaacttgaatcactagtcaagaggggattatggacaacagtgaagcgctagtttgttatgtagcaagtctagcaggctcgtaaattttcagatacacaacatatatacaaaggggaacatcaacattataccgctgaagtaccgattgcctttttatgaggtccgaaagtctcatgaacattatgtgtacgggacatgaacatcggaatggcgttatcaaaagtgaagctcacatgaaatctatgaaacaaaacagaaatttctttagcatcctcaaactccataaattctcccagcttcaaaatcaatcgattgtgccagtgcggacgtgggcgtgctaattcagtaccaattcgcttagttctcacactggagactatactaggatatagattgactagattccgacagagccaaagaccaaactgatgcaaagtgacggcacagcacaaatccacttccccatatccccaattcccccaacccattgtcccgttgcgcacgaagagcaaaaacgaggaactgaacaagagcgcggatcaaccaattcaaccgagaaaccgaaagaggaggcggtggtgggagatcgggactcaacggtggggttgaagtggtcgagggtctggtccatccaccgctcctcctgcgtcaggtacctgcctggtgcggcggcgccgccgaggcgccccccgccaccggtgggaggcggcagccacagcccgatcggctccgccccgggagccagcagcaggagcaccgccacggcggcgactgcggcgccgacggcgctggacgccatctctctctcgcgcgcgcttccgcttccgctgcggcggcggagaggagacgatgcgtttccgacgcgagcaagcaaagcgaagcaacctcccttggcgagaagtcagaagtggaagaggattttttttttttttttgagaactgaagaggtaacgtgcaaagtgtattgctaccgctacgggatgtgtacgagattttatccgggcgtagggtagggtgtgacgaggaggatacggtatacggcctaggaaatacggggtacggggccgtggaataagtccaatttgcctccctcatctcttgcgtttgtgtgaatagcataccttaactggaaaaacgggtataactcctccttcatctctaaaaccagagcaaatcacctcctcccttggtggtttttccgacgtggcattgttgacctggttgacaagctgactcagcgtggtgggacccacatgtcagtgtgtagcgctctctctcccccccgtcctttcccttcaccccggtgtggctcatcgacgtgggtcgggccaaggcggcagggcagcgcgttgcgacggagagaggtagccgtgcggcggcggtgatgcgggagagcgcacggcagcgggcggcgcggtggtcggctacgggcggtcgtgcgcagtgggccaaccttgcgcgggcacggcggatggcggcggctggcgaggctgggcacggggcagcgcggcgacctggcgcggcgcggacggcgatgcggccagggaggcgtgacggttggctggatcggcgccagtgcggccggcgaccgacgtcctctccgcgtcctctcccgcgccgccgcgaccccgtcgctgcctgcgcatcccccgccgatgccgagactgcctccacctcgcgttcctgtgacgcgctggaggccgagcgcgccgtcgcggagctcctccgagagcacggggcctccccggctgatgcggcttccatcgccgcgcgcgccccggggtacgccgccatgctcgccgacggcgtccgcgagctcgacgagctcgggctctgggagtcgtggagctccggggttggggcgggccgcgaggtggagatggccgggctcgggttcgggaggaaggtgtactacatggggaaggcgaagagtaggcacggccgcggcgtggtgccgctgctcgagagcgtcggggtgcggctctcctccgcgaagctcatcgagccgtatgtttcggcggctggtctcccggtgctgatcgatagggtgagatctaccacttcattttgagctcaatttgcttcatttttttagtgcatttgatgaccatctctgcccggtacaaactgcatagtatgagtggtgaaattcgctcatcatttcttctcttctttgtttcttgttgctccggcaattcgctcgtcatggcgcgaccgtgtggcggcggcgcatccaggccgagcggctagcgtcatgggcagtcggtgctgcggtgcatcagcgtgtggagcggatgcatgaccagtttccatggcgccgatgccgccgcttttcttttcttttctttccttttgcttttcttctttgtttcttgtcctctccggccgggcgttgtggcggagcgacggcgccgcctagatgcggacgcgaggtcgccactgggtgcgcaggctcggggttcgtcgccggtatgcaggtgcaagctcgctgctagggtggccacgacgcgaccactccccgccgccgatgcccagctcctctccgctagtctactccccgttcgtcgctagcgagcgcagctgccgccaacgagggccaccgccggccgcgcccctaccccgccaaagtgaagagaaaggccgagggagagagagagagataagggagagagagagagagcgcacgctccacactgacattgacatgtgggtcccaccatgctgagtcagcttgtcaacgggtcaacaacgccacgtcggacgaaaccgccagcaaaaccaccgagggaggtgatttgctctggttttcagagatgaaggagatgttatacccggttttccggttgagggatgttattcacgcaagcgcaagaatgagggaggaaaaatggacttattccacggggccgtagagcgagcccgtgtggttgcctattgggccctgggcctcgtttggtttctggatggaccgggagtccattgttctttgagagagagagagaagagaggatgttccattgggattgagattctcagcagtcgactgcaccgtgcctttgtcactgatatatagacccaacgacacatcgggtccacatgtcagtgataaaggcacggtgcagttacttccattgttgtagtggtatcgctagatttcagccccactacctctaaaattgtagtgaaatatgatgtgcaatgttacttcttttagttgcaattttgttgtatactagaaaaaatgcccgtgctttgccacgggtaaaaatatttttggatcgttatatattttactctttggttttggacaaaaaagctcatttcattccttgtcaagtggagttgtaagtccggctcgcatagctgactgtccttttcaacctccgaaagctaatgtcatgtccgtacatgccaaaaccgatccttccatcaaatccggtcgaatctttctcgatctttcaaaattggtttgagggtttttgatacactcgatctcctctttccgtttttattaaaatcggagcgataaaactcgggataaaaatggtgattttaaaatagagattaaattcagtgaattaaaacagagttaaaagagaaaatcataggaaaatgatgagggagcagtggggaattaatttttggcaatcaattggtggacgaaacgcatgggaagacagatcgacctagcggcgacgctagtgttcagccggacgataaaaaggcatggcatataaaagaacaaatccttatcgcgtgcgagaaaatacaactaaaaaacagcaacaaacatatgaaaaaaaacccggtaaaaaggcctgaaaaaaaggtaaaaaaacagcatgggaaaaaagtgaaaaaaggcgaagagaaaaaaagcagatggaaaaaaaaagacagacggaaaaaattgtgaaaaaaagaaaaagagtggaaaggacataaagaaagaaaaaatatacggataaaaaaagaaaaaagaatcggacagaaagaaggaaaagaaacggacggagaaaaaaaaaggaaaacggacaggaaaaaaaagaaaaaaagggcgaaaaataaaaaaagacggacggattttttttgacggaaccttgcttattttttaattaggtatagatatagttttactttgtttttatctaagtttggattttttttccatgtaattttataacttttatgaatagcatgtttatttattgtaattctgtatgttcaaatataatgctcaaccttttacatataaggagaaaaataggaagggtaactagaatcattggattgttatctaaggaatgaaaaagagactggaattttcataaatttcagtcaactgaaatccagacactcccttgctggaaacatgtttattccactgtttgttctattcaaatttacaaagtaagcttgttctcacagaattttcacagaaaaaaaattgttacttatcacaatgatcacgatatatatcaaaccactgtcgatctgtcattactcagtggcacgaccaatgcacggagcgggtgctgcatggtggtgatgaacccgtagtccgccgtgagatccacctcctcctcccatgggactcggcgccactcgaaggccgtgaccagattcgcgagaaagtactccaggtgcaggatggcatatcccatcccggggcacgtccttcgcccggcgctgaacggcatcattttcaccttagttgttgcctcctgcttgctgccgatggccaacctcaccccttcttccccgccctccatgaacctctctggcgagaactcttccgacgatgtccatatctgatagtggagttgagagacactagttagtgtatataagacgtatctatctatatatctaaagatggctgttgtacgctgcagctgattagtggattcaccggccatcaactttttgacacgtgtccattttctcagctgtgacatacgtcatctgtatatgagtcggtttttaagttcgtttttagaaatacatatctatatttgagtcgggctttaagtatgttctcttttgaaaatacagaagaagttgtataaaaaatctatttagaaaaacttacatgctaacttgagatgatcgaactcctaattgtaacttatgattttatgaaaaaaattatatatccaagtgaatttctacagtgaattccatcttatctaaaccgtataacaataataatgaaataaccttcacccgttgcaatgtacgggtattttttctagctaatataaaagttaaaaaattagataattgatatgtatagtatttcaggttttttttttcctgagtttatcactgtgcgtttgtgagttttccgtgtgatggaaaaaaataattatgtgacacgttgatgacgctactgtgcatacggaaaaaaaattctgtgcggcagcgccgcaccaagcttctcgtgcataccatgttgtcttctcccgatttcttctatggcgaagctgaccacgttaccccgcgcgacgtgcgcgccgccgagcatcacgtcgcgcaccatgtgccgctgcacggacgagaccggaggatgccgccgcaggcactccatcaccacggccctcaggtacgcgcacggctcgccgccggcggccgcctcgacctcgccgcacagccgcgtctggatgtccggccgccgcactaggttcgccagcgcccactccagctgggcgaccaccgtccccgtcgccgcgcccaggtactccgacacgaggcccaccatctcgccgtcggagagcttccgccgacgccgcccgtcgtccgccgggacctcgaggtacaggagagtgtccacgtacgtcgccggcgggggctgcaggaa

SEQ ID NO: 68590 - DNA, 623 bp, Oryza sativa
acttgcatatgtaattagtatgtaattttcgaatttacatatgtaattttagtacttacatatgtaattttgagacttacattgtaaatacactaaaattacatatgtaatttagggacttaaaatgtaaatacatgccgactatttttcgatgaaaaatatggcgccataaatatagctacactaaaaaattttgcctaaaaacgtcacatcgaattttttgacacatatatggagcattaaatatagataaaaaaactaattgcacagtttgcacggaaatcacgagacgaatcttttgagcctaattagtccatgattagccataagtgctacaataacccacatgtgctaatgacggattaattaggcttaataaattcgtctcgcggtttccaggcgagttatgaaattagtttttttccgaaaaccccttccgacatccggtcaaacatccgatgtgacacacaaaaattttcatttcgtgaactaaacacacccttaatttatgcccgggcatgattttcaacagctcaaattaatctataataatttatgcccggacatgattctcaacagctctaattaatttatgcccatttagtttcactcaaaaggcatgg

SEQ ID NO: 68591 - DNA, 1757 bp, Oryza sativa
tgttaatcctacctgaatctcacaccagctacctagctagcattgccattgaacctccgacgacgactagctactcgaccgatctgagctttttcatggcaggccaaccggccgggcaaccccgctggcgcagccagagggatcagtatcagatactctacagtcgacgcctttatcactaacatatagagccgatgctttgttactgacatgtggacccagaactcatcgaactcacatgttagtgataaatctaattaaggtaaggtgcactcgactacagaggatctcaatcccggccagaggcagaatccattgtattgccgtcgccgccgtggtgctcgtcgatctgatacgtgcgatccaatataatccgccacccaagccgcgtacatacctttgggctttagctatggaacaaattaagctctcaaagctgctgcttatacatttccggttgcgttataaaaggccactcctaactaatgaccatctatccttcgaatataagaatgatgagggcaactcccaaacagcagaaactaaagaagaaaaattaaatgattttctgtgaaaataccacagtacatagataagtatgcatccatgtgaaataattaattagcagctctccggtaattaaagaattcttgtggcgaaatagagtcgtcggatcgatcatcaatcaaatcatttgccgtttagagacacgttccatcaatcaagcatcaaaacctaactcaaataggagtatatatatgacatatccttgtcgaccaaaagaaaaaccgacctaactcgatcaggttcaggtacatactaagtactacagtactcctacaccacttccattaccattagcgcgccgaccaaccgtacaaatatatattcccaatcaatcaatgaatatcgatcgagttcgatatataaaaaatccgatcgatatatatataaatctatcgaccggtccatctcaaaggacgacaaagattcggtccggcgagcaagaagccaacaactccatcgtccatccaccatccgtcagcatccaatcctgccctggtatatgcatcgaggcttcgctgcgcgagacccagctgcgcagcatatgcatgcgacaccgtacgtaccacacacctaatcccatatgagatcgagagtgccccatatggtcagctgcatatgccgtcttatatatgcttgccggtgcaacaagccaaccgcgcccggccaccaccaaagacaacaacaacacccccccccccccaccccaccccacatgtgtgtacccctcctagctagcatctctctacacatgcgccgctcagtgatggcgcggtgtaagtccctgtttaggagagtttctacggtttctctctgaatctctaacttattcaaatagtctatctatagattctcgttccgattctaagaactcataactgtagagaattaaaaaaatataaattaattggaagtcaaaaattctaaagatatgaaactcaactttgtaaattttgatttttgactagatgattggttttacttctgttgtttcttagaatctcgagctttccaaatagaacctcgcggccgcctccaaaccgcatacggcattgtgcagtcgagcggggggcggcactgtacaagctagccggttggcatcaatgtggcacacaggaacacacggaattcccttttttcagagaggcatgcattatatatgcaggacgcgcgcgtttatgctatgtagggat

SEQ ID NO: 68592 - DNA, 597 bp, Oryza sativa
actttttatgctgaccatttttgcagcaacggtccataaagacctggtgcatcgaccacttttggtgcaaaagccaatcacgaggagcgtggggcccgtgaacagtgcaaggcgtggaacacgggggcccacctgtggtaaaggaccctccgtagacctggttcttcatgtgccgcatgaaccaagatgcggaccccacctacggtgcaacgcagtgaacggtgggctgggcctggctgcggcactggacaagtgaaggtagttctgggccattagatgggccgtaaagctaactcactgatggttcgtgatgtggtttatgggctggacgtctgtaccctcgtggacctattccagcgtttgtcgagcccattaagtattagctgggtccagatgggccaggtaaccaggtaggtccatgaaaagaaaacaaactgatttttatcctccataaaaaaatgaatttaaatgtttatcaggtaaattccggtatcagccaccaaggaccgataatccggaatatatatactcgaaaccttactggcaagagacaactggataaaattcaaactcgtcaatcaaatcatgccagaatat

SEQ ID NO: 68593 - DNA, 503 bp, Oryza sativa
gagtggatatgagtttctgtctgacagaagatagccaagttttacagttttattacatcatacatattttgttctcgagtcagctgatatggtgcaacattttgcctatttttttacctgcagagtttactgcgcgatactttttagaaacatcagtacaaaatattgtgtgctgattcattttttgaatgataatacggtttggcatttcaaatggaagtaaagcaaatgtataagctattcggagcaaaatgttttcaccatcatttttctccatcgtgtgtttctgttcatacttgttaaagattcatccagtattgaaaggtatgcttgtgcttgagaactctgcttctgttgctggatctattgcttatttactggtatcggtcgtaatctatacgtaaattttccagccaattgccaccaaggttggctgacgtggcgaggacgggcccacaaatcagcgtctcgcggcctccgcttcttcgcccacctcgcgttcg

SEQ ID NO: 68594 - DNA, 537 bp, Oryza sativa
  unsure (1)..(537): unsure at all n locations
ctccgtccactgcgcgcagcccgatcactttctcatcgtcttcgctaactccggtgacatggacctcgcgctctcgcgttccccgatcccggctcccccctaccagctgattctacgaccatggacccggcttgtgatggctacctccttctccatgccgttcagggtgtcgctggacctcgagggtgtaccggcacacgcctggaacgcgtncacggcggcggccctcgtcgctcccggtcgtctcatctctgtggacaccccggcgcgccccgacgagtaccggtttcttcgagtcaccatctcgtcgcacaacccgggcgccattcccaaggctcgtcttcttctcattcccgagccgacgttgggcttccagtgccttcttcggtatcgggtccttctccacgtgctctcggtggtctgcctctcggcccccttggcgtctggcgatgtcgacccggccggtggcggtggtgctagcggtgaaggtggtggcgctgcgaacgattgtggtggcgctgcaaacgatggtggtgg

SEQ ID NO: 68595 - DNA, 788 bp, Oryza sativa
ggcgaattcgagctcggtaccctgcagtacattcaacaggtgctgacagacatgttgggcattagcactgcaagctccattcagttgcccattgaggtgaagagtaccgtgattgatgccctcgttgggatcctcatgcccaggcccaaccatgacagtgtcgtgttgtccagtggatcaacatcgctagccaagaatggcttgcaggacaagttcataaggcagtacgcttcgacaagttaccatggcggtagcggtgttgtccagtggatcaacatcgctagccaagaatggcttgcaggacaagttcataaggcagtacgcttcgacaagttaccatggcggtagcgctagtaccattatccccgaatcaaagggcaatcaagccagcatcatcttgacctggcacgctgcgacaggttgctacgacaaagactatgagcaaaggaagaagatgaaggctactacagaatcgccgctacagcacaggcagtatcgtgttgtggccaccgctctatccaagtactgcatgtacttggtagcttatgtgcctcagctgctggccgggcagcagtcctacacaacatctgtctacaacgattttgtgcgctcgccgtcctacatcttgcagagtggtacccagctgaaagatgagctctgcgaggcggtggtggaagatgaactgaggtggaaggtgctagctgatttctgggtcgagatgttgctctacctcgcgccttctgacaatgtcacggctcacatcgagcaactcgcacaaggtggagagt

SEQ ID NO: 68596 - DNA, 518 bp, Oryza sativa
ttttgataaagttgccaaaaaagtggctacatttagtttgctgccaaattttggtaactatataagaaatcatgtcaaaattttagcaagttggtaaggtttttttgttaataccaaaatttttttttgaaaggaagttaataccaaaattcggtaaggttttttttcatcaaagtgaacaagctctttctctttcatttttccttcctttcttttacaacttcttttcttaatcttggtaggccttttgggccacatgctgggcccaccacaaccttcttgattggccatctccatttcggattggagctgaaattgcaagtcgccttctcttctttttgccggcgaatggagaagaagaagaagaagaagaagaagaagaagaggcctggcccacaaactggcatggagctacgctttcgaggcccatcatgtctgcttgccctttgcaggggttggtgggggcccacctgtcttccacctggcaccaacatacctcccatttttggtagtagtag

SEQ ID NO: 68597 - DNA, 18023 bp, Oryza sativa
cattagcagtcaatgatatatgaagtatgatccaaagctagactagaggatcattgttgagcatcctaatttggacaaactatgatacacacgcacatgtacacgtagtactaaagcttacgatcatatcaggtccctaactaataattaatctatttgtgctgtttgtccgtacccgtaatatatacactataaccatcatatgctgtttccataaaaaaaaactatatttagttgcgactatgaagaatctctcgtgctaactaaaatgcatgattttttttcattaattatttgttagatgaatcgtataattaccaatacaattaaatagataatagaaaaaccagtacgaattcatgggttaccgatcgagatgggtaaaatttgatctaatcaacaaatgagtgatgacatacccctctgtttcataatatagcaaccgatcgagtacaaatatatcacgtcctatattatattgctatattataaaatggaggtagtatacgcatgtgttggaccatctcactagcaccaactgaattttggttctcagtcaggcagaatcagtacgtatattggcatcgattgagactgtcctaattgaggtttgactggtccaacttccatcttagctagcttgtccctccacgattgatagtactattacatatatgtacatagatcgtttggtacagatcatgcatgcatgtacgtactcacaaattaattgatcgctagcatagctccaactaatttgattgagctagttagctagctaaatagacacacatagctgaaatataattcatttctttttagctcgaggtagcatggaaattgacacgtacacgacttgtatatatttttcttagatatacaatgtatatatatggctcaactcgcatgcatgcatgcatgaatctgcaattcatgtaagttaagttgcatgcatgatgcatggtgctgagattagccaccatattacacatagctaatatatatagtcctctccgtcccacaatattataatttcttgtatctatgtacatagccacaaagttgttacatttgagatgaaggtaggtgcactaacatgtatgtccaacaacgaacaaggacagatccaaatttgatgaggagggggcttattttcttctttctcctacaactccttgttattctttccttccttatgtcctctctatgacgatgatctaacagggtaggaggggcttattactggagatcgtgtggttgtaacgcagaaaatccgaaggtgccaaaaccatgtgagtcatgttctagtagctaataaggctcaaatggagccccttacgaagttctggctatagaaagcaattgtaatttcatcttacaacttgttggtgaggactctttagttaagtaatatacttatgcttttctccacaaaaaagcagggtgggaggggcttgagctccccggcatccatgttcgatccactacccctactgacaaaataggtaaaatagatgttaccagtctcatattaaaacttaaatatgtaactcctccatatctataaaccttaatttcccaagcagcgtaggtatagatttaagtatgggcaaaggatatagccctacttacaagttacaactataattagttatgctaactacccaggtggcgaaggacgacgatgagaatgagatatatacaagcaacaacctatttcctttatgacaaagtattagctagctgctgctgattaatcattacgttttttttatgatatatatacatgcaacaagctaacaagcgaggcaaacgtagacatcgatcgttctgttgcgcttgatttgatcgtgtgagtgtgtactgatctattcttgcccgaaatgggcctaatttgtttgggccctaagactacagataccagatccttgaaaagaaagccttgggccgcttccccttacctctctatattgggccatgaaagcgataccaaagatatttggaaaaagtacaccgaaggtccctcaacttgtcatcgggataaaaaacgtcctcgaaccgtaaaaccagataccgcgggtcccttaactatacaaaaccggtcacgataggtccctcgacggttttgatcccagttttgtcctatgtggccgccgagtcagcgtgggacccacgtgggccccacatgtcattgtgccatgtcagcctaccctctcttttcccctcttctcatttctctcactctctcttcgctcagggtggcgggggaaggagcggaggtcaccggcgagggcggcgtatgctagccgacaggaggggaggaggccgttgggcaaggccggtggggcgcggtcctgagccgccgcccgccgcgcggtccgcgaggcgggccgcgacggcatcgtcgtcgtcgccggccgcgccgtctctgcccagttcgccacggctagcgcggacccgtcctctggcgccgcgacggcggcggggaggcgagtgtatgtgaggaggccggtggggcgaggcaggaccagcgccacggcgcgaagcggcgggtgtgccggagacccagcaggaccagcaggaaggccttccgcacccaccctcccccgccgccgccgcccagctcctcccacggcggctcccagcccgcaccaagctccaccccacctggcgcgcattgctttgcccccgacaaccgtgccctgctccgcaccgtcaagctcaaccacggccacgacatcgccatcgacgccctcgagctcgcccgcgcggcgacgccctccccttctccaacgacgctgcccccgccgacgccgacgtcctcctctttctccgcctctcgggcctcttcgaccccgagacggtgggggaggggagagggcgagaaccgcggcgacggcctcccgcgcctaccctcccccgccgccgccgccacccagctccttccccggtggctgccgcacgcgccaagctccaccccaccggccgtgcactgctccacccccgacagccgcgccctgctccgtccccgacggccgcgctcagatccttccccggcggcactggcggcgtgggaggacggccgcgagaggccgtgcggcaccggcgtggcctccgctcctttcccgccgccctgagagaagagagtgagagagacgagaagagggggaaagagagggtaggctgacatggcacgatgacatgtggggctcacgtggatcccacgccgactcagcagccacgtaggacaaaaccgggatcaaaaccgccgagagacctattgtgaccggttttgtatagttaagggacccgtggtatctggttttgcggttcgaggacgttttcgtatcccgataacaagttgagggacatctggtgtactttttccaagatatttttcttcactattttcagaagtactaacacactacgtttggaatgcaggtaaattccctaagctcctcctaaaagtgaacttttttttactataataataacattataagtacaaaggcggtgctggaccttgcagtcgaacaagcccttgctccccggataatattgattctcacatattatgagaatatatagttttaaaatgagaaatatattaaaagccaaaaactggaaacaatatatgagagattagaggctaggattatatatctcgtttagttgtaaaaaaaaaaggttctactacctattactattaggggttacaatatgaatacatagtgcctacatgtgacaataacagggtgcataaaactcataatatgatcagccaccattcttcttcattttgttcttcctagcggccaaacactttggcctctgtatctcacaactatacatgtagctatagtaaggtgctatctgtgatttccatccaagtgcatcaaatcttccttgaggcctaacacttccaaacagagcatctaccagtgatatcttgggagcttcagcttcagcttcacagtgggaagatgcatgtgagcagattgtttgatagttatcaagaatcacaagaagttcagttgcttcttcacttggttcattcacccgatccaaagctttaatttgatctgcagcatacatgaatgaccaaatatgctggttcttcttcttgaactctctcagggttgcaagaaccaagctccagtaatgactgttggcatttgatctcagcaatctactgaagacattggcacccatgaaacacccttcagtttctattgcaatgtccatggctattgatgccatttcagggtgctctgaagcatccatgctcccaaatgttctcaccttgaagaagtaccagtaggcttccttggataaaagctgtaatctgagaggtggtgtggttcctaacctcgcaatcttgtctgatcggcttgtgactatgattttactatcgcgaggaatgcgagttttgtatatcgagtatagtctttccaataaaaccccatcgatatttttatctagtccttctgaatacctatccccatctagttcaacaatgaccaacacccttcctacacccgaggcacggtttcgatgtttgattacaccgccatctctaagatccacaatgctttcatcttcaagatcggctcgagtgaagaacacaatttgcgagaaatgattgcgcaccctttcatcgttgcaggcatgctcgacaagagtactcttcccaactctccctggaccaataatcggtagaactcctggttctagtgtgctatgattcccaggttgtaggagaaaattgatgagatattccatctccgtctggcgcccaaacatgcactggtccaagatcaagtacatgctatacggctgacgatgaaggcgagggcaactgcttaagaatgcaatgaactcagtagcatcagcaatggtgttctccaggtccccaagaactctctgcagctcacccaaactctgactgctactgtcactgcagaaacggatacgcttggcatgactgaatttagagatggcaaaagatggactcacttcaccatgatgatccttgccttgatgagctctgcacctgaaggtgtccagggtgtagtagcctctgaacatctccttcctcaggatgctcagctgctccagcatggcttggttggtgatgcaccgttcttccgcctcgtcgacgatgatgcgaaaccgcagcagcagcctttgcaggttctccaatctttcatcgtcgcttggagccggcttttgctgattcaggtatttgcttacaaggaaagatatggatctacctgcaagttcagtcaggatgacagaaatggttgcctccatgttggctggagaaaaccttgcagaatggttctgcaatggaatgagttacctctagctagaagtataacttatattatgtgatctgaaacttctgattgtgccaaaacaagtttttgtattatctttcaattaggattaggattaggagtacaagttgtaacaactaacaacaagcaatgagtgatcagaagtcaaaattggcaggggataacaaattacatagaatcaattagttgatgtcagttctcatggtgttctgcatgtcctgacgtcttgcgcatttgacacgttcaagcttcaactaatgaaagataatacgatatgctgacgaattgagtttgatggcctctcataaacagcacatttacataacagattggagtactcattcgctcagacagtcagacagtaggtgaaaatatttaaaaaatgctcagaactattacagtttaagataattacattatacagcagcttctcagataaacaggtgcaaatcttcggaaaacaacaagatggtgttaacaccaaaatttgacacctcgaacataaatagaaaaatatggccgaatttaaaaaggacctggtttcctttatggggctagtatgaccgccaccgtagagccggtcaaaccggtgatgtgggaccggtctgactggtggcatgtggtcggtcagatcgggtgagtctgactccgagttcaatttcgccgggtctcgagttcccttacttgagaaggtattttttgagttctaattggtcactatcctcaataaaacatggaaagggtcttgtaacaggaccgacccctttataagggctatggtcggttcgattctaacccccaaaccacaatccctataatctatcgaattgttcttttacctttacttttcagccatgctttctactttattttctacctaacaatagttcatccatctttgttgatttgcgccacaaatcatccgacttcactgcaagggtgcgatatctctttgtaggtttatcccgtaaaccttccgattcatccacgagacggtaaatcagtctagaggctaattttgatatctaaatcagctccgctagccagtttagttttgtatcaaggtggttggcgaccgcaagatgtttaggtgtcccgatcgtaattgtcttcttgctataagaaagttaccaacacgattttttgtgactatgctaggaaacgtaaaaaaaatttcggctatatatccgaccgaaatcaatccacatacattcactgccgccgtctacgtattacacactggatcaatgtattcggcagccacactgtccggtcatccgcaacagcaatcggattgctctcgatctgctgccaaaaattaaagaaaatcaaatcaaggtgagtttacaggaatagatcaacaccgtgagtgagtccgaggaaagccgccgtcgctgagtatttttcctatatatctgcagccgcgtgacgacgctgcatagatagatacggacatcgatcaattcgtcaaggccatcaggacttcagcgcttgccgtttcgctcttgtgttcctattttggccgatccagaaaaactaggagccgattcaacgtacgttgatcggcatatacaagccaactaggaagcctacccatcagtacgtggttgctctctgttgcgtacatccattgaaacaaaaaacaaaattcaatcaaagccattgcattgtttttgggaatacgcaaggagcgcatcattgtattaagaggaataaagtttatgcacatcggaaacgaaaaagagagggggacgaggtacaggagggtgactagaaaacgctaaatcttattctcgcaaccagttgggcgacctactaggcggagtttgaagaataagagctggcatagctgctctgccattgcattgtatcggctaaccaatattttggaacttttgctacctgcaaacgaggagaacagggaatatcagttagctatcttgtgtacacatctatttccctattcgcctacgacgggtggttaattatctccatatcaatctaaatcattctagaggctaattttgatatctaaatcagctccgctagccggtttagttttacaaaacccatcatggtttagcttcgtctaaatcgaggtggtttgtaaatccatatcaccgcaagacgtttaagtgtcctattcgtgattgtcttcttgtaaaaaaaaaagttgctaacagatggttaagtgcaaagtttgggcaatgccttgagccggacactcgatcaacgatctaaaaatcaggcgcccaccccgccccgccccgccccacccgtgcaccactctgcctttgaatataacttccctctcatcacttctcttattttgttatgcagagttctcttcacatgcatgtcatgtcatgtctagccatgcatgttcatgtaaatttttgatatatcattttgcgcatttttctctcttcttcatttttttctctcctaaaataatggtccgttctacgatccgataataccgttgtattgtttataattaaatctttatagtaagatatcacatgattatattttagtaaaaattcaaatgttgtttcaccccttgaagaaaattgtttcagtagtgttcaagagaaatgcaacatttaaaaataccaactgcaacaccaataaccacctatatagaactaggggtacggaaacggacggaaaccatctttatcgttttccttttcatatttctttttagaatcggaaacctcggatacgaaaacataatcgaatattatcgaaaccgaaaacggagcgaaaacgaaccggcgcgaatacggtaatgaaaatttatcggaataaaaaacccctcaaactgataaatccaattgaataaattatctatgtttaaaagagtaatgttgttgataaattccaatgtagaacaaaaaatattcttatgtaattttagatttgcataacaaatatttaaaaaaaaacaacagccaaacaccatggtattcactatttattgcttaaaaaaagaatccagggtatttcaatcacaaaatttttggtaattccgagaaaatttccagaaattctgagaaaatttccggaaagtttccgaccaattccgagttccgacggaaaccgcccttagcatttccgattccgtttccgagaaaatatttccgaattcgtttccgttttcgaaaaattccgaccgacagattccgttttcgaaaataggtccagaatccgaaaagttttcgtaccgttttcacccctatatggaacattgagtaccaagaagcgaaacaaaaaagtcatatgagagatacaatatatttgaaaaaaatgatattgttgaaatattttgtattattacgaatattaagctgtaactattgaaataatataaaatacttgccaaaactttcctggaacaccgcgtgcaatatttacaaattaactagtgaaatatcatacgaatactagttgaaacatacacataaaacatgtgcaacattgaaaaatatccatcaaaaaagctaaatattcttttcatcgaaatataacaatgtgtggtcttgttctaaatatttaattgcaatgaatttaatagtgcaatcaaattgtagattgaagaagttatttaagagaaaaggatagttcaaatattactaaaaaaaacttataccaactcaactaaccatattttcttttttactaaacgcatgcatgtactagtagtgacttggttaatttctagtaggctttacaggctgcagctacaccatgtctctgtagcagctagctgacagagtgacggaggatgaggcgggtgcccgatttttagctaaaaaatcaggcacccaatccgaagtcgcgtccgcaaagttcccgaggtcgcttatttcttgcaactatatgctgcgacttcagtacctcacagctgaacatgtagtcgtggtaaggtggaaggtgagatctccagccgagaaccttgaattttccttgaggcctaacatttccaaattgaaaatcttcgaaactcaactggggaacttcaacttcactctgagcagagtttgtacaacgatggagcatgtttggaacagaacatgtctgataatcatgaagaatcagaatatattcagaggaaattccgtttaccctcctaacatatgccgattcaaccacctcccaaggaccatcaaaatttgcatagagtgagatattcaacttcctgaattctctgattcttgttagaaccgtgctccaaaaccgagtgttgaaatttgcttttagaagttcattgtagatgcctgaagacatgaagcacccattccattcccttgctatctccatcgctattgattccagctttgggtgctcctctgcatccatgcttccaaacgcgcgcagtttgaagaagtaccagtaagcttcttgagtaaagaactttactcgaagagcttgtgtcgttccaaagcacgcaatcttattagatcggcttgagactataattttactgccatttgcaacacaacatttgcaaactgagtacaaccttctccacacaccctcatcgatgtctctggttagttcgatgatgattaatatcattttgccaccagtggcattgttttgatgcttgattacaccagaatctctaagagtctccatgcttgcatcttcaagatcatcctcactgaaacacacaatttgagagaagtgattacggaccctttcatcatcacaagcatgcgcaatcagggtggtcttcccaactttcccggggccaatgatcggtaggacacctggattttcagcaccgggagtatcctctttgagcaggaagttcatgatgtgctccatctccatttggcgaccgaacaaacacttgtctataagcaagtgcatgctatatggctgccggcacaaacgaggacaaaagttcaagaatatgacaaactcgcgcatatcttcgagggtgacttgtagtctgccaagaacttgctgcagctgatcttgcaaggtctggccaccatcccacaagtatcggatgcgcttggcaggatttaacttggatggtttaaaatagttactcacctcatgatctttggcattgtcttcttcatggccatggcatatgaagttgccgagggtgtaataccctctgtacatctccttccttagcatgttcagttgctgcagcatggcttggtttgtgataagccgtccctctgcctcctccacaatgatacgaacccggagcagcagtcgttgcagtctctcctccacggatggtaatgttggctttgagcacttgttgatcagcaaagatatggatctactggcaagatcactcagaatcacggacaaaaatgtctccatgtctacttctcatatgatcagcaaagatatgatctgaaattttgtaaatcactcaagtggtgaagagctggtacctgagaaaacacaatctgaatgtttatagagggtattgcactggttacatatacaaagaggggatatgatctgaattaaggcagccacgtactctactaactccaagtctccataaagcgaaaggtattgccctgtggttacatatacaaagttacatgtatatctagaatttatttcaaaccatacttttcagtgtgaactgtttggatcctaatttctgttttttctttgcagttccaataatataaccgtacaaggttgactacatagcggagacgattctacaggtttggttcagcgccatggaattctcgtcaagtttcaaaagcacatgcattttagttgaccagttcgcatgctagccaatgctacaacagcgacaggttagaaaaggaataaacattcagaaaatggttttcttcttttgtctcttttgataagggtcaagttttagcttctatttcttttaactagcaaaaaacattcagaaaatgatcccctacagcggttgttatgtccttcaatagctgactatctatgtttcttgaacaataaattatgagcatttttcccatccttgatgaggtactatgaggtaccaatctaatctaaccgttgatttagttggggcatgatggggctaacaaaaataagatctctcttctaggtcagaaatcgccgcatcctctcttccaggtcagaaatcgctgccgccgtcgcgcatcgaggttgccgccgtcgcgcgtcgaggccgccgccgtcgtctcccatcgagcctgccgccgccgccacgcatcgagcccaccgctgctgttgcgtatccagccgccgccgtcgagcgtcgaggccaccgccgtcgtcgagcgtcgaggccgccgccgccgacgattcaccgcactatcccatttgtcctgtccagtcattcagaacattggtgctcgtctcgaatttgtggcaagtttccaaatgacattaaaggtgggtattaaggctctatagaatgacatcacatttgctattgagtcttatttcaccctagcaagataatttccaagatctaaaagcaggggaacaccaaattcccagctcggagcacaggaacgccaaatctgagcagccgaggggaggaagatggtactgacttgccgagcgcgggccccatcttgttggtgagcgtcccgacgatgatcatgcagtcggactgtcgcggggatgggcggaagatgacgcgaaagcggtcgaagtcatagcaggacgcgccggcgtgcatcatctcgacggcgcagtaggccagatcgaccccctccgcgcccagttcatgaggtcgtctaccttggagatcactaactctgcccgaacgacacccgccgccgccgtcgcgtaaccagtagcccgccgccgtcgcgcatcgagcccgccgcgcatctggctgctcctgcctctcgcggtctcgacgccacgccatctctcgcggcctcgacgccacgccatctctcgcggctctcccgagtcccgacgatttttttcttctcgtgaaacaggaaaggacacaaatcacattatagaagtgggagcaggtttcttctcttgttaaaagaagttaattaatgctgacaaattgagtttggcaacctcatgaaaatatcacatttacataggagcttggatgtacacagatgctcatatttatacaacagtttcagacaataacaagatctcgtagcttagatactaaaaggtaccacaacctaacaatatggattactatctgagatggtcaggtgcaaagcttatgagatctcttcttactggtgaccatatgatgtggcctccgtacctcacagttgaaaatgtagttgtagtgaggtggaaggtgagatctccatgcgagaaccttgaattttccttgaggcttaacacttccgaagagaaaatcttgcatactgacctcggggacttcaccttcactctgagcagagtttgtgtaacaatggaccatgtttggaacagagagtgtctgatagtcgtgaagaaccacaagatattcagaggaaattttgtttaccgtccgaacatatgcaggtttaaccgcctcccaaggaccaccaacaagatacgcgttgtatattaagttgttcttcagcttgaattctctgattcttgccagcgccatgctccaaaaccgagcattaaagtttgctttcagaagcacactgtagatgcatgaacccatgaagcactggttcatctccctggcgatatccatggctaatgatgccagctttgggtgctcctctgcatccaagcttccaaatgtgcgcaccttgaaaaagtaccaataagcttcttgagtaaagaaatttactctgagaacttgtgtcgttccaaagcttacaatcttatcagatcggcttgtgactataattttacttccaactgcaacactaattttggaagctgagtacaatcttccccatacaccctcatcaatgtctcccattaattcgataatgattagcatcctgtctccaccaatagaatggtttttatgcttaattacaccacaatctctaagagccaccatgtttgcatgtcctacatcatcgtcgttaaaacacacaatttgagagaagcggttacgcactctttcatcttcgcaggcatgctcaatcagggtgctcttcccaacttttcctgggccaatgatcggcaggacacctagattttcagcactgggaatgtcctctttgagcaggaagttcatgatgtgctccgtttccatttgacgaccgaacaagcacctgtctaaaagcaagtgcatgctatatggctgtcggcataaatgaggacaactgttgaagaacatgagaaactcgcgcatatcttcaagggtgacttgtaggctgccaagaacttgctgcagctgatctcgtaaagtctggccactgcccgtgcagaatcggacacgcttggcaggatttaacttggaaggtgtaaaatagtaactcacctcacgatctttgacattgtcttcttcattgttatggcatctgaagcagatgagtgtgtaataccctctgtacatctccttccttagtatgttcagtttctgcagcatggcttggtttgtgatgaaccgttcatctgcctcctctacgattacacgtgcccggagcagcaactgttgtagtctctcctccacagttggagttgttggttttgagcacttgttgacaaggaaagatatggatctactggtaagatcactcagaattgcagacagaaatgtctccatgtgtaagtatgtagtctgaaattttgtagacctctcaatagatcagcaagaactgggatctgagagaaattatgtagtctgaaaaattttaaaggatcaggtgaagcagagtaggaattaaggctgccacatactcttatactgtggttacaaaaacacactttgaatgctccacatagtccagtatcccaacctagatatgctttttaatgtgaaccgtttggattcaagtatctgttttgtacattttgcaacaatataataaccatacagactgtccacatagcggtgacgatgaaagcagtaaagaaagttctacagattggttcagcaccactggtttctcgtcaagtttcacagtcacatgaatttttagttgaccaattccgcgttctagacactgcaatggccttctatttctacaaatgtgacaaaaagaaaggacctgacgaacatgaacaaaagaaatggcaaacttcttcattatgaaactcaacatgttaaaactgttgaaatttgagaagtgcttgtggtgcagctggcatggatagtccttgttttttttttctctgggtcaaaattcaaggctttgcttctagttaattccaagtcaacttttattttcaacttgtctgactgcaacactagtgaaaatgtcatggacagggaggaaacattcagaaaatgttttcctaccatggttgatggatgtgcaaggaatcagctgacaagctaaccacttttttttttctgaaattccttttggggatcaatacgcttatatggagaattgaagtattctgagaaatatggctacagatccttgaaatttgagttacctggatcgaaagaagcagacagaacgttgctgtcagtcgccgccattgcaggaagaacccgagccgccgctgccgccgacgtctccagatccggccggcgccgcagctgtcgccgccggcttccttggccgctccatcgccggccgcgctcggcttccttctcacttcgtggcggacgtcatcgctgctaggataggggaagtacaaccttgccgccattgctggagagtggggatccatccagtcatccagccaccagcgacttgaacccaaaagctttaaatatcgtaacctttgtccttggtaattaattaacttccttggtagagttaaaaataaagagaaaaaagatttttaaaagatatatttgagaaaataacagtgcctttgccttgatgtttggaaggaccagctacagggcgctttcgacactcttgtgctgctaatctgcgggatggtttggaaggagagagatgcgcgtgtgtttgtaaagaactgttttattcctcttaatgcaaaaatacgcatctagcgtattcccgaaaaagagatgtgcgtgtgttccagagttagagccgagtggcgggcatcctctttgccttgattaaagagtaggtcgtgatctgaaaagaagctgggggtttttaaagatttaggagagtagcgtcttgctgtagcttgtttttcttttcggaagttgcttatgggacaacatcaatcattcacttcagcagtctcttgtctaaatttgaactttgtgaatgtgtacatacctttttattaagtaaatttggtccacctgtttgttttaggctgggctggctaaaaaaaatagtgcccatttgatacggttggatgaatgatagggttaattaaatctcctattacaaatttgtcatattggaaaaatgatattattatttatcaaattggctcagtgtcataagtattttgtaaaatttaaattatgccattatatatgtatgtacgagacgtacttgaaccaatattttgcgtaacgtatttttcctacccacaaccattgcgcgctggtctcctcccagccagattcatacgtggggggtgttacgaaaatagatgcacaacggagacacgaatttttacgtggaaaacccttgcgggaaaaaaccacgggcgccgaccggtaatgatcactatagaggagtttattacaaacgtaggggaataacaatgggaacgtcaccccttcccatacggcttacaagagtatatatacgggataatagaaagacacctaataggactctgttgatagaaaacacagggcctgggagatctgcttaactccagtgcatgtccaaaactcgccttcggatgtatgagcgtgccagttgatttgatcctgcaatcaacaagaaacaaagacaaagaaaccgtaattaaatccataaatgatagccgatcggctaaatgccgatgacatgtcatttatctttgagccgatgtcatatgtaaatcgatcggcaattgttaagaaaacaaatcagaactaaatctactcgatcggctgcaaatatcaatgatacataatccttatatcgatatataattgaatcaagtgattgggatagatcggtcaccttgccgagacagtataaatcacttagatcgaaatatatattaataatgagattatatatatatattcatagcatagctgatcagatagatctagcgtgtatcggctaatactccgatactactttatattaagatattaaagcaaatagaatatactaaacagaaatctaatatacttaaatgcaacaagatcttaacatgaaggacagatctaacatgttaattgagcatgtagaacaaaagcaattggatcagataagatcggctgaaactccgatactaccctaatcggcaaccagtaggcaggctagagattgaaattctaagcacggcttaatagatcaaactcaactgatacagcattaagtatgaaaagaagaacaatatctagacgatcaagccgctggatgtttcatagagtggtggatatctcatataatctaagccaacgtcgttatttaacctaatcggctgccttctggtagcagatgttagccgattgtaggttaaatgacgatattgtcaaggattatgcaagatatatgataatttgacggactacataaacaagattagagtatcataaagatggaagcactaatctcgagaacacaagccgccataacaagtttacctcttgttgaagatcgaaaccgatgcagctcaacccgaaagcaataactcgtcgaaataaaacgaaagcaaaaagagtggcgatgcgccgaaattgtattgaacgtgtgtgttaatcattacatagggctcggggtctatttatacccgagaaatacaagatatgtccatattggacacgactcttatctctaacaaactctaagataccacaagtctttgcggcagacttttgctcacatttatctctaaagaatttacataaaatatcctatttatagatacaattgccttcccaggactctatccatgcgtggcattcattttgaagcacatcaactcgaacccaatgtcgcatacgggtcgtattgtcggaatcggctgtatcacttaaccagtccgactcagacttagccgatcccagtcgtagccgatccggactccagccgattattactctgtttccgaaaaaacccttatcttcgattctacttcgatttcattttcatctccaatactgatattaccaaatttggtcgttaacaggctcctactaggaaactaattcgaatatattgtgggcccaaaattcggatcacatatttaacaatatccaccttgagacgaatttcctcttgtagcataaaaacatcaatcaccaaaaatacctcatgtaggtaaaatcaccgcgcgccaaatagtctctaggactatactgtaacacccaccaagcttgagcaaagctcaaacttagtagcaggaactggctttgtcatcatatcaactgggttatcatgagtacttatcttgcataccttgacatcaccttcagcaatcaca

SEQ ID NO: 68598 - DNA, 5121 bp, Oryza sativa
  unsure (1)..(5121): unsure at all n locations
ttttgggcttatcttttgcaatagaacgttttggagattgatgaacaatagaagaatctgaatcttcaataacaggtgcatcttagttaatagcaacaaattcgttttctggtgcatgtcctgaactgatcaaatgctccacctgcacacttgctttctcctgactctcaacaggaacattagtagaaggtttgtcatgtaacataactgattcatggaagacaacgtttctactaatcacaaccttttttgtttcaggacaccataacttatagccttttacaccagacggataaccaagaaaaatgcacttaatagctctaggctccaatttaccattatcaacatgagcataagcagtacaaccaaatactcttaagtctgaataatttgctggggaaccagaccatacctcaattggagtcttcttatcaatggcataactgggtaatcgattgataagataacaagcagtggaaacggcttccgcctaaaactgtttaggcaaacctgcattagacaacatacaacgggcctttgatataattgtcctgttcatacgctcagctacgccgttttgttgaggtgtgtgaggaacggtgtagtgacgcacaatgccttcagacttgcaatatgatttaaatatcttagaacagaactccatcccattgttagtacgaaggattttcaccttcctttcagtttgtcattcaaccatagttttccactccttaaacacatcaaaagcttgatatttgtgcttcaagaaataaggccaaacttttcgcgaataatcatcaacgatagtcatcatgtaacgagcacctccaaaagatgtcttacgagcaggcccccataaatcagaatgcccataatcaagaataccttcagtagtatgtgtagatgtattgaacttcaccctcttatgcttgccaaatatgcaatgctcataaaatttgagcttcccgatgctttgtccatctagcaatcttcgcttgctcaattctgccaaaccaatttcactcgtatgcccaagacgcatatgccaaagattagtagcatcggaattagataatgaatcagaaactgcagcaacattacctaatatagttgtacctcgcagatggtacaggttggcagatttaatatcagctttcatcacaacaagagagcctttagttaccttcaaaattccgtctccaccggaatatttgtaccctttgccatcaagagtacataaagagatgagacttctcttcaaatttggaatatgccgcacatctgacaatgttctgatacagccatcaaacatcttgatctgaactgttccaatacctgcaacctcgcatggtgtatcatcacccatcaaaacagtaccaccttgaacagcttcataggtggcaaaccaatccctatttgggcacatgtgataggtgcatgcagtattaagaatccactggtcactagtttgtgcacaaccaacataagcaacaagcaattctgcatcagatttctcatcagtaacaactgcggctttaccttcctcttctttcttaccttttggtacatattttccggttctcttgtctttgtcctgtagcttccaacactcagatatatcatgtccatctctcttgcagtatttgcatgacttatacctgcctctggactttgatcttccatggtagctacttgaacttttatctcttgatttgctgtttgtgttcttctcctgttgcctgccccgaacaaccaagccttctgcttgtgaatttgaaccttcaaagggtaccatcttcttcatcttttctttggcatgcaaagcatcataaacttctttcaaagttagagtatcatggctataaagtatagtatccctgaagtttgcatatgagctaggcaatgaacacaatagaataaggcctaaatcctcttcatcatactttacctccatagactcaaggtcagcaacaatttccttgaaagcagagagatggtccattacagacccatcatcttgcaacttgtgtaaaaataacttttgcttcaggtgcatcttactggtcagatccttagtcatgcatatcnntgttccagcttcaacccacnnagcccagcggttgggtctccttccttaagcancctccgtgcaaaatattgttaagatagataaaagatgaatatatgacatagnccttacgatcccttttcttctcatcgttggaccaatcctgagtcctcttgtcaaatccagaaagcgcatcatcgaggtcttgttgtgcaagaacggctcgcatcttcacttgccaaaatgagaatcttgtgtcttggtccaggagcggtagatcatacttcaaactcgccatgggaattaatcctgaatttgctaaaagaaattagggtaaatctagcaaaaaaacgcgaaacccggtacacttctcgtgtgcacgtagcgtagatctgaaacttcctggtacacaagcttgtgtgcgcgtagcaattccacgtgaatagaaaatcacgtgaacaggaacctgatcgcttccctcgttgacttccttttcagcctcgggaaccgtgcgatttagtagatgtattgacgccggctgctactcctggacgtgcgcgtagacggcttgctgctgctgcttgccaatctcctgacgcgtgcgccgattccaggacctgggctgctgctgccctaatttcgcgcgggctgtagggatgacgccgatcagatcgatccggcgactcgacgatccggcgcctcgacgaaccggcggcggctgcgtgacgtgtagatcgatctccaaagctctgataccacttgttatgaaaatagatgcacaacggagacacgaatttttacgtggaaaaccctcgcgggaaaaaaccacgggcgccgaccggcaatgatcactatagaggagttgattacaaacgtaggggaataacaatgggaacgtcaccccttcccgtacggcttacaagagtatatataagggataatagaaagacacctaataggactcctactaggaaactaatccgaatatattgtgggcccaaaattcggatcacatatttaataggggggagtggaggtgggcaagtggcctatgcccatgggcagtggcaaggtgtagaggttttagcacatgtgccgaatacctgtacaccatcactacgctcctcctcatcctcagcgcccatccttgcgatcatcacattcctcaccactcctcagtcggatcccaccagagaacacatataaaccatccgcgtcgatggagctcctatctcgccacttcgctattgcagggagtggaatctaatccggggatgtccctttgtatattttttctttcaagttcatgtaaatggttatacaaaatgtaaataataatttgacaatgtagagtacagtaacatctatcgctccaccaataatcaacttcaaacttgatctatacattgaaaaaaaacaaattatgggatgaataatactatattgttcatatgttgaatttgcccttttcatttctcaatgtgtgagttgagtttaagtttaaattttattttaaagtgatatatgtatgtcatatgaatgttattttttgagatttttttaataactatttgagtggtgtttgagcaaatgagaggacatcccctcaagagtttaaaagtgtttcctgctattatgctattatggtcgctcaacatttagtctataatcgagtttgccgttattcattccacatccacaattgtttgctagctcacgtgtcttgcatgtgcgtcgtgggcaacgttgaggaaagcctcttgaaagcagcacattttacataggagcttgaagtaaacacatttgctcatgcactgggtgaaaaacaattgaaaatttctcagatttagattcagattcagataattacatcatacatcaacatctgagatagtcaggtgcaaagcttctgaggtctctcctccctggtgatcagatgatgtgaagtccatacctcacagttaagtatgtagttgtagtgaggtggaagatgagatcttgacgcgagaaccttgaattttccttgaggtctaacacttccaaacagaaaatcttgcaaactcaccatgggaactgcagcttcactctgaggaaagtttgtgtgataatctaccatgtcctgaacagaacatgtctgatagtcgccaagaaccacaagatattcagaggaaacattgtttatcatcctaatgtatgtgggttcaaccgggtgccaaggacagtcaatattggcaccgtatcctaagagattcttctgcttgaattctctgattcctgccagagccatgctccaaaacctaacattgaaatttgctttcagaagtacactgtacatgcttgaacccatgaagcacccattcatctccctggccatatccatggctatcgatgccaactttgggtgctcctctgcatctatgcttccaaatgtgcgaaccttgaaaaagtaccagtaagcttcttgagttaagtattttactctaagagcttgggttgttccaaacctcgcaatcttatcagatcggcttgcgactataatcttactgccttttgcaacacaccttttggaagctgagtacaatctactccatgcagcctcatcgatgtccctgctcaattcgataataatcagtagtctttcttcaccagtaccacggttttgatgcttgattacaccacaatctctcagagtcaccatatttgcatcctcaagatcatcgtcactgaaatgcacaatctgaaaaaagcggttacgcaccctttcatcggcacaggcatgctcaatcagggtgctcttaccaaccctccacgggccaatgataggcagaactcctgtattttcatcaccaggaatatcttctttgagcaggaagttcatgatgtgctccatttccatttggcgacccaacaagcacttgtctagaagcaagtgcatgctatatggctgacggcacaaacggggacaactgttcaagaacatgacaacctcacccatatcttcaatggtgacctcaaggctgccaaaaacttgctgcagctgctcttctaaactc

SEQ ID NO: 68599 - DNA, 1936 bp, Oryza sativa
gatcaaatttcccatgaggttcaactctccttgacaagatatcttgtataccaatttttggagccttctgatcttctgcatgagcaagctctactcggcaatgttcaaagatttcacagtagtagttcacatttccatctgtcctaggaataaccacacacttgctcttcatcccaaaatcacctgaacctttgttaggcagtaactggctctttgattccttggtcctgaagcgctcacgcaggctaagccagtcgccattgtaaatactagcttgaatgaaggtagccatgttgttcagatcaatgaatggtccaatgaaagtattgtacatctcacgatcaaagtatccattaaacatcgccattgataccgatgccacctcggggtaatctttaggatctgagcttccgaatgcgagaaccttgaagaagtaccagtaagcttctcgagacaagaattttaggcgaagaggttgtgttgttccaagctttgcaatcttctctgatcggcttgtgattatgattttacttccagctgaaatgcaacttcgagaagaggagtacatccttctccattcgtcatcggaaacatcttcagttagctcaacaacaaccaataatctttctcctccacttgaagctaatgatgagttgtgtttatgccttatcactcctgaatctcttaggataagcaatgatttttgctcgctcaaatcgctatcactaagaaagatgatgcgagagaagtggttgcgcaccctctcatcattgcaaacatgctcaacaagtgtgctcttcccaactttggcaggaccaatgattgataggacatcaaatatgtcactatatggagtttctggatgtaacaagaatttgatgatatgttccatctccatttggcgcccaaacatgcacttgtccatgaacatgtaggtgttgtatggttgacgatgcatggaaggatagttgttcagaagcataacaaactcagccatgccagccatggtgatctctatgatgtcaaccatctgatcgaactctctcatatctccatgtcgtctagtaccagtaaggactcgagctcgcttgatagagttgaatttagacaaagataaggtgttgtaactcacttcattgtcatcgtcgtcgttcatgtcctcctcctggtgtttctgaattctgaaggtgtcaagagcatagtagcctttgtgcatatcttgtctcagcatgttgacctgacgaagcatggcttggtttgtgatgtgcttcccctctgcctcttcgatggcggtggcgagccggagcagcatcctttcagtctctgaatcttctcctccatgaacgtcgccgccataggcggcgatgacggcttcgaggagcatctgtctatcaagaaggagacggatctactggtgagttctcctaggattgcagagaagagagtctccatttgggaaatggaactttccttctccccttgcaagatggttcagacaacaatttgatgaatggatcaacaaccagaataagaggaatcctgcaatcgtataatggcaagtgctctagcttgtctgagtagcatttttttgatgccaacttgtttgactagtaattaaaatgacatcgattgatggtgaacaaaattttgtggatgcagtggttctatagaaaagtatgcaatcaatcaacaccaattattctttttggggttgagagttgagagatttgcttaagagttctgtttgatgactcaagtactgaatctactataaagcgagactttcgttgtgcatgatattttttcttgtattttctgaccagtgttgaccaaatacagggagactacacctttctatagacttttacatatttcgtcaataactaattcctccaagcaattattgacctatacagatttaattaacttgttgtaa

SEQ ID NO: 68600 - DNA, 984 bp, Oryza sativa
ccaaccacccagaggattagcaacggaagtgggcacttgtattcccataaccatgaaaagaatattccaactgaatgtgcaacatgacaataaaaaacagatgttcaattgattcttcagagttacagaacaacacttaccttttcgtctccttttaaccaaattgtcttttgttaagactactcctttgatataccaaaggaaaatcttaatcctaagtggaattctaagtttccagattatcgactttcttggtaccacattatggtacataagagccttgtacatagaactcaccgggaagactctcttcccattggcttcccatctaaaaatatctggactattagataagttaaacaagaccatttagcataccagcttgtatcacgcattcaggttatcccccaccaaagctctactaaagggcacatttagaggaacattgcccagtacatcgcttactctcgcatgcttgtttattgttagtaaatagagggagggatataacttatcaaaggagttagtcacccacccagcgatcctcccaaaatctcacttgttctccgtgtccaactaccatagatcctagttgcaaaaaatctttcttaaccatcataagcccggccctaaaatgtaaatccccagaccgcttttccacttgagtgattgttcaattggctaagtacttccttttgaacagattttgccacatgcttccctcgttaaacaatttatagagccatttgcttaataggcacttattttgaatgtctaagttttgaatccccaaccctccatattccttaggcttacatagaatactccattttgctaccctatacttctttttatgttcatcacattgccagaaaaatcttcttgagaatacctttagttatttcaaaaggttaaactacttgcacaaaaaaagtcagattcagcacttctgataatagagcaattttacggtccttgaggagg

SEQ ID NO: 68601 - DNA, 9182 bp, Oryza sativa
cccatatgggatcatatcatatttgaaggcagttagtgctgctgttctttggattttttgtttgatcttacaaccaagcttagctgctttaatttcttactgatgtgggagtttttcaaatgcagctacgtgtttctcagtgtttctgtccagtgttatgcttagataccctctcttgctcctctttcatatgcatggtcttgcatgcctttaatggtactcctttcgtccaaaaaaaaagcaatctaagaggggatgtgatccctcgtagataatgaatttagatggaggtttgtctagattcatcattgtactaggagggataggatggagggagtagtggttagctcttaactattaatatatggtctacgtctttttcacagattttcttgattcctgtgtcttagccggttgtaagctagcttaccacccgcttcccctctctctcctctcttatccaactcagcattcagccatcttaggccattcccaacccaagaaactagatatagttctcataaacttcatgtcatcaagaaactagttctagatgaaactagttctagatgttctttttcaatacaaacactactattctatacttaaatttaatgctacttatctcacatgatatcttagatgtgtagaaattatgtctcatgcaaacacatggtttccttctctttcctcatttattcatttgccacatcatttttcattctaggtgacagtttatttaataatatggatattattctagttattgggttgggaatggcctggtagccttctattagtacctgcttactcctagccttctattactactccctcaaaaaaagataaaccctaggtttccgtgtccaacgtttgaacatccgtcttatttgaaaaaaaatgaaaaaaattaaaaagacaagtcacgcataaagtattaatcatgttttatcatctaacaacaatgaaaaatactaattataaaaaaaattcatgtaagacggagagtctaacgttggatacggaaaccagatttgtctttttttagacggagggagtacttgcttactcctagctttgctttgcagcagctagcaggagtaatgcattgcagtggcaacaatgtgcctctcctctctgattgaggaaaactagacttgctggtgtggcaatggcaggtctctgtgtgtgactggtaggagttctgcatgcttctacatgaccagagctctaggctagcaggtttgccctgaggaagaaagagaaaaagggttgcatttgaccactatacatgtccatttccatgctgctctttacacatcaaatcaaaggcatggctgtaaaagcttgcaaagatcacacacacactacactgccagtgccttgcattggatgttctcttgcatggacagccatttgttcatggggtaataggctgctctctcttctctttgtgatctctcatcagtcatcaccaggtattactcagctagccaacaggaaactggactactggagtactacgcactgtcacactcctttgtcaattgtcagatttgctgcagcttctcatgtacccctactgtagtacttgtacagtactccccttattttaagtgtatggctgtgtccaacgcttgaccacttatcttatttaaaaaatttatatattttttaaaattaattcacatataaagtattatttatattttattatctaataataataaaaatagtaataataaaaaaaattaaataagatggatggtccacaactcacgcttattatgggcgagggagtacagtagtatagctgagttctgacctttgaacaatggccgtgcggctcttccttcaagtcggaaaaaaaatccggtattttctttgatatgcagctgcattaatacctttgtgatgcctacctcttgtataaaaatttcctcttttacgatattgacatggttttaaaaacaatgttgatactaattcctactttatccgtcccattttgagcgtaaccacgagttttaattccttgttcaatttttgattgtctatttcttttcaaattcttttatcattagtatttttgttgtttttagttgataaaacatgaataatactttatgcgtgactttttttttaacttttttcaaaaaaaaataaatttaaataagacggacgataaaagttggacatggaactcatggttgcgtttaaaaatgagacggaaggggtattgataaaagatataaaacactcatttttttgttaaaacaccttttttacgatattgacatgggtcctaaaatgattccttctacaaatactattcagtgctattaatgaatagtattttttttgacaaagaaagttttttcttcaaatatatatatggctttgtgtatttttagttggtgcacaggtaggaagttatacttgttttgttaatttttttagagtgctaagtttttgcttaaaacatgtcgaaaagaatcaacaatatgttttggttatttttttgtgactggagggagagagtatggaatgaatggctgcattcagggcattgatcttgtttcattttcacgccgattgtttttgccaattgtgtggggactggggatctagaaagtattattatggttgagttgtcccctcgaacttactgtattttgacgttgataatcttgtgttaaatattgtatcatactcactccatttcattttaagtgcagctgtaggtttctatatataacatttaaccattcatcgtatttaaaaaaattataaaattttctaaaagtaagtcatatataaagtactatttatattttatcatctaacaacaacaaaaatactaatcataaaataattaaataagaccgatgatcaaacatttaacatagaaatccatatctacacaaaaaggaaaaaaaatactagttactgtgaataacaccgaggtcttctataaaaggccttaattaagaaacactgaagtaaaggtacaaaacaccacaagttagatctttgatttgaaaatatcagcatacgaaaatataccaggagttctgagttaaaagaaatattccttttgatcgtcgttctgtcacttgcccgaaaagaaaaggagaaatattcttctcgatcccaaatgaaaataatttttagtattttttagcttatttgaaaattttaagttgttttggtatatattacttttcttcattatttatttcttatttactcttaaagaaaatgcggaatctcttacaaatatttgactcatctattctagtatgaatggagggcaacaaagtcatttcagccatctttaaaattcagcttcggccgagtttagttccaaacttttttaacaaactttcaatttttccatcacattaaaactttcctacatatataaacttccaacttttccgtcacattgtttcaattacaaccaaactttcaattttggcgtgaactaaacacaccctgcatctagaacaacttatatttggattaaaaaaagagtatatatattgtacttgtatcataaacgtgtaattgtactttacccaaaatattacaacatatataaaatttcttcaggaattgatacatttgattattagggcactagttgaattacagaagttaattagtttaattctttagggtgataataaagctctcaattaacaactttggataccatcctggttgctttagttagtagatcaacgaactctttatttagattttgttgatgctacatttctgtcgtttttccgttttaattatatggcagtttcgtggtatatagtatggtgggtgtgactttggaaattgtacgcttgtttcttttcgctgtcattttccttcgtggagcttttgccagctaaatgctgatactgtcagtgtcgatcatacagtgcctctctcactgtatccatacacatctaattaataactcatctaaaaatagtactacatcttatcttattttatatcaagcatatttacccggttttttattttttaaaaaagtacctctcccacattctctttttttttcctgcgaaactgagatgtactatactacgatgcttgatttgagtacatattatatatttgaattcatacatatgcttgatttgacactttattcgataaattcgggtaataattaagcaagttctagtcatgcctagtgcaggaaaaccccctttgttctgcaaatacaatatttgagaaaatatatatgcatgttctgttgtcaatcgctcattgctcgtcgggtagctatatatagatatttacttcctagaaaaaaatgttgctcacaaaaaaaaaaaaccctactccatagcggaccgagcagtattctgcatatatgcacattctgcctcagatataatatgagtgaattgagcacttaatttgtaatcgctcatgatcattatgcttattcaattcagactgtcgttatcggtgactaacaaagtaattaacaatacaaaatattgagctacctaaagaaaacaaactaaccatgaattggcaagaacaaacaagtaataattacttaaccatgaattggcaagaatcaaactaacaatgaattggcagatatatatctagggaagtcaactataaccgaccccagcttataatatgtacgtgtgtgcactgcgtatttactcaaaatctacgtgcacacgttcagtgtgtacatatatatatatacagtatatatagttaattagcgtcggtatatatagacaaagaacagtggtgaacgttatttcatgacgaaggttttccgtacatttctcattgaattatatacgggcaagaaggaacatgcatgcatagttaattgattaattaggtttgttgatgatatggtccagctacgaacaatctaatgaatactttggtttcggtcgtcactactagtagttagtaaatgggataaaatcgatttgatctccaggccaattgggtatttttgacaccattcaattttcaatattgttagactaatttagggtggttaaatgctccctccgtccctaaatataagagattttggttggatgtgacgtattctagtactgtgaatctagataggagcatgtccaaattcgtagtattaggatacatcccatttacccaaaatcccttatattttgggacggagggagtagatgtctatacagcagtccattaaaaaaattatattttaaaactaggtcattggaacccatatatataccagtgacaacttgttaattatctttttcctccacctctcttctaaatctctcatcccttgccttttctcttctacctcctttgtgagctaagggaggtcctaatgacaacaaacttagactgttctcagctgcctatgccacgatatatccatcgaagcatccacaaatggaggaggacgtggcaataacatatagcgagctagcaacaacgacggtggtgaaggagcccaatccctagtttctagagagttgtattcattatcgcgtcacctggcctccccacccctagcacacctctgtctcaacttcttcaagatctacctactcgaatgtagcaatgccttactcttagctaggtggccatgcaagagggggaatctcgtcgtcgaaggcatgagcttgggctcgctgtcggctgcgcgttagatttacagtggaggtgttgatcgaaaagaagggattcggtgagagaaaggaggatggaagaggggagaacatagtagaaaaagccggaccagccagcgaaccatccgaacgtctaggtcacgggtcgagcggttggaccgctaggtcaaccggttcaagtgcaggtgaaaaaccgttatttactccatatattcctttcaaacactatatatgtgttgctctattggctagcaaagtttgcgatctcccagagacccacgtttgagtcccatgcgcactagattgagtgctatttttgcctgttgggctgcaaattgctggtttgggccttgatttggcccatccttttgtgttagccgtttgggcatgccggtttttttcccctccggtctttttgcgtgaacatactggccacatcgttggttccagtttttccccgttgaaccgccggtccggtctggttttttgcacaggggggagaaggaagctaagcagtattgcaagagttgcggccctagatttggttgtggactcattgtcatctttgcctctgtcaacagttagtgccaccacctcctcgagctctgtcgtctctagctacctccaccgagtatcgtcttctcctcgagcttgtgtcctcccttagcactgtcttctcctcatgctttgctttaccaagtttaatctccaccgtctcacccgctatgttcggcgatcgagctttgcttccatattgcccccaccgagcgtgcaagagagtattagggggaggaggggcagagagcagggtgtgcggtggataggtgggtcctatatatagagagagagagatgcggaggaatgagagagatgataggtgggtcctatatgtttttaaacttttaatgttgattgggttgtcacgtttggtgccacatagcaatggtgatcaaataagcgcgataaaaaggttgaagctatcaaatatagaggtgttttttaaacaaagagaagagtagtgaatactttctccatcccaaagaaatatagttctatgttatttagcataaattaagatatggaagaaaaaacaactctagtgctcccaatattcatgtgtgtatgcttactggtgtactccctccgtcccaaaaaaaaaggcaaaccctgggtatccgtgtccaactttgactgtccgtcttatatgaaatttttttataattcgtatttttattgttgttagatgataaaacatgattaatattttatgcgtgatttgtctttttattttttttcataattttttaaaataagacggacggttaaacgttgggcacagaaaccagggtttgtttttttttttgacggagggagtacgtaattaagtgtcaagtgagtcattgtcgaatcgtaacaccctgccaaaaaaaacaatataaaaatttgaaatttgtgtcagtgctaaactcaagctagaaatatcaatattttttggtattaggcgtctgagcgaatgagacgcgtttaaaagctgcacccaccttcgagtctacctcccatataatttcccaccgcgacaattttgaggagacattaaagtattttgtattgcagttaatgaatctttccaaatgttacatatgacgttgttcggatgtttcaataagtattttattttgcttaatttgtcattttgatggtccaatcgttttctctcatatcagggtcctagaaatgtagtagtacacacaaagaaaatatctgcatacactagttcagtgaagcatcgatcgaattaatcctcgtctcgttctctgatttctccgtccgtctttcaaatcgccggtgccaattaatcacaccgccgcgcgtccactccataaccactctcagtttcaggtggtgaagcagaaagcgtagttctccctccgtcaaaaaaaatctcatatccagattcatccataatatatcgttctcattctcatgttcagatttatctttaggatttaattctttttcgacagagtaagtaagaaattgtgacgcgcccccacaataattaggaagaaaagaaaagaaagaaagctactgggtatagagcgagtgggctgtggttgccttgttccttgggcttgccggccgaccatgcaagcaagcagtagtgtactagtgcagcggcaggctcttggccttggcccaaacggcgatcagcatcagcaagctaggccttaatttagtcctacctctctaaccaacagagaattaacggcagcagcttataaggtggattgcctggagactacctaaaattgcaggttaatcactcatgttacagtgtagtgcattttcactagccattggtcactggctgcagcgtcgaccgctatccgccagcgaaaatattgcattttcattggctttggccgctggctgcagcgtcaaccattgaagaaaacttaaaatgtccgacaggaaaaaaatttttaatagtgacagcatcactaccaacattttaaacattttaagtagcatagatacgtatctagaaagtcctaacgttcatgaaacagttttcttgggttaagatcctagccagtttcttcatttcagattttagctttcttctttttcttgtagtctactacatcggtcccaaaaagaattaatctacgatagaatatgacctaggcaaagtaaaaaaaacggaccagagatcgacccgctggccgtcggttcaccgatcaaaccgccggtttttatttattaatagtatatttgatttgcattattttaaatatagaatcatcacaaattggtgaaaatatgcataaataaactagtatatatattattatatggtcacaacgtcaaaagaaataaatgtagtgtggtaacataataaattcataatgccatactactaggacaaattaaaaactggttcgattattaaaaaatcacaaccagttcaccggttctcataaaaactgcccgattcaccgttcttttacctattcgattgcaggggccgtctttttgttgaaccgagccgccaaggttgccggttccggttttttccgattcaaccgtcgatctggtccgttttttttactatgatcctaggacaaccaatccgggtgtcacatcctagttgattcattttggacggagtgagtacatttaatacatataagaatttaatttgaaacatggtattggcaaccattttctgtatcttcgttaatttgctaatcaataaagatccatctttttttcctcgagagaaaaaaaaagatgaaatcgctatctgtccagttggtaatcacctgtaacaaaatttatatcacgcttccagatggccaccctataatatagcgtctggtacttctacaatatatatcaacggcctcccaaaatatatagctcgtttaataatccatgtctaaaattacaatcttggccactataaagacccgactattatacgctgaa

SEQ ID NO: 68602 - DNA, 4140 bp, Oryza sativa
caatgactcgatgtcatcatgttaattatcatcgcagttgagttacaaacctttcaccatgttaattatcatcattgtaagtcgcaggcacgtctgctgtgctgccgtgcgtggtggcaaaacaccttcaaattaaaactgaacacgagagagattatcttctaaattggctttcatatttttaagaataggatcgttctattaaatggcacattctccagactcttaaaacagtactctctctgtttaaaaaaaaattaaactagaaatagatggaactatctagaacaacgaatcaggtcagtcgatccgtttctaagttattttttctgagacggagggagtacgtgtgattaagtaaaaaacttaattttatatatgaatttcttatcaaactgttttaaatccattataaattttataatactctctccgtttcataatgtaagactttctagcattatccacattcatataaatattaatgaatctaaatatatatgtctgtatataaaaatccaaatcctacgcatgcttatgtctggaaacagagagagtatatatatttttgtttactagttttgtgccttacgtattaatcttgtttcattgttttctgcttttcgtgatagatagtaatttttaatctattgttatatggtaattagaccataagttttacatgacatgtagctaaagatgaatgtataaacacccacgaatgtgtcgtcccaacaaacactgaatggacaaaggctgaggatattagttgcatgtttgtgtacaatttgtatgaacaaatcaatattcatttactagtggaacatcatgtgcgtaaaatatggataccaaaatttaatcccttgaggtaaaaccatacacctcaaacaaaactctagtttaagctcgaaggtctcttggccggatagaaatgtgaaaaacaaaattgcaatcctgattaagagtactcttcaccgctctagtacttcttaagccgaagcgctgttctggttttacatttcagatgacgagaagaagacctcccatttaaaggacctgcagtcacttggccccttgaagatctttcgtgtcgacttgaacgaagaaggaagcttcgatgaggccatcaccggctgcgtcttcgtcttcctcgtcgctgcaccggtggtcgtcgactcagaaaatcttgaggtaattgaatattgatcgattcattacacaaaattaacatagatattagttttaacttaacttccagtaacaccactattttgttgctaacggttgatagtcaaatttagtagaaagctaaatttgggctaagttcagaaagctatgaaagccttcccgcaggggctggtctgactgagcacctagctgtctgactgacccttaggaacaggtctgaccgatggcgcgccctactgttatttgaccgaagaaatttggctgatctaaccagcaatcctaagtctaagttaattttgattccatattatgcttctttgcttgggaccggggtttgtttttattatagtcgtaatatacctctaaacctaatagaaatgaagagactttgtttcatgctaataaactatcaatcgatcatgaactgttcttttcctttaccctttacctaggagtagtttaataacataaatattcattagttcgcatggtaagacgtccatgctcgttccgagtgtgaaacccacggtaggtttttatatatatcgtcgccaagatcagaagctacatcgttgtttgatcataaagaggtgtcagcaccaactctgcatatatatatttcctgcatgctgcattttcttaattaagttttttttattattttttccatcaggaggacattactgaaaccaacgtccgaggcactttgaacgtgatggggtcctgcgtgagagcgagggcgacggtgaagcgcgtggtcctgacatcgtcggtcgccgccgtgctccacgacggcaggacgacgatgcaaggcggcgacgatgggcatgtggtggtggacgagtcgtcatggtccgacctcgactacctcgctaccctgcccaaccacccatctgcaaattgggtatgtatgcatatactttctcgtctctgaatattttacgctgttgactttttaaaacatatttaaccgttcatcttatttaaaaaatttaagtaattattaattcttttcatattgtttgattcattgttaaatataattttatgtatatatatagttttacatatttcacaaaagtttttaaataagatgaacggttaaacatgtttaaaaaaagtcaacggcatcaaatatgtagggacggagggagtatatcggaaaatttatgccgctcctctatttgttttgatcgatggaagtatgatttatgatttgatatgtaccaactaagggctcatttgaaacaaaggattctcggagaaattcaatcctatggataccccctaaggataaccatacttactttttgaatttgtagtttcaaccgaaaataattatattgatttgcagaaaaatcttgtaccgtattggaatgtggaattgaactgatgatctatgtgaaaaatcagtctctctttctctcttggctgaagtgctgcatggggaggtaattgcgtgcatatatgctttgtttgagatacaggctaaggcgtacgggccaggaaaggtgcggtcggagaaggaggcaagcagggtggcgcgggagaacggcatcagcctcgtcaccgtgctccccgtcatcgtcgtcggcaccgcgccggcgaccagggggttcaactccagctccctcgtcctcagcttgctcgccggtgagcgctcgcgcgctcgatcgatcgccggccgccgtgtcgtctcgtccatggcttttgcaattctcacctgtgactgtgaaaggtaattcggttcattgatcaggccatgaggcgacgacggagatgctgaaggccacccaggatctcgccggcggcacgacgccgctggtccacctccgcgacgtctgccgcgcgcaggtgttcctcgccgagaagggcgaggcggcggcggcggcgggaggaagatacctctgctgcggcgccaacaccaccgtggcgcggctcgccggcttcctcgccgggaagttcccgcagtacaatgtgaaaaccgatgggtacgtgccttagctttctccatcccaaaatataaaaaaaatagttaaacggaacacattacttgacagtttttaaattgatttggggcatgggttgtaattaaatgtttgtttctgtgtataaatttatctaccacttatagaatcatcaagacaaaaggacacgtttatgactaattttttgttaataatactgctaacataaatatttttgttactataatactttctccgtattttaatgtatgacgtcgttgactttttaaccaacgtttgaccactcgtcttattcaaaattttatgtaaatataaaaatagttatgtcatgcttaaagaacatttgatgataaatcaagtcataataaaataaattataattatataattttttaaataagacaaaaggtcaaacgtttgtcaaaaaaaatcaatggcgtcatacattaaaatacggaatataatttttttttggataatgagctttctttaattcggtctttatatctacgaatgatattcacggctacgtgagcgtacgtagtatatgaacaaaactttttgtacgaacatttagtcgtaaacaagacaaaacgtttacgacaatacatgttttgatgatgaagaatacattagtcgtaaaaaatacacgtttacgacaaaaacgtatgtcttgatttaataagctgctaaaaatacacgtttacgacacatatactgctaacaaaacgttttctatgacacaatatacgtatgaaaaaaaattgttcataattatcttttagtttgttttaattttctacagattatcatagcgtagtatattactctctgcgtctcataaaaaatcaaactagcattggatgtggcatatcccagtaatacgaatttaaacataggtatatcatttcctagtacaagtatatgccacgttcggtactatgttggttttttatgagatgga

SEQ ID NO: 68603 - DNA, 14599 bp, Oryza sativa
agtcagttgatgctcatcaaccaaccagaacgtttctgcatgataagtcattttacccttctaaaactttagtttgagataactctggcatgaagtccaatcactctacttaaacataaaagggatccttttaaatgaagaggtcttcataacaataaaaaaattgaaggccatctaaattgatagaagctggccggccgttgaaaaatcaggcccaaaggcagatcaccatccgtgtgatctcccccagtgatgtatacccacctcgtttttgacataatacaacacaactttcctcccagatacacaatgcatggaacatgtacagtgacgacgaaatacaaaagaattacagtgaccaccactaacctatctatcctctgaacaaatctgaacagtatggtgccgcaactcaaacctgtatgaagtagaaaaaaagatccaaagaagctgtggaggcataaaccaacactgactaaagatgaaccgccatggactttcagttggtcttgtataaacgtcctgttctcacaatggcgggggggcaaccgtgaaggataaatcatgtggccgcaaagcaccttgaactatgtcttgcacagttttgttccttctacaaacttctgagatttctgcaaatctatctgttatggaaccaagactagatcctgatgatgcatcagatataatattcaagaatcttgaacgttctgaatctgtcaaggcttgtggtggtataagggtaatacattcccttgcccaactcaacatgttcccaccaaatgatctgctaagggacaccagaacatacgagacctgcaaaattccaagtagaagatgaaaattcatcctcgcatcaaacataaggtggagtcaggatctagatttctagcatttcctgtaacattttaaagggaagacggtttcttaaggcctttcttgggaagatctctattttacaagcacaatcaaaattcttacaaatcagtgaattaacaaaactgtcaaatactgttcgtacaatcaaaagcaagaacctggagaagacaattggaactaaaaaaaaggcaggctatgagtacgaacagtttgtgccaatttagccaacacctgttgcttcaggccatagtaggtgcgtgggacacaaacaaggtcttgaaaagctttggaaaatgcagttggaagcatttgaacaaatagcacttccagtcactctattcataaaaaggactgaactgatcgcacagagctgtaggggatggaataataggctaggcagagctcattgaacagtgattgaattcaagaacacatccatacaaatacaataaagtgtaaaccatcggaatatatttcaacatctagttcaagtgttgaccacaatttgagcatatatagtgaggtgacatcagctgtttgataagagatgccacctagtattttttttcattattcctgttttatggatgcaatatgcatcttgtgcacctaaatttcaaattacacacaaaattgcttcctacaatcttgtcaacacagcttgaaacgaggatacaacagcagatttgccctcaaacatcccacattgtagttcaatgttattaaaaaatagcatcagtttattaaaaataatcggtgaaaacagtggtaagtgggaattctccaatgatttaacttttatttgggatgccagtagattatcatgacatggatgttttgtagtattccagagcatttgagatgaaatattatgggataatagttggaaaaacaatttacctaaatttagtctgattgtcaagcagaacagtagacattaaataacgttttcatgtcaatgaagatgagcagagagtaatccaacagaaaattgaaccttaacgcaacagactatgaaatcctcaaaaaggaacttgatgattctgaagaccaaattaggtagcgctcttttccgcttatccaccaaattattgccgcaaattatttgctccatgcttattaaaatatggtttctaaaaaaaaactttattttactgtattgcttagagcactcgttctaagctatttgttaggtttttaatatataatatttaatttatctgtcagttttcatccgcatttcatcactttagaacagtgagaatttggattatttttccccaaaaaaagggataaaagaacatgttttccaaggctttttaaaagtgaatgcttcattcttcttatcaattattattttaattggtgacacagaactctaatattgggtttgttagttcatatttttttcaagcatgaaatttcagtaagcagcacaataagaaataggaaacaccatataacacacaatcatattgtgtacctcttccaagcgactagatggcagagctcctgttaaggaagcaaccattattctagtaagtactgcaccccgctgaagtataactgtatttattaattctcggtacttttccccctcaggtgattttgcaagatcaaatacatcagatagaaaagataatatagacttgcatgcctccctgttacataacacaagaaaaagaaagacaataaattagccatcacaaaaccgcattaaagaattgagcacagaatataaagctcatgtatagtgcatttctctctgacgagtcaggtagactattcgaggcactacctgtgctgtatagttataccaaccattgcacagtcaaccaatcttggaaacatctctgtaggtacaaataaatctggacagtaacgaatacatcttgatgctagcaggaagcaatcatcagctatatccggtctagctgtaaaatcctgcaaacatagataacgcaattcagtaattacttgtcatgttgttgatcataatttgaatatttgaatttcccagattaaaaaaagaagaagaagagaacagaacctgaatagtccgaaggagctgtattgtatggccaaaaagtgcctgaatcagacttgcaagatagtttgcacatgctggatcggacccaaatatctaataaaaaatattgtcagaaaatcaaagatacaacaaaaaatgcattgataagatctttcaacatatataaccttaataacttcactcgacaagtaaaggaagcaagcctgattgtgttgctgatacagagtttggatttcttcaagcattgcaccaatggtgaatcccatgaacctcccgcatgtccttaccttcatcaccagagcaaaaactcattattgatttattatggaagtttaatcattcataattgcacgatgctcaactgataccaacagacagacactccctctgtattttaatgtatgacactattgactttttgaccaacgtttgaccattcgttttattcaatttttttgtgaaaatatgaaaatatttatgttatgcttaaagaacatttgatgataaatcaagtcataataaaataaataataattacataaattttttgaataagacgaatggtcaaacgttggacgaaaagtcaacggcgtcaaacattaaaatatggaggtagtaataatttataaggcatttaggcaactaacatgggcactctctattatagtgaagtacagagtggaggaaaaatacttaacatgaaatttagcatttgctacttttggaaagtgtgcgcgcactgctgtcgaactaatcctagaatttagccaaaccacccttatgcacttgtgacagtatttgtattccatcagagtgtacattgtattaaaaaaaacttccagacctaaataaaataaaatggtaaactcacagcaaatttgcaagaacgacatagtgactccatggtccgtgtatcccatgcccgtctgcagaagtagcaatacaacagaaacggatgaaacatttcctgaatataataccaaaagtaacttccccatatctgttttgttgaaatactcactgatcaaaaatacttttcaatgttggccaatatctattgacagcgtcagcaactacttgtggaagtttcacattgctgcaaaaaatcagagaatttagtaaataaagaacaaatttctgtggaaaaatatataagtgggagataaccacctaaaaatgcatgataatcggtctatatgcaaggttaattgccgaacaggaacttgctgaagcactgtatctccttgctggattatttcctattatatcggtatatactatattagcattgataaaaatcgaaatcatcaaatgactgtaaaagatcaatactaacctgcaagggattaattactggttggcagattaactccaatgctctttgagcatggtctggtgggagagtcgtgataaccacactgatgagtgcaagaacatgtaaggtgagattttgaacaaaaccaaaacaaaggtagcaacaaatgactaaagcactggtgggaacaaacgaaccttaaggcttcaaccaaatgcaatgagtcctctgaagaaactttgtaaccaccaactccacttaatgcaatttggtaaatctggaaaaggccatccaacgaaccagagaactttctcctacagtctgtcatagacaaggagacaatttaggtacagagttagttgtaacaaggcaattttatgttaagattcaaccagcaaggaaatagacgaatatctcatggacactacagtacatcacaactacaaatgttaaactacaaggactaacaaggccacacaaaccatttcagttacaggaaatagctcaagaatatcaaaattttgaaaaaaaatatatgaacacaaataacagagattctgttaaggtatgggaatactcaagtcataccttcacatatatacttgaatgccacagaagcagctgcagctgtttcctctgatgtactcatacccttgttgagaatatcaaccagaggtggtagtatcaacagttcagatggtgcggcttcaatccattttgaaaatgctccaacgagtgaacaaactgcagtttcaagtacatttgagctccaatcatcgtcataactcataacaaggctagggaagaaccaattggcatttcagaccgcaaacttcaatagaataactaccatccacaacaaagggaaaacatatgaagacacaaacgaatctgaaactattgggaaacataatatttggtttagggcaagtacaacaatgccaaaataaaattatcataaatcctggtatctaggaacaaacagccctaacttgtcagaactctaaatctcaaccagtgtcaatgagctactgtcttacagtgaaacctgaatcccagtcacagtataaaattcaaagcagtgagctgcaaacaaggacttatgagttatgaactttcaattaaactgaaacatacctgtttgcagcaactgttcttgatgaggaaagctgggaagcagtgacatgaccttcaaataacagcaacacatttcatgaccagcatccagtataaagctatggtggtaaatttacgcactaagcacagtagaaagtaaccacacagcgatcttaaccatcagttaaatagcaaatgatgcataagtaaaaacattaaaatacacccaaaatgatatacatacctgtggtagtatttcattctcttcaactgagactgacttagcaatggcttgtatacagaacagcgcagcctcgacaggctgccatttttggttctgtccatttccacatgcctgagatataaaagtccaatcttttattatagattactaaatataaatcttttacaggattaggaagccaggaaagtaatagtcaagtatcagatatagcagaggttaaaagccatagcaaaaaagcaagctgagacaccacactacaacaaaacctgttagctgagtatgcagtgacgcgacaccataatgcatggcaaatttgttgaattatttcagttattgaattattggctacaaactagtgtagcttaattagcacatgaccatatattagaaggccataaaagatcccaacggactcgttaaccaatgaaagactcacagcagacaagctgatctctccctccctccaaccaacgttctcctggcttccccccgtccattgtttgtatggttaggcagcaaccatgacgacagcaaccaagtgccacatcgtataatcaacagtaatgcaatgaatatagagactgtttggtaaccatgttaaaagaatcaccacgccatggacacaacaacagcatcaacctttagtcccaagcaagatggtggttaagatgagaccctagtcagaccacacaaaccaaatgggaaaggaactaaaataaatagaagtaggactagcgctagcacatggattgctagaaaggaactaaggtgtgtaattatgcataagataagaagccagcaaatggatggacaaaacttgtgatggtaacaatttaaagcacctagttcaataagatttgcataagtaactgaagtcccacaagatattcatcatgcataactgaaaatttagactaacaggatgaagtacacatccatgtcatttgcattgttcagagctttaggagtctgaaatgagattttctgcaattagtgtgttcaaacaaaagaacttttttgaaaaaaaaagtaggtaattattaaatagaaggaagatgtagaagtataggaaaaatttgcacgaagaatttgcataatttattcatcaattaacttagatcccaggtttcctccagaatatccgcaaacgaacacatgcaaactctgacaaacaacattgaatcactaagcacatttctcaaaaagagattctcatgccaggatttcagaacagttaaacatgcctaaacaaccagtaactaaaattccacattttgtgaggaaggttattttggaaccgtagataaatttaaagcaagaacaggtcaaaagctaagttcacctgaatcagcttcgtgaaaagtattttcagcgtcggatcacctccaagaacatcagttgcgtcaagtaatacatcactaaccgctgaagaaaaatggatccaattacttgacaagttgtatgaaaaggccaacattgcaagagcaactgggttaaaagaaacactgtaccataccatatctggaatgtctgaaatccctttggtcttcctccgaaaaggtgtggtagagctcaggatattcaactcggaaacttacctgattcagttagcatgacaagtttatttttacacgacacatcatacagaggacagttatactaataaacctcaccctctcaaaaacataccagagaaacaagaatttcaaaaggttgacgaaatagctgcaatcttctattcctctcagtgttgattgagacctcagatccatatgatgcgtacgaacccctaagatgtgtaagcattgaatgggttgtttcttgtgaaaaacaagttatcatttagtaaagtggtacctatcggtcaggttacgcataagatgatgccagaaattaaatgtcatggaggaaatgtcaaattctgaatgagaagtaacttccagtaatgcattcactatctgcatggcatcatcagaacctgtagaaagataaaaaaataaacacaataccctcatacttaaatgatcacaataaactttgttcaaacatgaatctcaggatatacaacagtaagcatcatccatgaagctttacctgctgcaatcaactcaacataagaatcacccatgtctgccaacaaacgggcaatagcttttacatcttcttcatcctagtaatgtagaaatgaattactatagacagtaaagtaatgaaaaatatatttatcacattctcatggcacaaaaagttaaaaggaacaatataatgatacaaagggcaacaaaaaattgtgaaagtgatacataggaaataaaactttctcaaaaaaatcaacataaagtctactacgagcaaatttgataggtccaactagccaactagggaaatgccaaacataatattatacattgttcaatgtcgtttcagaaaacttttgaatttgtgtcccataatactaagtgacatttcaaagagaaaacaaaagaaagatgaagttcaatcacaagtgaaatcaaatatatgtggcaacaatcaactagtgtagcgtgtgtttcaaaatttagattctccttaaactcattgggttatttgaaaggctcagcaccctcattagttcgcaacttttaattgttatctaaatcaaattatatggccagaggataatgagcacaaacaggtgacaaatgtcaccataattatcgcaaagtttctgctttgcacaaattcgaaggttcattttaaaagatggtttgttgtgggttgcttggaataaaaaatcaacaaaaccattataggataaaagaataatttaggtaacatgaaggcaacaaaaataatcactattgaatcctgtaaatcaaaatagagttattcacattttactgctttgctaatgtattgtatcacccaaaccattgaaatatatgaacaagagaagtttcgcaaatagagaaatcagatgttcatgtaaaattggtaggaaatttcaaaccttcgatgaatctttgagttgctccttaagacccataacataaggaatgagaacttgaatcagtggaagctgttcggtgatgccattagattctcgagataccgtaaaatgtatcaattcggaagtaactgtcagtttaaataaaatgaattagtgagcttccaacaaaaacatgggtgtaaaaacagttatcttgaacgtaactacctgcgaccaattacagtgagtatagaataccagaggtcctttaaactagcttaattgattcaataagccatcctttttcagcttcttagcttataagcccaaaatttcatttcaatataagtgatgagcttaaaaaattgcttggaagaagtttgacaccataaggataacagttcaaagatttctaccactagaaagcatatttctaccactagaaagcaacgacaaggttacattacctaaccatgctcagctttcatctgatctctaatagaactctatgaatcaaatcatttagaaaacaccaaattaactatgcctaccgttgccgataggatgctttattgaagataaacagcagcacagtagcatgccaacccagatcttggcagcaacgacgtatgtcagtagcaacagagtatgagctctggattgatgacagccaatgcagaagccacaaacttgacgacaggaagcaaaagcagtgaagacacacttgccactttaaatcctgaattcttcaatgcgccgtgagatatcacagcgagagagagagaggaggacgcacagggcatggaaggcctaatggagaaactgaaagagctggattttcggcagatcgcttttccaaaagaagatagcttcagcttcagaatctgacttaaagctggaaaagatccatcttttgaccaagcttgttgatcattgaaattagcacagaagccacagctcaagctctatctattacatacacactcagttgttcttcgcaacctccatgatgagcagtgctagacgagggtggggtagatccacaaatctatccttaatgagtgcgcagaggtggcattgcagatcataaaggacaagaagagggcggtgctaaagcagtccgcaaggttgtgctctgcaacagcatgcgatgacaaggagaacatggaccctcaggccagtatggcagccccccgtatggattggtgctgcatcaaagacagtgcacatcaaaccccaactgtcaccacctccctccaaacaacattactgccacctatagctgggttgacacttatgtcaccgccattggcctcatcgccatagcgcctaagcatgcactaacaccaacccatttacactaccctctagaagtctgcaccaggatttgatctttttattagaccttgttcagaactacattgaaattttggaaactcttgttgaagcctaataaagcctctcgcattgtctatggtcaacacctggaaactgcactttgtttttatagaacctattgaagcatgaaacatgaacactaacatgtcaaaacctgaaatctggtacgctttttgtactgtgctgtgaaagctccctttttatgagttataccagagttaattgctggttaacatccaaatgtgagtatacaatattccttattcctgaacttaaactatctacgaatttgacatcagaattgtcaagaattacacaacatcactgcaaattggcctgcatagactcaattctgcagcaagtgaacagaaacaaaatctaaaaatgttactgagatcaacataactatcgtaacaataatgtactaaaaactgatcaattgaaaagaacatgaagagaaagtgatgataaactaacggatgatgggtaagtaaaatacaatgaaattttgatcatatacactcagtaccatttacagctgcctccaaaaattggtcagagttcaacgaagaaagtgccgtatagaccaaaggaagcgaagcaagattagatgcggagattctggcagaaagaataactcagtaaattcctgaggccaatactgccatgaagcagatgtttaatatttactaagaatagaaaatgttcaatgtactacaaaagctacattataaaggaatagagtgctattagattaaagtccaataagcatacccatgacaaaaacgaagccaagaagcaaaaccctccagaacctgaaaaggaacaatcaggttagctacagataaacctcacataaattgatttatgtttacagattgcagattttatgcatttttgggttgagatcaagcatattaaagcatgcctgaatgtgatattgctgtctggaaaggctgaatgtttctcaccatctaagtatattaaagtggaatatgaaattgacatgaaacataaaatagcaccattctcatataccaagataatgagaatagcacattataaaccagccctccagtcaaacctttctattagcctaggatgtcatctgtcataatataaccaatgaaatgtggtaatagatgcttcacaggagatgagttatgaataactttgcagtgaataaactgcctgttatctctgaagagatcctaacatgcaagcttaaaatatttatcctaacatgcaaacttaaaatattttctttgccacttaagctcctaaggtgccaatgaaaaacaatcttgaagagaaggaaattgacctgttctttcagttgatcaatacccaagcaagcagtcaatagactaagtgcaacttcggctgatgaacgaaggtcattctcaaactgtcggcgcctttcaggacgagctgctattttatgactagaacattcctgaaaggacatcattgaagaaaaatgaagaatatgctatagaaatctgagtagctggcagtgtcctaaaaattggctctaggaaccaggtagccgcagcaatttggcatttgatggtgcattatgcagctgctctgcattgggggatctagttttgcaatataaatggtgaacagtctttcttttatgtcatatatgctcgctaactgcttcaaagtccctagccaagttggtcctgggacctaggtgcgccttggcggcagcaactagacgctcctaccgttaggcaccggcctcactgaccctctaatgtctagcgcctacttgaaccatggtagctggtgtacataactctaaattcaagcatgatcatatatgcacatggcaaaattacaagcataatagtacttatgtgatttaaaatagatatctggctacaggttcataatatttagaaaatatgtcaaaagtcattaatgtgattcatcaaaagtctaacttattattcagaaatagcatcaatcagcatgtacaatctactattactaaaatatctctcttttttttggaaatggcaaaaggacaataaaaaaatgaattgttttacttcaactcattttcttttactcaagacaataaccacaaaaatggtactactttggtgcttcctgtgcacaaaatataatagcacacattttacaaggcattgagatcatatttcagctttctttaacgcaaatccttcagtgtcagaaggattcatggtacttctatatgagttaaccaaactacaggacagacttgaagtaaaactgttcactcctatataggattataaagataggatgaactcagcgacatggaaacaatagggtatatgataggagtccatatgaggctagacatgtatgtacctgtggcaaaacagttagcagctcaaggaagcttgggataaagtcttgttgagagttcatttcatcacttagccaattcacaatcccaccacctccccagtcctctacaggtacatgcaccgcaagagcagccattgcaatgcaaatctgaagatggcacaaaaggtagtttgccattataactgtgaaatacaaaattgattgcttaattacaagctatatactcaaataaatgtggtcttagaatgtgtgcaatcaaactttgatatatttttttttgctactaatatacacgaccgtattaagatttttttgctactaatatttttttttgctactaatatgattatatttttagtatgctgtgagtatataattacaaaaggtataagtcaaaattgtgtactggtgattgtatcaatatcctaaatgacaagtacaaaggaatggaggtagtatagattacctgtgttctaactttttgtggccctttactaaattttttcagcaatgcctgcagatacatcacagttaaatgaaacaaaacaagatcttcacaagattatccaaatcttactagtaaaggtaaacaaatccatcactgaacatgacatgacataactttgaaaaattggttttattttattttgagcaagtgaaataacgcctattatcaaacagaaatggcagccaaatagaagactgattctacttgatacaacatttagttgaactgattataatatgctaataagaaaagaaaaacaagaacttcaaaaactggtgcttacatatagagaatcttgtagcggacggaaagcttctgaaggtaattcttcaaagtccctttgtacctggtattgggataatttaaaagataacaggaagaattagaccaatttcagagttttttaaataattagaagagaagcagtgatacatatcaatttatttaccttgcttctgagggtttgagagcagaagatttgagtctccatattactactttcatcatgaagtaagctgtcagctacctgcaaattaaaaatagaaaaatatatttggatgtcatcaagttaactagcatccataaatttactaaaagaacagcatccgcaaacacaaacaagatgtcactgtaacagggggaaacagggatctgccaaacactgaagagaagagagttttaaaggggggcctctaaatttactaggagtacacagttacgcactacacctacagtaaaacagttaaataaggaatatgataaaatttaataacacaaaattaaaaaggtgagtgggagcataaaaattctaaggaattctcttcgagtcacaaatatacacatccatgcgccgaaaatctatatgctgatttcatcatcctccatgtttcacttcggcagccagtccataagcttgtgtagccacattggtaagccacacatcatagcacaacccaatggtgagaactgagaacgaacctaagtttgcatcaaacactagcaagctttaactcatccaacttgcataaaagtccacgatgctgaactcgatttcccagcaaatatgccacgatctacgctcagtatccaaaataaaatctagtttgaaaggtacttcatgattcaacatactaataaagctgctgattaagctctaaccctaagttcaccagactgttaatgcatcaaccgtagcctcaaacgtaggaaccaaatacaatgtgcaatcagtcacctaaccagcggaacagaagtccgctccaacaaatatcagatcgcaatgccccctcccaccccccaacacacacacaacaagggccagagaacgccccctccacaacaaccccgctgcggaatcagcacgaccgcagccaaaatctcatcaggaccaacacaactaacgaaccccaaacaggtgcgagatcgagacgattcggctcgaggaaggggaagggggaaggggcccagacctgccacgcgtcgagcgtgtgctggaactgctgcagccaccggtcggcggcggtgcgcgtggcgtcgtcggggtggtggtacagcgccgccagcgccttcttcaccggcgacgtggcctgcgcctccatatgtcccccccacacgcgcggcgcggggagccccttcttccacacccacacacactagcaccaccaccagaaccctaccctcgccgccgccgccgatgcgatctccggcgagttcgctggatctgccggcgggtgggggtgggggtgggg

SEQ ID NO: 68604 - DNA, 6643 bp, Oryza sativa
ttgtttaagttttctttttgttttttattagtactccgaattaaaatctggttttatttttggcttttgcgggagattggggcagtggagcttccctgggcgtgagctggggtgtctctgtgcacgtgggcccgaatgatcaaatattaggagattattaagtccccggtttttcttaattaacgtagtacatttcttttaatgatgtgtttcttgtaaaacgtttttaaatataaaagttgctttgaatataaaatagatctatttttaagtatgtaataactaaatactataaaattaattatgggctaatggttgaatacgctaactttatttttattttgatctatctaaaacaccacctaaaagagctaccgtgggttgggctgttgaagttaaaatgccgtaaggtttgtaattgctctttttctctaaagagaaaaaattaacagatcaagtggataaaaaggatactctttacaatcatgacttggtctagcaatgattcggtggcaatcaatcatctagcaccttgattgatttatcatctgctcgatggcacacaacataacaaacatatctctttttaaaagacagattaagtcgttaacatcttttctcataggttcatagcatgtgatccatccgttttatattataagttgttttaatttttaagtcaaatttattaatagtttgactatgtttaataaaaatataacaataattatagcatcaaattaacggtagcgctaaaatattagttcgagcaccgcacaacgctttcttcttctgcttttctcttgtttaccacaccaccattcatctgcatctcacctttcctccgtccgtttttcttttcttttttaccacctcaccttccgtgtttattttttctcttttccatatgcttttctccctttttaccacaccaccattcctccgcatcacaccttccctccgtccgtttttcttttctttttttaccacatcacctcgtgtttattttttctattttccatcttatccatgcttcatcaaaaggcccggtaaaatattaaccatctagatttttccccttctcattccttctctccagtttctgttttttgcattttagtaccgtctagtttttctttccgagtttttgtattttagtatcttcccgcgtttcaaaagtaacgaatttactatgtggagttttccatttactcccagctttccacatctactcattcaaaagtaacaaatttactcgcataaatgctcccttcaaaagtaacaaatttacttgcatgaatgcccccatatcgtactgcataattcctaaatggtcgtaaaggaattactaccagcttataacgctactaattcttttactagtgttatgaatattgttcagactttgtgatctgcgagtaaaacaattaccaccttcctctcgatatagcccacgatattgtagccaccgtgtagtaatatgtttactgtttactgatatgttcaatacacaatataagagtaaaaattgatactaagagtattgttaatctgtattataaaatggtcatacgaatgaaaaaaaatgcaggctcaatcacacacgagtgataaaattactcacaagtgaatcaaactagaaaagaaaaaaaatgattcagccaaaaatccatcgtgaagttgggatcctggtggctttgttggatcttgctataaggatggagaggttggtctgtgtcttgtgactggtgctgaagagggcaaccgggtgattagcagtaatcgacgatggaatcatggaaggatgtagcggcgtggtatagaggtgagctcgacgttgcatggtagcagccatccatcatatagtaagcacgaagaaaatgcaaaaacattatcgttcgtgtcatagagacgacgagcgaaagaaaaatagcaaacaacttccatcatcgacggactccacactatcctctgcggacagccacatgaagcatgatgtgcaaatgtaggacctgtgcagcccatcaattcagatcaggtaatattggagattgcacgttaatttggtttgcaaaaataaattggggcttcatgcgtgaaggtgaatgagagtatgcatgtaacattgaacatatgagatgaatgtggaataaggcatgattgtgcaccataagtttatctttgactctttgcggatcagggtcacatatgagatgatgattatgggctgatttggtttgaagctaaaacttgccatacaaatattggcatttttaatagtaattctagtaatatttggcttgctaccaatacttgcaaacaccacgtagatattgtcaaaaaatattggcattggcaaaaacttacctatgttttggtattatcaatattttggtatgcttgcaaaccaaacaaaagccttaatgtcatccttggctatcatccacccccttacaagaacggatcgaaatcacaaatcaatgcacaattatcaagatatgctacaaaggccttgtttagaaccaccggcaaattttttttccctgtcacatcgaacgtttgaacatatgtacggagtattaaatattgataaaaaaaactaattacatagtttgcgtgtaaattgcgagacgaatcatttaagcctaattgcgacatgatctgacaatgtggtgctacagtaaacatttgctaatgatggattaattaagcttaataaattcgtctagcagtttacatgcggattatgcaatttattttattattagtctatgtttaatacttcaaatgtgtgtccgtatatataatgtgacacaccaaaactttacacacatatctaaccacccccataaatacaatgactgccaggtaaattctttctttctttagaacttttcacctcgaggacctcaactccttcctcatcaccaattgtgttttgtctcctcagtgtgccctaagccatcatctaaagagtgaaaaatgttgttccaatcaaaataaaaggaccattcccgcccatttgaaaaggctagttattttcaaaagccaaaatggacagattaaatctccatttagggctcctgtggaatgcgtaataagaaaaattaatttagaaattcagaggaatatgaaggaatgcacatgtaaaacaaataatttcaaaatataggaagtttggaacacaaaatttggctaactaattatattagtagtcaatatgtgctcaacttaaagtcatttggtgttatatgacacaatttgcttggacttagcgaaggaaagaaaaaagatgtcaagatggatgttcaaattgtgttcaaattcttgtatagttgaagacgaagaaaatatcctctgtttttcctacatacaaaacgaaggaagaatgccgatcttttccccaaatgatttgaaatatatcctacaatccaaatgaggccttagggcatccacaatgtggtgtaaaaatagtctgcaagcaatagaatattccattcagccacctattaccactgtgcaactagtccatatagaaaatatagcaaaagatacccatatgcatatggactacccatatgcatatagagtacccatatggaataaattatattatctatctctacttttctctcttctcctaatgataccttgtatccatatacattatggagattgccatagggataaactatttatgtgggtcccatcttcttagaggatccaatgtcctgcaaatttctttcaaatggaaagaaaggaaaattcagcgtcttggaaattttgctttcctctattttttccatacctaagagctactttgaaatacaggattacaaaatgtagggatagacagaattacaatactccaatatggtaggcatgtaaaatagaggattaaaaacatagaaattctatgtaaacagctatttgtatgaggtcaaggaaaattataggtccactgctacaaagctttgcttatattttttaatcaaacaactttattagtcaatgactgtgcgacttatttccatagtgttgtcattatatgcttgattggctccttcttcatccaggaaagtaacataagttcagactgaatgggtttgtttcccgtacgtttcctatggaatcgccggaggaggaaaaaaaatcatttgtactgcatgtgaccaaattttcaatccaattaaagttacagcaatctaatccatttttctaaacagataatctggtctttactttatcaaaaagctacaatcattcattacaatgttcttaacttaaatatagccaaacgcaaatataaaactacagtgatccaatccataagaacaaaattccttctttttcctacaatcggaaggaggcctagaaggctaggggtgggcgttcggtcagaccgaaaaatttggtcttggttttcggtcatttcggttttggaaactcatgaccgaatttcgtaaaaaaaaactcaggaccagtaaattcggtctcggtctcggtttgactgaatttgacaagtagcaaagactctatgcaagcaacaatgggaaagtggagacgaaggtttggagagtggagacagaggcggcagcggtgcgatggaggcggcggcggcggcggcgtgatggatgggttggattggaggcagcgctggttagggcggcgtgaggttgacttactccctccctgctgccctctagggtttggtatttttactgagcttgttaggcctcctaggtctattggatcacaattcggtcttctcggttaattcggttaactgaaactaatgaccgaattgctcgaaaattttttggtctgttgatggctgaggccgaactactaaccgagtttctcggtcttattttgtccacccctgtagaaggctagaaagctgcactcattttttactagcaaaatgtccatgcttgatgctttgcttatggtataaaataatgcacacacttatttaaatatatatatatatatattatttacttgtttcaaatacatatttaaatattatataatattagaaaatatcaaggactttgtaagacgtgtaaatttggtggggggttggtggagaaacaatatttaaacttgaaatgagaaaattcaccacctagctggaatagctcagccggttagagcgtgtggctgttaaccacaaggtcggaggttcaagccctccttctagcgttatttttattgggccaatagaatttttgtttctggcccagttcagcctatttttattgggccaatagaatttttgtttctggcccagttcatagaatttttgtttctggtccagttcaagccctctttctcgcgtttttattgggccaatagaatttttgtttctggcccagttcaagccctccttctcgcgtaatatttattgggcctcttacctctattgggctaggtttattgggcctcttacctctactggcccaacatagcccactttttattttctggtccaacatatttttcgtttatttttgtttctggcccaacatattgggcctcttacctctatgagcccaacctagcccatatttttattttcaaggccggccttaagtccattctattttgccacatattaggtcttctacctttttcttggctaattcctactacgtatctttctttagtccaaaaatattttcttcttatcaggcctagtccaatctgttttttgaaggccggtcctaatgcatgcgctcccgaagtccgatgaaattacacaaacacaactttttttcccctggagaatatctgttccatgcaactacacaagttcaacaatctgtcatccaatttgctctcttctgtaacatctatatatactgagtttgataattattctattctatatgattggactacttacattttaaaattcctcttattaacttgaaaagaaatggttgacagctaatttgccccactgtagatttataaaatttataaaattctttgcgtggttttattgcaaattaaacagatggaaatctatgtatcagagacaagacatcctttaactttcttgtgcagcatatgaaagagaagtaacttacattaaagagcaaaaatattttgggtagcatatgaaagaagatttataagtataaacaaaaactagataaaaaatatgtacagcatatcatttaaaaatattcccaattttattgaaagaaaatacattttttttgggtgaaatgaaagaggaatcatttacacaaaataaaatggcacaaacaaaataatttacgttaaactgcagaaatatatcatgtatatcatataattggtaataccatattaaaaaaaatgtgaaaatcaacccaaacatctattttgtgcaagggggctttgaatgttactctttttttctttaataaaggcagtttgggtatttcctaaaaagccatctggtccaatggtacagagtgaaaaatgactcacaaactcatggtctagtatataaggaggaaattcgcaagtcattgaacaaagtgaactcagtggcagaaaatatattctctcttcctgaagagcttggctcaatcagatttaaatattattcccatcattacattttttaaagtacaagaatatcaaa

SEQ ID NO: 68605 - DNA, 7151 bp, Oryza sativa
ctccttaagtagtttatatatggctcacctacttatgggtatttacacaattttttcatatcactaccactcgatctaattgccctattaatttacttcacctttatttatttatacacttctatcacaaactaccataccttttactaaagcctacatattttctgaatttaactgaactctaacacatgcaaatcattaatattaatccattgtactacttctgctagaagtagagctcgtccctgtacacgcagttgctaccaccttggcgccatgctggttccatctctatgatctctcccatgccatgctcctcaaaccccatcccaagtgccatcgtggcatcgttgttgccaccctggcatgttccaaagtgggcccccaccgccatgtcgtcaccagttggccgatgttctaggaagctgtattgcagcatcgtcaggttaagcagtgcgctgctactaccggagttgtcgttgttgctgcagtggacaccgctaccactgatcatttggtccccaccaccttgcatgagtaccattaatggtggcaccgccgctgaccggtggtcgaacctgtccaccactgtcggatcgggcgatgagccaaggagaggtgccatcgtcgtcggcgaggaggggtcagtagagccatcggtggcaccgggaatgaaaaggtcgctgccactgcttccgccaccctcggcttctattgtcgatggcttcttcttgtcaaacaccctacatagcacccaatcctcctgcttgacacaaaagaatacatagaccatgattaattattatgtgaatctgagcacaccaaattaagtagtagtgcttagctattgaaaaatatttctacgagaaaggtaatatagagctaaggcacacaccttaggttgggagttaggtgtttcaaggcggaactcatgcatgacccatgtcgtcttttgcccattaggggcacggccgaggtaaaaaaccagcgtcttcctcatcccgaccaccgctcgtgttgtaccctcatggacaatccggtccttccccgtggccttccagtaacctgtcttggtcgcacggttcgtccgtgaccctgtcgcatatttccggtctctgaagctgaagaagtaccactcctctgcagtgagcttagccacctctgaaaaaagttaacaaaataaaaactaattaagctctcatatgcatccaatcatcagctaattaataaccatttagtgctatgttacacccttcattaaagcatcaaagttaataataatatacattagagatactaattaactgttgtatctgtacctacactgtagagctaggtacgtgagatcatgagagagggattggatacgcttgcacgtgaagtgttacagcggtcactgttactggcaaacagtgacgtttttataattctctgagtggccctagctagctagaagtggacatataaacaggtcgttattggtctctagcttgcgagacttggagtcttgtgacttgtgagctagctagccaaggaaccatcacgaaattattgccgctaattttatgattgcttgcaagctataatagctagctgatgatcatctcgtgcacattctgtatctatctatctacacctatagctatatgcttgtgctccaaggaaccccaaatgattaactaattatcaaacaattatcaaggcaccaacactgtatctctcttgtgtacagtgaaatttcgcacccgatctcaattcattgtaaaaaaaaaaatacaatacttctgactatgtgtctggacaaagtaggtttgtagggtaaggttaccgggaagctcccatggctcgcgggcgtgaaggtcgacgtcgacgagggtgccggaggcgacgcggtggttggcgaccttgttgcggaggtagaagcagatgagctcctcgtcgctggggcagaatctgaaccccggcggcagcgtcgactccatctccctcagcccggccatcgatctcttcgatctcaaccccaacaaaatcaactaatcaaactcactaatgatcactcgatcttttactctcctagctaaagctagctaagtaacaatagcttggagaagacgagacgcagctagctagagatatagctaaatatgatctcttcttcttcttgggaggcgaagcaatggaggggcttatatagaggggagagggggctagctagcacgggggtttgttaattagttagataattaagattttgggatgatttgggggtgaggggatagaattagattgaaatggtctctgtcgaggacgacgacggcgtcgccatctggcccaaaagatgctcgcctgatgagctgagctgagctagctatatcatatcgatgatcagctgagctatcacgcttgtgggatttgtcagaggctgctgctgctgctgctggtggctagcttagcttgagcttagctgcacgcacaggcccactcctcacaagggatcgatcgatcgatctaattatatacattgcgtttatctgctaggaaaaatagagagaaatgtcccgggatcttccggctaactccacaaggtaacgggctagccggtctgggtttgaagtctcacccattatatttatttgatattagatcattttctaatattcgtgttttttctaggaaaaataaatgtctaaattatttctgcaaccagcagagatcataatatatatgccttttccctaataataataataaatatgctttagtttctcttttcatgcaccaaaaacaagacataccacgttaattgtttttaattcttagatggttaattgtttttttattcttagatggttaatttatgacacaaactggctatttcctttccatttttcctctcacgaatctctaggcagataattttaattttctatatggtctatgataaccaaccaaattaaggtccaattaaatttttcataaaccacatcatttaatttcaattatttctaatcttttggccaactgatcgaagtttgcacattgtgcaaaataattaaagtaagttacgtcatctaacaacacaagctccatcttatacacacctactaccattactatatttcagcattaacccacggggtattactaatataattacgtagcgatcaaaacatactattatccaaacctgctaaatgtaagcgggaaactaatagattttgtctatagcaatatatatattcgatttcgaggacggacgctagctataaatgaagggagaagagactagaaagtgacgagacttcaggagacgtggaagcttgtcacaccaaatgatgattaaaaccaaatccgatatatatatgtacatacgtatgtgtgtatactttctcaaattttagggtcgttacgtgtgtgacaatgttacatggcacgtgaggactttgtcacgggccgggcaaattttgggagaagctataacggcctgtttagttggcaatttttttttatcttgcatgttacatcggatatacggacacacgtttaaagtattaaacatagtctaataacaaaataaattatagatttcgccagtaaactgcgggacgaatttattaagcctaattaattggttattagcaaatgtttactgtagcaccacattgtcaaatcatggtgcaactaggcttaaaagattcgtctcacaatttcgaggcgaactgtgtaattggtttttttagctacatttaatactctatgtatgtgtccaaatattcgatgtgatatcgtgaaaaaaattgtttgggaactaaacatgccctaagtgatgagcagtttaccaattagcatatagaaagaagactaaaaccccacatctccgtcgtcttctgccaagtgtgtaaatatgcctgaccatatatgctagatagcttcacccttgataccttcttccttgcatgctggctggtcaccttaatttgtgctcgatcccctggtggcactacatgtagtccctccgttccagaataatatagtaacaacttttcgtgaccattctaaaatataaaaactctcaccgatatctcatttttttttaaaaaaatcgggctgtttgagatctcactggggaagcaatcaaccattagtgatatgaaggttgatctctaagttcacaaactatgaaccaatacattcacatcactgcaactatttatacgaaccgtgagcttgagacaacaatttcttatatatagtacagtatatattatgtgaaagcaatataaaataaatatttttatacactaaacatacttatatagtttgatgaacgtggtcaaaatctacgtgaacttgaaattttaaaaagctagctacataagtaaaaaaaaagagatttaatatcatattttttttcttggagcatgtcctaattcatcaatacatgatcatgagcggagacaggagtaggatagttatggcaggagccctacatactcagcttaaatacccattgaaaaattacaattcaaaacttattttaaaaaatataggctaaattattgaaattacaatagtccatggacaaattcgatctggttccgcctctaagcacatgttagctgttttaaattaatgcgaaaacatacgaagacacaattgagctttgcatatgctccttaataatcctcatgcccctatagtactactgtctgcattgccaattgacagtcatgcttacatacctggctagctttgttcaatataaagaagttttgctagctgcaaaactatacttaacctaacctagctaactcaataacttaatttgttctatgttgtctatatatatatgccctagtttttctattttttggatggttaattatagcttctttcaaacaacaaacaacaaaatcttactcacgtgacaatgatattgccataacagctgactagctagttcccattaagcaacacacaaaacactatagcaaacttccacatgatctcaggttgttggactcttgtcagctttggtacgatttttaagcttctaagcgacacggctatgcaaaacaaaacacgaaaaaaagaaggaagaaactaattaaaaacgtctcacaaactaagatcatcttaattaatcaacaattagctagaatcacacacacatatttatatatattgcacatacgaatacacactacacacacaaacataagaagccaatagtacgtgtgctcgataatcacgagacatgcatatatgcagtgctccagtagttaacaacacgtcgcgattgcgattagcaataaagagggtgattaggacgggattaattagaaaagggaaggggaatctcgtcgatcagattgcgctctacgtctgtccaaatccatgcccatcaggcaaaggtcctgtgtcgatcgatcaagcagctagctgctgcctagctgatcgatcgatcgattttttagcgcgttaattaattgcaatttcttctccttaattactctggatggcgacattgcaagagattagctaatgctacactcagctagctgttaatgcaattgattagtagctcttgcaaatgcatgctgctgttggatttatgtgtggttaatatcgtaatcgtgtgtgtgttcctgtcaagtgcatccatggattaccattaaattaaggggcactttggaacatacatgaaaactacatactctcatgcgttattaatttggcaggaattatatatgcatacggtttcgtgcgtacgtagctttatttgaaccaatattttacttctccaggattttttggagtccattacttaaatataagcatgtatatatatatatatatatatatatatatatatatatactgtatattcgagttgtactgtatttatatgtcgaatttgctatatatttgttgataaattttcctccaaaaatttgtcaaatgtaattacaatacaatcgtagtgtaattacactgtaactataatgtaacttgtatgtaacttttaagaatctctcggtaacatgttatttcagtaaaatagaggtcgtgggaacaaatcctttcatatatgtgtgtgctgtgatttttttcctcaccagaacaaatcttgtaatagatctaacgattcaaaattacgtgaaacttacgtacaagttacactgtagttacatgcaagttacagtgtaattacatacaagttatagtgtaattacactacgattgtactataattatatctgttaaatttttagtagaaaatttatcgataaatatataggtggtctctttatatgtatactcccttttccttacccagaaactagacacgtgaatgcgctagatgctccctcctcttattccatgcattgcgtctatttgtgcatgtttgccatgagactctggagaaggtgcgtgtgaggtgactctgttagggtgagtttgaatttaccatttcatctattgtttttcacgtgcatgttttctaaattagtaaactatatttttttgcaaaaaaatccatagaaaagttactttcatattattattttttaatttttagctaatatttgattaatcatgtgttaattcatcgtgctccagtttgcatgcatggaggattaattagtttccaatccacaataacgaacacaaccctaataaccctactaattagtgcttggagcagatcattgaattcattttggtgcttgtatgtacaattaataccggtgtaacagagtcagtagggggtttcttgtagtgacctcactgtcaatacccaaatttagcttctaaagtaagaaataggtaaccatagataaatttggaatgaacttagatttgtcacgcaaggccagtctgatcgaaaccattgggccggtcaaaccggtgtcatgtggctggtcagaccggtggtgttcgactccaagtccgatttgtcggttctcgggtttccttgttaaagcttaagattttaaagtcttaattggtttctacacctaattagacgtgaaaaaaacctaggaaataagtttacccttcctataaatataatggggctaaggccgactgaaaaaaacaatcaatcatcaaaattaacttatttagccaaaccctctatattctac

SEQ ID NO: 68606 - DNA, 1228 bp, Oryza sativa
agcgtagctgaaaattacatgcatcgacgatggtcttatcctgtccaatgatcacacgacaagtatagcagaagtactgtgttgtgcatcttcaagcaatttgcatgcactactgtgtgtgtgtgtgtgtgatcgagttgatggaactatagcaaggcttatggtgtagttattttaatctagtgcagtattaggcatgcattgatttatgttttatctcattaccacacctagctaggctacaatggtgcattttggcttatatacagggagatggattggaattttgttcctcaaaggatttcacttctttctttatatatcatataaatagtcatattttttttaaaaaaatcacaagataaattaatatgcgatatttcacttcataaacatgaccttgataaaacactaacgagtatacatacattcacaattatatttattattttttttaaaacttgtagaagtccagtttgaatttgtatatttatgaagtgatgtatcacagtataatctatactgttatttttttagttttattcataactagttaaatatgacatgcaagaatcaagggaaaaaacacttaactatattgagagattggaacgttggtggttgctggcaggcaaacccccattttactcatcatgacaccctactttgaatatagcactatactagagtctccatattgaacatagaaaatatgcacaaacacacattcttccttacacaaattaaggaattgaagtgagactagcaactattcttccacacacgcaagggcggatccagcgtgaggatctagccctagccccctacatgctggatctccatggagagcaaggagagatgggagggggatgtagaaggcaatgaggcctccccaacgtcaagctatatcttccttgcccacacggtaccttcctcgtgctatttttggttgcgcatttctttccaatgccgataggtccctttcgtctatactagtaggggtgtctgtgagttgcaacgtgaaataaagtagggattaattgatttcacatcacatagggtgaaatgatgttaagtaatgattaagtataaatttattgtaacgaaaattttaacatatcacaaacgataattatgtcacattttttacagttttatatattggtaacatgagcaacggaaattgttgaataaaatggcacagtattttcctaaaaaaatagcacgg

SEQ ID NO: 68607 - DNA, 2257 bp, Oryza sativa
gctcccgctccccccccccttccgctccaatggcgaaggaaccgatgcgcgtgctcgtcaccggcgccgcaggtacggacggcgtcgcgctcgcctcacttccccctcgttctcttggtttgccgacgcgatctcgtgcggggggcggtggctcggatctggctgcagatccgcgccgatccagtggagggtttcgagtgtggtggttgtagatagctagatctcgttgtgtggcggttgatctggttggggggggggtgcggattatttagtgggagaaggtcactggcgtgatttgatttcggtactaagttttgtggttcgtggattggatgagctcatctgatggtgggttgtattagatctggttattatggtcgcttgatctggttttcgggggactgattttgcttagtttgtgatagttgactcgagtttgtgttaagtctgtgcatgaggttttagtgggggtttagtggagatccatgtgtatttcttttgatctgtaggggtttgagtggtttgaaatggatcatggtgtcgatttgatgagtgggagtgtgggtttccatagttagaggtgggaggttagtcttataggttaaaagggtttagaagggtttacctattaatctgttaatcaaatgatccgatgggagctagtcacagttgtgagcttggttctcaaagacatacactgataacttgagatgtttgtcttgaaacatgcatttaatttagtttagctctggagggtgtgtcccttcaatttggccccacaaaactgtttgggatcgggtttgtattccgtcaagttctggcatgtcttatcccagctcaggattcaactgcaaaaattatcatgcatccatatagtgatagtgactttgatccaaaattccgtcgtagattctccatctgggatttggcaggatatcttggcatttaaacatttaaatctaaataattaaattgcattgcacatgcttaataagtgggattagcaccaaattgtagggtactaataaggaaaaggctatgcatactaactttttcttactaaattcttattactaacactgatatgtcatgctatgagtgcgtctaaattttttataacttccatctactaaaatcaaatggttgagatgattgttagtaaaagtttagtaagaaaaatttagtatgtgtagcagtgctcgtgctaaaaattgatctacacaagttggggttcttaaaccaagatataaatggtttttgtttatccatctcattctaatctcttgtctagtgtgatccatagttagaattgctaaattgctataaatattttctttcaacagctgaaaactatcactgtcttgttaacttaaactagtttgccttcattgttatgaaagcttcatttttctgatgtatgcttatgccagatgggaacctagctggcaattaattgaattagttagttcaatctgatgtggtgtgcacttcacaaacacttttgtaatgtggtctgaggtcctcttgtacgtggaaaggggtgctttgttctccacttaggagctcgggcattggaaatgtaactgattgttggttagtacactctgaatcccactcttagccaggttggatcaggtgaagccctgaggaggggccactagctttcttttgggtgctttcacgaatgatgataataggtgatatggtaatcagcatgaaaacaaatgtatttttttatgctcatctggaaatgtagcagtatttgaaagctgatggtttgcacttcatatggaatgcaataccattgttgcttgtgtgtcttaagaaatttgcacccaggggctttcttttgtgagctaattcattcttttattccgcaggacaaattggatatgctcttgtccccatgattgctaggggtgtgatgttgggtgctgaccagcctgttattctacacatgcttgacattccaccagctactgaatctcttaatggccttaagatggagctggttgatgctgcatttcctcttttgaagggtaagctggttcattgaactcaatttgtttttaaactgtcagcatccttgctgatgtttaaacttttctgttttggtgttgtaggaattgtcgcaacaactgatgttgtggaggcctgcactggtgtgaatgttgcggttatggttggtgggttccccaggaaggagggaatggaaaggaaggatgttatgtcaaaaaatgtctccatctacaaatcc

SEQ ID NO: 68608 - DNA, 1231 bp, Oryza sativa
caagtccttgtcattgcaaatatcttcagtatccctgctgatggcaacttgctcaggatcattgttgagttcttgaccaagatcgattacaaaactaccagacagaccatcttcttggaaatagtggacaacattgctattaggaacagaattgtaatcttgatcattgggtacttgtagtctaccaattggctgcaccttatacacaacccaccaattagtgaggtcttgcacagatttacatgggtacggcatgtaatacacctgtgtcgcttgatgagacaaaacaaatggttcgaattttggaaggattgacgcatgagcaacctcaaccagaccatatcttggtgtatacctcactttgcttgggtcaaaccaatggcaattgaagagcacaagtgtgagaggttttctgccatcaaagctgatttctactatttctttgatgtaaccataatactcagttgtgtcactattttctccctgtcctatagtcaccaaaccactattattgtagttgcatttggcctctcatgttcatatttgtgtgttcggaatcgatacccattcacatcatacatattatattgcaagactcgagtgtggcatcctttagctacttgtctcaaatcatcactcatagtttcgtctaacatactctagcagtgaaatgaaaggaaataatgtgtcaataaattgtggcataatgttctattatggcaatattgaaggttatgttatagaaaaacataagtattattaggttattgacacaaatgcaattaacaggtgttaaactgcaaactaatgaaaacaaaaagaaaatggaagaaggcactattgattattaaggtatcgaatttcaaaactgaagttatcaagttattaattggctaggttctttttgttagtagaaattggcaatgattttattctgtccagatttccgacctaacagatgatcaattgagaagtgtctccatattaatgacatgtacatacatgttcagtactattttcataatgcttgtaaaaaaattaactcggattgtactatgaaaaaggcagatgcatactagcaacttgcattaatccaaatgtgctttactattgtaggtccaaagaagtcacctaatttagagttttagcagtaatactttattggtttgatggggattacataggttgcaggaacattcatgaaagaactaatgttctacagtttgaaaag

SEQ ID NO: 68609 - DNA, 2073 bp, Oryza sativa
ttcgtccttttttctcaacaaatctgtatttggtgtggaattctaaactaaatatatttgcctttgataaaccaaaattttgaactaaatttcgaactgaactatttacgtgtggattgcaaactgaaattttgtactaaatttcgtttggtcccaatacaatgtgaaatagctaaaaaaaatactcactacgttttatattactcgtcttgacttttttgttggtcaatttttttaaactagcaaaatgaacatgctttcatctaaattccatgattttcgcttccactcatattctaaagaagaggaacggacgtagtcgggaatgtgaacgtcgccattgtttcatgtcaaaaatgccttgccgtcggccgccgacggccgactgccctccgcgcgcagcagccggcggcggcggagcagtcggtgaacaccatccggttcctcgccgtggacgccgtggacgcaagctctgccctcgccgcgcaacccatctccctcgccgcggcaccccgtccacctgtctgacgcccgtcacgtcctcgccttcaccacccggcgcaccgtaaggaccgcgtcacgcaggacgacccgtgtgacaatgagaaaaacatgaggtgattaaaaaaagtagttaagttttgaataagattataaaaaacatagcaacatttttttttacataaaaccaacatattatcaaacaaatttgtttttgtagatgtagctaaatttttctacaaacttattcaacacctaaaaaattttgactacaaaatagtcaaagcgagatataatatgaatcggagggagtgcatgttattaaaattagttaacaattcctttgattctgttatgatttgtagaacttttgaactaaattttgattgatccttgcattaagtgcctttgctaaacaaaaactatttcctttttaacttcgttaagaattaaactttggtttgttgtatataataagaatttatttcttcaattaatttaatcaaatttattcaaatttataattttgattaaaagtgttgttcagaggtctatctcagaatttatttgcgtacatttcaagagaaaactttcgtttatctttaatttttctaaaagctatctaaatattcaaacctgtttttcttaggaaatgttcagctttatgtcttaaaatgtttttaaacaatgaacatttctaactttcaactaaaaaagatatcagcttgttgtcatgctgttgagattgggactcctatttaaaaaaatttcgtatggcattaatttgaaagcattcataatatataaacatcgttgagtgataatttggttgacaatgaacaaacacaattagtttgttactaatttgtgcgacccttccataagttgccagacattcactccaaaatatgaaataatatcagtcatcagttttgctgaacgcgtgagttatatctggacagtggccactgccacaccacataagttccaagttgataagttccactgaatgccaacatttccaaccaaaagtaccaaacttccagttcacaaactccagagcacagtaacatctatgaccaaaagtacctaaggcaacatgcacaccgaaatagctactagagtccgaatatggactcaggttcatgcaaccccttaggaaagtaaatgtatataactaagaacaaaagactaaaggcaacagccacaaccaacagctactcaggttcatggccatgaccatctaggtcagtttaattacaaaacacatccacatgttccaggcatgtagaactagtccattctttccagcagtagcaaagtcataattatcttcagattgcgctcgctgcgtcaagctgaaccatctaaattgcaccagaaacaatagcaacccctccatggtcagcacagaatgagtttccattcagagccgaagatacggacaaagcctgttttatgttacaaacaaaatggttaatattagtcctcataagttatatggggaacaattacttcatgcacacctgcactaccatgtatcaaatacttactgggttagtcaacatgaca

SEQ ID NO: 68610 - DNA, 3757 bp, Oryza sativa
taaagctgcaactacaaaaatttagcttgtttgacattaaaaagtgtggtataaaaatcttttagtattgtacagtacaatttggccgtaaactatgaaaactgaagcccaataaaatgcatagtgacctccatattggagaaggtaatgctctaaacaaacccaagaaattttcctcaacacgatgaagacggcttggcaagcgattcagtacagcgctttctggatcgtcgggtgcaatcctgtaatgtttccaactccatgctggctcatctcttcctttaaacttgacaatgccagggaaaaaatgcttaataagcacggtcaggatgccagtggggacccgaatgttgcccccaaaatcattagcttgccattgcctgtgcaaatcaatgaacaaatagatcaagccttcatatttcgactaatgaaacataccaaaattaccctatttacctatctctttttggagtcagcacaggtttgtcctcatctcgggtaggtcgcggtggcatccgtgtgggaccacgaaaaaacatttcctcgtctgtttcttcgtcagccaatatctcatccaaatcagaagaattatcaggttattgggaacctgaggaccttgttctacatctcggcaaggtagcagcgctcacagcctgatctgaaggattggaatcctccctgcagcccaagctcaatcgccgcatattgctacaaaattaagatatgcagtattatattaaacaggtcaaaaactacatagtcgcaacatggtataataatgcctattataaaatgttgatacaaagatgtagtacaccatagcattgcagatcatcacacaacatggtgctgtcattccaacccgattcaaccattcaacaacgatctaaacaagtagggctgtggcaaacactcacactcaccattatgtcttctgaaaagagggcaagtttttcctaaccaatatgtatccatcaacaagtacacaaatatgaaaacacattattttgactgtgcaaggactctcacccacatcattttgtagtctaatattgtttttatttacaaagcacaacaacttattcatatggtacttgtggtattacaagaaattaaaatgagatacagttcctagaaatcatacaccgaactatttctagatcctgggagaaaatggatgggttttctagaaccaagacccaactttacatacgattcaagaaaaaactcaacatatacataccaccagctggatggaagatgaggtgtgctcaagctgtacaacgaaggggagcctagcagatggacgtggacatgcaaggagcgcgtacggccagaaatgcacagcgttgctcggtggccgtgcggcggactgacgctggggtgcacagctatcctaccatgtgcgaataagagaggggaaaaatcagaaaggggaaaagtggcgaggagaatgaagcggcagggggtggggaagtgaggggatcgattaaaagggctaggggtttggtggtctctattttgggctgacatgtgggccttcggctgtaactcgcgcgggattctcctgttactcgcgcggcaacgaaaatcaggcgcgccagccggccgcgccaacggaaatcttggcgcgccatccgcctgcgccaacggcgatcccgcgcgccagaccaattattccgcgcacgtaacggcagaaactgtgggtcccacgctttaccgtgtttctcaattcgtcacacggcatttttagccacttcccgagtttttccttgttcacacacggtatactttaaatgttatcgtgttccatataacactctcggtaaccaactgaggtacacggtagtctcccactctctggtagtgttagccgggggttattcattggcagctcagttttccgtcatttatgataatttgcacgctatggagtagagccaaaaaatgtgcaagcgcttaatattatatatatatatatatatatatatatatatatatatatatatatatatatatatatatatatatataacaagttcttatgtaaattttaaactgttgaatagttccatattgactagcttttggtctaagaaaaaacgggccctaatttatataggcttggctttgcccctgcgctacatgattttatcatattacaccaatattatgagtatataacttttttgggtgataaaattggaattaagacccttagcagttggataaatccacgcatgtcatacgctggccattacacaaaaaaatatattctaaatacacatgaaaattactgtttggatttatacctttgttctaaataaatacttacttgacataaacaagattcatgttgatctgagtaagaaatcaattaaaccgaaaaaagagcatgcgtatgccttgtatgtaatcgaataaataaataatgaaattgaatgaacaagcagacgatgattagctgcatgctaattaggcagttctttacactaccatacgactaataattaataattaaggtagcaaataaacacgaggagactacgacatgaacaaacttaatttatttcccaatcaataatcaatcagcctagccacccggcctatctatccattcttctccatcagctaacctcgccaatcatgtacagtacatacaattgatatactagtaatttacacccgttacatttgcgtcttctgaaaccccaatcagggggcatgcaagtacacaatgatgcagatatactcctacttattggcttggagtatacatcaatcaatcaattatatatatactccctccgtactcgtaaaagaaatcgtttagaacaatgtttaaatcaaaccttgaaaatataaatcttgaataactctaaagttattgagtttgaaaatgtaaaaattatatgaatagatttatcttaaaaaatacttttatttttttatgtaagaaaaaaaaagaaaaatactttcataaaagtatacatatatcacttttcaataaatatttttatagaaataataaatcagagttgtgttttggaaaccgtgtcactgtcgaaaacgacttcctttacgagtacagatggagtatataattatagttcattgattaattattgtcgattggtcacggcagtgagaggcagatagcagcttagcttagctgcattatcttgagacagagtaccgcgcaaaatgccaggagacacctttcagaaagggcaccactgcctgcagcaagtcagcaatgcacagctagctatagcggcagccatgaccgcgagcgagtgagagagagctcgccgtcgacggcctagctaggctctcgccgtccgtcgtctctcgcgtcgccatggccacaggggatcaataattttgtgggcacacggccggagaggcgacggcgatggcgacggtgaggtctgattttggcacggcgtttcgtcggtgggggcagagtgtggtggagtgtgctgttgtgtgtggtacagcaggcgagatgccaacggatgatcagcttattatagcctccagctagcgacccatgggttgtgtatgtacttgctccatctcataatataaatgcactataaaatttctcatccgattctatggtgctatattatgggacggaaggagtaggtgccaaacagctagctagatgtctaggtgcgatcaaataatccttcgttctaaaataagttcatttttcacctattttatgcagtggcgaatccagggtgtaaat

SEQ ID NO: 68611 - DNA, 4322 bp, Oryza sativa
cccaatactttctctatctgtaaatatattattatgtatactgaggcagcctgcatccttgccatccgtaaatttctttactaatgactaattagacttgctaatgatcaattaggtggggctggcgcaccagccagccccaacggtggatccgccactgattttatgcatatcaataaaaaatcaaatagattaaaatactcccactttatcaaatttcaatgcaattattctctactttatctactcctaatgcatttatcctctacttacaaactctggtgcaatgattcttgaaaaataaacttattttagaacaaacggaaggaacgaaaaaacttagtcttagacagagggagtatataatagtggcttattccattatatacaacatattttttataggcttactcatctatgtagttcttttaatcttttatatgatataggtccaacacctaggtaccaggcactggatcttattgaataccgtatggtaacaagtatgacacattataggaagcaggtctgaaacctatggttactagattgctaggtctggtacttatcggtatcaagtttagtatccagtatcatatctcatttgatactggtgtttgaatctcctcaagatgaagattaagtatttcacgtaaaatgaggtgataataacgtgtgattaattgagttttaattattacaaacttgaaaatggattaatctaatattttagaacaactttcatatataaagtttttacacgaaacacaccgtttagtaatttgaaaagcgtgccacgagtatccaaattttaatccactcctttaagaagaaacgaacgggacctcgatatattatgggtaccagatctaatacgtatgagtataacactatattacctgttcatacaaaacagaagcaaatttgatcaccaatatgcacgcatggagtaggcatcatcaaaaagttacacaaagtaccatgtttgattatattccatccacctatcgaaagctaaagacataaaagctaaaacatggagcaatctttaaggcagggcctagctgcagccctatggtgcagtccagcaaggcttctagcaaaccttgctagcatggtcgtggctacctcgtcgaagaagcgctgacgcacaaaggaaagtgtcgacgagtgatactcggagaccgaatgattagagtattagggtacgttggaatgagaatctacgtatacgacatcaagcagacaaaagataaggattatactgattcgggccccttaccaggtaatagccctactccagtttatatgagattgatgacggaaaaccacatattacaatggaagtaagcagaatcgacaataccaacaagatcgtaatcgatatattcgacgagatccctcggcgacttggctcgacgaactccagcttcataaactatggtgggtgtgttgatgatgaaattctatgcctttcacccctccctgggggtcccttttataccgtggaccatcttgatctccaagtaagactcggagacatcggatcttgtacgatataacagaaactctatcccctccgagcaggattttggaaatcacttgaatcgtagagatatttttcataatttgtgacagattcccacggcgtacataggaacaatctgtgtacgtgaaggtatcccatatccgtatattccataagtcgaagaataggaggtatgtcttatccgtaaccatgacagaaagggtgttgaccttggcatgatgtgagcacaagatgtgaacacgcgacacaagaatgcatggctgtatcgttccatgtcgttgaccggatgatattccctagctagcattctcgtaagtttatttgcttgaagggttcaaaacgatagtgtaggactgccacctgctctggctcaaataccttcggcccatcctctaggccttatactccatcgttcgttcactacgagttgtagatgttgtagcctattgaagaacacatcaaggtactatcatatccctcgataaaggtgacaaaattatattcagaaatgtggatgccgcaagacaaactagggttctaagttagtatactgctaggagataaagtagtagtcatgttttcttatctcattcacaagccaacaaggcaaatatatagtcttacattgattgatatctggtagggaaataaagcaaaagcaacttcaggttcagcgaggcaacaacattcagggaaaacgacaatgctagatagctacagttgtccccgcgatcgttctcggtcgttggatcaaccaaacctccatcctcagttgtgtgatgcacttaagtgaaatcggcgaaatgttttcctcactgtcggcttctattcaaaagaaaaactctgaagaactctgaactacttcaattaacaagcgaactgaatcttcaaacaacttttgattttcatttccatttctatcctgctaacttgacggtagtgcttcatctaattgcatcttctatattggaaccaaaatacaatcttgtggccatgtgttgatctataccaatccacagaatccacgtatgtctgccttttagaccatgcatccatgttgtatagcgcctatgaggcgtttactataaagactcatcttccggttaccactttgaactatgaccactgtttgtttctatttgtttgtcaagaactaatggcagtgtattgtgttgttataaagtagaactcaaggatttataccagattatgacctcttatccaagtagaattcggggatcccaaataggatatggactaacaaggccttatcattatcgaggcagactacacagtccattaggtggacaggattcgttccttgctatatttttacccatattttggaattaatatatttttgtataagaataagtatgaggtattcctagtgatagcaagtgcagatatacaggtacgtcatatctaactataacactgatagaatttattggtcataagtaaaattataccaaatcattggaattttacattactttgaatttttggcacataatatgtactacatgattttccccttttgagatagatattagctttgcgatgggttgcaaatggtggcaagagatatgcccactagctaccttatatcatccaatcgcactagctggtattgattggcgcgagagataagtttattaggggacatgaatgtaagttgtttactttattaagggatggtttgaagtttgtgcagatttatttttccgtttgcaaagtatgggtattatatatgtggttaatagtttttctataccatgttcttcagcgagttaatgtttgtggtaaattgaaggcttctatagatgatgccgtcattttaaaggcttctactgtgctacccattttgattaagcattttactacttctacttggtctgtacactattatataattaatgttctctaaaaaatagtccataataatacatgcaaaggatgggagctgagaactatgtttttttagatatattgaagtgtaatgagaatgaatctaaaaacaatatttttatagttacattaggaattagacaacatccccaaagtagtacgtgaaaaatataagatatagtaaaaggtttttctttaaagcttatctataaattcacattataccatacaatgttttgctataggatgaataattatgtgcaacatttgtggatgattttgcctattcaatttcacgatcaaattcaatatagttaattttgaaccacaacaataataataataataataatggtatatttagatatgtggttgtgcttctttaccgtgctatttttttaggaaaatactgtgccattttattcaacaatttccgttgctcatgttaccaatatataaaactgtaaaaaatgtgacataattatcgtttgtgatatgttaaaattttcgttacaataaatttatacttaatcattacttaacatcatttcaccctatgtgatgtgaaatcaattaatccctactttatttcacgttgcaactcacagacacccctactagtatagacgaaagggacctatcggcattggaaagaaatgcgcaaccaaaaatagcacgaggaaggtaccgtgtgggcaaggaagatatagcttgacgttggggaggcctcattgccttctacatccccctcccatctctccttgctctccatggagatccagcatgtagggggctagggctagatcctcacgctggatccgcccttgcgtgtgtggaagaatagtagctagtctcacttcca

SEQ ID NO: 68612 - DNA, 1620 bp, Oryza sativa
atatagcatatggctccatctactatggtctatcttgctagggctctagcaaagctagcttagctagcttccttaagatggctagctccaatgaggtgttttcaaacatgcgcatgctttgctctccatccaatccagtcgatcgatcgatcgatccaatcatggagctagacccatcaatcattgtgcccatttccctttctttgatgtgtccgttttgattcgatattggccatatcacctcttatagctataccttcgcggctggccagttcacccaaaagcttactcaactctgtcgtaccggagatcgacgcccgatcgtatgatttcacactccctgtgtctctgatgtatgtagatgacgatgaacagtgtcccatatcggtgtctcgtgttggtacacctaagcattgtagcgggagctagggtgctgacagggacggcgccgaggtccacgtcatgaggggtagcatttcttgtcaagaaagaacacgtatgtgcaagatggcaaatttttttctctcctattgcgtgcttgtttgggagcaaggagatagagagagagagagagagagagatgcatagctaaataatgagtggccgtttcttcctttgcagctaagctcttgtacaagtccacactcaatgtgtgttgggtgatcgaattaagtgggtgaaaatatatagtttatatgtcagtagtgatctacagagcagtgaatgacattgatttctagcttagctacagcttctctctactagagctagtctactatatcattaattgtgttgttatcgaagtttaagtcaacctagctagctagatcgagtaatatggacttcattcttcctttattaatataagagaaacttaggtttttaggctgcacgcacaacaaaatgttgcagtatattacaattttgatcaactatacatgtatctctaaaaatatttagcccaggcatagaaggatatgtttaattaaactatagttgatcaataaaattagtagtgaaattttagttttgaaatatcatccctatatatgtgtctcaaagtagcatcgagagcgagtatatatagattgtttcttggatatattttcgtaccaatttataatggaaatgtacaagaccatgcatatatgttccatcaacttaacttaactagtactattagtactattgtgtactactattgccttgtgagacagataatattcgtgcacattggagatttaggattctagctaattaatcgtttccaatacacacatttgagattgacgtaattcgcaatttcgtacacgtactaatgtatacatgcacatagacatagaaatagagtagctttctgcatggcgctgtagactggcctactgccttaaatgcgctcaatgaccctgcaacaaacatcaacctcagggagctcggtcattgtcccatccccacgatttaagcatgttatgttcggccagtctttaattaatttctccattcatatgcctccttggttgcaatgtactctcccctcgaaaaaaatccaaaattagatgtgatacattctaatacaatgaatttagatagagatatgttcaaattcatagtttctagtat

SEQ ID NO: 68613 - DNA, 75695 bp, Oryza sativa
  unsure (1)..(75695): unsure at all n locations
atggccctttgannattctctnnnnnnnnnnnnnnnnnnnnnnnnnntggccagtttcctatcacactccttatctgagtggccaattaaaccacatatgaagcagaagtgtggcactcgctcatatctcaaatcaaagtgccgaacgacctcattaccttgaacattgattttaatggctagctttgttttcaggggacgcttgacaggaagatccactcataagcgggaaaaaaaatcatgtttgttacgcccgtcatcctccacatccacttccttgacctggccaagtttgcttccatataaaattcctctttctttcgtcattagaaccagcggtaaatcatatatcctaactgttggcggctattaaatgcctattctatgtcgccagtacctgcataatacttggataatacaacatccaacatagtgataggatttaactctaacatattccacgagtgttagtgtatatttggatgcaagtaataaaccactgaagttgggagaaaatttagattaaagtgaagaataattctattcatatgagagttgggctcctaaactccatcaaaacagcaaaaaatgggcccaactactggagaaatggataaggaagagcgaggaggaggcccagactaaatctggggaccatctggcctagcccaggttggttcggtcgaaccctggtgaccgccgttggatccaggttttggtttagacacttcagacgctctcttgatggcggttgcggggtatttttgcaattcacatagttacaaccgtcataccggcttatttaaggagttcattctttcacttctcacacacactccaagcttgagttgaattataagaggctctattgtactttatgtatactagaattagggagagagtaaagtagaagaagtcgaaggaattctgaatttgtcagtaatcctcttctatttcttatactttattaattattctgctttaatagaaatatcattatgagtaattaagatttacttcgtgagaattattcttggttagttcctaattagcgcgtgggatcattgttcactatagtccattaatttatattgattgctttagtgtttagctagcgctaaagtagttattaattgcgtagacgcggtgtctgagtaattaacttccggtgattgcttcgtatcccacaataggcttgaggtgggtgtagaggtggtgacagccctcaattacaagtcctccctgtccgggtacgcagtagagtgacatctgggagtagcaggatggtcagtgcctgaagtatcgcgttaggattaaactgagttttccgtagacactgtttcttactagtaaatcctctctaccctttgcctacatttgcttcatgcccttggatgagcctgaagagctgaacacacatgttccctgatgaaattgataccttggaatactctcagatgaagtgctacattggtatcttccgtatgcttacggattttacctgtgatgttaagaaataccaatactaacctagatgggaactacctcaaggggaacctgtgacggactagtaattccatcaaactttgccaccataagagcatcttctctgtgcagccatgggcctccctgtacgatgaactggtagacaccctccactatgaaagtaacaatgaacaaattgtctctcagagacttaaacttatgtcagatttcagcctccacgcccgtggcatatcatcaaaaagagctgtctgattcggcgttttcagcgaataatatcattccaggattgaccattgtcctgcttgcttgacctcttcttcctctaaattcacctcaatcacgtcctcttcttcatagacttcgccttctgtaaatgctccaggtccctgcaaatagctatcttgctcttctctttgaaccgagctttgagaggatataaccagcttgcatttatccccctatctttgagaggatataaccaaagctaaagcagttggatcatccaccgccatcttatccccctacaacttgtggcacatcttggccatggcgtcgctcgacggcttcgggcaggcaaccttctcaacgatggtccctttatcgcccccaccgtcaaaagacgtcatggattggatcttgttgcctcgaggactaaaccctagaaaccaaagcagacctagcacctccatggatttcacgggttcaaccagtagcggcgtagtcccctcagctttatacgcttcaactaccgagtccgatttcttcatgatctcaaaccagaaataccatccacgatcatatttccaacgtttcccaatatgagatcccatatgtttgttataggacatttgcttatttgaccctatttcgaagcctaactaccaatttagccctatttttctagtttgcttatttgaccttgtttttcgaaaacaaacactccgtttgattctgtttctgccacaccgttaaatatccattaaaaaaaaagaaaagaaatataattacatttcgtaatgaccaaaataccctcgaaccctatccagacaaccctatccagtctctctctcttgtattcttccttctctctctcccggcgagtgacgcggtggcgctggctggtggagggagcaccgacggcggtagcggcgggccgtggagggaggggatccgcgccggcaccgactcgcggagggagggcggctgtgccggggcgtggatctacggtggtgacggctagtggagggaggaagcaccggcggcggtcgcggcgggccgtggagggaggggatccacgccggcggtggctcgcggggggagagcggatgtgccggggcgcagatctgcggcggcgacggctgggggagggagcgaccgccgggccatggaagacggggatccatgccggcggtggcttgcggggggagagcggctgcgccggtcgcaagtggaggtagtggcggcgcggccatcatcgttccagtgttcgatgtagtggccttccatggcgtcgaagctgttgacgatgaggccatggctgccggcagtggtctttcctagcttcgcatccatctccacgatctgcgtgagaaagacgtgcgggaactccagcacggggaacgccgccgcggcgccgcgcgcgccgtcagccaccaacacgacttgcgggaacatgtacacacttcgcaccaaagaacgccaccgtcgggaagatgtcaaattgtcttgttcacttcaatttgtgaaaaatctgtcaaattgtaattaaatttatcaaattgattcaaatttgtcaaattgaattcaaatccgtcaaacttgtattgaatgtgaaacatatgtcaaattaattacaaatttgtcaacagatctgaatatatacatgttctgacataataaaatagggccaaataagtaaggacaaaaaggactatttgctcctaacttaacaccgttaactcatcttaacggaatagggtcagatggtaggttcgttttcgaaaagcagggtcaaataagcaaactagaaaaagtagagttaaattagtagttaggcttcgaaacagggactgtgtttagttcacttcaaactttcaatttttccgtcacatcaaatgtttggacacatgcatggagcattaaatatggacgaaaaaaaccaattacacactttgcatgtaaattgcgagacgaatctttcgagcctaattacgccatgatttgataatgtggtgctacattaaacatttgctaatgacggattaattaggcttaatagatttgtctcgatgtttacaagcgaaatctgtaatttgtttgttatgattaatagattcgtctcgctgtttacaggcgaaatccgtaatttgttttatttttagtctacgtttaatatttcaaatgtttcaaatgtgtatccgtattaaatttttttttttgccaaaacaactaaacacggccagggtcaataagcaattgccctgcttgttatagataccatagtagattatctcatctggtatccttaccttatccgctaaagatttattggtatggcggctgtactgggaatcgaacccaagcagaagaccaaaacagaccttccaaactcgattttccaaccggatcacacccacgggtgaaatccctgaagcgtttttctgcaaatcggagtagaactccatctagatccatctctacacaagaaaaatggctgccgcctcctggtcgcccaggcgccgccaaaaccctagcattccgtaaaaaacggagcaaattataataacttttttttgggggaaattatattgtaacaaatatatgtataaagttatgttttaatttttagtatttatattaaagttataatttagttatagtataatctatctattattatatactaaaaatccattaaacttcctgcaaacgctctgaaaccgccacgtgacacccctacaaacgctcctataccgccacgtggctctctaataaattagaagaattataaaaaaagcaaaacatctaatcattggttttcatttaatctggtggacccattatttttaaccgttagatatagcataaaaatgtcaattagatttattatcttcagaaagccacacatggcacgtacgtgtacgtcaagtacgtacgtactccatccgtccaaaaaaaaaggcaaaccctggatttccgtgtccaacgtttgactgtccatcttatatgaaatttttttataattagtattttcattgttgttagatgataaaacatgattaatattttatgcatgacttgtcttgttaatttttttcatattttttttaaataagatgaacggtcaaaagttgtacacggaaactcagggtttgtctttttttttacggacgaagtacatattttgtacgtgagccccacaccttattttctatttttcttttgcacgaacacatgaaaaaaataaaattcatatttcagcccatatagttcggagtatgtacgttgcacatcagataaaaaccacattaaataattctaggcttccagcccatagttatacaaatataagttattttgagttgtattgtactctactcacgtcatcgaaatattcataaaatatctcaatatgtgaataatatacattatataattatctaattgtatatcacttaataatatgtattaataaattagaatttcattttcaaaaataaaaacaaatccagttatgagtaacattaaaaaaactccagttgtgagtatcattaaaaaaattactccctactataagaaaatactgttatatcagaataatattactaaattatcataattacaccctaccaatcaaatacctaataattaaaaaaattactaaaacatgataaaaaaaacacttgaaaaatattagtgcactaaccatctacactattcattaaaaaaaaggaaagttatttttttattaattatactattaataattttaatgttatgatttaataagtaataatattatttatttgctatttttttattataccgtttagccattcgaaaaagtgctcgctacaaataagggagtaactaatcccacaagcattttagaacacactcctaaatttattacacttagatacaaacacaatatgtactatacaatatacttggtcaattctagcctaaaatatcagttgtatatcctcactgatctccatatatgtaagttttatatacgagccattatccactaatcgccaagtcatattacttacgagaaatatcaatcgtatatactcattgatccctatttatgtaagttttatatacaagtcattatccactaatcgccaagtcatattacttacgaggtatctgtgcacacagtgcatataacgattagctgagatctaatgagcatgtgtgtcatcaaacactgaagataaggcaatactaagtgcgaaactgtcaacaaattatagataagtagaggatgcaaccaatccaccgcaaataatagttgactacaattagattgcgacaacgagtaatagcattcctacactcctatagatgcttataagatgtcatgtgatgctctaattagatagaatctaagaaaagttataaaaaagcaaaacatctatcatcgatttacactcaaaatcggtgatccattattttcaaccattaaattagatatatgacagtaatacatttgccctaaaaactgtccaatctgtccttacatacacacacaactcctacatatgtacgtacgtacgcaagagataaaaaagaaaaaaaatagtatatgatctatcccatctagaagttttcttcctctttccaactataaggtttttcccaaattgatcatatgcatagcgacaactcctagcgatatggaaaaaaaagacatgccatggcgccgcctcatgccacccattgctccaccctcttctcgttaatttatttgaagtatttttttttactaacgatgtaaaaagcaataacatgagctcatataaatgcgtgcatatgcagtgtatggatacacatacgtacgctctatccctatccctatgatagacaaatatttgttcgaacaagcataggtgaaatagatgtatactatataaaaaaaataaaaacttgtattaactcatatgttagcgaagatcacaggttgagcaaatattttttacgtggtcctcaccattgactgaagctattagatttgaagtaggatcgaatgatcaaccgagctaatttttaaaagagaaataaattatgtctactctatacaataaattgactcaaagacataaaaaaactattttcatcatctccatcttctttcactcacaccctaaacaacgccaagcatggatctcaattgacctacttaccaatgcaattctttataaaattatacacctcgcttatcttgaggagcgcgactatatcaatgcggaacccaagaataaaggcatcaaagaaaaaatcttaacggctaccatcggcttcacccgatgacttttaaagaggcattgatataagtttaatgattttatccagttaattggtagaagcggtatttttaaatatttatatatagatttgatacctgtaagttattgtatttggtatgaggtagagatgaacttttttggtattaatgatgtatttggtttatttttgatacatatataattctatctattaaaaagaccttcatatttaaagacaatgatagtaagtagtggtgataggtgagaacaaaaagatattcgtattatttagtatgtcaacatctatggtttgcccctccccctcaaaaagacccacttttggatttgaatatagatatatatgtccagattcaaacatagaagtgaatattttttttttttgatggaagggagcattccttatagtgaatatggtgagacaaagcttcatttagtattttttttataaacaataaataaactacccgcgcatgtgcgcgggctttcttactagttatattaatgattatattataattttagtacagttaaatttgaaagtttttcacattaaaaacttgcggcagttttctttagatatatagtctttttcaagtttatgtttatctccattttcaacaatttacggttgagaataacgtcaatatatttgacattctttttactcgacatgtcggtaaattccaaaagtatacattgattgcagtatactgcagtagattcttgatcttaggattacatgcttgccgtacatcttaattagcacatagctagaataatcagcgtgttaagttgctcagggcgtactcactggccggccactcctggaagccgaagccggtggcacgccggggatcaacggcgggaggaggggcactggcggtagaagagatggcgggggcggtggaggcggtggtgggttgagcaacggcagcggcagcaccggcggtattaacgacgatggcggcggttgtggggtgagcggcggcaggattgatggtggagatggggtggggaacaccggcgggacgagagacggcggcgccggcgtgattggattcggcggaattggcacgccgccgatgttcggcggctccggcacgagagggagcggcgggaagaagatccctttgtcgtcgcagagctccgggtggacggcgaacgctccggcgttgaagactcgggcgccgtcgccgccgttgtgcttcgtggcggcgaggcggaagcctctggcagtagcggcggacgtggcggcggcgtcgtcgcatgggcgcgccgcattgctggcgagcagcttcaccgagcacgacgtcacggaggccagccggctcttggcctccggcggcaggtggacgcggaactcgccgcgacggtcggtgagggcctgctgccggaagacatcccgaccgttgccgtcgtggcaccggacggcgaccggggcacctgcacgcatgcgcaactcacgggcaagagaatcatggactgcaagaagtggacatggctgaaagcctggaacgtttgagatggaggagaaggcccctgcgcgcgcgcacctgataccgcggccttggtggcgtctgagccggagtggacggagccgacgacgacgacgacggatgacggtggttgccggacattcttcccgccatggtgagcggcgagatggcagtggaagcaagagatgaccaccgccacgagtagcagctgccaagcgtgcattcgagcagtggccaccatctttaggctaagaatgcgaggtggattaatttgtgaacgtctcgcctgctactatttatgaacgtgaggagaagaagaatcgagaagcacactgttggatgcccacgtagccagccctgttaccaacttaccattactaacgcgcgagaactggagaattactcccttcaaaaaaaaaaaaccctggagaattatttttattatttaatcctttttattaaataatttaaaaaacaggccctccaaacttctcatgtcatgccaatacttatggcatcacagtgtagcttggccacgctattcagactggtgtagccaaaagttttagtttggaaaacaaatatttggagagtctatttttattttttaagtaaaaatggttaaataataaatagagtaaattgtattgatggtacacaaacttaaaaatggttaaataataaatagagtaaattgtattgatggtatacaaacttgttaggcgagtgcaatttagtatataaacttataaaatgctcatttcggtaaaagaacttgtctagtttgtgcgaacgaggaccaaaatagcttgcaatgttaattttataaagctggtgttgattaggatgtgacgcccatacgtgtaatgagtatgtataagacatacaatatttataatattggtctctactttatccttcatcatggaaacgatgaatgtcatatatctctaacccttatatcattgctcattttttcatatatttttctatgttcactatatatatcccgttctattttttattgtagaggtgtacggataatagcaaccttctcaaatatatatgtatacatagtatcctaatcagcccctattgaagaggtgtatggctaatagcaaccttctcaaatatatgtttacatagtatcctaatcagcccctaaatcaataggattatccatgttcgcctttctttgcacgcaccaaacaagctcatgcaccaaaaacgagtattttacaagttcgtgcattagattgtacccacttgacaagttcgtataccttagatgcaatttaatttactctaataaaaaaaatcagaactgggcaggtaaaatacgaacgaatgtttttttaagacgagacgagggaggtggtaatacattactacatctctccggctgctcgccggattgtattactgtagaacagtttccatgcacgcacaaacgacatgacatatacgtacacacaacaggcagcagactataaattaatatttttataacaaataaaataaatttattatgatcatgtgtgtgtgtcttttacacaattgatgaatagttagctatcacaccctaaagtttcacatttctttagcctcaattcaattaataaactgtctcccaagaattaatttgaattaacctagagctaaaccctaattaataaatacaattaataagtggaaatggtatggtgaggtttttcttgagttccccatgattaaatacatcaacatgatttttactagaatttccaaagcaaaagaaatcattctaataattcaaattcgattatcataattaaattaattgttattcttttttttcctctacttctctcctcaggtcgcttgtcggacccttcccttacctccggccggcggagccggagggtgcaaacgtcgctcgcatgtcctgcacatctcctgcgccccactccaccctttccgtgcagccgacgcgctccactccccgcaactacctcccactaccagaaacattattacctctgacggctaaaacccatcacgaataaatgaaaaaccgtcaggaaaatcggtcctgacgtgtcaacgtcaggaaaataccgtcagaactagcttggtggggaaaaaataatttgcctgacgtttgtccgtcaggaaaactattcctgacgtgaggaaaactattcctgacgtgcgctcacgtcaggaatagttttcctgatgtggattgcacagtcaggtggtttcatacacgtcatgaaaattaatgaccgtcggtagtgtcaactactcccgccgcatgtcgctcccctcaaaatcggtgggattagattttcaaatctggccgatgtctctctctccctctccactcccatgtccgctgcaaaatacgcccccctacttgccacatccgagctccctgccactatataaacgaccctcatgctcacctccttttccctcatccgtcgctcgctcccgtcccataactcgcgcccacgccgccttttcgccgcctctggtcgccactagccgctgcgctaagccacgccgtcacctccaccgggttcgcaaggtcgagggctacctcagccgccgttcgtccgtcattgtccgcagccataacacgccttccctcagttcgccggtgagccctccatatccaccgcctccggtcggcaatggttgccgccgtggcctctcaaacccctctgatcttcttccctaggtcgttctggagcctgtacaccccttgccgccatcgttgtcgtcctccccgtgctggtcgccgtcgtcgtcggtgaggccctcctcttttcctcctccctctccttgccgtgccgccgctcgccgtcatcgggccggcttgtcccgagctgcgctccagtacccgtggaccggtggtggaccaccacggtggtcccggtccacagtggacctggtgctatgtcaccgacggatggggaccgtgtgtcggcacccccttcccctcgctgacgtcagcgtcggcctttaatgcaaaataattgattaaggacttttgtttatagtaaaaacacaatgaatcttctagaattcatatctaatttatttgagctccgtttaagtccactcaagtcttagtgaattcataaaaatgattagaatccattagaaatggtttcatttcctgtttcagtggacttatatagcctgttttgcttgtgtgctttctttgtcacatagaatctggcagttccgacactcacgtctattacgaagtggttgcagaggttcgagcagcaccggagcaaggaaagtcatgcattacaattgatcatattgtacccaatttgtaaatgtctcgctttctattaaatgctacattattttacgatgtcatgtgagatggttcctattacttagccatatgttgtttacctcatacctttcataacttgggatccaatatgattagatattggtttagaaagtgcttagccatgcttagatcaacaagctcttgatggggaatctcactaatatcttagaccttgattatttatgataactttggatatgtaccaccatggtattaattaaactaaaatatgcttaatggtgggccgtgggtgcatgattttgatagacgtgctcatggcatttaaggattggttcgcgggttaccctagaagatttaccatatttaccagaagccagcatgaacaacggctgggcttgtagtgtaggttttccctagctgacgtaccaaggcaagggtgagcgtgatggaatttggatgggccctgtgatggcctttgtggcttttggattcacctaggcacaagaggggatacctgacttggttataaaggaggaggtgatcgaaacctgaaaagggtacaatttgttagggagggttatgcgaagggtcctgtcacagtctccttctggtatgttatggtggtatatcatgcacggaaacgtgtcgtgcggctgtcttgtgggtacagttgtacacctctgatcagagtaaaactattcgaatagccgtgcccgcggttatgggcaatcaaccagactcgccgtgatttgtctcactcttaataatttgacttaatggaactagtttagttcaggtggttggttgggcctattgcgatgtgttgtagcattgtacagtgataattaatattgcttaattagcttgaacaatttactactttcaacttctccttttaaatgctagctttatgcaaataacccttagcctcctttggaattaccttgcatcatacctcctcttggtatgacttgctgagtaaagtgggtagtactcagtcttgctctatcttcctcacttcagaggcagagtacttttcggatggaggttactcagaggattaggctcgtcactgccatcaaggatgcccgtggagtagagtcgccacgctgcgagcgtcaagttgtctagtttagctcgcttttaactccatcgcatatgtaggactttattacgtttataagacatggatttgtgtatcaacttgtcgttcgtgtactctggttggtcctggaaaggggttctaatacacattctgcttggaaattctgattcgtgaatttctggggtgacttaagtttaaacaaaagcttaatcaaattgaacgacaaaggtcagaggagctttcaacagatagagctactcatagactctctcgcttttcaaatactttacgtacctactctagattttgaaatttggtagctgtaaaaatctaaaaataaataagtagccaaaagaaacacccagtttctatttatatccactagctgaatactcattaattgcttctcagaatctctagttctctcagtaggaaaagaaaactcttgctccacaatcacctcctattgtatggctctaccgcactagtggttacaattttttttcatctcttgaatgtaagttttcaaattcatccaccactttgcttcagactttttaagtactcccttcgtcgtttcattttataagtcgtttaatttttttctaatcaaacttcttcaagttgatcaagtttatagaaaaatatagtaatatttttaacacaaaacaaatatattatcaaaatatattcaatgttagatttaatgaaactaatttgttattttatactccctccatccataaagttacacctatttcacatttgagtttttccaaataagttgttcctatttgtagtctttatgcattcaagacttaaatgaagagataaattaaatgttttattagaatccatggagtcatctaaatattcattggttgcatgcttgcattcactccttaattttgtaacatccaaggtgacttaagttctccttggtcttggtgtcaaaagtaatatgtgtaacttttgtagatgaagggagtatgttgctaaattttgctataaacttggtcaaactaagatagttgccttaaaaaaaaggtcaaacgagttatactataaaacagagggagtaacaagtgaaaattcagagatatatatatatatatatatatatatatatatatatatatatatatatatatatatatatatatgtctagaaaacaaatgatattttctttatgtgaaagtgaacaatcgagtgaatcaagtgaatcaggaaagtcaaaatgttttgtcccatacattgaatagcggcttgtcggcatgaaagaactagtggatataaccgaacattcctctctacaattatagcacaagcatcgctagatggaaattcgcctaaaaaaaaacatcagtacatagaatggctttagatctctgatgaattttgacacagtcaccttatatgtctgtactcgtataatttgtatacatcgatgacgcttcatatgtccaaagcagacaaactcactccatccatacatgcgtataatagaaattaattcgatcagcccctatacttgagagatgtatacgaccactacttttatcagaggcctgcaacagcccaaaaatcagtcatctatgcactatcctaagcacaaactaatgaatacaatcgtatggccagaaaggcagaaacaaccagccgttaagagaacaaccaattgacacacatgagtcgacgtctacacggagggatggcagtgttttgggaggttatgcgccttcgttgtcagggaagagaacaaatatacatacaagtttatttggcacactcgtgactcaccccattcacagcttcacgtgcagcggttaggaacgagtgagatgctacgtggcgatgaaactgttcagcgagataatgtttccgatgattatgtagcgattggctccgaatttgtatgcggtgcttgcctaaatgcctgtccatttgacatgtgcctttgttaaccttattgaaattgaaaattagtttgtgctttatcgtagtgagcattgcttatctagtaagtattttaagaactccagttcaagttgtatgcttcatatgatcctcgtatttatggctaattatttttcaatgataaactcataatgactttatcaatatcaaaatataccggtacagtctttcggagatagagatgctcctggatgtacggttgcactactatagaaataatttttctggacgagcatctcaatagattgcagacagacaataggtgtcggcgtttgtaaaaattgacccctactttcgcatacggctatttaagagacccacaggtaaaaatcaattttcgtatgcgtgccacttaacatgtccgcatgcgaaaatacccccattttcatatgcggccttcactactaggaaatcgggcttatgcaacggctagaattcgttgcaatatgcccaaaatcattgcaataggagaaaatgcaacggatttttgtcattaggactcgtggcgcaaaactccgtagcaatagggtttttaccacttgatcactttgccgttgcaaataacaacttattttgcaactgagtgaaccatggcaattaacaaataatgcaacggtgggttggtggtaatagaacgtattgcaacatctgatgtcgttgtcgtaggaactagtcgcatcgcagcaaagcgtggtaataagtgcttaatggcgttgcaaaatgtgtattaccacggacctcaaatgtggtaataggtcgacctcttgccatgctcacaattttagttgctatagatagatcccactattgccacgctatgtctcgttgctatagctagaccctttattgccgctcaaaatatttggttgctataagtgggcacctctattgccactagaattatttggttgtgcacctctattgccattagaattgtttgtttgctataggtgggcatcgctattggcacaattattgtttgatggctataggtgggcacttctattgccaaccaaacgtcttcgacgatataggtgaacccctatattgccacgatgatggcgtagttgctaaaggcgggcatctgtattgcatcgataaacaagtgggctaagcccatataggcccaacaatcaaacacaataacaacccatatagcacaaaggttacagcctaattagcatccaacacaacccgacaaacatccaatacaacacaaaatttacaacccagttaacagccaaatccagctacattccaaatacaatcgcagcaaccaaaatttcaccagatgccgcgtgaccatgatcttcgaagtgagcttagcagcactgcatatgcacaagttaaaacatcagtaactgccaagctgagctcctgcaatcaaaaagtacccggagaacaaaatcacagtagtacaccatggtaataccttaagttttctatcaggcaacaatcttgttttgatttgtaaatcgaaacatcacccccaaaaaagtaacctgagaaggacaaaagtgattactcggtgatgccagagcaacgaagatcacaaagcagttattgccatggaataaaactatagcatccaccatggaagatgattaatagcatcaacaaggaatacaggacaagtaatccaataatgtagattaagtcaagcctactctagagcataccattcccatttgaatagtctaaagtattgggctaccttggctaaaaatgacatgaaaatgtatgccaactcccaaaataaacttaaggctttgagtgcacaagaagcagttattataggtctaatttttttgggactgcaattctagaaaaaaaaaccagtaaaccataggggcataacataccttgtttcttcttgtctcatctgcaccattgacaagcaatatcattgttatatctctatttctactctgtatagctaaatgcaacggtgtccacccatcctgcatgaaacaaaaaaatataaaagaaaaaatcgatttcactgtgaagggttgaactgataagaaaaagaaaaatgcacaatagtacattacattatcaacaacattgaagggccaacatgccataaaaatatctaaaattggagtagaaattgttatgtacttatgttgctagagagaaaccagatcaatgtgagaggcactaacatcacaatgtttactatattcctcattgcagcgttgtaatgtgcggttaggtagccgacaatgttaattaggaactatttataataaacattaatagcaagtcgatcataaagttgaatgattctttatcttggttatctatactaatataaaaaggagcagttgtccccctccaatcctacagaccaaatcacccgaatcgatctctgccgtccatctgcgcgcttgatttcaccaccgcacgatccatccatccacgccacgctgaatacttcgctcctcctccacccgccaagacatcactccacacgcgaagacttcgcttctcctcctcgctagctcctcctcctccccggatgttctgccgccgcgccgccgcatcctcgctggatatcctccccgcgtggactgccgctgccggagcctctgattcttcttcttccccgccaccggagccagtgcttcttccccgcgtggactgccactgcatccccgccgccggagccggtgcttcttccccgccaccggagccgccgcggccggttccaacctcggcaccatccgccagcaccgacgacgaggtccaccgccgcgaccggagccgacctcggccccatcccccgcgcgatgactccgggatgctcctccttcccttgatccgcaactcctcactccagcgtgctccgtgcctccccgccgctgagacactccaccgcggcctgcccctaacgaagctaactctgccgcgcgctcctcgctccgctcctccccaccgccaccacacaccaccgcgccctgccctcgccggcgccgtggatctgtatgtcatgaagcctgtctccgctgctgcacacagtcgactcccccgtgaatatgcctttcggctggtatcaccatcccgtcacggccctgtggtcctaccttccaacggcactctgccgcgcctccagtggtgccgccgttgtaagggtcatagtctgcccacaccacgcactcggttctcacggacgtgtgccattctctcttttgcaggtgagagtgcagagtgcagagtgcttcagctgaaagtgagtcttccgattcccctcttcagcccaatagtcctctatgtggattatctgaatctgaatgtacatcattttctttcactatggcttgatttacactatttgatctagctatcagttcaagtggatacaatcctattgttatcctttcaccacaatcagtagttttctgagaagttaatttctttgcatacactgatgaactctgtagtagattctctgcaggctctttcttgctcaattaattattgctcactctatagcagatcaactctggatttagacttatttggccaagcactatggctaaaatggcatgccaagcttggaacagaaaggtcaagcaatttttccaaccacggtgcagcacgtggcaatggcactaccactaatttctatcatatgtaggaagatccaagttgatgctagcacaggctttggtgaatcactgatgggtgagagacctgcagagttccttgtccaacagagcaatggctgagttctttcagttgtgggatgaaattcagatggtgcagcttcaaccaggaatagccacgactccattcggtggtagctaacaggtgatggccagttttctttctcatgggcttacaacctcttcttcatggcaaagaccaaatgtttatatggtgaactgcataatttcgattctttctgttcatgatgatctgttggttaatctggaaagacggaacgcttgggtatttgagcagaggtctagacctatagagcaattatttggagacatcaaggagatcacgatttggaagtcggctagcattttttatcctgcagtgattatttattagtgttggttgtttattgtggtatgaggttttgcctcatacctttgttcgatagcatagtactttgtactttgtttctccctaaatcttaatgaatttggtgggcctaatcctttggccaacctggcaaatcatttcagtagtaaaaaaatgtgttttcctggtcagatttatatatatatatatatatatatatatatatatatatatatatatgtatatatatatatgatgtctactaggctgaaactcttggcttggagaaactttgttgcataatgtagcaggagctgcagcggattgaaaattgatggtatcaaaggttcttaataatacaagcaataagttgtcaaagaatcattgtttgattttgtagtaccaaaattccaatcacacttagtggctaatcttttttattttgactaaactaatgccacatgttagcagcagtagcagaatttttttattttggtttcaggttttagaactaatgttatttgttgctccaaataatccaccgatattgtcaggtgggagctatttgacttgtgtggctagaagtattcaagtcaattatctgcttgcctcggcctacttcaatagacaacagaggatgctctacatcataatcgtatgcaaagacaggtaatacacaccatatttcccttcatttgcaaagtcctaataaactgaataagaacagataccacattcatatttttctgatagatctcaaatccatatattgctaatggtctacttctcaaattggttttacacctcaatgcttgttctgtattccgtttgccacatattttatcaatcaattgcagttctttgaaattggatcatgacttccaacttgcagcagctaattgcattgtatcacacgttcattacaagatacttaaagcaaaaacggcaatatattggttggctgcttgcacttgcaatgagtaagagcatagaggttctggacttacaatctgaggttaggatcatgttccatatatttttacattgaacactattgcatgaattgcactatttgtagatgttctatagttaatcaactatgttaccttaaatatacatggtgtgttctagattctgaaatgtttagcaaacttaggcaacatgtagattaactatcacaatttatgtcactttttcatatccagcgaacttatctaacttttcttttcaggttacaaaaaatgcaggaaaaatgtttagactgtcgaagcaaatccatcaggaggacaccatggcatctgatgttgtctactatgcatcaaagagattactggttgtttttattccttctttttggttgagataatttacgttaatataatgttttcatagaagtgagccaatcttgatttgtttggttaacacgggttatgtgttgaacgtgtgatccaatagtatggctttgtcatgttctcttatcagctaattgtaagtccttagcagctggaatgctagatcatgactaacaagtgaaaacgatcagtgatagttttatgcgtgatagttttatgctggtgcagacatgcaatgccaaataaaacatggataattccttcttgtttgtgcataattaattgtttgtgcaggcttcttagcactcagtaatttatcttttcgaagtttctatagttgttgctcatatacaagggataattttgttgctcagtctcacaaggacagctcactacctatccatctaaaatctgattacacatttgcccattaaattctactatgcacaacaagaagccacgaattctactatgcataacaagaagccacgattgtgctcttaattcaaatctgaatttgttaggacatattattgacgtataaccacataaataaatccgaagtatatataatatttttgtttccccatttcaaggtctatatgattttacttatttggttttggtccgcatactggtagtatgcctgagagtggttatgttgatgactgttaagagaatgacaagtcaatatcttgctttgatacctttttttttttgcatttttgatttagctaaaaataactatgtactcgggtgatatattttatcaaaaacgtgcattgcacgtgcacgattactagtaatctgaaattccgaactgtgatcttctcccaaacaatatgcttacatgttcattttcatttggcgctatgctgctgcagcagttcagcaaaaatagaaagccttggcaaatagcaatttcagaatcactgcattatagccaatagcagtcatctgatcatgcacatgacacatgactggataagcacatatgatttattttgtgatcatggattatttcattaaagtaatcataaaacaactgtttctaacacatgactggaaattgagtacaacttaagcttaatttttgcacccattaagcactacatccagctcaggaccagtcaggacacaatgtacccaataaaactcaaataatgacatgacacaaccaaatgacaggaaaaaatggaagaatatttgactcataaaactaatcaggttccatgtcacttttttatccgtttacaggatactcatttcaatttatctgtttcagatcagtcacagatcaagcataaaaaagtatttactttgctggattcaagggccattggagcatttcctaaaacaagatatgtgcaagtgcaactcgatctatcaattaacctgacaaaaagaactgaaaaggttacttgggatatttaaagaacaacataagcaagaaattcaaagcctaattatatcattatatataaggcagatattgctttaaaacataacaaatatcagaacattgcagcttgcaactctatgtagccaaatcactgtaatgtgaaagcgtattaactaaactagatgataccccgtgcgttgcagcggacatggcatgacaaacttctcaatttgcaatatgtgtaatagttgtcggtgaaaggtacctggctactggagctagagaaccatatctgaattctgaaatacttagcacggttggcgaatattcctaataaaagaacaaatggcctgcaaaaatgtgcaatgaaaatgttatgatgaaaatatcaccgaaaagatatcctctatactattattatttatcggctgacaaaatcaagttgcacacatctacataatggagtagttgtcagcataccttagctagcaaatcaagtttccagagtgaagatgtccaaagtctcaaatatatccagttttataagttcttgcttcatctgcaacaaaaaggataggtgaaacctcatcatgatcacaagctaaaactcatctgagattgtcgctgcaagataaattatcaagatccataggaacaaaaatcaaacaattctccccaaataccaaatgcctaatttggggaaatagattccaaaagctcagatttagagggaaaccttgcacttgagtacttgtgcccagtaacaataatagatctaaactattagagagatcgacagtacaaagataaaatttaagtgtactaataatcacttaccttgcagcagttgatacaaaactgggatcatcaggactcgggatgccttgtgcaagttacaatttttgaagcaaaaatcagaggcgctgagcactaccattactggaagtgctgcttcacaacgacaggaagagcactgtgaacctgaagataaaaacagccggaagaatcagagatgatggaaaattcattagttttttatagcactgaagcaaaatacaatgtggtgcccaaacattctgtcaaatggcaaccatccatgtgcaggttgtacgaaattaaggatcgatcaaagctataaacagtggatcgtgtaaatagaaaagtttgctacagatgatgggaagaatcagatgggcaaccaagtagtacatactcttcacggatactttgtgatcatgcacgagacagaagttgagctttggtcacactgaggtcagggctgcttccggccgggataccgataggacgccggcagctagatcgacaaaaacggtagtggtagaatagatcaattgcaattgatttctattttgttcggttcctgttgcaaagttaccgatcacccccataagaaaatgtgaagcccagacctggcttagctgatctagaatcagaattctttggtgccttgctaaacaaagaaagaatcactccctgctaaacaagtaaaaataaagaaagaatcaccttgttcctcatcgtatattcaatttgacataatcctacgaacaaaagccatgccttcagttaatcattgaactcatcaattcaaccaaatgtaatcgttcagagaaagaggataaaagatctagaaagactaccttggcaatcagatatctagttgtcagttccagcagccgccggcgtcccgcaaggccacaactcaattcatgctggacgcagcgccgacgggagtcattttgagggccttaggagcagaggctaaaaggaatcggaggccgtcgaaccgcgtcgcgaacttcttcccctccacatgctgctcccccgccgccgcgcgtgccgcgtcccttgacaacgacgaaccctgacgagccaaaggagaaaagggtatcagaggagatcgaggaagaggttatgatggacgaggaaggcgtcgcacctgccgacggcggcggtctcctgctgctgcggctgattggcgactcctcttcctgcggctgctgcgggtgggcagtgggagggtggggcgcgcggggaggggcgtcgggagggtgggtgccgtgccgcccgtggcggtttggagcgagagggaaggggcggggattttgtgacggtaagaggcgtgggagcattaatccatccatgggttaatctaactcgcgacgtgatcattggataagaggatttgacggttagaaataggtgggtatactaaaaaggaaaccgctattttttatattagtatagttagatagatgattctggattgtctatttatacaactttgttattaataattgtttcatttgaaattatttactatctgaaacattatttgaattaaaaggaggaaagcaaatagacttctcggcgatggaggagaaaaagggttgggcctgcagcccgaagagggaggaggagggagagagaggttgcgggctgagggagagagagagtaatgcttgggctgaaaaaggcccaacgacagagagatgaattttaatttgttttttatttattttaataggttaaataaattttgtggtattaaaatttgttattgagctccgaaaatttaagaaaaatttcagagaataatttagaccacgtagaatattaaaaaatatctccggccatgatttttaaaggaaaattttagtttcatcattaattcacttgattaaattgctttaacttttaatatatttttctagaaatgcattatataaatctatgatgtttgctttgttccccttatgacaaattaatatttgtcacgttgtcccattgaaatactttatgacgatttctagttggtattaataacgaacacctttttttcgtcactaagccaccccatcttatactaattgtcataaaatggaatgtgctaatgatgaatagcaccgtcgtcacgaggaattcgtcacagaagatcacatttcttgtagtgtttaaatttaattttagactgatctttatgtttcaaatgcaaaaatcataaacaacaaaattgtagaacttatcgagatatacaactattgtattggtcttttttcaaataagttcatttgaaccgttcaaatatttaattttcaaaatttgataaattcgaataaaatttggggttaataaatgatttcaaatggaaaaatcaccaaaaccaaagttgtagaactcatcgagaagcaaaatttttattttagtcatttctccatccgactctatttgaataattttaaattcgaaattcaaagtttgagaacttcaaattgaattttttattagtgaacgacttcaactgaaaaagtcatcaacaacaaagttatataatccatcaagaactataatttttattttggtcatttcttcatccgataaagtgatagtaacattgttcacaaattttacatatctcccatatggttttataaattataagagaggctgtgtaaattctgtgaacaatgttactatcactttatcggataaagaaataaccaaaataaaagttatagatattgatgagttatacaactttgttgttgatgaccttttcagttgaaataagttagtatttgaaaatgttgtttgaagttgtcataattttaaattcaaattcaaattattgaaacaaattcatatagcaaaatgactaaaacaaaagttgtagatcttgataacttatacaactttgttgttgagatttttttcatttgaaatcatttactaccctaagttttaatattttgaaattaattaggaggagggaggcaaaatggacttcttggtgagggaagagcaaaaggtttgggccggcggcccaaagagggaggaggggaaggggaagccggcccaaatagggagagagaggtgcggattgagggagggagagagtaatacttgagccgaaaaaggcccaaggacagatagagggaatttaatttgttttctatttattttaataggttaaataaactttgtggtattaaaattagttattgagcttcgaaaattcacggaaaattttagagaataatttagaccacgtagaatattggagggaaggggacaccgcagccgcaaaggtgatagcacacgcgtgccctgatgcggctatattggaggcccacataaacatgtctattgcaacaccagtaatcgttgcgatatatacaagttattgcaacgaggatcatgttccttgcaataagcatctagtaattgccaccactttaatcattattgcatccacaacaaaccgtggcaatatgaacatgttgttgcatccagtggcatccgtcgttgcaatatgcaactccctcttgcaaccccacccaagagtaatgcaacacaagaaaacggttgcgatattggcaaactaaagcaacgcaaacttatgaggttgcagtatcacatttcttttgcaacgccaaacatcactaacgcaactctgaaatattgtggcaataggcccaacgaattgcaacacaaataggaaaatggttgcatcaaccccattcttttgcaaccgaaatccatgcatatcgccacacacacacgccgttgcattactataacaaattaccaccatttcacggtttggatgcgatacaaaaccctattgcatccacatgagtgccattgcaaggggggactcgtggctattgcccgaattcctagtagtgttttttaagtgacccacatggaaatatcacccttcctatttcaacaccttttttatgctccattcctctctctcccactcctactaccatggcccactcctcctctctcccccactcctcctcagtccggcctcctccctcccgacaatgggcaccggcggcggcagatgcaacggcgggtgtggttgacggcagcgtcggtgggtgtggacgatagtggtcgtgggcgatggtgacggcgacggcgacagccccctctcccctacccgcgcggatctggcgatgggtttgagtgtgaggctagcggcggttctcccccgccctccttgcacggatccgacggtgggctcgagccggatgcagtggacgcggtgggcggcacggtggtggcaggcatgccggcggcaggtgcatacgacgacggtggcgctgatcctccatcggcgacaatgggaggtgtggatccactggcagcggagacgggagaggcagatccgctagccgcggctggctagggttaggttttgatttttggaattttttttgtgattttccaattttgcgtgccaacggcttatgcgtggcatgcggaaattcggttgtcgcatgcgggtgcaccgcctgcatgaaaaaatcgctatattcgtagacctttccgggaagacggttagtctaaccgcatgcaaaaattgattttgaccgtttggaaaaatcccttttgtagcagtgttgtgtgtttatagaattaagtatgaatgtattgtgtttataatgtggtttaaaaaatacacacttatatgcacatcttcaatataagtacacacttatttttacatcgtaattatgacacagacaaccgacaatgtgtatcttaacacactcttaggtaggggtgaaaatggtaaccgtaattaccggccgaccggcgttcgtttttgactttctactggccgagccatatggaaatggtaatcgaccgaaacaaaaatggaaatggtaaaacatatggaaatgaaaacgaaaatggttttgctgttataccaatcgtttccgtatttaccgtattcttatggaaattaccgtttcttataatatggtaattactgtattataaatatgtcgatatttatagggcatgtctatacttgacccacaacttacagattgactgactcttcaatcaaatctctaacttttgtgcatggctaaaatgaagttaatttataatttatatagtataagcttgaatttatgaatacatataacatacttatgtaaagttaaatatatgtttttatagtttaatgttcccgtatttattatcggcttccgatctgtaccgacaagtttccgtccgtattgttccgtttccggttttccgatatttccgatattgttttcgtttccgactttaccgtttccgatttcgtttccaagaaaaatatggttacggaaatggttgaggctgttttccgatcgtttccgaccgttttcatccctactcttaggtctcaacaaaataagcaaagtgacatggcataggattagtctcgtaacacactcttaggttttaagatttcaagctataaagtgacatggcataggattagcctcattcattgatcatatcgttcaagatttcaaacattgcgagaaagttcatctcacatgtcgagactcatgtcaaatccgatttcatactccaattcactgcatttgtatcattcaagacttcaaacacccaaatccaagcaatttatctcacatcgattgtcaaggctcatggcagttctccagtttcatctcatattgtcaggctcatggcagttctccggtttcatcctcaatcggtttggttctatatcacaatcagtcatctcttctcctaaatctcatagagctgttgttgacagctgttaagtaccaaatttacgtcatcaatacctgcataaatctaaaagtataagacatccaacatagtggtagggtttatttctaacaatttccacgagtgttagtgtatatttgatgcaggtaaaaacctaccaaagttgagacaaaagatacataaagaaggaggtgaattaaacttccaaatttaagctatggatttttgagcccacaaacctaatgaaacaagagcaaatggaccttcccactatacatatgggctgagggattctccactagtgtccacaagaaaattcggggcaaagggggccagaaagggtttggccgaacccaaaactagcctgttcggccccaaatttcacaggccggtagataacgacttgtattacagttgggaccatttataccaatggaaaccatcatagagaggacatgtggaggctcaagagtgaagatgccctttggattccatggagcatcctcatcctcccaagcaagctccacctataaataccccttctcatccttcaatctatcacatacaactttgagctgaattataagaggatctattgtatcttttatacattaaaaataggtagagggtgaagggaagctctggaggagtgcccagaagtttggcgctctctccgacttctacctcgacgattgtagctttctaggaggaattctggaggggtaccagagctgtcgatacactctactccgggttcggagaacttccattaagtaaacatttgggatcctttcttatcttatttaattatttagtctaattaagatagatttccatctttacgggttcattgtttagtattcgtactaggactccggatagagaaggaagttcctgcgcatatattagagtagtaattaataacttagatgtggtgtctaggttagaaattacatttgtttgttgtgtatcccacagatttgtcagaggtagacagcaggtggtgacagccctgaatcccatcccagtaatcttccacgttcagatacatcatagagctatggccggaaccacgctggcagaccagcaggagtcggtgcctgaagcaacagataggaaattacctttaacttagcttagataattaaaacaatagaaagtcctttgtagcctagccagcctacctatagttgttgtccttggatcgtctttgccttaggtagattacacacgttccctgagttcgatatccttttggggtcacccgaaagtgaagtgctgcagcggtattccgtgtgcttgcggatttatctgtggttgtaagaaataccaacagctgctctagttatgggttttatctaatatttccatcatgagacaggtattttgtttttcatctccgtagctttattttggtatctaatggtgcattaaaatattttcattatatcgctctctgtttttaagcttgcttatcagcttagttattctcttaaaataatgtttgtacaggtgctaactaaatattttatcttaacatttattgatggacaatcgctaacaagtactaccttagtatagtccgacagaacggcagaaccgcacaagataggaagcatgcttcactgcttcaccgttttcactctgctttgaagattgtttttttctagaaaatttgagtgactaatctcttcctttgcagcacacacatatattgaacctaaatgtataaccgtattatttgatacgcatgtattgagatttctcaattaatatatacattacaacttaaattccaaatagtgttcaccttgttttttaacatgttcttagaatgcacatccttacaaggatagtaactatttaacacgcaaatgttccgcagcaacgcacaggtgtcatctagttctactaatttcatgctaaaatgctactctatctgtctatgaagcctataaatattttatactgtcttcaattaaatacattaaccattaatttatttcatattatattatcaacaaatataaaataagcatcatatgaaaatattttgaaaggcgaatctattgatacttagtatagatatttagtatagatatagttagcataattattagttaaaagttatagactttgattttaaaaaacaaggacgctctgtaatttgggatgaatggaataccaggtacgggcgaacagtacacggccttggcccaaattggtgttgttctttgggggaataagtgcattttaggttacttaacttgacagcgagttcaattttcatccttgaaccaaaataccagctacaatgggtccatcaagtgtcaaaaccaatacaatataggtcccatggtagtatagcgagtggttttgtccgacgttgcaattcgacccaagtcaacaatgctgagagtcagcgtagacctcacatgttagggcttcttcacctctctctctctcttcacctatctcagtattcctccccttgttcccatctcatcagggagcaaacaatgaggagaaggcccacggcggatggtgaggaggaggacggcagggagaagggcaattgccggtggggcgaagagtgattacaatgacacgtcgtatctctcttgagcttctcttctctcttcctcactatctttcttcagtcaccatgcaacgatgatggtgtggagcgggatggccaagcttgtcgtccatgccccatgcatgaccctcacggcaaagcagaagcagagaagacggcgctggtccaatctccatgcggcttttcccctccatgtggtcatcgccatgatgcccccaacagccaccaccgccttccttgccactgcgcccacgcctcctcaccgacggccttctcaccgcctgttggcagccttctcatctcttgttgtgtttgaggtgtcgagatagatgagtccagctaatgtgggagcaattattgggttttgtggcaagtgaggtgttggtatgcggctaatgttgaagaatatatcggcactgcagttgttgttgctgttgctcccaatatatcggcagcacgaggaggaagagaagctgcgaatcttggttggtcaatggaggtagtgaggagactgccatgccggagtcttggagagacacggaggcgaatgccacgccgtcagccttagtagccgcgtcagactcgagcctaggaaatgggaagggtggtggcagtggcgccacggcgaggaaagagcttgcagtgttggcttgcgtgtcgttccacatgttatttgcatccgcaggcaagacagtcgcgacggtaatggtgttggggacgttgggcgttgtggcgaatgacgtcatgctgccattcatgatggattgactaaatgctcttcggcaacctcattgatgcctccggtggtgcgcttggcatccacgacgtagtcaactgggtctccatggtctccctcattttcatccataaatacagagaaaccaggctccaccattgcccttctcccagccgttgtcctcctcaccacctgccactagacttctcactgctcgccacctagcgagataggaactgggggacgacaagagagataggtgaagaggccttgacatgtggggaccatgttagacttgggtcgaattgccacgtaggataaaaccatccgctatgctgccgtgggacttatattgcaccggttttaacatttgagggatccgttgtatctggtattttggttcaagtacagaaatcaaactcactgtcaagttaagggacctaaaatgaacttattccttctcaggccacagtgagacgaacaggctgtagtatcactgtatcaccccattgttaggttggaaaaagtcgacttagactcccttaattgttcaccgaatctaattcgtaacccttaactagaaaaccgggtaagacgacttcccgaattattgaaaccagtgcaatttgactcctctagcggttttggagggcggttttgctaacgtggcgctgacgtagcattagaattaaaaaaatatctgtggggccaatctatcattcacacacaaaatatattgtgggacccacttacatatggagcccacatgtcatcctttcccttccttcctcctcctccctctctctctcccttctctctctcttctctccccttcggacgcacgcaagaagcgggtgccagatcggcgacggcggcggccaggggctggaggggcgacgccggcgtgcgggcgagggctggagcggcgacggtggagtgcaggcgacggccgagccaccgcctgccccgtctccaagccggcccaccgttgctccccctccttaaagtcccagagctgcagcctctgctctcccccattggtcgtcgccgccggagcagtagcagcagcgccgccgccgcctgcaaggatgaacgggaggccggcgacctcagccggagcggcggcgaacctctgcagcaggcaggggtgctgcgacggcggcggcggccacagcgaagctgcgacaacattggactgaagtgtgcgctgatcgaaggcggccaccgtggcgtgctgctggtcctgcgagaacgcgaggtggggtggcatcgccatcatcttgaggtggggcaagcaagcgtcgcctgcttgctgctcctgctgatgttgcatttgcaatggcttgctgttgctgatgttgcaatggcttgttgccgttggtgttcgagcagtggaggagctcggcgaacgcgccgccgccgccgttgtaggcgttgccattgttgtcgcagggggcgttggcgagggagagcacggtccgccgttgccgatccggctcccgctcctcgcgtgcgtctgaaggggaagagagaggacatgtaggccccacatatcggtgggtcccataatatattttgtgtgtgaatgacagatgggtcccatagatattttttttaattctaatgccacgtaagcgccacgaggataaagactggattagcaccgccacatcagcgccacgtcagcaaaaccgccatcctaaaccgctggaggagtcaaagtggactggtttcaataattcggagagtcgtcctacctggttttctagttaagagtcatgaattagattcggtgaacaattaagggagtctaagtgggctttttccttgttaggtttgggccatgtgtggggcaaggccctggagattgagcctaagtagtgccagcctaactgccgctgccacgagtccttttttgaaaacaaaggatttaacagattacgtataacatcctaaaaattcatatactgtaacaatcaataacatttttcaacctttaaaactttttatcagtattatttgcaaaaaccctaagtgaccttttcatgtaaaattcaaaaacaataaaagtttcaaactataccgttgtcaaaatcgaagaggtctattgtcatcgatatagaaatctaacaattatatttgcgtagtatctctcgtgagagagatgcatgtcaatcaaactagcgattttctataaaggttcggctccttcacgaaataataaccctacatttgcttggtactcagtgtggctataaatgggcatctggtgtctagtccaaattactatattctcgtcaggagttccaaccagaaggtggttggaagatgggccatcgagaactggtttgatctggttttacttagctcgatatttgatctgttgttgtcttattcttggcctcctcttatggtcacatgttaagtttctaaactactccctccgtcccctaatataagggattttgacattttgctttcaatgtgtgatcattcatcttattaaaaattatttattttatttgtgacttactttattatccaaagtactttaagcacaactttttattttttatatttgcataaattttttaaataagacgagaggtcaaacagtgtaaacaaaatgtcaaaaattttagaaggcatactctctatgctacgacttatggaatataccgataaggtataccttcacgtgtacggttggtttccgtatacgctgttaggagtttgcctcaaattacggaaaatatatctatgagttaaggaattgccgaagtcctactcggaaggggtaaaatctctagtgtatcgtatcggtttacataatctccaagtcttacatggggtcaaggtggggaaaggctaagggcatcgcacctcatagccaacacacccaccaaagtttactaagccggagtctatagagtcaattcgccgggagatctcgtcgaatccctcgaccatgatctcgtcggtattatttgttcagttactccctttgtaatctgttttcatcatcatcaatcccatataaactggaataggactattacctgataaggggcctgaaccaatataatccctgtcttttgtctgttttgatgtcgtactacgtagatccctgttccaacgtaccccaataccctattctttcggtctgcgagtatcactcgtcgacaagtactaagctacgtgttctgtgtaaaagttttgcatacaaaaatttcttaaaaaaattaaatccattttcaagtttaaaataatttatacttaattaatcatggctaatgactcatttcgttttatgtgtcgctgagtagctcagcccgaatgctcattagaatgcatccttaaggccctctaatatcttaggtggacaagtacatacaggtattgcagaaactcttcggtatagtcctgatcgagtccgaccatacacatctccatcagatgtcgtttgaattgtagaactaagattttgtaaaaacagatatggtattttataatgaatatttagaaccttgaatgatctcaaataataaaataatcaacaagaaagttgtagatcttatcgagctttgcaattttgctataaaatgtcttcatatgactgtatgaaaaaattatgcatatatccgaataaaattttatccatctctgcagatatccgaataaaattttcggatagtttccgaccgtttcccattccgacggatagtatttttactgtattcgatttcatttttgaatccgagaatttctgaatagttacgaccgaatctatccgaatccgaaaaatggtccggattgacggaaactatccatacaagtttcaaccctagctataggctatgggaatggtattggagggtatttttggtactaaaagtaccagatgacgtgccgtgaaatttctcgtgagaggatggttcactcgcctattccaaaccgagcaaatacgacaatatccaaacaaaacaaacacgttgtacagaaaaagtgacggagtgagcaatcagagaattcagaaacgaagtcgccaaaaaccggtgaccggctccgtagaacaaatccaacatcggccatgccgccccgccaagaacgcgtacgcccgaaccaccccaagaggccaagacatctgaaccactacgtggtcagctttgacggaccaaccgaacccactcgctcgccctctccttcgcgccgcggcagctgcttctgctgctttaatttcgctcctcttattcccttcctttctgcattgttactccaaacccaacaacgagaattacaaagcaagaagctatctgcacgcgtggcatgcagctgctcctcctgctgctcgccgccgtcttggtggcggcagagccggctgcagcgatatcgacgatgcccatggagctctacttctcgccgggggagctcgcgcgtattgccgggtacggcgaggagccggtttcgaccgtggtcgtgtccggccaggtcgcctgcgagctctgcctctgtcccggctccgacctcctcaccttcgagctcccaggttagcaataagttctgaacagtttggtatattctacttgttgattcattaatttgatagttccagcggtgctttctttcctgattgcatgtttgatcatggacctgccttgtgtgttcgaagttgacatttaattagctgtcagtgttcttgtcaaatcaccgtgtttaagttcttttcgcaacgcctgtgtgcacagcacaaacgtttctaattgattgattagctagattcctctagctttgatagtagggaccgtagaaaattatctttatggttaatcttccgatatagtagtgttaattcttattcagtaaagaatttttatattttcaaagaggaatgtagttggatttataagaacaaaaacatatatatgacgtgaggtccctcgttgtctgatgaaccgtcataaaatgctacgaaaaacattttgcattagaaacaacatcactttgaactattcacactagatgatccttttctccgctgcgattatccgggcggtaaatgcatggtgacaagccatgacaaactttgaggacgtgtttagataatatgatatgtgtcaatgactaaattgattttgagcaaaagttcgaggaccatattgattatttaccccatgtaaatcacagaataaatgttcgtaaatcaagaaaagacactcaatatagcatgtgtggtattagacatcatgctaaatttcgagatagaactcatgtttatttttgagatatgaactgataaacaggaaagcaaaaggataaaacaataaaaaatagatggccgattgttaatttcatctctcattcaatttgctctcaacatattgtgctgctgtttagtataagtattttcttaaatatatttttttagtaaacttaattatactttaaaagtttgaaattttttgctacagtacactctagatttgtggtgtttcctccaccacactttatctgtggttatttcataaaagacactccgaccattttgtgatggagagagaaaattttgtaatagatgaatttactcttggaccaccatgcaaaatttaaatttgaaaaaaaatggttgaacttatacatattttgcaaaatgcaaaagccatcccaaattgtggtaataaaagatttcgggtgcactgcacataatgagaattaccaaaagaaaaaatcaaacaaaagaaattaaacctggaacaaatataagtgaaatttaaacatatttttataaaatgttttttacattcataattaaggacaagttccgaatgttgcaaaatattgttaaattcagttaaactttttgcaaatttaaattttacaagatttccctaagggtaaaggtgtaaatttactaagtttttccttggaattatttatttttcttcttctttttgaagaaaactaaaaaagtatactgtatgtgtaaccgtaaagacaacggactccgagtctttggagatccttccgaggtcgctggctcacatggctcacgcgtagtagtacgtactagcaggtcaccaaaagcagcagaatcacaggtcctgtactgtgctgttagcctaccatccggtgtcccgtcgctaaatagcccagtagtccccaaaataagtgcagccgtggatatccgtgctcaacgtttgaccatccgtcttatttaaaaattttgtaaaaaaattaaaaatatttaatcacacataaagtactattcatattttatcatctaatagcaataaaaatactaatcataaaaaaatttcaaataagacgaacggttaaacgttgaatgagaataatgcaaaatagcacttattttgggacggaggattaccaagcaagaagctttttttctacatgcgtactttggtatacttgctgtgttctggtgggcatagtacgagcgatggaacggaacggtacaaacactgcgatgcgtgtgctgttgacaaacgatacgtgccacgcttaaaagattttcttgttttttcaagtgaggaaacgcatatataggtagcgtttgggaaatgaaatgggaaaaagttaacggggtttgtgatgggagaaaaaattatttccctcatttcgcatgtgataggattgggttatgattgtttgcttggttttgtcaaagaaatataccctctttccacctggaatgaaccgagtatttaacctttttaagttatatttaacctttattttgagggcaggtttgtaccttcacacccattcagtacccacccccaataacccacctccttcagactatgttcggttcttttctttttttaaaaaaaagaaattgattagaagggatttattttatatctattatggcgtaaatttatttccgctcaatcccctttttcctccaaaccaaacgaggctcctttaggataattatggtgggaaatgagctgaatatttcaaaacctttttcttttccccatcatccaacaatccaaacaagggatataaaatgcaatatccaacctcttattttcactcctaccactttttccccttatccaatcaaatggcaccttagagaattttatcatggttaccttttctttttcccacaaaacaaatattcacttagttatatattcttagatactctggtggctcgcgcatgtgacattttcattgtgttaatgtatttataaaaaatataagtgaaacccactctcaattcgacacatatatatgatactttatatcttataaaaatttggacatgtttgggttaatgcccaaacaaacacaccaaaattttgtcagtgctgaaacatgtgcttgctgtttggtttcctattaacaatttttttttggtaatgccaactcacccaatacaaatgttttgacaattcatattggttagaaatcttcatatcttttggggaaacatagcaacttcatggttttagcttctggacacgataaaagttgatctttagggaaaacaatttcaaagtgtggttattttgctaccggacattgcataggttaaaatattcgtttaccagagaaaaatatggtaatgagtggtgtaaaaaaaaatttcaaccattttcacccgtatcagcaccaatgtcgtagaagcagtaaaagcagagcctccttgaaaacatgcatacgatgggttccttaattagggctttactcggagtacgccttagcagcctgaagccaataaatatatgtccttccaatcataactattaacgtttagaattaaaacttctactgtcaattttctattaaaacaagtttgcaaaatctaatatctaataattttatgatatcatgacagtattattttacaaatatactcttacgatatttttaattttaaactaagcattcacaaagttaataatggtcaaagtttcgaattttggccatttttttgtcataaattattaaatatgtatgagcggattgcggatccagtaattaattgtaacttcagttttcttaacatgtgcccgaagtggtattaagccaaaatgccattagaaatgcttcatagtagtgatagcaaattagggcatgtttagttggcaaaaaattttgcccctacatatcatatcaaatatacggacacacatttaaagtattaaacgtagtcttcgccaggaaactgcgggatgaatttattaagcctaattaatacgtcattagcaatgtttactgtagcaccacattgtcaattcatggcacaaagtaggcttaaaagattcgtctcgtaatttcctagcgaactgtgtaattggtttttttctacatttaatactctatgcatgtgcccaaacattcgatgtgatagcgtgaaaaattttatttgaaaactaaacatgcccttagaaacgaatatagtaaaataaatattttaactagtcttatccaagtcaatcgagacagagttagtttgcgtaattcattgtaaggtcaagtctatcctagaataagataaaatcaaaagaaagaaaaggcaaataaatcttgatattgattactttcagtatggcatcacaattagacagtgccataatcgtcacgcctacaatgaaagaaatggtcaggtgtttgtttggtcaacaagcacaaaccacatacagtaggctagatttgctttcctatctactactggctagtgctagtatcgcctatcatgttaaaaagctgatttagatgctcggaaacaaacgaaccagacattcagacatggactacccactacccagccgtatgggccacgacgatattgtgatcacttatcaccctgacaagtagttctgcgagcgagatgaattcacccgttacatcaaataatggcgcttgcaaattgccattcattttccgtctgtgtcaacggatgtaatgtaatttgtattttgcaaattcccattcatcgtcacaatcattttccgtctgcgtcaaatgtatgtactccctccatattttaatgtatgacgccgttgactttttaacaaacgtttgatctttcgtcttattcaaaaaatttatgtaattataattttttttattgtgacttgatttatcatcaaatgttctttaagtatgacataagtatttttatatttgtataaaaattttaaataagacgagtggtcaaacgttggttaaaaatcaacggcgtcatacattaaaatacggagggagtagtatatttgtagtttgcatagtagcgtgagcgcatgaatttgatggtctccagaaattcctttgtgatgtttacctatcgtcgcacgatatatagaaggttcagaaaggatttggtgtacaagggaaaagaaaaaaggtacgccctttatagcttggtttgagtgtgtgatgaattcgtcactttgattataatgagttcgtttgatttgaggaatggaatggacgtcacacctctgttataaaatcagccccaatatatacagaacgaagaagaacatccaaattaaacgtgatgaccatgcagatatacggtatttcttaatgagattcaactaaaactttatatcaccgggacactgattatagacactcctagctgatccaacgtattacagtacatccgggtatacatgactctcagactgactaagccactggctaggcgtacccatgccattgatactatcaccatgtggttagaatcagtgatgcatctctacttaagagagagtctaggacatagtccgaatttaactctatcatacacctattacaactctaaattctaaactgtaatcgactacatacatatattcgacatatactctgacgaaaacaacttccatgctcacttattggataaataatggagtcatttctcaaattatgtagaatttttatttgtgaggatgataccatgatggatcaattattctagatggtttgattcctcagaccaaactgcccattagacaacgtcatgacaccattgaaattgaatattttcgtatgactgaaatctagcaaacaaataccaaatgaataattgaactctagtgatcaattgacaaacttactgacacgactttctgtgcttaatcaagtattgacaaattgaccttgcaaactaaattttcttcaggagccaaggtagaagtagcctgtgaaaccgaaggccccaacacacaggcgaactctgtatttacagcaaccgatgagttcggcaacttcaccttccacctcccttctcggctccacgccacaccaagcctcgagaacgcctgcgtcgtcaaggtgctccagctccctccagactctgcatgtggccttcgtcaccgtcccgccgcctcctaccgcatccggccatcgtcctcgttgtcgtcgtcggctgatggcttccgcgcctacacggccggggtgatacggctgcagcacggcggcacgccgtccggggagtgcgtgcaggtagaggacagagtggataagtagcctaagaatggctggtggaaatcgtgcattgggcgaaacccagagatttcatcgaccgatcgatcagttgcttagttagataggagtagctgtcttctggtttctccaatttgagaaattgtatatggagaggagagcggaggtgttgattaggtcttattaccaagcatgtaaatggaaaaaatgctgcaaattaagtacatttcaggagtcagtttgagttatttctcataatgatgacgaatgatttgactaggaacattttggaaaatagaaaaaagatatagtacgttcagggcttcaggcaccattcgtcacaatctgtttgactatattccacatgtaaccaagtttccaacatcaggaaaggacctgccaagttcaaaaaaaaaaaaggaaaggacctgcctgcaagcctggttttaaacccaaaaccggtgtaaaataccggcccgcagtttttttcagctgggctacaaatgagtccttcgatgacatgtaatagaaataagtctattttgcctccctcatccttgcgctcggtcgaatgacatccctcaaccacaaaacaaagtagagcatcttccccatctctaaagaccggtacaaatcgaaccctcgggtgattttggaagcggttttatactatgtggtgcttactgtgcattcaagatagaataaaataaaaaaagtgaaagtgggccccacatatcggtctcactttctctctgcttctacccttttctatctctctagtctccctttcttctccggggtccaggaacagactgatggccggcgatgcctgcgaagaggaggagaaagagaggtcagcggcggtggatccgccttcccgtgcccccccacctcggcctacggcttaagcagctcgccgacactgcaggggcattggcctcagccggggacatatcatagatgaaccggagcagcatggcggccatggtgcggcacactttgtgcatccagagcgtaccagagcatcccggctccgactgttctaatcaacaccaccgacgctccggaacaacgtcggtcatgaaagagtgagaagtgttcgatgcagaaaatgtaaacaaaatgtacttttcccttactgcacagtctgcagtggcttctgttggatggcctggtccatgcgccggatcgctctcgtccccttggtctccggtggaaccaccgccaacgtcggccatgtgagaagacgctgtgcggctggacggcctctgcgtggctagatggagaagacgatgtgcggccacggggaacgcattgagggtgacgatgggggatgaagtggataaccccgtgatatgctgtgggcccacatcgcgtgggtgtgtgtatctttgtattctaatgtgtacggtagataatgcataaatgtcactcgagcgcgggaatacatactgagaggaatttctatgcacgaatcactaggcacatcgtgtggtgcctgtctggggtacacatcccccctgcagataaaaaacttccgccggtcacgacacctaatagctggagaagaggcatggccggcgcaagactgccttgaggagaagcataacagagcctaatcccagagcaaaaccggataggaggcggaggccgatctccaccgccacggataggatgcgaagtgcgaggtgtggggggacgggcaactggatccaccgctgccgagctctctctctcctcctcttcgcaggcatcgctagccgtagtctgttcttggaccccccgagaagaaagggagattgaaaagggtagaggtggagaaagtgagactgacatgtggggcccactgttattttttttggctatctagaatgccacctaagcaccacttaggacaaaaccaccagaggagccaattttgccggtttttggagatgggagaggtgttatatccggttttacggttgagggatgcgattcagggcaagagggaggctagacatcccatataatatgttttttttagttcacattttgtatagaaagaggcccatatctaaaaattggtccataacattcgcaagtaatacacccgcagtcaaatcaccttagaaaaatggcgccgttaattctcaatttcataatatttgggcagatgacctcgttactctttttttaaaacgagaaaccaagaacatttggtctttatattaagagaaggtttcttacaaactcttgcgctttcattcttttgatcggacgcccgattgaaagagtagaaaatcagacgccccgattgaaagagtagaaaatcagacgccctctctacctttccatactatgctaggaagcaaacttacacttaggggctgtttgagatgggagggacttattttagtccctctcaccaccttactctccctggtaccatacggcagtgtgctacatgtagtctgcatgcacatgcacatgcatatcctactagagcttctcatcacttctcataaatatatttttaaatttttaaactaccttttctcttaaattactcattttatttgtgatccgattgcaccactatatttattataattaaatcttcacaataagttgtcacatgactatatttcgagacttcaaaataaagcaatgtgcaacatttaaaagtacattggaaaattagcaaaaatattttttcatcgaaatataatcgtgtgagatcttaatataaaattaattataacaaatgcaatggtataactataatcatatcataaatcggataaatattttatgagaaaaaatattttaaagtttgttaaaagaggtgattttatatggagagaagaaaaataatgtaatgcataacggcagcaagatgcaacactaaggccatataaagagtattagggtgcatgacatatatagggcaacaacgctcggaggggcgctcgatatcttttcgttgcatcggtcacccgtcttgaatcaatttccatgcctattgcctctgatgaccattagatttttcctttccaaaataaatatacttcccagtgctacattaatattaaacacaattcccaatattaaaaatattcatttacaaaaaacaaaagggatagaattatttgaccacgaatttaggaaaagaagcatatatatatatatatatatatatatatatatacatcaaatttgattaaattaatatgactttagaaattaaaatgtttataattaattaatcccttcgatccaatagttctacgggcaatcccaacctaaaaactactacatttgtttttcatatatgatgtcgttgacttttaaaataagtttgaccatttgtcttattttaaaaaatatataattattatttattttattgtatttgatttataatcaaatgttctttaagcatgacttaattttttcaatatttgcacaaaaaatttgataagacaaatggtcaaagtttgttgaaaaatcaaagatgtcatatattaaaaaacagatgtagtatcaaatagttttcatacttgctatgttatgtatgcaatatatatagaaattatataactagtgagtggtttcttcaaaataaattctcgtccaatcacctctcttctttctacttttaatttttatccaccaatctctttttttcttagttcctatgtatagctagcttcttacatggaaatgatttttcatcttttctcatctctccttattaactctcttgtcatctctgtctttttttaatgtgacaatactattaaatgatatgtaaactataggattgggactgctcttagccaattctcgtcaaaactagtttaaaaaagattaaatttcataaaaccccatcaactactactatagtccaaaacgcacaaaaccacatagttctacacatactcccaagtattatggtgctaaagtttcacaaaaccacactattatccaattttatatactcctatatgaaaattttaatttttttacttacatgcatgtaacatttatacgatagataaaaacttataaatttaaaaagtgattgtataacttaataaagctgtagtagatcaaagttaaaatgattaatattgtggttctgtaaaacttttttagccctaatacttgggattaagtaccacactagaaaattagcgtgccgattggcacgctggtaaatttatagccctgtgtgtattatcatgtgtactacataagttatgatttctaccaagcaattgctttcagtttattaaaaatatcaacatggtcatggtacttgtcttaactgtatttgtctatagatttttcaacaccgtatgaaaattgttggtgttacttgcttatgtacatgtaaattcgcttattttatcttaattttcaattaaacctatagtagattacatctatttgaagatttttttaataatgagaatcttgctacaactttttggtgcttttaatttcgctatttactgttttattttctagacatccaggatgttactgtcattgtgttacatgcctcgattttgatataacatgaagtaattgcatttccgaaaaaacttaccgtgtgctagaaattctaatatcgctccattccttttatatttattccgttttgtattgctccatccggtcagaaatatttgaccaaacatctgtaacttgtccactgataacttctcatagcttatatagcttagtttatcaaacatgggaaaataacatataaaaaaatattataaaattactgtcataatcttatgaactcaaactgatgattaaagttcataaaattgactgaaaaatcttagtttaaatgtaaaatatttttctatcgttggagtacttatttttcttttctattttttctttagtattgtgtttgctaggcatgcacacgcctaacacatgaaaagagactttcttgatgagagtttgatatgtgagaaaacatctagtgtgttttttattctttttcatgctataagggtatatgggcgtcaggccctgatgtgcactagggttcccgatcttccgaaagattctaataaacaacgatttgggcagagtcgcgacacaaatcgatccggcttcttgaacgcgcatgctcttgagccccgcaatcgcagcaccacgtctcctctagttatctcccgtgccgaaacgcggatgacctcgccgagaaggctaatccctgtttgccaatcgaagaacacaaacaagaacgagatagaaaacaaccaaaattgcagatgaatgattaagctcactagttagggtcttacaaaccgatctagcggcgaaactgttctcgacagattaatctaagcaaaacccaactctaaatgatgacggctacggattaagtacgattaggacgtcctagggttgccctagggcgcacacccccttggctaagcccacgacacaattacaaggcccaaaacccgagtcagattcggactggatgagatacgtggcttgttttgcagattcccggcagctcggtaggaattttgatgtgggaccaaaaccatatgaaaatagactccataagctttccaacaagtactcatgggccccgaaattccttctagatcagcggctaagtccgtttgaagatgatgctgtcaggaggcccgaatccgaatccaaaacgtgtacaacttgatctcttgtcttctgtggaccaaaagtgacgtggtgaggtagaagtagacttggagaaggtcttggtttggtcctcaatcaacttctttaatcatctatgcattagttacgttcggtctcttttccttcgcccaagcaagtacctctgcaaacgaaaacacacaaaacttattgtgtagcaacgtttgttcaaatatataacaagtaaatctaatgtagaacatatgcacctttatttgattaatacataagatagtcatggttatatccgagctagttatgtcctcctcatcctccccttcttggttggaaatcgtcctcggtttcaccttgtcatggagcgtattgtacttatctttgtctatcacaacatcctgtgcggaacatttcttgatggccatatgattggatcctaaaatctttgtagtcgaaaagccacaacactccccttcttgcaaaccaacctgtaacttttaaacaactagaggaactagatagagaattacttatatgcatgcggtcctcttgacaatacatttcatcatgaaaaggaggtatagtcaaattcaaacaaatatatactcgatgcacattatattctcctttactatcataattgccaataatatgaaagatcacatctgaagggcatggcaattcaaatctagcaaataatttcttctctaaacagttgagtgaacaaagatcatcaaattgaatataaccccaagtatttaaagaagatagctatgtaacctcttcattctcgctagcaatgtgaataacatgtttaaactcaacacatggtgtctctactatagaactaacatgttcattcactagttgtgacatagatataagtgaagcatcgcacaactcttctttatcacaagaaacatcaaacaaattattttgtgacaaaggtatttcagcaattgcttccactataggttgctctagtgtagcataagtagtgaacatagttggcacatcataactatgcataccttgagcagttgtagcaccattatctttacctttttggtcatcttcagaaattgtaggcgcttggtcaattaaacattcctcaagcatgcatggagctatggatagatctttttgctcttcgtctttcttctcttccacctcattaccttggttgttctcagatgcctgcaagatattagtatccaaagcaataggcacaacaatatgttcgttttgtaattcagacttggttgaatacatcacaatagcatctttcctggtatctctgaaaatctcatcgattccattcttcatcttttgaagattatcttcaaaaatttcagtaaaactcatgggtaccaatttcattttctgaccattatatctaaatgtgtatgtgttagcaacgaaattatgcgaaccattattatcatatacccatggttgaccaaacaacaaagaacatgcttgcatagggacaagatcaaaattagtagtatcatgataatttctaatcgaaaagtttattctcataattctatttaccttgaacttaccacaagagttgaaccatttgatgtaatatggatgaggatgcggttgtgtaggcaactcaagtttctcaaccaaatctgaactcaccaagttattgcaactctcactatcgattatggtacgacatgctctatccttaaccacaaactttgtttcaaataattcgtggtactaccattgctccgctttctccatttgagaacttagcacttgttgcaccaaagtactgtcatcacgtgcaccttgttagtatcgctgattttgagcgccactcatacctgtcattgcaaacacaaaaacaacaacaaacaatgaaggttatccctaataatctgctacgcggtgtagtggtgccccgcaacaactcagccaaatggagcaccttaccaagctcttacaagtgtcttaccagcaatgctaagaacggtacaaccagtggctggtttgtgacaccttgaaggacgtgatgtggcaattgcaaggatcaaagcggtgctgaccagaagtatatatgtggagcttgggaggcacaatatatagtagcaaaggaatgcaattatgctaataagaaaatgcaaagttgaataatagttcaaagtactagtcaatgtgctggcctagcctagactcaactctagctcaagcaagcacccgacaccactaaagactagatatgaatcaatgcacaactttgcactctgataacatactcaaaggatgaatgattttttttctttcttggtgcggctttttttaagcacctttctgcccttttttttcttttttttaggtgcggactttttttttgcacctttctgccttttctttctttatttattcttttttttactttttttttcaacaaaaactgaccactgaccttgaacatggattcaaatgtaaatatgaatattacagggactcaaacgcaaagtgcaaaactaaatttggatcatctcaaaaatggattgctcatatcatgtaggttccgtttttataaaaatatctcaaatccgctgcttaacaattgtataaagaggataatacggacagtcacagatacatctgatctgatccggagtttctcttcaaccgtacagtattccccctcgcgcgcacagtacacatgcacagtacggcaactccaaaaccgtttgataaaaatttctccaaatcacaaaaatggaaacccgatgagagacgattcaatttttcaaggtcccggcaacaaccaacaagatgcaaaactggacccaaaattgacgtacaactcacacgtgataaaccctagacacaaagtgatgaacagatgcaatactcaaaactaaaaattaaatctaaaactaaactagcactcgacacgacgatgcaatctagaattcaacaaagcaaaatctaatagaacaatgcaacggctcaaattgtctaggtaaagagtaaatattttttgtgtggcaattttctggttatgggaagataaattacctaatgggcaaccgcgctctgataccacttgatgcactagggttcccgatcttccgaaaggttctgataaacaacgatttgggcggagtcgcgacacaaatcgatctggcttcttgaacgcgctcgctcttaagccctgcaatcgcagcaccacgtctcctctggttatctcccgtgccgaaacgcggatgacctcgccgagaaggctaatccctatttgccaatcgaagaacacaaacaagaacgagatagaaaacaaccaaaattgcagatgaatgattaaacttacgagttggggtcttacaaaccgatctagcggcgtaactgttctcgacagattaatctaagcaaaacccaactctaaacgatgacggctacggattaagtacgattaggacatcctagggttgccctagggcgcacacccccttagctaagcccacgacacaattacaaggcccaaaatccgagtcagattcggactggatgagatacgtggcttgttttgcagattcccggcagctcggtaggaattttgacgtgggaccaaaaccatatgaaaatagactccataagctttccgacaagtactcatgggccccgaaattccttctagatcagcggctaggtccgtttgaagttgatgctgttaggaggcccgaatccgaatccaaaacgtgtacaacttgatctcttgtcttctatggaccaaaagtgacgtggtgaggtagaagtagacttggagaaggtcttggtttggtccccaatcaacttctttaatcatctatgcattagttacgttcggtctcttttctttcgcccaagcaagtacctctgcaaacgaaaacacacaaaactcattatgtagcaacgtttgtccaaatatataacaagtaaatctaatgtagaacatatgcacatttatttgattaatacataaggtagtcatggttatatccgagccctcatcaggcccatgcatgtatgcaaggcccagctgaatgccaggccctcgtatgagcgcaacatagcgttcttttttttcttttctcgatctctcccgttgcaagtatgttcgcctgttattttgcgtggaaaccgattccgtgaatagggacgtgccacatggcttatctctctagtgattaatttgcatagaattctttttataagataacaaaatcctatagttttatgcaatttagaacgcagtacctataattaagtgaaatttactcttaataataaaaaaaaagcccccaacgaagtctctgctttgccgatgcgaccggtctcacctcccctacccacggcaggcgccaactgagcccggcgcttcccgtccgtctcccttcctccaccagtccaccctctctcctttccgttccgttccgtcccccaacgaataaaagcgcaccgcgtacatgccttccaccgtgtcctccaaagcaccagcgccggcaggagggccccccgccggattcgattcccggcacgtccttctcctccctttctcgcgggcgccgcacgccccttccccctcctcctcctcctcttggtctgatgaatggggagagcctcctcgaccgcagctcctccgccgacgccgccatgaacgacgccgtgcccggccaccgccaccaccacccggttagcgtcttcctccgggacgccaggttgttaaccgagtcatcggtctatcgatttttttccctttccatctatttatctctgagtttttattttcttgggggtcctgttgcaggttggcgttcaggtgggacgagctcgggagggagatcatggggattgcggtgcccggcgcgctcgccctcatggctgacccggtcgcctcgctcgtcgacaccgccttcattggccacataggtttgcttctcttctctccttattttccttattttttttaattttttccccttactgctgacttcgttgtgaagtttccaccaccagttctgacctgctccaggtgggattggaacgtactctgttctacccttcggccttggtcgcacgatgtaattttaatactactagatttcttttcagcttggagcaaacctaacccagttcattccgttagtggtaggaattaaggtgtggtgtttggtcctgactattacgaaatttatctggctgtgctggtaatagatctcgcttccataatgtcgaacctaaaaaaatgaagcagtagtttgtaaagtagtagagtcttttgccgacatcgtggctgatggttgccattgtttagaatattgatactaaccctaatatttcattgctaagtattaaaacaaaattttaatgctttcaattcaagggttagtgtgtagttatgtagtacggtgcccttaaatgtcttaacatcaaagttgattgtcagataggttttttattgatgaattctgtaagaaagcaatcaaaaagcataaagttggataatgaccattgtttaaggtcaacgcaaactggccatattttatattcagcaagtatgtatggtaatactaatgaatcaatgtcatgtaaaatagatgtagaattaattactgaagtttagaccattactaattcgtagagaattccaattggctttgatttatatttagtttagctactttatgtcttgaaattgagtttagatcttctacggctaatttgctttcttgatgtgcttacatttgacttcaccagttagctaagaaagtgcttctacgttatcaagtagtaatttgccaagaagaaaaacagcaccccctgcagcagccacccatggcttttgtgttagtcaacccatacattttttagtttgtaatgtcaaactgcctactagatgttggcactagactacatgttcaccgttatcccaaataagattattaatgaacttaatattgctctttcatttatttttatttatacatttcagcctgctttgaattttgtatgaactttacttcttactgtattgtaatagaaaaaaagggacacattctgattttcaagtctttgacttattttgtctcaagttaatttgattccttttgttcaaaacaggcccagttgaacttgcagctgttggtgtatctattgccgtgtttaatcaagtatcaaggattgcaatatttccccttgtcagtgtcacgacatcatttgttgcggaggaagatgctacatccagtgacagagaaaaatatgaaataaatggcgagaatgaattcaatgtttcagacagtgaaatggaagagctggtttctcatgaaggtaaaacagttctaatcttcttttaagaaacattagaaattaaacaatgcttatttctttgacactcaatcttgccaccagaggctagtgctgctcccagtaagtcgtctttcgaaactgactcaagtgatgtcaaaattgaacataagcggaaaaacattccatcggtgtctacagcattactacttggtggggtgctcggccttttacaagcactgcttcttgttatttgcgcaaaacctctcttaggctacatgggtgtgaaacaggtatatgttccttcataccatttcctttgtggtaaaatcaattattttgtctaatcgtaaagatgtaaacatcaaggattgagtcatcattttttcctgtttttgaaaaatctatcaatggatgttctttatcaaaatttaataactgagaactcatctattattaagtttagctctggatagttggatgtgcacatatatattgtaagtacgaagtatcactaatggaacttaatttttcatgtatattatgatctgaatgaaattgtagcaacaaactagtgtattggtgagtttcatcattaaggacttctatgattttggttttttaattctagaatacactgtttatttattatttttcacatcggagtcctttttctactgaaattttctgatagggctctgcaatgttgatgccagcactaaagtacttggtagtcagatctcttggtgctcctgctgtgcttttatctctggcaatgcaaggggtatttcgtggacttaaagatacaaagacacctctttatgcaactggtacagtatttccttgactgcagaatggtgtatgctgtatataatcaaaccaagtgtctaaaataatgattatttaaactgtcccttcaaagtcattctacttgtggtggaatactttaatactttcttttaagttcgcaaagttaaggcaagatgacatgatatgaactggtgggatcaaacacttatgacctaccgtacattattcatgtaataaaatgcatgactgtagaacatgtgtctcttgtagatggtatatttaaatgcatgagatgttacgattagtgaataatttgcctcaggataatacatatacctaatggtgttaactctttttataccagtggctggagatgcaaccaacatagttttggatccaatatttatgtttgtcttccagtatggtgtcagtggtgcagcaattgctcatgttatatcacagtatgtagcacaattctctcttataatatcattgttttttacccgtgaagttggatgacaaactatgtccaaaagtatataatacctttcttctacctcttgtgatagtgtatggtggaaaattctgcagatatttcattgcatccattctcttatggaggttaaggctacatgttgacctacttccacccagctttaaacatatgcagttcagtcgattccttaaaaacggtaattcttttctaatatttttgggttccaactaagacatggccctttttttttgccacaaaccattttacaatacctggtcttcataggatgataattattaatatccattttctcgtatgcattcttagatttgatttttttcattgaaagtgcatacttaattcaaaacagcaaattaactatttatttccttttttacatttgggttatgcctgcttgactttcacattgttttagcacataatttcattctaaacgcaagttgcccttgcttgtttcaattattttacttgaaacatttctggttatataaaactcgttctcacttttcacacttcaggtttcctattacttgccagagttattgctgcaacatgctgcgtgacactatctgcatcaatggctgcacggctaggttcagttccaatggctgcatttcagatttgcttgcagatctggctggcttcgtctcttcttgctgatggattggcttttgcaggacaggtaagggaacagttgtctccactcactccaatgctgacaatactgaaggtttctattgaaccttcattttaatgaaaaattctacctcagtaactgcaccaaagggtatataattgagttttctaaattatctaacgttggaaacagataatgagatgtatcagcatgaactgaaatgaatttgcattttgttcttatgcatctggatcatattttgacaggctatacttgcaagtgcatttgctcgtcaagaccattctaaggccgcagccacagcttctcgtatattgcagctgggattggttttaggacttctcctaagcatttttcttggcattggcctccgtttaggatcaaggttatttactgatgaccaggatgttctacatcatatttacctaggcataccggtaaactttctttatactgatgccaaaataattacaattttaagtcatattgtagttaggattcctcagttgtgtgcgggagcctgatgttcctttatgatatctttcctactgtgcattgggatgcctgcctactgtcagagttacctggaatttttttaactaaagagttatttttcctgttcagtttgtctctctgactcaaccaatcaatgcgttagcttttgtttttgatggtatcaattatggagcatcagattttggatatgctgcttattcaatggcaagtcaactagtcaacacctatgtccttctatctgtattttcaatcctttttttttcacatatttttgttgaattcattgtcctcagattcttgtggcaattgtcagcatcatcttcatagtcacactagcaagttacaatggttttgtcggaatttggatagctttgacagtctacatgagcctccgaatgcttgcaggattcttaaggtacaatcagtcaaagcattatcttttctaacctgagtatttgattacaaacctttattacaatgacaaacaatagttataagtcttcagtaatgattgctacaaccagaatcaccaccaaacagttcacaggacaccactacaccagctttctcccagtctgcacaggcacacaccctaaaagctaacattccatagggaacatcacaatctggcaattcatggtcaggaataaattcacattgacaggatcaacaccaccctgtgataaggaacatcaataagacgtgcagccactagtctcgtgccctcgccatgcccttcccccatggctaaaacagaaaccactttgctctagcatctatcaactcgaatgagaatagatgctatcatgatgaggaccaatacgagtaacagcaagcatcataccccagctttagagctcaacaccaaggaagaaaagttgctgattataagaagtgatttgtgtcaacgtgcacttggcaaataaaagaggtagctagaatgtagtaatgtatccccgtgaggccgtgacagacgaagcaagaaaaataccaaaactttgtgctatatgcctacaaatgtagtttcatctcaaatacgaaaataaaaacttaaattcgttttatacctactgcagtgtcattcgttttctatattgattttacaagtttgcaataaatcgctatactaaattttcaggatagggactgcacgaggaccatggactttctatgcagctcaacgcatgcattctcatgaggtggttggactttgttgaacaatactataggaagacaccatggatactttgtaaggttttgcaggtttggtgggaatggaggttgtttgaacaaaagaaaatattcaactgtcatgtacatagataatcacacatgttactactattctaatagattctcccctgtcgtgtatgttgtatttgcccatgtatagttcagtatgttcggctggctattttgtaacaagtttggatataaagtcacgtagcataagatgtttgcacaccgtgagatatacggagcattggcatttgatttttaaaacattaatggaaattttaccagatgccaacgacaagtgatcggttctgtgaattattattgacggacaagtttttgaaactccgcatgttgctgcgagagtttagtaaaatagctagacgacatagcttacataagttgatatgatttatgataatttaaaaagtatatagaatgatgatttaaatgtaaaattaaggtgatatggctttataagagaagaaaagaaggaagataatttagttcatagattaatcatctaagaacttaaaaataattgagtggtatagccatcacataaccacgatccgaagccacaccgagcaatcacagaactacgatccgaaataactagctttatacctgtcaaggttggatgcggccaagtggtgagggtgagaataatccgaagcctcctggactctgacctgtcaaaccgaacaatcacagaaccacaatctgggactaatccacacaagagacccgagagccaaaagcacgaattagggggcaccagaggagccttctcacaaatccaaaagaactcacaagaacaaaggggtaagacacttatgtagtcttcagcaatctctcatatatgaggatttcaattgaacaaaagttatctaatggatggagtagagaggtatttatactaggaacatccctcctagctgaggttgtgaatataagaagccacgttctgatggtcaaggctaacataaatgagaatgcaaagcgttttctcgggttcgcgcacatccctttagctcctgcacaggcttcagtaaaaatgccataactttttcttggaaaatgatattgaggtggggtttgatgcattggaaattagatttgtccctctttccaaccatgtatgcatgcaacccgtcttttgactggctgggtcgcacaagccttggaagttgagcctttgcagcgtaaaccatcttcttgttggcgtagacagctactggttgggcatgaactgattcctcctcgacgtaacccttgtcgtcctcaacataacctatccttcttggcgtagtgatgatatcctcgggcgtaaaccttagcaatacaaaggtagagcatttaggtagtataaaattctcactaaaatttgggttaagttgagcaaagagcgagttcacctcttgttgtattttcctagcatggctgcgcataattggaccatgatatgcttgatcgttcttggtgaaatgtaatccatcaacttgatttacgtcatcttcattttcttcatgtgatgtatgacgtaaaccatcacccttgtttacgtcaagtgtagctgggatatgctcatcaaggagcatccttagttagcaggcaagttaagggtctagcaactaaagtgaaatgtttaatcaagcgccgatagaaccttgcacgagctaggaagctatttactcctttaacattggtaggatgtggaagctgttgaatgacttctatttttgttctatccacctctaccccctttcgaggactggtgttctaggactataccttcatggaccatgaagttgcatttttcctaattaagtaccaaatcattttcttaacaccgttgcaagaccatatctaaatttatgagacaataacaaattttttttcatagactgagaaatcgttcatgaaaactttcatgatttccttgatcctgttggggaagatagatatcatagacctttggaatgacgcaagtgtattgcacaacccgaacgacattctacaatttttttatagaaatgttgctttaaaatcatactacccattttttaagttttttttagctaatacttaattaatcgtgcactatcgttccgttttccgtgtgggaggtgagggttcctaaatacagtctaaattgggatggaaggagtaacattttagggcagaggaagtacagagtttcatcaaagcagccctgcgaagtggcagcatcggagttttcctaatgcgcgatcgatcgtgcgccctcagtacagagtttcatcaaagcggccttgcgaagtagcagcgatggagttttcctaatgcgcgatcgatctcccgcgccgagggcgcgcgatcgggaaagccacatccgtcccctaacacactcctctcctcttccttctcccttattctcttcctactacaccatacatttaaaaaaataaaaaaacacaagttagagaaaagttaaaaaatagaaaaaaaatctaatactcttatttatatgcatagactatatacttacgtacagactttataccgtaaacatcgcacgtataaactttatgtacagaaatactatatattaaaaatatttgaattcaaattcaaatttgaatcgggtatataaacttctgacttataaactttgggtttataaactttagctgtaaaaactttagatgtataaactttagatatataaattttaggtgtacaaactttagatatataaagttactaaaataataaagtaaagcggtgttaaaaaaaggaaactgcgtggggagggaactgatcgcctagcgcgatcgatcgcccaataggtttttcggctgcgactcactcagtcgctccctcgacaagttcacaaatcgtctccccttctccgaccatccaatccatcggttcggctcaagtgctcaaccctccgcagatcgccaccggctctttcgcctgatctcatccctgacgctcctcctcctcaacccaacacatgtgccttccctccctctccctggctccaccacctcgatcttccgacgtctccaccccctgctcgttcaatccaacaccgacgccccctcccccttcggcccttcccgccaccatccactaccttggccttcgcccacggtcccctccatctgatgctgccacttccgcctcccccaagtccctttctttggctcctctttcccaattgcgctcgttcacaaacttgagcgacgacagagcactgggcatgggcgagcttcgattggaagggcacttgcagaggaatgataagcaagtgcgctcgattgacaagagacgtgtctggtttctaatgattccattgaggtatagtatctctactttttttttcctttttcattctgttttagataacaaatccatcggattttgatgattggtggaacgatcgtattgtgttgttttctctgagtaaatttatcaaaaccactcgttccgtggtacaagtaggagaaaaccactgatactttgacagttggcacttaattagtgctcattgccacaatctcctttgtgtgaaatttactccagttacttcattctccttatccttactgccatatttatattttaggtcttaattaaagtacaagcacatgacaatccactataacttatactatccactcaattacaaaagggcaaaaggctgctatgagtagttttgccaacgggtatgtttgatgatcaaaaggtaaaattaatgttcatagctacatgcttctttttttaagacatttttatcatctactccctccgtcccataatgtagcaacctaggatgggtcatcccatccaaggactaggatgggtctcatctcatcctaggttgctacattatgggacggagggagtagatgcctgataaagtgtcactatgaaaagacccttaggtcgtttgctgggaacaatgttgagcatttaagttgtacagccagctacaactttatgatgttaaagttgtattgtgtttggcaacccaaggtgtgtgctaatatgagatagaataatttatcttactagatccaaatctattatctatgtaacaagttcttaaaataactgttgttcaattgttcatccctggaaaccttacctccatcctccatcctcataatccgtgatggtctatttcgtattcaagtaaaggacaaaaatacttaaactaagctcctttatatatgttatggctgcatggaggtgcaacgttgcattaagaaaattggtgataggaactgataacatgtatcttccattttaaattctgagcactgatcagtcctgctaatatttatggcagtattttagaatgcattatcttcatagtcaccaaaaatatagttctttagctgggtaccaaagtggttcttggcatgttgatgtgctgcaagcctgcaaataaatatcgtagagtattccatcaggctatcctttatctattgtctgctatctggtaaaagatatccttgatgtctccatggtttgtgattggaacaagtacatttttggcccttgaactcttcttgaagtccattttgcaccatgaactaaaacactatttctttttttccgcaatcaactttcaaaaccggacaaggagtctatttttggtggttttatttgcgatgacagtggttttgctagtgtagactcctattacacattttcctgatgacgtagttaggttacatcaatatgttaggagctacgattcgtggctccaaaacacacacacacacaagggatagagatggagaagcaacactggaacagagaacaaccagagaggaacagaggagcagatagagatagattggattaattcttgcttgccattaaccttaaacactccggctcttaatagccttacaatccaactaatggcgctaaaaggaagggataaaacaacttaacaaacttcaactaatgttgctaagataaagggataagcagcagcactaaacagccgtgccgcccggccctatagctcgtccggcaccaagcccagcttgctgcttgcgccggcggaagggaattccccacataacatctctccccccctcgatcagtagctcgtccgcgagctggaacgagggatatcggttgcgaaagtcgtccaagtcctcccaagatgtggccgatgccggcagtccttcccattgaaccagaagctggcgcacccctcgagccaaacgggcgcgcaacacttggcgaggaacaggttgggccgctccatgctgaatgggtggcaaagccagtggtgccgatggcgacacacccacgaacggcttgagcagtccgacatggaacacatcatgaagccgtgtccccggcggcaatgcgaggcgatacgccacctcgttgatgacggcgacgacgcggtatggcccgtagaagcgaggacgaagcttgcccttgacagcctccgggagggacgcaggaacgcggtggcgaacgcggagccacacccacgcccccacctcgaacgacacctcccggtgcttctgatcatagtagcgcttggcatactgttgtgcttgttccaggcggagacgaacatcagcgaggaatgcgtcgcgctcctcaatggactgtgccaccgctgccacccgtagctcgcttgcgtcgtatgcccggattgagggaggatcgcggccatagaccaacttgaacggcgtgtcacgaagggcggcgtggaaggaggtgttgtagatgtactctgcccacggcagccagcgcagccactggcgggagcgatctccggtcatgcagcggagacacatggcaatggccttgttcacggccttcgactggccgtccgactgtggatggaacgccgtactgcggtggagcttggtgcaggtggcggtgaagagggctgtccagaacgccgacgtgaagacggggtcccggtctgaaacgatggactccggcaccccgtgtaagcgcacgatgtcgacgaagaacgcacgcgccaccgtctccgccgtgtacgaatgtgcgagggcgatgaggtgggcgtacttggagaatcgatcgacgacggtgaggatgaccgacttgccgccaacgcgtggaaggccctcgacgaagtccatcgcgacatcggaccaaatggcagatggtaccgggagtggaagcaggaggcccgcgggatggaggtggtccgtcttgttgcgctggcaggtgaggcagccttggatgtgatcgtggacgacacgccggtcgtcgggcgtgtggaagtcgcggcggagtcgatgaagtgttttttggatgccctcgtgtccgtcatcatgcgccgcggcgacgacgactgacacccatggtgagcccggcggaatgtagatgcggcgcttgtaggtgacgaggccgtcgatcaccgcccatggtgttgtgcgcgtgccggagttgatctcgtcgcggagggcttgtagtgccggatcggtgtcccccgccgtgcggatgtctttgaggagatcgaacgtcggcgtggagagtacgaaggcctggctgtctggtgcggcgcggcaagacagagcatccgccgccgcgttctgtttgcctggcttatattcaaccacaaaatcaaaccccaacaatttgcttacccaatgatgttgcgggatcgtggataagcgttggtcaagaaggaatttgaggctgtagtgatccgtcttgacgatgaattgccgcccccacaggtacggccgccagtgtcgcactgcttgcaccaagctgatgagctcacgctcgtacgcggcgagcgcgtgatggcgtgtggcgatgggccgactgaagtaggcgatggggtcttcgccttggtgaagaactgctccgaagccggtaccggatgcgtcgcattcgaccacgaatgggcggttgaagtcgggaaggctgaggaccggcgtggttgtgagggcgagcttgaggcgctggaacgcatcatcggtcgccggcgcccatgcgaaactgtccttgcggaggagctgcgtgagtggagccgccacggaaccgaagtcttgaatgaacttgcggtagtagctggccagaccgaggaagccacggagttccttgggcgaacgggggcgcggccactcagctaccgcttgaatcttggcggcgtccatggcgaagccgtgctgcgaaatgatgtggccgaggtacgctacgcttgggtcgccgaacgaacacttggtgtgcttgacgaagagctgggctgcccagagcgcggtgaagacggtgcgcaggtgctgcaggtgcgacgtccacgttgggctgtagacgaggatgtcgtcgaagaagaccaagacgaagcggcggagaaacggccggagcacgtcgttcatgagtgattggaacgtggccagtgcgtttgtgaggccgaacggtatgacgagaaactcgtagagcccatcgtgtgtacggaacgccgtcttgtcgatgtcgtcagggtgcatccggacttgatggtagccggaccgcagatcgagcttggagaagatggcggcgccgtgcagttcatcgaggagctcgtcgacgacggggatggggtatttgtctttgactgtgcgctcgttgagagcccggtaattgacgcaaaagcgccatgacccatctgccttcttcaccagcagcaccggcgatgagaacgccgacgtgctccggtgaatcaatccattttcctccatcaccctgcactggcgttccagttcgtctttgtggcggacggggtagcggtacgggcgtaccgccaccggggctgtcccgggcagcaactggatgcgatgtgagcggtctcgggccggcggcaatcctgtaggctcggtgaagacgtccgcgaattcctccaggagggagtccagtagtgccgctggagcgcacgccagagcacggggtcgctggtgtcccggcaacccgtggagcgtgacgcggtgccagaaggacattgtcagcaccgtgaaatcctagaggatcggccccaatgtcgcgagccactgtgttcccagcacgaggtcatagccacccagagtcaggacgtaaacgtccgtggcgaattcctcgccggcgatctgtaaaggcatgtcggggaagacgccggggcacgccaccttgtcgccgttcgccaccgtgacgttgaggcccatgcggggctgaggagcccgaccgacacgtgccgctgtatcctgagacaggaacgtgtgcatcaagccggagtcgatgagggtgtagaggtcggtgtcgccgaggtgggccgtgatgtgcatggcgtcggacgcgcgaactccggtggccgcatgcagagaaatccggagtgtggcggccgcgtctgcttggtcggtggcggagtcgttgtcggtgtcgtcctcccccaactccaggaagaacaatcggcggcacaatcggttgtggccgcgcgaatagggctcgtcacagttgaagcagagaccttgtcgtcggcgctcatccatctcctccggtgacaggcggcggacggtgcggttgatcgcggtggcgtgcctgccggttaggcggcggtggccggctctggagccggcgcctgggggttggccgccggaggaagtggtagtatgccgcggccggcgtgtcgtggcgggcggggtggccgggctgcgagttcgcggcgttcgaacgaacgagcaagactcatggcctcttctagcgtcgtcggatgctgcatctgcacatctaaactcatcggttcctgcaagccaaccgtaaacagttgtacctgttgatcctcggagaggtagccggtgcgcgtgagcaggtcaaggaaacgctcggcgtagtcatccaccgtggtcgttcgccggcaggctgccagctcgcccagaggcgtcgagtgcagaggtggaccgtagcgcatgttgagcaactccgagaagcgatgccacgaaggcggttcatggtcacgttcaaggcgagtgtaccactgttgcgcgccgtcgagcagatggtaggaggcgagccagactttgttgtcctccggcgtgcgttggccccggaagaattgttcacagcggttgaggaaggggagcggatcgccgcggccgtcgaacttgggaaagtccaacttgtggtagcgtggaggannnnnnnnnnnnnnnnnnnnncggtggccgcccggacgtccatgcccatgaaagccatcgccgccgcgaccgtagcggtcgccgcggccgacgttgtgatgggcaaagcggcccccattgcgatcgccgacgtcgctcaggtcgtcgaagcgagaagagggagcgcgggcgccattctccaagcggttgatggccaaggtctgggtacgttgctgctggtcgatgtcggtgatcaggccgctgagctcctccagccggcgcatcatgtcgtcgaagcgttggcgccaaacgtcgtcgttagcgccggccatggcagaaatggaagcggaggatcggtggagactgataccaagatgttaggagctacgattcgtggctccaaaacacacacacacacaagggatagagatggagaagcaacactggaacagagaacaaccagagaggaacagaggatcagatagagatagattggattaattcttgcttgccattaaccttaaacactccggctcttaatagccttacaatccaactaatgacgctaaaaggaagggataaaacaacttaacaaacttcaactaatgttgctaagataaagggataagcagcagcactaaacagccatgccgcccggccctgtagctcgtccggcaccaagcccagcttgctgcttgcgccggcggaagggaattccccacataacaaataaatgaggccatgcatgtgatttctgtgtttcagttgactgcaagaaccctccaagcaaatgatgcagattatatttcaggatggagttctctaaatatactttaagatcagtgctatacgtactaaaagtttcttataaaactcttacaaacaaatatcttaaccattaatttatttactcagttggtagttatgaaaaatcaagatacaagtacatcatgccatataagttctaaagagtcagtaagattctttttggtatgtgtcattttccatctttaaatagtgtatcatccatcatgttagaccagattctattttagtgatactaggaacatgacgtacaattaactttgccaactatgtgaaaaaaaatgaagcatcattccagttgttacctaatgtaattctgatttctgtattagcagctgtctaattatgtttttttcttcacttaatttataaactttaattagaattacatcctaatgatagcatctccttttgtgtacagttgcacttcaagggtttagcagaattactcaaaacatttcctgtaactaatgaatttgacaaaaaaaattgtaagagatgttgatggtcttgtgatttaaatccttaagtatgtctttaataacctggaataatctacaccaatttttgtagtgttatttattccattagtaaaagttggtgtgcattcatgaattaaatatcaaacgatgtttgacaattattcttaccatttgacagatgccactgggcagataattaaattattgtttaaattttcatgaacttgatatatttacgcaggttgatgttccatcgaaaacatagggtcctcaaacgttactactaacacgaaggtgtaaaaatgccagtgccctcttatatgtcaaattgaacataaatcactgcgagcaacaattattctccctgcatccaggtaatctacatgtttttttttacgtgaaagcggcaagagtattgccgaatatattagaaggagaagtgcgggttgcatagttgttacaagtggactattacagtatgaatgtaagcaactcacagaggtaaaagctgaaaatatcagcatatcgcagcttataacaaccgaatcgttcaaggaggttggaaagtgatctggttttcttggatatcatcgttgatttgctgagcagctctttggacgttcggttcttcccctctgaagatcttcgcgtttctctgcagccagacacaggtaatctatatgtcaatctgcaattacatacaaatataacacaacactgaaagcaaaactcaaacagtatcaatcaatgaccatctaggttgacggagtcaaaggcatctgtttcggttgttgctgataggtttcatgtcatttttttcagataatgaataggtttcataccagtattagtatagcttttcgaatctaagtaccaatttgtggtttccaacaatcaggttcaaatctagatacaaatttgtaccgtacagcatttaggttaattggttaatcatgtttagaggggcaacgtgaaaaacacaagcatacttggtttgtggaaaaggttgattctgcactagtatttacatcactttccagtccaacttttacacttttgagtgggctagatgggagaggaaacttaatcacggagtgttaatgtgtgtgttagttggcagtaaaaagatactgttatcagcctgggcttaaattgacctgttttgatatttcagaatatttgataaatgcgaacttaatttttgaagtccttagtataatttaaaattctgactaaccaaacttaaaaccttataatcatacaatatattagaaaccaaatttatttaggtacacttaaattccgcaaatcatatactggaccttggatgtgttctgttatgttgcttgcatccatgccatgcaaacattagtgttgccatgttagctcttgacattgctcactcatgaccaacatactaagcatgcaaatagttttgttgtgaaactacctctaaacgatgcaatgctagaaccaaggtatgtattacgaaaaaaaaaaagaaccaaggtatgtatttacctcttcagagataagtgcctaagtggagcgtgtcagaaaaattcttttcagtaagcgcttgcatgtctgcctgccacaaaatggggcatgaatctcccaagatatctttcaccactttcctacttgcatttgcatggcatgtcatacactccggaataatctgttgaatagactttttgtgatggctttgatttcttttgaaacaacttgatgtctttattttccaatctaccagcgcctacaagcttctggtcctaacattacgtttacgattagtgctttgtgcacttgcttttcttttcattttgaatgggaacagtaggaaaggatcctactatagtttcctgcacaatctcactcgggtaatcgggttgaccaattgtcaaggtcttgggtgtagaacgcaccatttgcttgcatgcacgatggaatgggtagataaaacattaaggcctatatatgcagccccgagaagtaacactgtcttgttgccaatgcatcatacacactgagatatggcgcttggatttccagaatgcatatccgctgttgtgttgatctctttgtccactatgattgctgcttcttcgggtctgagtatgagcaacagcagcaacactgacctcactgcactgatggctttcaaagcgcagctctccgaccctctcggcatccttggaagaaactggactgttggcaccccgttttgccattgggttggggtctcctgccgccgccaccggcagcgtgttactgctgtggagctgccagatgttcccctgcaaggagagctcagccctcacatcggtaacctctctttcctatctgtactcaacctcagcaacaccggcctcatgggttcagtcccggatgatataggaaggctgcatcgcctcaagatccttgatcttggtcacaatgacatgttaggaggtgtcccagccaccatagggaacctgacgaggcttgatgttcttgatctcgagtttaacagcctatctggtccaatcccagtagagttgcgtctctcgcacaaccttcgcagcataaatatccagatgaattacctcaccggcttgataccaaatggcctattcaacaatacaccttcattaaaacatctaatcatcggcaacaacagcctgtctggaccgataccaagttgcattggctccttgccattgctcgagcgccttgtccttcagtgcaataatctcaccgggccagtgccaccttcaatctttaacatgtctagactacatgttattgctcttgcctcaaatggcttaactggccctatcccaggcaacaaaagtttcatcctcccgattctgcaatttttctccctcgactacaattatttcactggtcagattccactagggcttgcagcgtgtcggcaccttaaagttttttccctgcttgataatttgattgagggtcctttgccctcatggctgggcaagttaaccaaactcaatgtcatctccttgggtgagaatctccttgttgttggtccaattcgagatgcactaagcaacctcaccatgctgaatttcctagacctcgcaatgtgcaacctaacaggagccatcccagcggatcttggacagataggccatctttcagtcttgcgtctttcaacaaatcaactaacaggacctattcctgcttctcttggtaacctgtctgcattatctgtcctgctattggatgacaaccacttggatggtttactaccaacaacaattggcaacatgaactcattaacagaacttattatttctgaaaacggcctacagggggatctcaatttcctttctgctgtttcaaactgtagaaagctttctgttctatgtatcaactccaatcgtttcacgggaattctcccagactacctggggaacctatcaagtacgctggaatcattccttgcatccagaatcaagttaagtggtaaacttcggcaaccatttctaatttaactggcctcaagctgctagatctttcggaaaaccaactgtttagtgcactaccagaatcaatcatggagatggagaatctccatatgcttgatctcagtggaaataacttggcgggctccatcccatcaaacacggcaatgctaaagaatgtcgtaatgttgttccttcaaaataacgaattctctggctccataatagaagacattggcaacctcaccaaattagagcacttaagattatctaataatcaattatcatcaacggtaccaccgagtttatttcaccttgatagcctcattgagttagatctgtctcgaaacttgttcagtggtgcattgccagttgatataggtcatctgaagcaaatttacaagatggacctctctagcaaccactttcttgggagcctgccagattcaattgggcaaattcagatgataacctacttgaacctatccattaattcattcaatgattcgattccaaattcttttggtaacctgactagcttgcaaactttggatctatcgcataacaatatttctggtaccatcccgaagtacctgtcaagttttaccatgctcgctagcttgaacctatctttcaataatttacatggtcaaataccaggaggaggtgtcttctcaaacatcactttgcaatctttagtggggaactcagggttatgtggtgttgtccgtctaggatttgcaccgtgcaaaacaacctatcccaaaagaaatggtcacatgctaaaatttttactccctactataatcatagtagttggggctgtagcttgttgcctatatgtaatgattagaaagaaagttaagcatcaaaagatttccactggtatggttgacacggtcagccatcaattactctcctaccatgaactagttcgagctactgataatttcagtaatgataacatgctggggtctggaagctttggaaaagtttttaagggccagctgagcagtggtttggtggttgctataaaagttatacatcagcatctggaacatgccgtgagaagtttcaatactgagtgtcgtgtgcttcgaatggctcgacatcgcaacttaataaagatagtgaacacttgttccaatctggactttagagcactagttcttccctacatgcccaatggaagcttagaggcactcctgcactctgaaggaagaatgcaattaggttttctccaaaggttggatattatgctagacgtatcaatggcaattgaatacctgcaccatgagcactgtgaggtgatcctacattgtgacttgaagcctagcaatgtactatttgacgatgacatgacggctcatgtatcagactttggcattgcaaggttgctgttaggtgatgacagctccatgatctcggcaagcatgccaggtacagttgggtacattgcaccaggtactataccatactcgtagcttttttactctttcaagtttatcttttttactgccattgagtggtttattactaactttttttattgagtagagtatggagctcttggaaaagcatcacggaagagcgatgttttcagctatggaatcatgctgcttgaagtgttcactggaaagagaccaacagatgcaatgtttgtgggagaactgaacaacaggctgtgggttagccaggcatttcctgcagagctcgtccatgttgtggacagccagcttttgcacgatggctcatcttctactactaacctgcatctgcatggcttccttgtgcacgttttcgagctgggtttgcactgctcagctgactacccagagcaaaggatggcgatgcgtgatgtggttgtgacactgaagacgatcaggaaggactatgtcaactggatggtattaatggggagcactgcccagcagtgatctattgcccttgtctcctcacagtagaatgggttttcgcttccgcattaagaataacacaacaatagcgtcagctgcatctgcatgcctgttgattaccctttgcttctatatttgtactgttggatatatatatatatatatatatatatatatatatatatatatatatatatatatataatgattatatacacccgggtgtatataatctattgtgcttcttcagttcttcctaagcttcaacaaacattatttagttggagtgcatgagtaattttcatttgagaggtgtgagtgtgactgagtgttctttttacatcagtgtaacccaagtgattgatctgctgcttaaatttgcttatttccaaccaatacactaacctagaaaaggaatgaattttcgctggtgccctccaattccagcactgttttccatatatacatcgaatacagttttaacagtggcgctccaagtaggttttctgatcggtgttggttatgctaattttggtctgttcacgttaatttcaaattcacctgtccatgagatgttcggtagtactggacccgttagcatttaacaaggacgtttgaccatcgatcctacttaaaaattttatataaatgttatttgttttgttacatgtttggttactaaagaaattttaaatattatgctttagcatatttagattaattttttaataatttacactatgtttggtactactatttttaattatatattaatgctattaacttttagggtatctatctatctatatctatattaattgggcactttctagaagctctcacattaatcagactaatctagccgttgattaactagatcataaaatcatgttcatagattaattactactaaaaaaagcccatgagcttggcactataggtgtcggaataactaaaaccgacacctgtagtgccttttcctcctccacgagttgaaaacacataaagctggtacttttaagtaactatagatgtcggttctaaagaaaaactgacaactatagtataggtgccggtttttaaaaaaacccgacacctttaatatgttataggtgactgttaattaaaaacccagtgccagatcctgctggaggggaggcggtgggcgacgggtggcagcggtgccctccgctccgccggatctggcgggaggggaggcggcgggcgacaggttgcggcggcgccctcccttctgccagatccagcgggaggggtggcgggaggttttttaaaaaaacccgacacctttaatatgttataggtgacggttaattaaaaaccggcacacataataaattataggtgtcgggttttttaaaaaaccgacacctatccaaaccgcgtcgagctatcgagccgatccaggccgacacatcggccttatcctatatgagcgtaccttatcctacctctctccatctctcgtctctatctatctcgcctctattggctatatctctctctcggctctctcacttctctctcgcgcgcatgggggagggcagatagcggcccggcggaggcggcagcgacggcagtcgcgccctccccttcgccgcactactagaaaaggcatttttcccaacggaagggtctcattttcgcaggcggacatagcccttagagccaaatgaccgcctacaaaaatataaatcggaatgaatatgccggtccgcctacgaaaatatattttcgcaggcggcccggtagatagccaaaaaaaataacagtgggcggcagatgtcaggcttacttggtccacctctacccttgttaatctacctttcttctcggggggttcaggaacagactacggctagcgatgcctgcctataagccgaaatagagagcctcggaggggtggatccacgtgcccgtccacctccaaccttgagtttggcatccctttccgggggggggg

SEQ ID NO: 68614 - DNA, 19849 bp, Oryza sativa
  unsure (1)..(19849): unsure at all n locations
agaggaaatcgactnnnnnnnnnnnnnnnnnnnnnnnnatgaacgacgccgtgcccggccaccgccaccaccacccgcttagcgtcttcctccgggacgccaggttgttaaccgagtcatcggtctatcgatttttttccctttccatctatttatctctgagtttttattctcttgggggtcctgttgcaggttggcgttcaggtgggacgagctcgggagggagatcatggggattgcggtgcccggcgcgctcgcccttatggctgacccggtcgcctcgctcgtcgacaccgccttcattggccacataggtttgcttctcttctctcctttttctaagtctcaaaacgcacccctccctctcatctctcctcccctcccctctcctccccacggccggcctctcccacggcggctacagcgcgtccggcggcgtgggccggcggcggagacgacggcgcgggcggcggcggcggctctcctcccccctccctcccagatctgggagaagggaggggggaggccggcggcggcagcggcgacgacgaagcgcgggggccgctgcggcggctcccctccccctccctcctagatctggccggaggagggaggggggaggccggcggcggcggctacggcgcggggcggcggcggcggcgatgacgcacgcgcgggggccgcggcggcggctctcctcccccctccctcccagatctggccggaggagggaggggggaggccggccgcggcggctaccgtgcggggcggcggcgtccaccacagcgtgaggctggcgtgacgacgacgacgcgtgcgcggggccgcggcgacggctcccctcccccctccctcccagatctggccagagggaggggggaggccggcggcggcgactatggcgcgaggcggcggcggcggcgacgacgacgacgacggcgcggggcggcggcgacaacgatgcccggcgcggctcccctcccctcccctcttgcctggcgtggcgacgccggaggaggatggcggcggcgaccgccgcccgtgattttttttttgtttttttgaatgtattttcgcaagcggattgttgccccaactgcgaaaatggatgattttcgcagtcgttgacctccgcctgcaaaaatcactttttgccgcctggaaagatattttttctagtagtgcgcgccctcccctccgccagatccagctgaaggggaggcggtgggcgacgagtggcaacggtgccctctctttcgccggatccggcagaaggggtgccggaaggtggtggcgcaagagggaaggctgcgggcggcgacagcgccctccctttcctacctctcatcccagtatattgtagaattcgttggtgatgtttttgtgaatttgttcattctgtgatgtcaatttattttggtaatgatttgtggatgatttttgggtttgggatactaatttgatttggagatgggcgcatgcgcggtgacggcgcttagtgagttcggctcgaattcgagctggctctctgtttttttttggcttgagcaatgctaaaggtgtgagttctatttttcttataggtgtcggttgttagcattggtgccgaccaattggtgctggatttatgtggcacctatggtcctttatgaaccggcacctttgaccttttttaagtagtgataaatattataaccgtggatttttgaagcccaacaacgtatttgggtctccattcaatgtccgttacatatgcttccataatttgtgtgtatcgtcgtatcgatctctgctgccgtgttagactccgctggtgacaagatcaggacacgcatgctacagaccctgcactcgaggatctccgtcgaccaaacgcagtgcggtcgccttggcagccttcgtttctcctagaagagttgaataaaattttgtatactcgtgatatgtttttcaaactgctaacgatatgtttcgtgtgaaaattttctatataaaagttgctttaagatatcatattaatccatttttcaagtatgtaataattaaaactcaattaattacacgttattactacctcgttttaggtaaaacacttaatcttcttcatcttcatcttcaggagattcaaacaccacctttgttaagcaagatttgattcaagttaatatctgcagctactatatcttcgttttaatttctcaagcaagcaagatatattcgattcaacttttttgggttttgtttagttcttttttacatgtttctcatctgaaattacgtataaattaatctcaggtatcatgatcttcatagccataattttgagggagtttataaggtatattcatttgcttttaagttaatttctcccacgtccttcgtaagcaaccaataggcttcactgtggatctttcatatttttctttttgtctttgcagatctttacaatatcaatattaacttaattctgaaattcaaaagtattaattagcatgtgtacatcttttaaccaaaaccacaatattaacagactaatgagtatattaaacttaagatgaaaattttattatttaacatattatattagacagtataatatagggttggcgattagatctatactaattggatattttgtattttctagaagctctaacgttaagtagaaacatctgaccgtttatcacataaattatttaatcattgcagttgataattgctgatctaaggccatttaaagcccttctactctaaaggtcttcaaaagctattcaaggcccagtagtccagtacgttaatagctcatctcatgctctacacattgaacctaatggacaggacagggaatatgcagaaagaccattcctaacctaacgactaaaatgatatccatagcattaaataagctgccacctagaatgaaatatgatgtgacaagtgaataaataagaaaaaaagaaaaaaccaggtcttgcatacaccatatttaagacatcatgtgagataagtagcattaaatttaagtatagaatagtggtttttgcattgaaagattagtgtctagtattagtttcttgataatgtggagtttatgaaactatatctagtgtcttgggttgggactggcctaaacccttaagcacttgcccctagatgccatgtagactcatttgctgatgtggaagagagagggaaggagagagtgaacgagccacctctcgtgcaaggggtgacctttatacacacttcaataaaaatgtgagagcattaaatttattgaggtttgtgtgctagaggtaacttattgtatagattacctcttaatttatagaaaggtgatagagatgaaattagaggtgacaaccactcaaattgctctaacagattaggatcacaccctgatcgaatgatcagcagcgatttgggcgccatgccgccatccaaccagcattgtgagcaaatcgaggaacgtatggcatgtgagacttcggcagcgacgaaagtgtggagattatgggtatcccatatctacacggcgatggtattcgaactgggtacaggatacctaatgtagatagaatatcttatctgtatcttgggtttgtttcttaacttgtgtatcaaggaaacaccctgagacttagtcggttacgactgtattttacctgtatcttcatattccgttagggatatagattgtcttttgtaatccggactccttcccatatataagggggggtccgggcgcctctaggggcatatgctgatttttcccgaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacagttggcgcgccaggtagggggagcgtcaagcttttcgccgaccagtgcaatgggtcctttctccggcatcgacgacctcgtcttcccacccgggcagacgtttcggttcggcagcctcgacttcatcaccgacaacttcggcaagatttctctctttgactcggaatcggaccagtcgggagagaaccggatctcagtcccgtttggattcccaaacgcggctgaaacctacttcaagaccatctcaatcgagtcggcttcaaaccactcggctgagatcgcattttctccaatgacaccagatcaaggtgatggggcttacccaccggtcctgatgaagctccccgacgatttagcggccgtctccaccacgacagcgtcctcatcccgtaggcctaggcggaagtcggcttcaacaccgatttcgcctagcttcagggaagtcggcgtcatcctccaaccactcggcacggtctcgacggatcagctagatgaccactacagctctcccaccgtcgactcgcgccccaccgacatcgtggagtacgacgaatttagttctcgctacaacgacttccacgacttcgacgacttcgacggaagcctagatgacgactacacccctctctactttggcgttttcatggccaataacgagacggaggagcaacgccaagcccgggagaccgaagagcgtcgccgactggaggaggagcaccaagcacaagaacaagaacggctacggcgtgagcagcaggaccgtgagcggatcgcgaaggaggctgaggatcgacgtcagcgagctttggaagcggggcgccgagcgcgtgatctcatcggccagcaagatgtcgaagggacaccggttttccgcacccctcaacagaatgcggttgccgcgatcaccctcctcgacaccctcctcaaccaaaacgagctcaatcgatccgaccacgtcgtcaacatcttgaaccagacgaagaccatgatcgcggcttcggtcccagttaactccgaaagcgtccacacgccgactggcagccgagtcccccacttccgatctcatgactaccgtcatccaagcctcagcatcaccggcgcaggatccaaccgcaggagcaggggccacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccagaccgccacgacgacgaccttgacggagtagcagccttcaccgacgacctgcgtcgagtggattggccagccggcttcaaaccgactggaatagagaagtatgacggcaccactaaccctgaatcgtggcttaccgtctacggtctcgcaatccgcgcagcaggaggtgacaacaaggccatggcgaactatttaccagtggctttagcggattccgcccgatcttggctccatggactgccccgtggtacgatcggatcttgggccgaattacgcgaccacttcatcgccaacttccaaggcaccttcgagcgtcctggcacacaatatgatctttacaacgttatccagaaatccggagaatcccttcgagagtatatccgacgattttctgaacaacgtaacaagatctccgacatcaccgacgacgtcatcatcgccgcattcaccaaagggattcgccacgaagaattggtcggcaaatttgggcgcaaacctcccagaacagtcaagctcatgtttgaaaaagccaacgagtacgccaaagccgaagacgccgtcaccgcatcgaagcagtcgggtcccagttggaagcctaaaaatacgccggctacgggaggaggtggaagtaacaaccataaggaccgcaagcgtaagcctgaggaacttgttgcaaccgctgctcactcttctcgacagcgttcgcgcgtcaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaaaaaggacgacggcgacaccccggctggatttcaagaccaccgcaaggagctcaaccatattttcggcggccccatggcttatgagtctaaaaggaagcaaaagctgaccgaacgggagatcaatgctgttcagcccgacacgccccaatatcttcgatggtcagagatcgcaatcaggtttgaccgctcggatcatcctgaccgagtggtccacccggggcggtaccccctggtactagacccagtggtccgtaacgtcaagcttcgcagaaccctcattgatggcggcagtgcactcaatatcctcttcgccaagactttggacgatatgcagattcctcgctccgagttaaaatcaagcaatgcgccttttcatggagtaattccaggattatccgcaactccactcggtcagatcactcttccggtcacctttggcactcgggaaaacttccgcacagagaatatcagctttgaagttgccgatttcgagacagcataccatgccatactcggacgcccggcgttagccaagttcatggccgtcccgcactacacgtacatgatgatgaagatgcctggtccccgaggagtcctaaccctacggagcgacatcaagcaagctgtcacatgcgacaaagagagttgcgacatggcccaaacccgcgagatagcgtctgcccgagaggaaatccgactggctgcaaccacggtgagcgaaggagaagtgcccgctgccaagatttcaaaaagtggggaaaccgaagccgagactaaaaagattcccttagatccttctgatcctaccaaaactgctgtaataggcgccgagttagattgtaaataggaaagcgcgctcatcacctttcttcaaaataataaagatatttttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagctgttagcagcaggcttcatcaaagaagtccttcatcccgactggctggcaaacccggttctagttcggaagaaaacagggcaatggcgtatgtgtgttgactacactgacctcaacaagtcctgccctaaagatccttttgggttgcctcgcattgaccaggtagttgactcaaccgccggctgcgagcttctcagttttctggattgctactcggggtatcatcagatccgactgaaggaatccgactgcttgaagacttcattcattacgccttttggggcatactgctacgtcaccatgccgtttggattaaaaaacgcaggagcaacttatcagcgcatgatccagagatgcttttcaacacagatcggccgcaacgttgaagcctatgtggatgacgtagtcgtcaagaccaagcaaaaggatgatctgatcttggatctagaagaaaccttcgcgagcatccgcgccttcaggatgaaattaaaccctgaaaagtgcaccttcggagtaccgtcagggaagctgcttggttttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatctcaaacaactcctcaccaagccgccggtcttagcttcaccacacccgcaggagccgttgttgctgtatgtatcagccacctcccaggtcgtgagcacagtcttggttgttgaacgtgaggaagaaggccatgtccagaaagttcagcgaccaatttacttcgtcagcgaggtcctggccgactccaaaacgaggtaccctcaggttcagaagctgttatatggtattttaattactaccaggaagctgtctcattactttcaaggtcactcggtaacggtggtcacatcattcccactcggcgatgtactccacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccctgtggagaaaatagagcactggaccatgcattttgacgggtcaaaaagactttcgggcactggagctggagtggttttaatttccccgactggagaaagactaagttatgtgctttggatacatttttcggcatctcacaacgtcgccgagtatgaggcgctccttcatgggctacggattgcaatttccctagggataaagcgtctaattgttcgtggtgattcacagctggttgtcaaccaagttatgaaagagtggtcctgcattgacgacaatatgatggcatatcgacaagaggtgcgcaaattggaagacaagttcgatggactcgagctcagtcacgttcttcgacacaacaatgaagctgccgacagacttgccaattttggatccaagcgcgagacggcgccctcagatgttttcgtcgaacacctttatacaccgaccgtacctcataaagataccactcaagatgcagacacccgtgacatagctatggttgaagccgactggcgagagccctttatacgatttttaacttctcaagagctccctcaagacaaagatgaagccgagcggatttcaaggcggagcaaactttatgttttgcacgaatctgagttatacaagaaaagcccttcaggaattctgcaacgctgcgtatctttagaggaagggagacaattgctgaaggacatacattctgggatatgcggaaaccatgctgctgcgcgcaccattgtcggcaaagcttaccggcagggttttttctggcctactgcagtgtccgacgccgacaaaattgtgcgcacatgtgaaggttgccaattttttgccagacaaattcatctgccagctcaagagctgcagactatcccactgtcttggccgtttgcggtttgggggctcgacatggttggcccgtttaaaaaggcagtcggcggttacacgcacctcttcgtggccattgacaaattttccaagtggatcgaagctaagcctgttgtcacgattacagcagataatgctcgcgatttcttcatcaacattgtgcacagattcggagtacccaatcggatcatcaccgataatggcacacaattcaccggcggagtttttaaagacttttgtgaggactttggaatcaagatttgctatgcctccgtggcacaccccatgagcaatggacaggtggagcgagccaatggcatgatacttcaagggattaaagcacgtgtttttgaccggctaaaatcctatgccggcaaatgggtgcaacagttgccatcagtactttggtctttgcgaactacacccagtcgggccacaggccagtcaccttttttccttgtctacggggcagaagcaatgttgccgagtgaagtcgagttcgaatctttgcgcttccgtaatttccgtgaagaacgctatggagaagaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggagaattcaaaccacacgagatcggcacaagttatctcctctatgggaagggccatttattatctctgaagttacccggccaggttcatatcgactcaagcgcgaagacggcactctcgttgacaactcttggcacattgaacatcttcgtcgtttctacgcttaactttatcattgtatttccctattttgactgtcaacatcaagttttcttcttgccgttgtcagtcgggggctatcatcataataatggagtgtgattttttatcaattcagtttgcttacttggtttatcattgccttgtttggtttttctacttagtttgcgaggactgaaagtttttaatggcttctttgggttttaggctcaacaaagcttagcaaaaacttttaagaaatcacaaactttgcaagaatcatcaagcacagcataaatacaccagtattgtacaaattgagcctccatgtattacattcaaactcagtcggaatcagttctttcatcatcagattcatcattactcggctggaggtcgttgttgcgaaattgctccacaacatcactcgcaattttgtcagccgcagtttgcgcactactgataagatcaagggcagcttcttcgcttgtcccgtctgcaaatccatcaatggtgtcgatttcaattctcgggtacaaggattttgtcatcgccaaggccatgccagctcccatacttccagctttcttgatattcttgaaatatacttccggagcaacactcagcttgtcaaatatttcggttgcgtcgagtgcactcggaccaccattattgaggaacatggcttggataagtggtgcagcggcattggcgacgttatctcttgctccttcaagcctcttgatcttaccaaccaggacgtcaaactgagcttgagatttgatcttgcgatctacaaaacacatttataataagaatctgctgcattaaagagaggacagttcaaattgtcagctggcagtaccttcaacctccttcaaggctgagtccctttctgcagcaagttctaccttgtcttttttcaaggcttcaatctgtttttccatctgagccattctagtggcttgcgctgtttgaaatccaagtgtttgaggatacaattatgatagcataaatcaatggaacagatctggatgattaccttttgatgaaccacttagttcgaagtttgcatcctggagctgggcgattcggtcccttagctctttctctgtctttttggcgcactccttggcctcatgcagctggtccctgactgcttctagagttcccaaatgaggaaccagcttttccaaagttgtagtcttggcctcattgcgaagatggattctctgcatgatggatcatggttcagttctgctaaaaagaaaacaaagttaccgaaggccgtcactcggaagacttacatttacaatacgagtggcttctccgagcgctttcttcagctggcacacttcttcatcttctttttgacggtttatgactatgccggcggcttgtgaattctcgtcccaccatttgatcaagataggaggacgagagctgtcggtcgcctttatacgagggatttcttctccgtcatcacctgatagtcctgatgtgtttccaagacattagacggataaactgaggttatttaaatcgccattgtttgagaagacaactaacctgaagatgtacctagctgggcgtgaggtgatctttgttctttacccgaagacccagctatcgagtcgttaccagcctctggtccttgcgaagtcgtcgtctgcgcttctacttcggggatctcttgattagggcctgcgtccgactggtttccagtcgggggctcttgagttgttgccgtttcagttgttgccgactggtttccagtcggcggcaggtcactcggattcgccctatctcccgaagcatgggcgccagtcggctggctttcagccgtcggctggttttcagtggtcggctcggggtccttggatatgttctgctctgtcatagccggatcagggtcttttccagatggatctatatcagatggtttcctgcagagtgttctttcagtattcagcatcattttcatgagcaaaacatgccgaagcggaatcataccgagaggtctaatacctggaagatgttctgatctttggcattgcacggccagccagttttttcctgggcatggtacgctttgggggtttactaggcgagcccttatccccagatttatcatcgtcgccttcatcatcatcaagtaccagttttctcttgcgaggacctgtttgaccagccaatttagaggtctgaggttgcgggtctggtctgatcgttggccctccacctccctgagcggtgtgttggcgaggagaccggcgctgagagactggtggatctgacttcatcaatgcatattcctgcacaagatgctaccacggttaattaattcaacatgaagacaagatattatttcggtcataagttgaaggattcagatacatacctgcggaggcggattgaatgcgttgtatggcacgactggcagctggtgtgagtagctaacgacgatagcattcgagaatatcttgtacatcctctccttcatgattttaaagtctagagagtctgggtcttcacggtttggatcatgcttgccgtcgaattcgaatgctgtgcgggatctttccttgagtggcgccagtcggcatttgatgaagtgccgagtgatttgctctccctgtaagccttgttctttaagatttaacatgcgatccagcaactccaaggcttgtgctgcttcatctccgattggaagagagttccaaatatcttggtacactggaggaagacaagtgtacccgggaagagcaggctcgggattctgaacatagaaccagtttgcatgccatcctttgttcgaggtcttgaagggcatcgagaaatatttttggctcagagttcccctcagttggaatcctgcccccccgactacgcacggtttgttcttgtttggttggggcttgaggaagaagatccggcggaatagggcaaagtgaggtttgatccccaaaaaggcttcgcaaacatggacgaaattggcgatatgcactatggaattcgggtttaggtgatgcaagctgattccatagaaattcaagatcccccggaaaaattttgaggtcggaagagcaaagccgccgtagaagaaatgcgagaagactacgatctcatgtgtatcaggggtcgggaaagcctcaccgcacgctggccgccacccgatgatctccttggctgggagaacgccgtgcgccaccatctccttcaggttctcctccgtcacgtcggacggcgcccattggctttcgaagctttctctctcttccgccatcgatttttctcaaatgtgctgatttgattcgagggatggcttgggagaggtgaggaattgaggcggtggatcacgggaaggattttgatgcacttttcggaggtggatttggccggagttgtgaaccctagttcaccggcgcagcttttcactgtagcaaggagtggggaaaatggcgagagttccggcggggaagacgaagcgtcgcttggatataggatttttcagttaagggtatcggaggtgctaatgggcctaggcctgaacagtacttcagcccaatacttttaacagcgtggcccattgtgttccttagggacttaggcatattttgctttggcaatattatgcgcacgacagtgttgcccaatgctgatcaaatcctttttatgcggtaatataattctttggaattattgcaatgcaaattaaaaaggtgcccgacagaaaggcgttatgctgtttttgcaagcttttttaggctacaaaagctgtttgggttaactaggaatggcttgtttttattatagtcatttccttggtatgttatatacctattttcattatggtacatagtcatggcctaggctattcgacttatttattaccataatcttcataatacttgatgggtaatctttagagtttttattcggatgcctgtcaagtgtgttcattcgtgaaccttttagagtgtaaaccactcggatttcttttattatggctaaaaagcagtcggctagcatgcctatttaggcgccgcgtacgcttttgtcatataatgcacaattgtgttactatattgtctttcaactatatgtttagtttgttaactaatcacatagttgggggctacacctaattaggtgcatctattcgatgcaccatattctttatcttttcgccctttacagtccactcggcaggttttggcttgaagagtttgaagtactcggattatcatctttgagagggctacgatggtcgactgcaaaggactcgggggctactgtggagattatgggtatcccatatctacacggcgatggtattcgaactgggtacaggatacctaatgtagatagaatatcttatctgtatcttgggtttgtttcttaacttgtgtatcaaggaaacaccctgagacttagtcggttacgactgtattttacctgtatcttcatattccgttagggatatagattgtcttttgtaatccggactccttcccatatataagggggggtccgggcgcctctaggggcatatgctgatttttcccgaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacagaaagctcctccaatcggcgacaatttggacttccatcaagcggggccccagttgccctttcatcccaatcgacatcgattttacggatctctccagctcaggtattatttttgtcattcaagattattaactgcaatatattggttgtttatttccatgtttccatacaacacatgttagaaacagaagatcgccctaacattgttgaatgacatatataaataatttacgaatgatatatataaagaacaaaatgatgtttgatgaataattgcaagttatcccttctacatatttagttttttataggatttcttaaaaataatggatcagcaaaaactggagaacaaaacaataatccaaaatatgaagctgtacaaaacttcacgatgcgtagtccatgtggggaaaattgatgaataaatgttgtgttatgcattttgccaaaaaaaaaaaagaaaattccgagatgattgaatccgaatcctggagtagctactcctacagtagctaaccgacacctgtccacctccaattgggtttcgggtcttgcttcaggaaaagtatccactaacccaccgatgcagaaaataaataataaaattgtatttcgaaaaatcggtcaaccaaccgcaccatcattatggcctgaatgttctgcatgcaaggccttttgaatgttctgcatgcaagcctggatattctgcacgcatgcaaggccgtttaaccaggggagtcgttagtgttgatcttgccgccgggagctctatttaagacgccgacgagggtagaagatgcggtaggagtgagcagatgcatcaatggttcagcggcagaaatctaatggagcagaatccggtggtggcagaaggcaaaaactagccgtcgagttctgtcgcacagcagaagccagcggtggccggtggcaggaggccgaacaacggtgacgagttctgtcgcggagcagaagctggtagtggcaggaggcgggacgttgacggcgagttctgtcgtgcagcagaagccgatggtggcagggggcagaatctcattaggtagttctatcacgtagcagaagctggtgtggtcgcagatggcggaacctcatcggcaagttctgccatgcaacagaagccggtggtgcaggagggcatatataagtttaccgaaggaatgcaaggttttgcagaacacaatactcatctacttattggattgatttggctatggcagggtacgtgtggaagagtccaatttgtatatgttctgtctagttcttttctcctgtttgtgtgattagttgtgacggtgttttgcgttcatatgtcaggaatggttttgcacattccatggctgctggtgatcagagtgaagcgatgatcgctctgttcggaaatataacatccattctgatggaagtcatcctcttcccataattaacaaatgctatgaagagatgcgcatggtgttcacttcatgatagtcgcacaacattcaccatgtattttagaagctatgatgtagtaacccgggcacaacaggaatgcttcggaacatgtgtccttggagaacatgtagcccgtaggctaatgaatggaaagtattgaaatactcgctccatctacttttgatagtcatattttatcttagcacacggaccaaggataagtaattctacttatcatccatttaaacatgctactagtcattcctcgtaaacaatcaattcattaatatttacatttctcaatacccatgtaaccaatcatgtgtggaagaatggagagtcatgcgttaaatccgagaaagtcattaagaggataggttgttggattgaaatatgcctatcaaaaataaatttttcaggtttagaaatatgactatcaaaagtagatggagggagtaatggcttgctttcttcatgactatagattagtagtaggaagtgtcccaatatatgtatgaagttcctttttcttcttatcgagatgcaagtaatatttgagttgagttatatgtaacatctgcatgttggtcagtgcaataaaaatgagtacttttagctgattgtgttaagcaaactccctattgtcatcttaattgaaagtgcagaagaactcgatatagttcttgcagaatatagtctagtaaaatggaatggagacatcggaactgatgcatgtgagtgtatgtggctgccatattgatcagatgaataccagaggtgaccttctgggttcttgtagatccaatagatggaaaatatcaaatgaatacggaagccatgcgccttgctgctggaattctccatgccagttctttcaccatatgatctgcaacacagtcaccggcgagggtacaaatcttagttcaggagggttctgaactctcctcatgcagagaacgatttcggaatgatgatgttctgctcgtcgtcaacaatgggtcaattatcctgccttctcgctctggataaacaatatgaattgcgaataaaccatccgaatatctctcttgttagctcattgccgttcgaatttcatatctgcactagactcggaaagatttgtttgattttcaaatatgctgcagaggaggaacgatttttattgattaccaagaaaaatatatctggttaaatgaatcgggtgggattatacgagtacattaaacccgttaacagttgttaacataccccatgccagcgattatattgacggtggataggaagagagtagctactcccggtagtagcgtataatatatatatatatagacacacactagcaaatatgcccgtgcgttgcaccgggtaaatatcaaacaaatattgatgggtaagattgtttgtgtacttataacacatgtgcacaaaaatattgaatttgtacatatcttgcaaatatctccaaattttatacatacgagttgtgcaaatcgtgtgaattccgtattgtcgtattgatctagagcattactgatgagccatctatggtgataaatttggagggtgtagcccaatgaatttgcatttgctatatatgttagtgttgatatgtcactactacaaccatcggcgaccttccccgggattcaagcctgttgaccccgccaatgtggcggcgatgcagggtgccgagatgagcgccacggggctattcttcctgtccagggtcagcccccgctgtgtggttgctgcggtgctcaggctgttgaggcgaatatgaggcaccatccaataatgacgggagaagattaataaggccacaacactcaaggacgtggtgggcggtgtcgtggaggtgctcccggtaaacaagctggccaccagggaggacgcctataaggtgcggtcgccgctgcgcagaacgacaggaggcatgccagtggcggcagggagctaacacgatccattcaatcccgatccgagtcaatcaagaatccaatcccgcaccgtgcagatgtgtttttcttttccgcggggaaagcgatcaccgatggtagggacaaagtgcgtgcgagaacgcattctacaaagtctaggtcagtccggagcaggccaggagtccaagtttattcacaaagacccattctacaaagacccattctacaaccaggagtccacgtccttccacaccttttcctactctccttttttttttttctttcattgaaacctttcgctatatatttctagtcatttccagtatccatgcacataaaactgtatagatttctcacgtaaggtaaaaggcaaaatctttatatttactaaaaaatagaaaaacagaacacattttttttaattctaatttacagcagcgttgtatttagtcatgtcctattagagaaaaaaaatgaatttaacggaaagaaggtaggaaaaaaaaagagaacagggaccaaacaacagaagatttcgtttgattgcctattcctttgcattgagaacggcagataatgctcatttttgaaaacttttatatgggtcccatgggcatacattgaactgagagtatactactcctactttgcttttctgctgcacgcgtcgaccctttctgctacatgcgtcgaagccgagacaacggcgcgcacacgcgccttaattccgcacctcgaccttatcctttcccactttcctcccggtttctctcctcccctcgctcgccttctcggtttccttctatccttctcctcgcgctactctcaaccaacgacactctccctctccggcactccacctccctctcccccatcatgtctcttctcaacaacgagagtgagcgccgcccttcccatttcttctcccacccaccacgcatcagccgagagagagcaccgcgagtggataaacgcatccttatccactcgcctcctcctctcacccgtccctctctctccctctcgatcactccctctcatccccgcccccacccttctcgtctctcccttgtcggtagcagaggaggcggcagcgatggcgttaactgctcccgtgggctggatccgacggtggctgtggcatcggcggctcccgctggcgaatccggcggaggcggcggcggtgttgtttctggcaggcggattcggtggaggcttttccggcgggtggatccagcggttctctaccccctcgtcctcaccctccgcgcccaagcttgtcctgcggcggtggcatcagcgctcccacgggcagatctggcagaagtggtggcggcggcgtttctgatgggtagatcaagcggtcctccacacactccccctctgccccaagcttctcccgcggatccgccggcggcggcggcggcttctcccttggatccggtggcggcgacgacgttggtggcacccaccggcgatccggccaagggaatctgcctgacgccgccgacgtcccctcggcccgatccgccgttgttgttggttgtgtatttgttgtttgtatatgtgatgatgatgtcgttgttacgattgattttggggtttttatgtgatgatggtgttgaagctcccccacccccccccttttcctctcaaccactcttg

SEQ ID NO: 68615 - DNA, 10220 bp, Oryza sativa
  unsure (1)..(10220): unsure at all n locations
ctcgcacatctaaccttttgggttttttgcgaaccaaagggtaataagttgagcatttgcacccccaatacgattcccggagagagtgaacagttaaaaaatatatccacagtgagtcttacctcgggatggaaagcccgataagctttaagttcgcacagaggggaagagcgcatagccaccccatagcgcccggtgaacgcctttaaatatcctataaacaatgtggtgttccatggccacctccanatcaatatttatatttatgatcctatttatacatatatcagtatgcatatatatatatatatatatatattggcgacgtttgatgtcacgactacggtttttgcatagtatggggatcgttggtacttggatatatgcgagattgaggtaaaacagatggggacgaggatttttatacaggttcgggcccttaaattgtcaagtaataaccctactcctattggccgaagccggtcgttgctcttattcaccataatcacaccagtataatatttggggaagcctatctaactgttgtcaacttggtggtctgaagtgctgactcgtagtcgacaacagggtagccttactcctcgaatccgcatccggcaagatcaaagacagtgctatgtctctcctatcagtatccgtaaacaccataggggactagccatgcttatctctgaagtcgatatccggcgtcttgtcttggcgtatgttagcttgtatgttgatcttgtgtcttgatctattgttccgtgtcccctctcctcctagggggtcttgtatttatatccataggtgttcccttgtccaagtagtacttggaaaaccaatatggatacaatccgagtagtccttatcgtttccatgtagaactctattcatctttccttatgcggaactcctcctatatccgaaggttgtttccgtataaaacatgatatgtggtgggtcctgctgagatttaatcaactactattaggtatatggtatctataaccctgacacacacacacatatatagtagctatattatacacccctcccttagaataactattctacacccccctccccccatcagcccaactaccaagcccattcctccctccccccatcacgcgcgggtccacctccctcctgatccacgccctgccccgcctccccagcgcccgctcccctccttctcctaccagcgcgagcgatcgcgcgcccgtgcgcccggcccagcttcttcctccacagcagatctctctctttttttcttcgctttttctcctcctccccatcccgatttctctctctcctttttttccttcgccttttctcctcctcctccccatcccgatctctctctctctctttctttttttcttttcttcgttttttctctccaatctcttattttcatttctattttcgtttttagaacccatgatcttatggttcataacaaactcccctaaccaatccgccttatgacacgatttgatttgagatcattattttctttctatatatatctgttcaaaatttatgaacacaaacccgttatgttactataggaagtcatatcttgttactatgattcggtagtaacattatcgcagaactgcattgacacaatatgttactgcaaaatttataggccgttactgcgcaatgtataggtcgttactgcacttttagcagtaacatcatgatgaaattatagtaacagagaacatatggtagtaacggtactactgcagtaccactggttgtgcatagctaaaatttaaaatatccatcttgtgcaaaatacaagtgctaaaaaagtgcatgtgcatggtcacaagttaacacaagtgctaaaagtacttttctttgtccatacaaagatacgtagtagcaagcttagtacaagtaaacttttagaattctaatctttaaacaataatatctctcacatcgcatattattttttagaaccgttttcaccataacattgtaaaacgacgttacaacgagacaatagtcatgttactacacgatgatcgacacaaaaatgcttttataacgttattttgcagaaattagtcatgttactgcacattgatcgttgcgttactacgccgttccagcgacacgagaactaaaaaaagtaaatcccaatctttagagagcaatatctctcacgttatatagtatttttctaatctatccgcaccatgatgttcgtaaaaaaatgcttaacaaaactagatccatcatgactatttttcgatgttgttactacgagaaagttgtcctgttactgcacgatgaccgttatgttactacggaattcttgcgagacgtgaacttcaaagtggtgggcgggggagatagtcaatgttcggttcagtcatagatctcaccggcggtatgggtctatgaccttctgttgattaaggtggtagggggtacttgggccctagtaagggtgggggaggtggcattggcccatggaagggggggtgtagaatagttattctaggggaggggtgtagaatagattcactatatatatatatataatattcaagtaatgctattttatagtttacaaaagtaatctatttatctattttgcctttttttttcttattgactcggcacttcaagagtgcttccacgctatagaaaatacggactgtgaattacatgtatcgtgttaaataaaacctgcaattggaatatcacatgctttattttaatttttaaaatagtaataattataaaatacagaattatgtctattttagattctcactttaatattgtattaatttatttcccaaattaaaatttataattagcaagttgtacttgaatttggaaaatgaccaacatattcaacataggattaaaaatactcatatttattatacacacacatacgatccaacagatgacgaggctctctaaccgctgaggaaaggtactgccagcttgtcaccgccttcctcgtggatcgccaaattcgaagtttccaacgtctactccggtggcgacaaggacgggatatgggtccagatctcctagagttggctacaactctatcaggtggagttgccatgatatgtgtcattccgtataccccaacggctaggattaagccacgttaatgttaatatatacttaaaacaagtaattaaccgtgcaacagataaacttacatcaacaacatatcacaagatatttttactgtagaattatagaattaatacaagaatttcatacttcatctattttatttaaaaattatacatattataagaatttcatacttcatctattttattaaaaaattatacatattaatattgatatggttcgctgttgcatatatatgaaaacactatgttgatatatactgctgcttagagttgatcgactgtatgtgtttattaagaacaaaaagtttttcacttaattttttgttgagaacataatcaaaatagaggaagcgttgaaaaaactaattttcctctcaagctataaccattaatgttgaggagttaatttattaggtaaatttgatgaggcatgatctcagccgtaggaaacaatggatggtatagatttggccaactctacttgtagagttatacccaactccaggggatccagaccccaaaatataagacacaaccacccttaacccaaagaccaagaaataattattattatatcttgtagtttggatcatcctaaaaaatataatgccactggtggagaaacgatttgtactcccggttggaaacccccctatagtcccggttttccaaccgggagtaacaatccgggactaaagatcgctatctttagtcccggttcaaatacccgggactaaagatcgatctttagtcccggttgatgttaccaaccgggactaaagatgtggtcctggttggatggtttttttctttttttttcttttctctctttcttttcactgttcttttgcccaaacaatctcacatcaaacattcacagcaaatcattcacaacattatctcagatcaaacattcacaacaacaatatagttcatccaaatcattcacagcaatagttcatctcaaatcattcacacaatagttcatcccaaaacattcacaacaacaacaacatagatcaaatcacacattcaacatagatcgtatcaatcaacacagagcgaatcgcacattaaggaaaaaaagaaaaaaaagaaaaagaaattccacggtagcgccgcctccaccacctgccgccgcaccggtctccgcgccgggcgcagccctccggacgaggccaccgcccggctgcctcccccttcagatccggcggcagccggccgcttcccctccggatccgccgccgcccggctgccgcggcgtgaggccgccttcaccccaccgcgcaaggggcccgccgccgccgcggcgcgaggccgacttcgcctccgcccggccgctgacggaagagaggggaggaatagaacggggagaggaggaggaggaagagatgggaggaggaagagaggggaggaataaaacggagaagagacgggaggagtaagagataaggttagggaagagataagaatagaatttattaactcctcgatctcgtgcacgcctcatcctctccgccacatgcgtgcatgccgatcttttgttccggtttaggctaccaaccgggactagaaatagatctttagtcccggttggtgtcaccaaccgggactaaaaatagatctttagtcccggttgacaacaccaaccgggactaaagataaaaaagtagctctaaccttttgaaccgggactaaagataatctttagtcccggtttttattgcaaccgggactagtatagattttagctgaccgaccaaagatggtttctccaccagtgtgcatacatctaataggattagagcaagtttaatagtatagctaactaccagctccaattcatctatagccaatctaatagcccattcatacaatagttgcatactacactattaatacctggtcccacctgtcatacgcacactgcatcttggagtccgtgctacagctggctacaaatctgtagtccgctgcttctctctccttatttatctgcttaaaatatgtttgcagctggcttatagcctgctattgtacctgctcatcgataacatgtgagtggaggatttaaaataataataatttaatgaagaatatgtcatagttgattgcatgcttgcatgcatgccttatattatgaaacatcgaagaaaattggttatgccttatattatgtaatggagggagtacatccgtttcttatttagtgtattatgttgactctttatatgccgtttgatcatattcatatggttgaataaaaatacataagtattagtattttgtttgttgtcttgttttaaagtgcaaattatggttaagcttttgtactccctccatcccattttaagtgcaataataacttttcgtgtccaactttaagcatccgtcttatttgaagtttttttataattactctctccatcctataatataaggcatgtcaaacttggtacaatttttaaaactaatcttttgacttatatcttctcatacttctataaggtttgttgcaacaaaattataactatcttaaagtaaatttaaatgtcaatccaatgatattaattatagcaaataaaatttaatttatattataataattgttggtcaaatatttttaaagttgaatcctgaaatatatacacaccttatattatgggatagagaatgtagtatttttattgttgagatgataaaatataaatagtactttatatatgacttatgtttttcaagttttttttaagaaaataaataaaacggacggtcaaaattgtgcacagaaaattatggctgcacttgaaatgggatggatggagtatttctagtgttcaattcggctacacaaaacgaaatattcctgctaacggttttagagctggtttaacaagtactctcgggagtaaaatcatttcttaccagcacactcgggaaacgacgaggggtagcatgacagactgacttgatgatgaattgatgatagacgaccttgcgttggaaattcccacatgcagttactatttggttcatcactgcacacacgcgccgttgccatgcattccaagtttcgaaccctcggatggcgcgccgtcccactgctggttggtcggcaagaccttggacggcgcgacgtccactactacacaaatgctccagatgtcagaaatactaacggagcgtttaaactgagaggtgtaaagttttagtgtgtcacattggatattatataatgtatcgtatggagtgttcgggcattaataaaagaattaattatagaatccgtcagtaaatcgcgcgagacgaatttattaaatctaattaatccatcattagcaaatgcttactgtagcactacattgtcaatcatagagcaattaggcttaaaagattcgtctcgcaaattagtcacaatctgtgcaattagttattttttttactatatttaatacttcatacatgtgttcaaatgtttgatgtgacagggtgaaaaatatttgggtaggatctaaacatggcctaaaatcaacacacagtgttctttccacaaaaacatgcaccagcagagcaccatcagctagaatcggcacttttataaagaataggtgttgatttaaaaaaaaaaccagcaccaatacttgtccggtttttaaaacaatcgacacctttaattaatttattgtaggtgctagttaattaaaaactgacactacaaatatataaaatttaaaatcgactggaaaaatgtaaatttgactgtcaatgacacgatctattcagagtcaaatctactgtttttatttttacttatataagttaaattttataataatacattacatattaatttatcttattacaagtttttaaatttttgatattttatggatggcatgtaaatacaagagaatgtaccagcgagaaatgaagactttagtactatattttttttatttgtacttgtctactttaatgtagaagaacatagcgatccaatggatcactgcatgccacgtgtgattacaggctaaagtgtgtctcgttgcggatggtctgatgagttgaactgggactgctacgcatgaggtcgtgggccaaggccctttacagatgaggccgtgtgacaagcatgttctggcaaacacggtatcatgcttgcccaaacaatggaataatgaaaacctgataattaaagatagcaacctattatatagtcctccacataatgcacaccaggcacttgcgcagataaagtcgaagcatgtcacccatagataaataagctcgatcaactgaatgtctgaaacatcgaagacagtacgtagctaataggccagtcgactacgtacaacacatgcgcacgcatttccactgaaaaaacctactcacacgcgacattagctacggcgagcgggtaggcgaaggagttggagtactggaaggagacggcctcgctaggacccaaccggcctccgcccttcaccagacagtcgttgaagccgatacgctggaactggctggggtcgacgagctccgcggaggcaaactcgccgcaggagatgtggacgtcgtacaccgtgcacgccgtgcagacgttgatgatttccacgctgtaggtcgggatgccgctggggaggtgctccgcgttgttctggtacaccaccacgttctgctccgagcagctgtccggctgcatccgctgcatccagtggcgtccgccattaggagagtgatcttcacctgatgatcaacgcatgcatgcagggacattgagacaactaatatataaattcatgtatctaatgtatgaaatcagagggtttggtccttgtgtatatgagtatatagcgtactgatgttgagaagcttgttcatgttcaacgtcttggactgcatcgcggaggaagatgactcgccagagactactagagctgcattaaaatcaagatgatggtcacagagacgaagccaaacgcatgagaaactgagaaatttagaattgacagctgcataccttggctagctacgagcagcagcaagatgatggtcacagatgaagccaaacgcatcgtagtgcagtcggccattgccttctctgtataacctgcagctagatcttacctagatttgaaatagggtagcagttggcagcaaactgccaaatacttgctcaagctatacaggcatgcacttcacttgcctgccgggagtatataagttcaccaggccatctgctcatgcatgtttgcctctgcaaacatagcacgccacttgactcgggagaggcaatgcattaactgagaccgcgcgcatgcatgcacgcgcgcacaccattcgaacggttggcttcgtcccgcggataggtctcgatgccgattggttacccacgacggcatattgggtggactgccgccacgcgcgatgaagcggccggtggacggctgccactctatcgaagatgctgccacccggactgccgcccccgcccatagcttctactatggtggtgtttggatccataagtcctagggacttattttagtcttaggactaatcattttagtccataactgtttggttatagggactaaaagggactaaagtttattaaatgcgctgcacaatgaccatattaccccctaaaaccatacaaagtggactgcaccatgccccttgctgcagcatgctgtttgctgccgctgctagcactttacaagcaaaaccattgttgctgcatgacagcacaaccaaatgcaagccaaatcaatgtttcaccccaacatcacatgttttaatccatcataatttggacaaatacacaccttcagcaagccgaatcacaagcaataacccccacatcattttcatcatcaatatcacagcctaatcacagaaattcaaagaagctcatacacatctcaagttgttgaaatacatcacagaagtttcaatgttacaaattacaagcactcatggttcaattgacaagttaaaccaaatacaattcacaataaatttgaaccattcattacattcctttcaaagaccacaatccatcggcaacccagtcccgaaattggttcatgacacgcgagtccaaatcgtttgttggttcactagatggagcagaggttccacccaatggatcataattttcatcatggtcacaattgtcgaactctgtattagccatttgactgtctctaatgaaattatgaagtgctatgcatgcatggataattctgctttgtttttcctgcgagtagctaggtaaactaaacaaaatcctccacttgttcttcaagaccccaaatgacctctctatgacattccgacacgaagaatggcagtaattaaagtgctcccttcttccccttggcaatgtgctttcgttgtactcttggaatgatatgttatacccttgtatggtgctagataacccagcctatttgggtatcccgagtctacgagataaaactttcctggaggtggctttggaaacttggcactaaatctagtttgtgcatcattgaataccctcatgtcatgaaccgaaccaggccagccagcaagcacgaaagtaaatctcatatcaaagtcacagacaaacataacattctgactcttctccttatgtctattcctatgttgaacagcagctgaatttggcaccacaacttggatgtgagtaccatctattgctccaatgcaattatccaaatatggtgtgtactgtggagaaagcaatttcttatggactgttgtgaataagggatcttttggcctaatgatatcttttgcaagtttcagtagagcggtcaaaactgctttgaacttactatgtactgttctaagagacctaacaaatcggtcttgggcttgcctaactgattggggagcacctactatccacaaaaaaaagacccaaacactccatggaatctattttgtttgtggacttcaactcatatgattccacaagcacagaatgtaacctctcaaaaactggcctgtgcatcctaaacnnnnnnnnnnnnnnnnnnnnnnnnnntgatntcaggggcg

SEQ ID NO: 68616 - DNA, 1844 bp, Oryza sativa
cgcgcgccaattgactaacattgagtacccgcgtctatcaattagggtatttgacttatcactttcagagttgaaagaattgagcagccccttcatgagcttcaccactgggctcttactttttttcccaggactagaagctgtggacacatcacagctgctactccctctcttcctgttgttagtgctcatggggctgttctcataaccatcccctacagctctttcccctctagctgtctcccctgcatcccctgcttcttcttctccttcctctccatcttcatcttcaaaaccagggatatatgctgtggaaccatcaactgcaactccttgaaacatctctataagaaaatctaagtactcagggttgccatggcaaaatttcttggcatcccccttctcctgtattgacacttaatcaatatcacataaaactctaaaatcatgtaaactagctcaatttttgacaactgcgtacctttttttttcccaccaagcatttgatgcaattatttctccactagcacttctaccagctccagtttgttggttcagccacacccaagcaatgtactaattctttagatgggtgaatctattctttatctgtttggttgaatgccttaggttagccctttggaaatatttggccttcaaattctggtaccctctagttgtccatgctccattaggacaatgcccatcccttatttcctcacgtgctatttcacacaatgtgtaagttttttcttctgtccaatttgccttgtcatacgtattctaggaaagaaaaacatgatttaaccctaaattaaccacatgaacaacaaatgacataatacaaatgcttagctcacggcatgcatagcaatatcaatatcatgagcaacaattggcatatttcgcaatagaacagaacaaacataacagatttgaaccatcgggggtttaccatgtgctgaccatcaggaccaaagtcctcttcgtcttcatcgttgccgtcgtcctcagacacatatgtcccttgagacgacgacgcaccgactcgctgtcctcctccgaagactccaaagtcaaaggcgggtggcccactgtgcgacatggatgtcccatgacctcggacgcgtccttcgctagacgatgagccaggaggaacccatcctcgcattcccctgccagatccaacgccattggtcaacgacctgccacggcctcgtcctcctcctctccctccacgacttctgccgcgtccccctccccccgctggaggaggacgtgatggggggactggatctgctccctgcccgaatcggaggtaacccaaggctacccggttgaatgatctgttggtaggaggcgaaatcggggaaggcgtcggcctgggagttcagattgaggccccccgatccccctcccccaaaatggatgtcggcgccagatccaccatatcctgaagatccctgcgagaagccgtagtcggagccgtccatgtggcccgctggagcttcattgaacgactgggagaagaaatcgtgaggattcccccccgccattgttgatgcgcgattcgtgaggcttgcgtgagcggcgtcggcttgcacgacaccggtgagccaagcggcgggcagaggactagctaggcggtgggggctaacgcagggagacggcggcgaggtgtaacgccccgattttcgttcgggattaaaaatcatttaataatgcatttcctagaaattaaataaaaatttaagcaatttattcgagtgaattaattggagaattaaaaatttgccttaaaaatcactggccaggaatattttgcaatattctttgtgccctaa

SEQ ID NO: 68617 - DNA, 6695 bp, Oryza sativa
  unsure (1)..(6695): unsure at all n locations
ggcttganccgtgccgttgctcaaccgcgccaccccgtggtcccggtcccgggtgggaccgattccccttgacccgttgacgtgtgggcccgccctgtcggcgccggcctctttgatgacgtcagcgcttaagctttttcctttgagaaaataaataataattgcgcaataaatcgagtttaattctagaaattcattcaaatggctcaaaacttctaaaattcatacctaattcattcgaactccgaattgagccattcaacttgcaaaattcatctaaaattgagctctacatgtttgtttagtttttatgtactgttttattgatttttattagagtttttcctcgttttgcatgccagtgtgtagaatccgtcgtttcgaaagtccgcggtcgcgaggaaaagagttcggaagatcaaagtgaagaagcaaggcaagtcacacattccccttgagcatgttgatcccaatttacaaatattttactgtttgcaaataaatatgcatgttttgctaattacatggggtcagggttttacctatctgctcgcttgtgccatgtttacttgatatctgtcctttgtcaaccatgggtaataaatcacctagcttgtgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgactgaatggtgggctgtgggtgcatggttttgctagtcgcacccatggcaattaaggaccgattcgcgggatgccctggaagaacttatcgtacttaccacaagccagcgtgggcaacggctgggcttatagtgtagctttcctctagctgacgcatccaggcaaggatgggcgtgatggagcggggcgggccctgcgacggcctctgtcgcttccggattcacctaggcacgagaggggactgcccgtcgcccgctagggacgggggtgaaacctgaggtgtggtgtgcttggctagagggggttatgtgaagggtcctgtcacggcctctttccggtatgtcgtggtggcatgtcggcgcacggtaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatacactgtagttcaggtgggttggttgggcctgttcaacgtggtgtagcgttgatcagtggagatttaatgttactctaattactcaacagttttactgttttgctcaataaaatgttttacaaccgcctttatgcaaatagccacaaacaatccttgtatccccttgcacgtctgcatcgttggtgtggcttgctgagtacggtggttgtactcagccttgctattattcccccttttcagaagtgtagtgcttctgagctgaagacgaagttagaggaccaaggctcagaccccagttgagttttgcctgtggagtggagctgaagccccgctaggatcgcctttttccgctgctgctgctttcgtttcggtgcgaggactaagtgcctcttttgtaagtattttacgctttatttacgtttggaactgtatattacttgtcgctttgtgtaccctggctggtccttgacagggatttaatacacaaaatagtctggaaatttgggctaaatttctgggcgtgacacgagggcgcggggttgtgaggagcgagagagagacggcggcgagggcgcggggttgtgaggagcgagagagagatgacgcgaggaagagatgaggcgaggaagagagtgggcgaggaaatggatagggttggctggcgtgaaggggcagtggctggaagagagccactttttcccaataagcacctccatttgggacttctggactaatgcactttagtcccattttagtccctcctgtttggtactctagggacttaaagggacttaaagtggtgggacttcttttttagaccctcaaagaaacagggcctatggctggcgtccaaccggttggcgtggagaggagaaagcgattcttcatatcccttaaatagttacaaaaaatataaaaaataacaaagataaatgcgaatgtgtattaaccaatttcagtttaatttactattttataacttgtagaagtcgaatttgctgcgaagtgcgaagtggtatatatcatattaatttatttattataattcttaaaagaacataaatatttagatgtcataaaataaacaagagaatattttctcaagatgaatatttatttccgtgtagagtagtgagtactacatgtagcaagaaagactctctactataaaacaccacgtagaggccggtctgtcttataggtattgatttgcctaaaaccgacacctataaagaatttttccactttttatcgggatataattaagaagaaatatctatacccagtcattggtatcggtttataaccaaaaccggcacaaaaagtcatatgtgctagtttacaattaaaaccggcacctatgatgcgcaacttatatatatatgtatttttacctaactttttcatactaagttgaagattacctttatatgaaatttgtagtgttccacgagatctacaacctgatagttaattactttttgatttgaggtagtttgggtatccgaaaatatattgtaaagtctcaaatctatttggataagtgaattttcaaaatttctaaacgatctcagatggaggcaaaacctataccttttgactaccctcattagtactgctaaattggtgccgatcacatataaggggtttggaaccaacaccaataagagattttctactggtgactaaatcaagagagataacattagtgcatgcatggacaatataaatatttggggactaggagcgtttgcttcatgtattgattccaatgattcaaatcattttgatgaattttaaagctaactagtaatttgtccgtgctaacgctacggtgacaatatgtatcacatataaacaatcaaatcgaactgtaagttcttgtaatttgccaatgcaacatcctcttcgtccaatattattagtttggacgatttgtggtttagtttagccacatgacacgatggatcgatcgagtaagattggtatattgttctgggtaaaggtgtgcgtacagcttaattcctcacatgtgttgttgattgtttgataaatgatctgtcgatcccataaaccaacttttagctatgtttcttaacatagccacagttagacatatagccagcaattggcctttttttttttttgggaatagagggtgtatatttgcttgataagctacttgccagcagggcaattactgaagtaccagagagttaaattgagcaacccgattcattcagcatcagctgaacacataagtcagtttctcccaaaataatgcactatgaaattccttgcccaagattctagcaagtctcactacaagaaaaaccttatgtagaggctcttttgtagaaacaattttcaaaatgcatctaagttttgaagctctatagtctagagacactttttagaggcacttccaaaatcgtctaaaatatttctactctagagacactttaaagacatttttagcatactttgttaaatttatcttgtagagacatcttttcggcactttaagatttgcctgatatgtaaagatattttcttaaggcacttaaaacgatgtaaaggtatttttccaaatattaatatatatcaagttactagatataagtaacacaaatcacatatttacatgtaattatatgatgttgagatggttagtgcattgaagataaaaatggtcaactcaagaagtcatgagttcaaggattggtaagggttaatatttttctttcttttttcatattgatttgctatagttcccacaacgtattaatgcaaatagagacatcgtagttcgtagagacaattcaccaaaaggcacttatgagagactcttcaaaatgtctcaataacactgaaaggcattaaaaatgtattaatgcctctacaaagtgcctctatttgcatagagacatcttataaaatgactcttagtttgtagagacaattcaccaaaaggcagttatgagacactcttcaaaatgtctcaataacactgaaaggcactttaaaaatgtctctacaaggtatatttgttgtagtgtctatttgcaggcgaccccaaaactgcatataaagacaaattgtaagtgaagttaccttgactttccaactgtactacataaataactcccttaaaccacaagtcatgcaagaccatagatcttagggcgacgctccggtgctctctacttgtagtattctactacaagtagaattaatctcgaccgtttattttaaagggtagattagtaatctcttaatacagattaggggcaattttggcatgggatgatttctctgtctcggtcgcttgttcgcatcaggtccgacgcaatctcgccccaagcccctgacgccgcatcatgtcatcgctaccacctgtaaaaaaaaaaaggttttcgctactcccggtaggcggcggcgcggcgaaaatcgtcggcggcgctgccagtggctcggcgccacgaatcctcagctggccactcctcccacccctgacctgtctatccgttcccattcctctctctcttccccaccatgcgtgtgcgctcgctactcctcctggaaggcagcggcgcagtgaaaatcgccggtggcgctgccagtggttcggcatggcgaaatctcaggtggccactccttccacccctcacctgtctatctgtttccattcatctatcttccccaccgtgcgtgcgcgctggagagcgcaagtcctgccggcggcggcggttgtgcatcacatcccctcccgctgatggctaatctttgcaacgctcccctctacttccattccccttcgcaaagtgagaatggggcactagcttgtggcagcaatattccatcctcttctgcagagggatcaaagaacggcgacatgattatttgtgctggatgagaatcacccaggtcatagcaacatcagttatcttaggtctactctggtggcactctgatccctcgacaccaaaaggtctacaagatcaggtatatagatagcaataatcatgtgattcattttacgccaaagaaaatgcgactcatttggaatggtggagttggttactcagagagcttattaatgatatgtcagctcaggtatgcatcaagattagcatcgtcacacaattttaccttatgtatgcatgccagcttactgtttttcatagctgtgttttggggtttctttcatgtgtttactgccattttcacattcccacaagagaggaaactgtagtaattgttcaatagtttagagtggcattgaattgatgcagttgatgaaacgaacataattttattttgggtggttgtactgatttttattacttatgatgtataaatgacataagcttatatttgggtgcttgtactgattttttttttgtacttattcataggtgaggtctgacataatgaattcgagctatttgagcctagaggatcaggaagagtataaaatgatgggtaatgtggttttttcaagcgaggacgaaggttacaaattctatttaggctatgcaaagggcaagggttttagtgtgaggaaaaacaagttgaagcggaaggacggggagatcatatggaggcaatttgtatgttcatgtgaagggcacatggagttgaagcactttgagaggatagaccgtaaaatggagccacgtgacctgacccgctgtggttgcttagctaagcttgagatcgagctgaacgagaagaagggagtgtggtttgttaaggagtttgataaccaacatacgcacgaacttgcaaatcctgaccatgttgcaactttaggagttcatcgtgtgatgagtgattcttagaaagcccaagcggtcgagcttcgcatgagtggccttaggccctttcaaatcatggaggttatggagaataaccacgatgagttggacgaggttggttttgtgatgaaggacctatataatttctttactcagtacaagatgaagaatatcaagggtcgggatgctgaagatgtgttcaaatatctgacaaagaagcaagaaaaagatgcagaatttttcttcaaatacaccacggatgaggaatggcatcttagtaatgtgttttggccagatgctgaatcgcgtattgactatgctgctttaggtggtattgtcatttaccatagcacttattgtgcgaccaagaataatcatcctttcattcctttcatagtagttaacccaccatagaaggacaacaatatttgggtgcggaattctatccaatgagtccgtaaattcttactgttggctccttgagacttttttggaggcaatgcatcaagtgcatccaaaatcagtaataaccgatgacgacctagcaatggcgaaggctgatcaatttgtacataagtagcaaag

SEQ ID NO: 68618 - DNA, 11777 bp, Oryza sativa
ccactcactcattctttatatgttccataactctgtgtttggtttgcttgtgtgctgatcagtagaatcgactggtttctcaacacgttatcagcacgagactctaccgagctaaaaaggtaaaaagaacatgtcggacatagcaaagaaggaattcgtcgagcttgccttggatggtagtaactacctcacttgggcattggacgttgagattaaactcgactacatgggtctcgatcatactattgtgctgcccgaagttggcacggtggagtctacgaaggccgagaaagcaaaggcatttcatttcttgcgccaccatctccacccagacctgaagtttgaatatatgaccgagaaagatccactggtattatggcaatccctgaaggatcgctttgaccagcaagggtcaattgtgctcccacaggcacaacatgactggatcaccctacgcttccaagacaacaagtctgtggcggcgtataactctgctctccataggatcatttctcagttgcgtttatgtggcctgaagatcactgacgctgagatgatcgagaaaaccttatctacctttcatcccaacaatataatgctgcaacagcaatacaggaactcaaagtacccgaagtcctctgatcttatctcagtcctgttagttgcagaaaggcagaatgaggttcttctaaagaatcattctgctcgacccactgggtctatggcagtgcctgaagcacatgccaatgttgttggaaactcgcgtggccataaaagaggccacggtgagaagaaagggaaaggtaagggaagtatcatattcaagggcaagagcaagggtaaaccctgaggtaaaggcgaactcaagaaggttacaggtgaatcatctggggtaaagcaggataactgctatagatgtggaggcagagggcattggtctcgtaactgccgtgtccccaagcacctggttgagctctaccaacaaagcatgaatgagaaaaagagccaacatgagtcccacttcaccattgagcctgaagctcagattgaaaagcatgatgacatgcttatcaatgttgaggatggtggggacgtccgtatggacgatgattgggacaaccttcttgaaaaagatgatgacatatttggagacctgaagtaatctcctatatgtcagtcatatgcagtgttctgcatgagtagcacatgtagaactttggtcatgaataatgctcctgaagagcatgcttagtcttttactgggcctgaagtccttgtaatgtttcccttaatagaatcaacttactccatgtttaatttcatttatgtttatgttctataaacagactttgtgggaatcccatggcagaagaggatatatgtctagtagatagtgccaccactaacacaatcttaagggaaactagatatttccacaccttaactaagaaaactggaaatattatgaccattgccggaaacaatgctcatatagtaggccctagaagtgctactcttgttctccctatagggacccataactttgtaaaggatgctctattgtatcctgattgaaagcgtaccctcttaagctttaaagatatccgtgcaaacggtttccatatagaaaccgagattgagcaagatgctgaatatctgctcataacaaaaatagatggatatcaaaagcaagtggtggaaaggctcccttcatcaccatcaggtttgtactacacgtacataaagcccactgaggaatatgttgcgatgaaaaccatatttagaaacccagagtcatttagagtttggcatgacaggctgggtcatcttgggtttggtatgatgaggagaatcatcaacaattctgctagccacaatgttgaaactaatgacttccctaatcctgaagattttatttgccctgcttgtgcaaaagggaagtactaggccatccctcctgaagattagggatgagtcacctgttttcctggcaaggatacagggtgacatatatggacctatccagcccttgtcgggcccgtttagatatttcatggtactgattgatgcttctaccaggtggagccatgtggatctgttgtccacaaggaaccatgctttttcaaagctaattgcccaaatcatcaggctaaaagctagcttccctgatagccgcgtacaatccattcgaatggataatgctggtgagttcaggtcgaaggcttttgatgattattgtttagccatgggcattaaggtagaatattcagtaccacatgtccacactcaaaatggcctagctgagtccttgatcaagaggatcaagttgattgcacggccactgttgcaggattgtaggctaccaaccagttgttggggccatactgtgttgcatgcggcaacactaatccaactcaagccaactgcatatcatagtacatccccccttcagctagtgcgtggaaaagaaccaagtatttcccatctgcgtaatcccaccaccacagcgtacttctatgggaccccaccggaagttggggatatacgttggttatgagactttgtccataatcaagtatcttgagcctatgactagggatcttcatacggctcggtacgctgtttgtatctttgatgaggactattttcccagcattagggggagaaaggcatccagaagaatgccgagatataatatggaatgcaactgggatgcagtccttagatccacgcaatagtgaagctgaactggaagttcagagaatcataaatttgcaaaatcttgcaaataagttgctagatgccttcactgattacaagggaatgacaaggtcgcatatacctgcagtaaatgcgccggaaagagtagaagtaacccagaaggttactgactctgctcttaccccccatcctaggaagagggggagatctccgggtgttcaggacaaggttccgcggagacgtccgcggagacaaggacctgagccacttgttccactcaaagaatcagttgaagaagctcaacctgaagttgagaaagccccagaagaggcaactcaacctgaagttgagatggtcccagaaggacaccatcctgaagatggagaacccagtgctttacgcgcgaaccttggcactggaagatcggaacaccccaactcagtcgttatggcaaatcacgacgagctggaggaaataaatgaggagatttccactaactatgctgatataggagagtaacatcatagaaagaccactattgtcgacattcactttgcctcaaagattgctgttataatggatccagatccagaaccaatgtccatgattgagtgccagaagcactcagattgggacaaatggaaagcagcaatagaggcagagttgcgctcgctttataaaagagaggtttttgggcctacagtcccaacacctcaaagagtcatccctgtaggatgcaaatgggttgtcctccggaagaggaatggccaggtggtgaggtataaagcgaggctagtggcacaagggttcacacagagacccggtattgactaagatgaaactcactctcctgtgatgagtggaatcatgtttcgatacttaatctcaatggcaactaatatgaacttggatatgtagttgatggatgtagtgaccgcatacttgtatgggtcactagattcggaaatttatatgagggtccctgaaggactcaagattccgaatctgaaaggaaatcgcaacatgtatagtgttcgcctgcagtgatcattatacggattgaaacaatccggaaggatgtggttcaatcgattaagtaactatctcctgaagagaggttacttaaaccatgatgattgtccctgtgtgttcataaagaaatccctgaatggatcttgtatcatcttggtctatgtcgatgatcttgatatcattggcaccacagaggacattaaagaagcaatggcttattttaagaccgagtttgagatgaaggacttgtggaaaactaagttctgtttggacctacagctcgagcacctccctgaaggagtgttcatgcaccagtctacctataccaagagggtccttggtaagttcaatatgaataaatgtcatccgttgaaaacccccatggtggtccaatccctggaagcggataaggacccatttaaacccaaggaagatgatgaggaagtgttgggacctgaagttccctacttaagcgccattggagcactaatgtatctagccaattgcacgagacctgatattgtttttgcagttaatctattggctagatatagtgcaaccccaaccagaagacattgggttggcgtcaaaactatcctcacgtaccttcgaggtactcaagatcttgggttgtggttcccgaagaaccaagatccatccatggtgggatatgttaatgctggccatatgtctgatcctcataatgccagatcctagactgggtttgtatttctttgtggtaatactgccatttcctagcgatctgtaaagcataccctggttgcaacgtcaaccaaccacttagaagtaattgctctatatgaggccacacgagaatgtgtgtggcttagtcggatgatcggtcacatccagaagtcatgtggcctaaacattgataacacccccaccattatctatgaggataatgctgcttgtgttgcacaaatacatatgggctatgtgaaaagcaatttcacaaagcatattgctcccaaattcttttatcctcacaagctccagaagagcggggaaataaatgtcttgcaaactaagtcatgcgaaaatctcgtagatttatttataaagtctctgccagcatgtcacgcccggaaattcactagtaatttccgaactaatttgtgcataaaatcctcgtccaggaatcagccgaggtacacaaactgacaatttaatatacaaatccatcttaataataacgttacatacttacaaaagaaaagaaaacagcagcggaataacgatctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcaaaagcagcatttagcaaaacatttaagagaagtaaaacagtggagtaattaatcagaaattttaatcaacactcagcaacacacccatgctgcacaggcccaaccatcctgaacaaccatacccggctgtacagatctaactccaaaccaggagctaagcagattattaccagttataacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacagtaccctttgcacaacacaactcaaaacagtgcaccgttcctggatcataatctccccctcaaaaccagaggcaatggactccccagcgacccccacggacttctcgccgcttcacagtctagcacactatgatgaatcatgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccagattttatttatcaattaattaacatcacacgattaaccatcgtgagcgaccattaaatataaccataattaaaataatataatatagtttataattatcccctttagttagctaatgtttctaagcatagctaagcacacatacatatagcatttagctgaaccaatccaatatataaggttcatgctactcaaattataacccataggaaaataaagtcatcttaggccattaattaacggggaaaggttcaccacccaatgacattcgaaaataatgcatagttgaaataaaataatagctttaaacgggttcaacatgctcaaagggttatttgggatctgtgtgacttgccttgcaataatcggtcttcaattaatcttcttgaatacttccggcgcattcacgaaccttcgcaacgatggaaacgacaagctaacacgcaaaacgaagaaaaagactaataaaaaccaaataaacaatacaaaaacaagcataaacagtacatgtggatatttttaacatgtagatcttgattttagaaaaatttagcaacttgaaccacctgaaacggatctacggttatttagttatgattttccgaagatttaatctattagaaaaaaaaactggaaaaggggaagatgataatgtcatgatgacgtcatcaatggcggccggctcggatggcgacctcgccggagctagagtgatcggccgggattttggaggacatgtacacgtagaggacgacgagacgaacccaacgatactcaccctcgtgccaaacgacgaccgacgacggccggcgacgaggaggcgacggcggcggctcgggttggccggtggggacgggctacggcggccggcggcgaaggagaggcggcggccgagcttctccacctcttggcgaaaccaacggcggcgacggcaagcgacggcgacgacggaggcggcgtggcggcgcaaccggagttcggccggcggcggcagcggatggtttcacgcggcgacggctctacgggtcacgggagaggacgggagagggggcaaacgaaaaagaaggactagggggtcctatttatagccttggattgaagagatcggactcctcccgcaagaaaatcgactcgggaaatcaaaaactcggttttggagataaactcggaaacgagttcgattcgggcaagatactcaacgatttgctccgatttttgggggtaaagatagaggaggatgagaggataaaaactcctcaaacaatcggaagaaaaagggccggattgggtgcggatttggaggggaaaaggggcggctcgagctagcaaggccggccggccggaggtaggagaagggcccgacatgtgggccccacatgtcggtgtcccatgagaggaggggcggccggctcggcttgagccgactcgggcggccttgggccggctccggcgtgcggaagagagaggaatgttgggccgaattcggcccaacggcttagggaggggtttttgaactttttaattaaaataatttgtgaaatgttgtttcaattattaaaaatacttcccttgctcaaataattcccagaaaaatctagaaaatagaggaacaagcaaagtatttaataaaattttatctagctcatttttatgttgaaaattttcctagattattagagtttaacttgtaggcttttaaaataaattctaataattccaattaaacaacaatttatatatttaggatttttagggcgtgacacatcatcaagcttttacaaatgtgttcatgacatcggcatgagacgactttgtgaattgcaaggattagagggagcaaacaattagcccatgattgtgatcctgaagaatcacaaacaagtcctgaagacttgatcaactgttgtactctttttcccttggtgagtttttttttcccattaggtttttctcacacaaggtttttaacgaggcaacaggtgcaacacaatatctagagtgccatgtactcttttctcctaccattttttcccactgggtttttgggaggagtttttaatgaggcatgcgcataattcaaattcgtccaagggggagtgttatgaaacctatcttattatagacaaattaaattatgattgggaagcttactacaaaagaaagcttacgccagaagccagcttacagaggaagccagcttatggcgcaagccagcttacacgagaagccagcttacgctgtaagccggcttatgatgcaagccagaaggttcaaggcttacgatgcaagcctctaccctcctccgcctataaatagggcccagaaggtccaaggcggggataaccgatcttcggtctactgcttcttcttttgtagcttgtactcaaatccagaagaaataaagcttccgctcgcttattatttctgtgttccataactctgcgtttggtttgcttgtgtgctgatcagtagaatcgactggtttctcaacattgtcaaatctgaaccttccgataatatttccaattttaatacttcaattggtaaagtcctttataattttattttccttaaccatcagacaaacggatgatctctacattcgtgggcaccgtcctggttctgggttttacggaagtaaacaatcgcgtaggccgcacgacacttcaagatagggtgcggcgcactgcggccaccgtcgatgcagatgatttggccggtgatgtatgccgctgctggcatacacaggaacgccaccagcgaccagacctcctccggcttgcctgcacgccgcatcggtgttcgtgcgatttcctcctgtacgaaatccggcgaagtcacgccttgaatatgaggattgttgccgctcttgcactgtagtagagagcatttatattcaatgggagatgaaacaaaaacgaaataattaggctcgattgcatatatagttccgataattccaatggtaaaaaactggttcaattcattgccacccgggtaaaaaagtgtgtaaattactggagcgtgtttcatatatatacatatatggctatcaattgtgcattattctttaggatatatagttcggataaactattcttcttgagtgaaaaaataacttctatctatctatctatttccatctatctatctatctatctatctattattcttcttgagtgaaaaaataacttctaaaagcactccgaaacagccatgtggcactctaattaatcagtggacccactattttaggttttcatctattagatttacacttatatgatcgacccgacattatatgtcattagatctatttttcaaaaaaaaaaaaagaaaatcacatcccctcccgtgtcgcttatgtacgtgtccgtgtacgccctccccctttttatttttgaccgggtgtacgccctcccctttgttccttttctctcctatttttatgctattttagttagatggaaatcacaattatttataatatgtttttagaaaataaaactaaatcattgtcctatacatgtatgtcgacgtttgatgtcgtgattccggtatttgcatagtatggagatcgttgatactagtatatacgcgagacttaggtaaaagacacagagacgaggatttttatacaggttcgggcccttgaattgtcaggtaataaccctacatcctgttggccgaagccggtcgttgctcttatttatcataatcacaccagtacaatatttggggtagcctatctaactgttgtcgacatggcggtctgaaggtctaactcgtagtcgataacagggtagccttcctcctcgaatccacatccggcgagatcagagacaacgctatatctctcctgacggtatccataggcaccgtaggggactagccatgcctatctctgaagtcgatatccggcgtcttgtcttggcgtatgttggcttgtatgttgatctattgtttcgtgtcccctctcctcctagggggtcttgtatttatacccataggtgttcccttgtccaagtagaactatggaaaccaatatggatacaatccgagtagtccttgtcgtttccatgtagaactctattcatcctttcttatgcggaactcctcctatatccgaaagttgtttccgtataagacatgatatgtggtgggttctgccgagatttagcccataaccctgacaacgtacttatagtacgccctcctccccatgttccttggcaggtgtccaccctcctttttttaattatattatttaaattcaaattagaccaaacatttttgaccattaaattattagttttcactattagatcttatcttcgagaaaagaaatatgtatgtttctctctccctgtgcacgtatttaagtttcaaaaagacaaaaaaaaatcatcacttccatctcaggagggatcccatctccctgctgtctctcctttttctcttctattctttagctatcaaccaaatatataaaaaaaaatactcccaccatattatgacgccgttgtctttttatcaatgtttgactattcgtcttattcaaaatttttgtacaaatataaaattatttatgtcatgcttaaagaacatttgatgataaatcaaatcacaataaaataaatgataattacataatttttgaataagaggaatagttaaacgttggtcaaagagttaatggctttatacattaaaatacggagggagtaataattagatagataaacaatcataactctcgagtacatatccaatttttaatttgtttaaactattatttatttaaatgttatcatatgtttctctacaaaaattataatacgtcacctggatatggcgaacccaagaaaagaattatcagggcatcgcatggatatatgccctttctttcagtggcgaggctagcaaaaaattatcagggtactacacatataaattatgcaattgttgattgctatatattgattaatatgaaatgaatatagctagaatcgaataatctacccaggaaggtgaatgtagttaggccaatgtatcttttgcatatcaatcaaacaaaaaaaagctattataaaaaaatgtacatatattttgtcatcttaaaccatttaacgaacatactccgtgaataaattttcatataaaagaaacattaaaaataaaataaacatgtattatgtgatcttaagttattccacaaaattgcatagctatatcagattgacggcgttaaaataaaaattataattgcaaccatgaaaataaatttatgcataaatttaatttatctagggaccacactcctacactttgaatgtaatccaaattgtcatacaaaattgtaaaataatttaacaacatataaattactttgcaagcatgcatagaaaaaatagatatataatatgtaagtgaaaagaaaaaaattaactatgaataacataaaaattataaaaaaaattgtacctttagttggatgcaacaatatctaattaattatgtcttttgaaatatgctcaaccgacgagataaattaaatcggttgatttgtacgtaagcgttctaaaatatagtatacattaccatttaatggacttagaggtaaaaaaacaaaagaatattactatggcttccatatcttttagatataaagataaattagtctattttatatgcgtagaccgttaaaaatgtgaatactcctatatatgaatattaataggctacgagcatgtccgttgttcgtacgcatgcataaccaactttaaaatccatttcgattttctgatataatttactatgtatgaatattaatattatttagattgactatagtttttctttaaactattgtatgggtctcacgtatcatagagaaacaatgttt

SEQ ID NO: 68619 - DNA, 36227 bp, Oryza sativa
  unsure (1)..(36227): unsure at all n locations
caaatcatatacatttgtcagtagtaaaagtttggcgaggtttcttaagaaaatagaaacaatggatcgaacgtatgttattatatattaaaagcacgttaaacttcctacaaacgctcttaaaccgccacgtgtgactcctacaaacgttcctaagtcaccacgtggcgctctaataaattagaggaatttctaataattcttagaaaaagaaaaacatctaacaattgattttactttaaactcagttgttggtgatatgggtgcgggggtattacgtttagagggaggaggccgcccccaaacccacgtggcaccccccgaggggggtcgagccccgggtgcagcggcggctacctcctcatagcttggggtcgggctgccccgaacccacgtggctccctaggaggggggtcgagcccggggtggagcggcggctgccccctcccagcttggggtcgggccgccccgaaccccatgtggctccctccgaggggggtcgagcctgggccgcagcggcagctgccccctcacagcttggggtcgggccgtccccaaacccacgtggctccccccgaggggggtcgagcccggggtggagcggcggccgccccctcccagcttggggtcgggctgccccgactccctccacgtatcagcccacgtgtacagggttcggtgggtgtgcctaacgcccaccttactgcatttaaagcggtccatgcagccgcgccatgccgcatttaatgcggcgtgctgcgcatctgactggtctgtgatcggtcgaatgaccgatgggacggcgactgtgtacccccgccctgtcagtgtgtcaagtggtgtgcgtcgtgctccgtcccatcccatcataatgatgaggggcttcacagcctcttattgcggtcagagctggtccaaccactctgaactgacccgggttcccgtttcctggtgcaaacgggaacccggaagtcctcatccattaaacggtgaatgacaagggtgccccgcatgatttgatgggccccgcacagcagccgacgtgtagatagcttctgggctaaggcacaagacatgtaattaatatagagaatattttcccttctccctaggtagcactcacagcacatgtggtatccccttagaaaataaaaggaggaccatgcctagcgggaaagggggatcgaactctggatcctaagccaaagcttgtctagccctagcttgtacaccagggattcagagactttctaagcacagaagaatcatcatacacacaggagtagagtgttacgcttcatagcagctcgaacctgtataatccctctctcccttcctctctgatctacatctcgtgggcctagctcccgcaaattcaccgcggttgcgtcgaaagagactcctcaggatttcatccgctcccccggccgaactcacaaaggggggcctcacagcctcccgctagagagcatcacccctcgacatcagtggacccactattttcgaccattagatttgctaacaaaaagtaaaagcccctaaggcccataggggctgtccatatcgtttacgcgtatggtgcatgtacatacgctacatcctcccctcttattcaagctcccctccactgtatagaaaatatattttgtgataatctaaatcatagagctaatattttacgtacatcattagattatttattacaaaatttataattcaagacccaaaccattggatttatctcaaaggaaacagacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccagccgggactaaagatcgagctgaccttttttttttttgcatgcccctgttgctgcatggtttatatatatatatataaaccatgcatatatatgtttcaatacatatatatgcatacatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatatagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaacctttcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctatgttgtatggcaacagtatgaacgtcttgtaatgctgcgccttcagaagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacatatagtaagaaatctaactgaacgatatacttacaaaatccagcaactcataatagagacgtcgagggcgtccagctggtatagttcgtagattcccctaaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtttcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggaggagtcgatgctggagcctgcggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctagaatcggcctgcagtggtaagtacctgaagggtccgttgggatggccatgcccgacgccaccttcatgttgtgagagattatttgttagtaatcaacatatataagcagcaactagcggaatggctaaatcttacctttattgataagttcttgaagggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactaccctcttcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaaatctaattacaaataaaataatcttatattaaaactcaaataatattacatgctaagactaaaatagtcatgtacatgctaagtgtttcgtgcgtatatgctaagtcacgagacatttatgttttaacaatctaagtgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaaccttatatgataagtctaattacaggtctaataatcttaattaattgcattacaaatataacaatcatttatattattacgtcacttgcctgctccaattccttatagggctagctcttccactcaggcttgacggacgactccgacaacacgtcttttctgcaagatacaaaaaaatgtattaggataaatgcgaagtaacatatatacatatatatacatatatatacatatatatatacatatatatatatatatatacatatatatatattgcatttcacgttaacgttcgtcctcgttcgttcgctcgttcacgttccctagctcgttcacgttcgttcgctcgttctcattcacgttcgttccctcgttctcgcttgtcttcgttcgatcgttctcgttctcgctctcgttcgttcgatcgttctcgttctagtaacaaaatgtcgcggcaacgtacgttgacgtgttcgttctcgctctcgttcgttcgatcgttctcgttctcgttcgttaacagcggtgtgccggcatcgggcggcgggttggcacgccggcgtgtcnacgacgctgtcggcgtggcgttgtgggnccgtgacgccgccggcgtggcgtgacggcggtggcgtggcgtggcgtgccggcgacggcgtggcgtgtcggcgtcgacattgcgcgcgcggcggtgaagacggcgccggcgtggcgacgtcggcggcggcgtggcgttggcatcaggcggcggcgttgcgcggcgtcgaaggcggcggcgtggcgcgtcgtcgtcgtggcgcggcgtctcgtggcgggcggcgcgacggagagagatcgagatcggagagatcgagatgcatgaagggagttctggcggcggcggctctcaccccaaacatttgccgacaccttaggaggcggcgaggactacgagctctagacaccggcgagatacgtcggcgtcggcgcgggtatttgccctaggcagtgtcggcgaaggagagagtccaagagagatcgatcggccgaaaacgtctaagtgttggtgaagaagacgagggcgcaccgggaatatatatacccccggatctttagtcccggttgttctcaacaaccgggagtaaatatcttttcccgctatttcgaaattctttttaaacccggttagggttaagaaccgggactaaagtggctctattgggaaaaagtggctctattccagccactgccccttcacgccagccatccctatccatttcctcgcctcatctcttcctcgcgtcgtctctctctcgctcctcacaaccccgcgccctcgccgccgccctgcgttagcccccaccgcagctacgcgctagctagtcctctgcccgccgcttggttcgccggtgtcgtgcaagccgacgccgctcgcgcaagcctcacgaatcgcgcatcagcaatggcgggtggaaatcctcacgatttcttctccagtcgttcaatgaagctccaacgggccacatggacggctccgactacggcttctcgcaggggtcttcaggatatggtggatctggcaccggcatccattttgggggagggggatcggggggcctcgatctgaactcccaggccgacgccttccccgatttcgcctcctaccaacagatccttgaaccgggtagccttgtgttacctccgattcgggcagggagcagatccacagtccccccgtcacgtcctcctccagcggcgggagggggacgtggcagaagtcgtggagggagaggaggaggacgaggccgtggcatgtcgttgaccaatggcgctggatctggcaggggaatgcgaggatttgttcctcctggctcatcgtctggccaaggaggcgtccgaggtcatggggcatccatgtcgcacagcgggccacccgccttcaactttggagtcttcggaggaggacggcgagccggtgcctcgtcgtcccaagggacaaatgtgtccgaggacgacggcaacgaagaagacgaagaggactttggtcctgatggtcagcacatggtaaaccccccatggttactttctgttatgtttgatttgtgctattgcgaaatatgccaattgttgctcatgatattgatactgctatgcatgccgtgatctaagcatgtatatgttgttttacagtatatgttgttcattggttaatttagggttaaatcatgtttttctttcctagaatacgtatgacaaggcaaattggacagaagaaaaaacttacacattgtgtgaaatagcatgtgaggaaataagggatgggcattgtcctaatggagcatggacaactagagggtaccagaatttgaaggccaaatatttccaaagggctaacctaaggcattcaaccaaacagataaagaatagattcacccatctaaagaattattacattgcttgggtgtggctgaaccaacaaactggagctggtagaagtgctagtgaagaaataattgcatcaaatgcttggtgggaaaaaaaaattaaggtatgcagttgtcaaaaatttagctagtttacatgattttagagttttctgtgatattgatttagtgtcaatacaggagaagggggacgccaagaaatttcgccatggcaaccctgagtacttagattttcttatagagatatttcaaggagttgcagttgatggttccacagcatacatccctggttttgaagatgaagatgaagaggaaggagaagaagaagcaggggatgcaggggaggcagctagaggggaaagagctgtaggggatggttatgagaacagccccatgagcactaacagcaggaagagagggagtagcagctgtaatgtgtccacagcttctagtcctgggaaaaaaagcaagagcccagtggtgaagctcatgcaggggctgctcaattctttcaactttgattgtgataagtcaaataccctaattactgaacttgttaacagcaagaagttaaaggagcagaagaaagaagaaattgttagttcattgacaaactgtcagaggttgncagtagagtgtggtgcacaagaagaaagtgtgcaatacttttgtgccacacagttgtttgcttccaaacataacagagttatgtttaagaacattagcactaaagaagcaagatttatgtggctgaggagatggtgccagcagaagaatttgtattagatgatccctttctttagctgcatatcatgggtctggtctgcattagttgtgtcttagctgcattagttatgatctacttttgtgttgaactatcaacttgtttgatgtgatgtgacgtaatgaacatgtgatgtgtggacctatttaaaccttcccttcttttcttcttgaagtttgttcatattatatttatgatgtgctttctttctatgcatatgtcactcctgcaggatggtgaaggcagtggtgatgaagatatctctgatgaagatagcagtgatgatgaaattgatcttatcatttatattttgaagaaaagagaaatggacaggagaagagcatgtatgcttgccgccatgattggtacgtattacttggaactttactctaataaggctccaagaagggtagcacctgagtctggacatgattgggttatgagaacattagctaatagaactgtttgttacaacatgtttaggatgcacaggccagtttttgagaggttacattctgtgcttgtggaatcatatgagttgaagtccacaaacaacatggattccatggagtgtttgggtctttttttatggatagtaggtgctccccaatcagttaggcaagcccaagacagatttgttaggtctcttaaaacagtacatagtaagttcaaagcagttttgaccgctctactgaaacttgcacaagatatcattaggccaaaagatcccttattcacaacagtccataagaaattgctttctcctcagtacacaccatatttggataattgcattggagcaatagatggtactcacatccaagttgtggtgccaaattcagctgctgttcaacataggaatagacatgaggagaagagtcagaatgttatgtgtgtctgtgacttcgatatgagatttactttcgtgcttgctgggtggcctggttcggttcatgacatgagggtattcaatgatgcacaaactagatttagtgccaagtttccaaagctacctctaggaaagttttatctcgtagactcgggatacccaaataggccgggttatttagcaccatacaagggtataacatatcatttccaagagtacaacgaaagcacattgccaaggggaagaagggagcactttaattactgccattcttcgtgtcggaatgtcattgagaggtcatttggggtcttgaagaacaagtggaggattttgtttagtttaccaagctactcgcaggaaaagcaaagcagaattatccatgcatgagcacttcataatttcattagagacagttaaatggctgatacagagttcgacaattgtgaccatgatgaaaattatgatccattgggtggaacctcttctccatctagcgaaccaacaaacgaattggactcgcgtgtcatgaaccaatttcgggactggattgccgatggattgtggtatttgaaaggaatgtaatgaatggttcaatttttcttgtgaattgtatttggtttaacttgtcaattgaaccatgagtgcttgtaatttgtaacattgaaacttctgtgatgtatttcaacaacttgagatgtatatgagcttctttgaatttctgtgattgggctgtgatattgatgatgaaattgagcgtctcgtggcgggcggcgtctcgtggcggcgaaggggagaggccgagagagatcgatcggccgaaaacgtctaagtgttggtgaagaagacgagggcgcaccgggaatatatatacccccggatctttactcccggttgttctcaacaaccgggactaaagatatcattagtcccggttgttgagaacaaccgggagtaaagaaaatatctttactcccggttggtgacaacaaccgggactaaggattatagcactgcatatgattttcgcttacatatgtgtttataaaatagaagttaatgcattaacattatttaaagttcaaagattaatgacaattacttcgaaaaattatttttgtctgtaataaattaagtggataaatcgtaataagcaaatatatgacttataattaataaaaattccaatatatatatatacttagcatatatatgaatgatattattatattggtaaaaactctagtcaattataattagcatatgaatgctagtaaattaaatgttaaaaactctaattaacatacatatgaaattgccacctgtgtgatttaaaacttttaaaaattgtaagtatcacatataactagcatatacatgatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaattggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccactttattctgaagggtttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaattgcttcctttctcctttggttccgggtgaaggtcgccgcgttgttccatatgcttcagatcattacgtgcttccagtgtatctttcgactttccgtatacacctaggaagccaagaaggtttacgcaaaggtttttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcactcgtaggttaaactcctcctgtttgtcctcgaccgacacggggacaccttccttcttccacaactgtttaagatctttgaccagtggtcttaggtacacgtccatgtcgataccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcatcctttccaaattctttaaattttctgtcgatgtttcgccactgcgaaccatcggcggggtgtctcagcatcccgtcctgttgacgctcttcagcgtgccatcgcaacattctagcattctccttgttcctgaacaaacgccttagccgcggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttcccccccggaagaatgttcttgacgagtttcaataaatcgccaaatgccttgtcactaaccccattttttgccttccattgcaacaactccagagtggtatccaactttttgtgcccctactcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccatttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaataaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccatctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaacattggaggatgaagttgcaaaccttttaggcacctccgatttgtatataatcaccaaaataaattcaatagaaattttggcatgacctcccctcttttttgaagtaattttgaagcttgctcgggcagctggaggaggaagaagacatatatatatataggggtgggactttagtcccggttggtagcaccaaccgggactaaagatcccgggggggcctgacaggtcctgacagcattcgaaccgggactaaagatgatgtttagtcccggttggtaacacaaaccgggactaaagatcaaatatgcccgtttcccttttgaaccgggactaaagatcatctttaccccggtttttattgcatccgggactattgtggaaatcggccgaccgacgaaagatggtttctccaccagtgagaattcctcccctcctcatgtcgtacgtacatgtgcatgtctcccgaaagaaaaatcaggatatatctactctatattcattgatgcatatgtaaatatgtataacaaattacgttaatatgaaccaattaaaaggagggctagcttgatggtacattattaacaataataatttttcgagatttattaaaaaaattgccccaaaacattcaattaaaaaagaaaaacacattaccttttaatttgaacttaatttgttacacatgttttctaaacgaactaagtctatctccattttaaatggtgaagaagaaaatgataattacgtatactgatgcattaaatattacatagtagaaaggtaacagatacctaacaaaatttatttaagcaaagtcggcagataaatttatgaagaaaacatatttctgaagtttggcaagtatggttgacattcattcctggtaagtttttcaaatatagcctacgatatacatgcccgcacaaatgtgcgggctaccatcctagttatatataaaagtagaaggaccattatcttagaatttcgatgtggaaatgaagaatataaaactgggaaataaatatatatagtaattgaacagcttatttggcatagctctagatctcacattcacggtacacttttagtttgtatgttaaaatatttaggtttgaaattttaaatttttattaattaaaatgagaataaattgattatccaaatattatcaaaataatcgtagatctggatttataaattagatttatagaattagaaataaccaagttaagaaaatcttgaatgcagagctgtgccaaaactaacctaattgtgacggaaaaaagacacccgcctttgtaacagaattggtgtacatatgtgggagtattaattcaacgtacatcatcaacaaggtgtgtagcgatgacgcctggcgcgatgcagttcacacgcatcctgtcgctcgcccattcaacagctaggctcttggtaatttaatttgattcatcgcttctgagattagtaagggtattatcttgcgattaattctaactaacattagtggagaatcgatctttactcgatcgaccaaaatcggtactaaaacctttataaccagacaataagaccaatgtactaattaagtacaaaccaaaatcacaaacgagaataattattttctaattacactcaaggaatttatgaatggcaaaatatccagtgcacacaaatttctcgtgctgcctctaactaacaaaattgaccaaaagacgtcataacaagccatatcttcgtatgtctactactgtgtcttaattaattagttatatcgaacctatttgtatttactgagcttttttgtataatatatatagtcaattttatttgttgtttttttattgtttgtatgggtctggatatgtctagtgtaattctgtataagccaaaatatagttaatatggttaacttgttaatttaatcaacaatgaatacatatatcatggtaaaatctaaaccgagaagcctctcggtttagtgctaaccagcgacgatccaattgtgagaagaattactgctacacgtgctgatgtgcgtgttgtttttcctcttagacatgtgtgtctttttcttccttcttataaagttttctcttaaattacttatccgatttacaatccaattacaccattgtgttcgttacaattaaatcttcacaacaagatcttacatgattatattacgatgaaaaaatatttatatttgtaaattacttttattatatactaagttacttttataatatatataagttacttttagatttgactaaattacttatatacatttataatgctctaagttaattattcttattattgtttttagttaattctatattttgtggactttataaatcttctctacactttacttgcaaattcactctacatagtttcttatttcagctcactcacaatataattatttctactacagagagttactccccccgtttcataatgtaagtcattttagtgttgcccacatttatatagatgttaatgaatctagatatagttctaaattaaagttactttctttttgttataagttacttctataatatatgtaaattagttttaagctttactgaatttacttttatatgtctaagaagtaacttagtgaaatctaaaagtaatttagacatatcataaaagtaatttgtgattcttcatgaaaatataatcatgtgagatcttgttgtaaagatttaattgttacgaacacaacggtgtaatcggattataaatcggatgagtaatttaagagaaacttctctaagaggaaaaaaaatacataaatattgagtgaactagtagcttttttttttttggaaagaatggtgtctctttttagcactatccagctagcactctcggtgtagttgtgtccatatatcatttagaaggtataatagttttgaaaatatgttaggcaataatggttacatttcagaatctaaacagcatcagctaaacaaaaggaaggaaagagcttatagtagaagagagaagtagagtgactatacgtaatagggaaacgtaactatacgtaagtacgtcaagtatgtgcaaggaaatgagactggtacatacgttaggtaggtgggatgggaggtggtgctgtgggttttgttttttccattgcaagattaatcctatggcctacaattgcagatgttctattttattttttcaaaatttctcgaatttatctaatctattagatcgccagatgacgacctatgagcatctgtaagatgtttaatctattttgctatagatagaagatgacgggagctgatgctttatcctcccttgcacacgcacttctaatattaccagagtttcaacttccttgaaaaaaataaaaaaaaaatctaaactattaattggtgcgcacagtgaatacgttctaaattttgtgctctttttagttaccttttgctgcacagaaagcacaaatgggaagagatgggaacccggtaacagttgatatgccggagatgttgacgacgttgcccttgccggaggtcttgaggagagggtgcatcagctggcttaggtggaagcatgactctaggttgcccgccatcactctggagagctcctccggcgtcacgttcacggctggttttaggaagaggaagccaacattgttcacctgcaggtaagttaacaaattataagtcatctaataaccattttctgtatctctacccaacttctacacctctttatagcattgagagaaatagattaagaaaatgttcaagagatggatctgcaaccaagaaccaagtgtactagctccttgtcgcgatctggcagacacgccgccacaagctagcacatgcacacatgtgaaggttcttgcattttgtaagggaaaaaaatggagatcaaggctaggtcgtcagtttgtcgtggtttggtgtatgcgtacaaggatgtcgagcttgccgtcgaacatggcggtgaccctgccggcgagcgcctccctgtcggcgcgggctgacacgtcgcagacggaggaggtgatggagagcttcttggcgctccactcctccaggcagctgttcagggtagcctcgttccgggcgcacgtgtgcaccgtcgcgccgaagctcgccaactcctccacgatggctcgcctggatgatgcatatataaatgcttaatttctgccactaagctagtagtaatgtgccgaagcaacgatatgatcaaactgacgatgaacagacaggaggtcagaaattaaggcacacaagctagtactgattcttttttttttgagggaaactacggcgggtgtttaacaccagcctgaagctagtactgattctagagaggctatatagtctattggtgccgatttcggtgcgattagaactaatgaccggatagacactaatcagaaaagtcattggtgttgtttctagctagggtagcgctggtagcctcatagacgtccatgctaggccagaacatggtgatgaccgggttgcgcatataattaagaacgtaatctaaagagcttgaattggttggagagctagctgtatttgggattttgggatgaggtcctcgagcgccttaatttgtttcctcttctcaaacagatgtgaaaactacgtggaccttggattcgatgaagggatgaatattatttagttacccgattcctttgctgccgccggtgacgagagctgtggcgccggcgaggctccaccgcccggtctcctgcgcgctgctgctggatgccatcatctcttggggttggtgtgtgagggagacaatagagtggagtacttgagtactacttgtatgggcataaagcgtttgacgccatatatctgcacaatattttgggtgcttgtttagccgcaagcccgcaaggcccgcaaccgcttgccaagcccccttccttgtgtccacctcatgtctcttctcgtcatctctatctcttcttgtcatctaattagactcgtttagcaaggacatactttctattatttatacaaggatttccaaaaaaaaaagtcttatctcatcgtatccacggtagagacgtagattaccttctaattgtaaaatgactagaaaaaaaataaatgtgcgttataataggtgaagatatttttcacgattgataaaaactttgccaatagaaacgctaaactgaaataagacaaacaaaacaatgggaaaaaaagttagaaatcacatataacattgtacccggttgcgaagtgagcatagctcaactggttaggttccttgtggtggaaccagcccacccgggttcaaatcctagatttgacacgggtgctcgcatttacggctaattattctttcagtggtaggcgatgtacccgtcgacagcgaggcgcctgtggtgacttcgtcaatctcaaaatatgccgacccagtcttccggaggtgctcatagtgatagggtgtgcgtgtgtgcgttcataggggtgagtgtgctcgaggcgcctgtggtgacttcgtcaatctcaagatatgccggcccagtcttccggaggtgctcatagtgatagggtgtgcgtgtgtgcgttcataggggtgagtgtgctgccggcccagtcttccggaggtgctcataggggtagggtgtgcgtgtgtgccttcataggggtgagcgtgcgcacgttgtgagcgcctgtgtttgatagggtgtgcgtgtgtgcgttcataggggtgagtgtgctcgaggcgcctgtggtgacttcgtcaatctcaagatatgccggcccagtcttccggaggtgctcatagtgatagggtgtgcgtgtgtgcgttcataggggtgagtgtgctgccggcccagtcttccggaggtgctcataggggtagggtgtgcgtgtgtgccttcataggggtgagcgtgcgcacgttgtgagcgcctgtgtttgtactgtgtttctcaaaaaaacattgtacccggttgcactcgcttcatgcgtcatcccacacgaataatctcttatatacaccattccatagcctcataaatcgatcgggtggctatgccataggttaatgcatatggattttgctatacctcaccgactaatgattgaactttttaattattcaattagtgaaaggtttttttaccatagatagaaaacttctacatggtaacaaacttgccgcatatcaattgtaatttcaaaaggaaaatatttatgagagaaatttggaaaaataaaagaaaaggaaaggagagggaaagtgaggtaattggaaggagagggagaggattaggatgatcggaagaaaaggaatgaacaaaaagaaaacagatcgcgcaacaccgagtggaggtgcataggatggggaggcaggatggtgtgggccggttgggattgggtttggagatggaggggccgggctggaatgctggaagtgagtgtatattagttattttaggcttatggtgaattggatataggcgacgtagacttatggtgaattggatattggcgacgtacaactaactcaaagacagatgacgtactaaaattttcgtgtaaatatcttttaatttttataatagtagagaaaaggaaaaaaatatatgtcattaagttagaccacaaaatttgatatacaaatggcgtctcccagttcaaacagaaatcactttgtcccgcttaattacatgtaaactctcataacacaactacttattatcattgtctggcaatgatgggtccatttttaattgatgaaattgtatatgtaccacaaaaatgatcccgtttcaaagtcgaactaccattttaagcccgctttttcaagtttgctcattggaccattctttttaaaaatgaaggttgggcctgacctattacgtgaaagtaacctaatggtgttaactcactaagaaaagatgttcataccctttgccatttgaccctactttcccaatttttttattcaatccaacttttttgcaccgccatctgagagctcaaaaaagtgattaggctttacatgattactgtcaatcaaatgttaacagaaagacataaatctcacctctgggtgccactgtgtgtcacacacaacttgcttaaggtgtggctgcgtgatttgttgccaacaatgtatcctgaaaataatggctacttgaaacaaatattgaacttgcactttagcataggtagacttcactacctgaataggtcagcctcgttcccatttctctggtccttcacgtttttttgctagtaccattcctgatgtacgtgagagtgtcccgatctttcgatgagaggataagtcgttggatggagcaacgttggtaatccaactataactatccagggacgttgcgccttagcaatcgttacaccaactgtagaggtagtcgtgaatgtcaacggatgcacggtcagcctaaccacgaggatatttgttcctgcaagcaatcgagaactagcaattacaagatgaacaggcaactcaatttgcggaataaagttttaagattgaatcaacaaaagtatcacaggtggggtttcgtaatgagcaaaccagcgatctaaccgatcacgggattacatggtaaagtagcaagctaaactttgatctaaacaaagcccggattgatctacggcagctaagggaaataaataggtgggaggacaagttagggtcgccctctaaccctaagatgcatccctaatggacccaacttgatacacacccaaataaggtgacgcaacaccatggatagaaaaaggtctctatggtaaaacgatgattgtggcctctccagaacagatatggacattgtagattatgtgatctactaaacataatttgctaaaccgatacatgatcaccctaatgcggaattttaggattacactgaccgttatttgaagccatggatgcgattctccctttgttgtcaaccggagtggaagtaggggatcgagaacctcgaaccacctcctcgcttgtcggtgtaggtgaagtagattgtcacaccctgaagttcttctcccaagcctaaatttaatttataaatggtcttgagaaattaccggtgtaaaagcaagagtgaaaccctaatcaaattaatgcaaataataatcggaaatggcatgtggaatttttcttgagttctacatttcgaaatatgctaacaagatttttagtggaattttcagagctctagaaataattttaaccaattaaaaatgagcataagtgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctatgttctggtggatctgtgtgtgaaggaatccagcgagccggagagcgagagagagttcaggctctagaacccctttttcttctcttctcttctccccttctaggcctgggcctcctttttatctggtcaggggtcaccacatgggcctctagctgcctaagaaaggaaacatgctttttacaatgagggctagtctacagccggaagtgacctctgacaagcagagcacacgcctcctgcccccctcgccagctttcccggtggacgcccatttcaaccttcattcaatggccagcgacttccttgccatgcttgcgctgaagcctggactggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacgccgcgaccggtcacggaccggataagcgtgcgctgcgccgcattaaatgcggcgtggcgcgctcgtccaacccgctataaatgcggttaggtgagccccgctgtgctcacctaacccacacacgtggcgccaaaaccacagggggtcagggcgccccagccctcggggccgaaacgggggcggcccgacctctcggggagacagagggaggggtggccacgtcaccctcgggcccgacccccccgagggggtcaggccacgtgggtgaccgcggctacccaagcctctagtcacgatacccccgaccccatgtcaccgacagtagcccccggcgttacgccaaggcgatcacctccctcgagggaagcgctcgggcgtgacgccactccttaggcccggtgacaggtggggccggtccctacaggcgggcagaaacccagcggtcgcaaatcgcgcgcatcggcaagggaaaaccgaccgacaataatgagcggcctctttaagaccgctacattactcgagcagcgcgcgattcgggacgagccggttcgtttcgcctggagacatgatgatggcgcttttcgcggttggcgagcgtagttaatgcgcgcacgatctgccccatctcaaccgccacggccacacatctgccgcgtgcgccgcaaacgggtgagtggggttagtggaggcgtgggcgcgagaaacgagggggcgaggtagtgggcgcgggaagcgaggagccgggcatagcgttggcaagggtgtaaagacgctgaggaagggattcgtttccttcctctcgccactcttccccttgccttcgccactcgcgctccaactcttcgtttcccgtgccctacccttgccgcactcgctcgctctcaagctcctcctccgccggcgtcatggcacggggctccgcaccgctcgacggtagcatgctgccgccttcccgcatcgtgagcgagaggcaggccgggctgccgcgccgattcatgccggaatctgccaccggccgggaggtggtcgcgctaggcgagggactcccggcgccacactacccggggcggtccgtcttcttcctctctttcgcaatggcggggctggtcccgccattctctatttttttcatggatattctggagttttatgatctccagatggcgcacctcacccctaacgcgataatgacgttggccatcttcgcgcacctgtgcgagatgtttatcggggtgcgcccatctctccggctgttccggtggttcttcaccgtacagccggtgtcgccgccgacggtagtcggtggctgctacttccagccgcgggggcaggtgctgaaccgctacattccctgcgtcctccgcaaaaagtgggacgactggaagagcgattggttctacacccccctcgccgatgaagcgcgcctccgacttccgagccagccgtagatctgggagatggctacgacgccgttcttgaccgcctcgcgggtctgcgatcccaggggctcacgggagccatggtgttcggcgactaccttcgtcgccggatcgcgccgctccagcggcgcgcccggggcgcctgggagtacaccgggcccgaggactacatgaggacccaccaggggcgcaaatgggactgggaccctgaggacttcaggatggtggtccaacgggtgctgaatctcagctccgtggaggcatccctcatcccccaaggggtcctccccctttgctgcgatccagagcgcgccaacatcctgaccatcatgcaggaggtcggggcgtcgggggagcgggccccccgaggccacgatggcgcgggcgggagccgcaggggggaacaatctaccccgggagggggtcgtgcttctgggccccgcgacgggggcccggagggcagccgtcctgccgacgcccgggagaagaggaagcaggagggtacccctcccccatctcctccccgagggggcggggtggtgcgtgccagcagcaggcgcccggagggtgccgtgctgacgccgcagcccgagggggagcgaaagaagaaacggctccgcaagatgggggggaccgagccatgccgggggaacctcatctcgcccccgaggtggtcgtttagccgacctccccgcaggttcgtccccgcgcccaccgcggccgtattcattctcctatctcccaaggcgagttttcactcacccgtttctttttgtcttctggtttttcttctgcctcagcgagatcctgtcgcgccccccccccccccgcccgccatcccaagtccggcgggtctgaggtcgaggagacggcgaccgcggaggcccggaggcgggaagctgaccagcgagaagccgcggaccgcctccgggaagccgaggaggctgcccaggaggccgtccgggttcgccaggctgaggaggccgctcgagaggaggccagactccgccgggccggggagtccgtccgggaggcagaggcggcgcgcgcacgccaggcggcctgccaagcccccgacccgactccgcccgaggcgacgacgacttccgaggccacccacgacgaggccgcgggcgcgccgctcgggcccgacccctcgggcgacgcttgggacgagccagcttcgggggacgcccccgagtctggcacgtcgatcggcgggccgagccgcgcggcacccacaccgagacggctctcccctctgccttccgctgccccactgagcgcggagtccctcctgcaggccttggccgccgcgaacagcacggtgctggacgggttaagtgcccagatggaggccctgcaggcggagcgggcggagctcgacgcggcgtgggcgcgcgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcgccaccgccgtgctcgacgaggcgcgggacgacctccgcctccaatacgggagccgggcggcggagctagaggagaagctcgacgccgcccggggagtccttgacgccgccgctgcccgggaacggcgggcggcggagaacgaggcggcgtcccggcagcgcgaagaggcccttgaggctcgcgccacggcgctggaggagcgcgcccgcgccctggacgcgaaggagagagacctggcggaccgcgaggccgccgtcgccgcccgggaggcaacactggcggcgcacgaggccgcctgcgccgaagaggagtccgcactccgcctccgcgaggacgagctcaccgagcgggggcgagctctcgaggaggccgaggccgtggcgcagcggctggcggacagcctgttcctccgcgaggtagcgcgggaggagcaggcgcgccgcaatctggaaggcgcccgcgccgagagggccgcgctggatcagtgggccgcagagctcgaggcgcgggcgaaggagctggacgcgagagcgcacagcggcggggcggccgcgggccagggcgacctagccgcccgccttgcagccgccgaacacaccatcgccgagctgcagggcgcgctggacttgtccgccggggaggtcgaggccctccgcttggcgagcgaggtagggcccggcatgcttcgggacgccgtctcccgtctagaccgcgccgggcggcaggcgggcctctggggcaggcggtacgcgaagtacgccgccaaccaggggggcctcgcccagcgcctctcagagatggccgggaccctcaagcggctccccgaggagctcgaggagacgatcaagtcatcctcgagggacctcgcccggggggcggtggagctcgtactggcaaggtaccaggccagggaccctgacttctccccgtgggcagcgctggaagagttccctcccggaaccgaggacggcgcgcgcgcgcaggtccgggacgccgccgaccacatcatccacagcttcgagggtacggcccctcggctcgcgttcgccctcgactccgacgaggagggcggtgacgacggtgcggacgacagcgacgacaaggagggcggtaacttttccttcttcttccgaggccttcggcccccttcttgtatagactgatttaatctgcaatcaagtaaagaggaaatttctgcgtcagttctgtttgttgtgtgtataagacgaggatggtctgtgccgcggtcattctgtgtcttagcttgaacaagggctcgtgcccaggtcccagcctcaaacggcgcgggtcggggctagtgcctggggagatcctcgtgtcgagactggccaggctgggagcgcggtgaccgagggttatggatgacccgattgtgggcctttgccgattcccccccgaagttcaccacgccccggggcacggctcggttctgggccccgtttggcgattttagccggcccgggccaccgagggcagggtcaagcacgagcgtgctaattcaagccaagattcttcaaaaggaaacgatggcacagacacagtcctcaggaaatcgaaaatgcttttattgaaatacggaagagaaaaaaggtaagtatatgcatgtggtagcccaggccaaccctgcacgcccgggggggtgcggggttggcccgagcccgagacatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagttcagcacgcgtttggacgcggcgtaggacgaggtcgtcgacgcagagtgatcgggcccggacgtggcactgatggtagcgccgcaggctctgctggtagcgcgcggctcggagggccgcgcgccgtcttcactcttccaaatagtcgaggtcgtctcggcgaagctgatcttgatcagcctcggaatacatggtgacccgaggggacctcagggtgagctcagatgggaggaccgcctccgcgccgtagacgaggaagaaaggcgtttccccggttgctcggcttggcgtggttcagttcgcccagagcaccgctggcagctcctcgatccacgagtcgccgtgcttcttgaggatgttgtaggtcttggttttgaggcccttgaggatttccgcgttggcgcgctccacttggccgttgcttctggggtgggcgggggaggcgaagcagagcttgatgcccatgtcttcgcagtagtcaccgaagagttcactagttgtcacgaccgaaaataacccaacgggcgttccttacgtgcgtgcattattccttgtcccaggaggcaaggtacaccaaaagttgatacagttcagagttcaacaagcggaagcgtaaatagttaatttattacatgggcagcgaaggcccagcacacacaaagacaaacgagaaacagcggaagactagggcgacgaccacaggcgcttgacggcaggcacgagctagacaccaaaatcttcatcttccggagactcctcttctgggtttgggaaaaattgagcaagactgagtacaaccaccgtactcaacaagacacaccgacaagtgcataataaatgcaagggagtacaagggagttataatataaagggttagggttgcagtaaacagcattaaaagacacttagttgctcaaagctattttgtaaacacgattctagaactatacaatattatttatcaaggccgtgaacccacacgaacctgccttaactcaaggcctacgatgattcagaccgaaccggcaacccgaccctgggtcccagctcgtcccaagccaacccaggccaaccattcctccttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccgcaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaactattttgagggttttgaatagagggggaggtgtgaatccaattccacaataatcaaaccaatccatagtgtccaggtgatacgaatatcccaaagtctagagttgaaaaaccacctaatgttacctaattaaatagcgaagcatctacctaaaatcatactagtggtaccatgagtagagtgtccactagttggggttttgtttattctagggtgaacaaggaaataataacaataacaataataaggtcataacaaaggaaaataggcatggctagataaaacagtgataacgcgggaatttaaataaagcgataatgcaataatttaaagcaacataattttataaactgggattcaatatgttcaaagatgatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtctaattccgagttcaaatggccaagttatggccatttgaagtttatatgctctttaaatgaatatttgcgaatttcttcatttaaattttaatttaaaatggatttattgcgtcagccgaggggaggggcgcgcggactgggtccacgggagtggggcccacgtggcagccccacggcccacggtggaccgggcgcacccggggtcgcaccggccggcgccgtgggtcccacgcgtcagccgcacctaagggcgcgggcggctgacagccgggccccacacggcagccgcggggcgtgcccaaaggcggccacgccggcacagccgacgggaggcggcgcgcccgcgcccctatggtcgccggtggcggccataggtacggcggagcggcggccgagagaggggagggaagggggaaacgaatcggcggtccacggctcaccccgggtcgatggcgacgacgggaacggcgaccggagctgaggaaggcggcggcgcggctcgggtggacggggtcgacggtgctccggcggtcggcgtgcgaaacggaggggtggacgaggtcggcgaggatgcggcgaagccgaaggaggcggcgccgaggggagaggtggtccggggcgacaacggcggcggaccggagctcggcggcgacggcggagagagagagcgacggcgcgagctcgattccggcggggagagagagcggcgagtggcggaaacggtggagggaggcacggggagggtttatatagggttaagagagggaaggggtggccggaggagggggaaacgggcgcgggagtcccggccgccattaatggcgccggcgaggttagggggaaagtttccaaatgaatccgagggagagagagagggaaaaatggggggaaagagggaggggatcccggggaatatttcccctctcttgattgcacgcggggcggacgggggcggcgggattcgcggcggcagcggcggcgctagggcgcgggcggggcggcgggagcggcgggaggaaggggatgacgggtgggccccacccgtcagcgagggtggcgggcgggcccgcccgtcagcggcgcgcgcgcggggaggaggccgaatgggccgcggggaagaggagagagagggaaagagatgggccgagctggcccaagagggggagggggaaaaaaggactttttagagcttttctttttataaaaccattttaacttcgtttatttcttaataattattatttgtgctctgaaaattccactaaaatttatttatgcattttaggcttttaggaaatatacaaaaatcctccaagccttatttgactttttactttgcacattttaattgttggaggctttcacatggattttaattattctaggcataatttcgaggatgtattttagagtcgttttgagacgcgacactagtgaactgggtgccgttatcctatttgtcgtccagaagaccaccgattcgtgtggtcttggacgggccgtcgctcagggcaacctccttgaccgggacctcgtcgcacgtgaccatccgctgccttggggcggccgggacggaggtactgagcctctcgtcgccacccgcgggcttggacgccgcggcgaggtggtccgcgcgctgctccatacaagcaagcgcgactttgaggtcgccatggacggtgatggggccaccggggcccggcatcttcatctggtgataggcgtagtggaccgccgccatgaacttcaccaacacgggcctccccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggatggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccaggcaacgcacggcgggtggtcggtctggtcgaaggtgagggcaacctccgaccaccgcgcccgccgtgtcgcctcatgggtaggggccgcggccagaagctcgcgcttcatggccttgaggctccggcgagaaacgtgagcgcacgctcccccatcgacggtggcgacggtggcctcaggctcctggaaccccaggtcatcgtcgccatcgtcgatgtcctcggcggtggccttctgcttggcctcacctcgccggttgccggcgggagccgccggggccttgccctcacggcgctcctgcctcttctcctcctcccatttcctcgtccgctcagccaaacttttgaccgcgcggcagtccgcgagatcgtggagggtggtgttgtgcacggtacaccacttgccggtcgggcgctccctgctgggagcgccggcctccttctttttgtcgctcgcaggcctcccctttcgtggggcccgcgaagcgccctcgacggcgaggacatgaccctcgtcgtcggaacgggccgacttcttcttcctcctcctgtcccgccgctctgaccgagcggcggacccgggggcggccagagctgccacaccagaaccggaggagttccaggtccaggcctcctccttgcgagccacacggtccgcgagctcaaaaagctgcgcggtggtctggggctccttggaggcgatcttctcgagcatgcggttgtgccgcacgccccccctgaacacgtagatcaccgcgtgtgcggggatacacggtatggtgttgcggacttgacagaaccgctgaatgtacgagcgaagaggctcatcgtcccttcgctgtaccgcatgcaagtccgcttcttcgcctgggcgcggatatgtgccctggaagttcgtggtgaactgctggcacaaatcctcccaagagtagaccgacgcgggtggcaagttcattagccaaccccgcgcctgacccttcagggccatggggaagaaattcgccatgaccctgtcgtcacccccggcggcctcgatcccggtcgtgtagatctggagaaactcagcggggttgacgcttccgtcgtatttttcggtgatggtggaccagaaccttgggggccaacggacgttccgaaggctcgccacaaaggctcgacagccggcaccgccaaccggggacacggggggccggcccccgtgcccggaccgaagtggcgctccggacgaggaagcgccctccgttgcgtcggcggcgcgacgatcgtcgcgccggcgctcgatatcgaggcgggcatccggccccccacgcacatcttcttgggtcggaggcgttgacgagggaacggcggacgaacggcgggtaacggccgccgctcgccgcgccctccgcctcgacgacatggagccggcggcggcagcgccagaggcctcggtggcggaggaccgcccgccggcgcctaggcgctgctgcgccgtcatgaccaagtcagccacgtcatccagccaacgtcgggccggagtctctggatcggggacgacgggcgggtgacgcaggagcgcgcccgcagcctggagcgcgccctggggcatgccgccatcgccgtagacgaggcggcgacgcgccccgtctcgccgtcctcccccgtcgcccgcgggcggcgaagtcgcggatcctccgacctccccgagcgcctccccccgcccaagatttcggcgagagggggacggtggggtgcgagcccgacggcgcgggttctgctccccgtcgtcaccgctagcgttcggagagaggctgtgcaccactgcccgttcggccattgggctgagcgggagaagcttggcgcacacgaaagaggacgagggcttagaaagtcacgcgcgccccctacctggcgcgccagatgacggagcgtggggctcctcactgggagaccgcgcaggcccccctttgccggttcggccggggacgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgtgtgaaggaatccagcgagccggagagcgagagagagttcaggctctagaaccctttttcttctcttctcttctccccttctaggcctgggcctcctttttatctggtcaggggtcaccacatgggcctctagctgcctaagaaaggaaacatgctttttacaatgagggctagtctacagccggaagtgacctctgacaagcagagcacacgcctcctgcccccctcgccagctttcccggtggacgcccatttcaaccttcattcaatggccagcgacttccttgccatgcttgcgctgaagcctggactggatctgaccgggactg

SEQ ID NO: 68620 - DNA, 17678 bp, Oryza sativa
acccctcggggagacagagggaggggtggccacgtcaccctcgggcccgacccccccgagggggtcaggccacgtgggtgactgcggctacccaagcctctagtcacgatacccccgaccccatgtcaccgacaataagcattatttaaatccctggaaattctttcctttttttctttttcctttttcccctcctttttccctaatgggccaccagcccatttcctcctccctcccgcacctagctgggctggccgaaggccacggcccagctgagcccgcgcctcctccctcctcccctcgggtcgtcgacaggtggggcccacctgtcgggcccgtccccaacctccagccgcccaccgtccgcagccgccgcctcgcaactgcccgcgcccgccttccccgcaccacatcggccacgcccgcgcgtgcgcccgccttctctgcgcccctcaaccccctctcccgctcgcccgcgcccccgagatggctgggatttgaatttcgaatcccgcctctgtctccacctccacctccccacgtcggccggcgaaatcgggctgctcccggccacgtccgagccccctctcccctatttaagcatcaccgctctcccctctctctttttccccatttggccaagctctctcgtgctttcctccgctctagcgtcgttgccctcctctccgccgccatttcggttgccgctagccaccgctagccgccaaaccgagccaccgtcgtgcgggccgcctcatccacccctcctccgtcggattccggggctggaacccactccgcaccgagcgttggtgagttcggccatggtcgccgccttcggccggcgtccccgccttctatgatctctctctccccctctaacttctcccattttgctccttaggttgtcccggaccccgtccgccgctcgttgacctctctccgtcatttctcgtcgccgttcgccgtcgtctccctccacgccagtcggacctcttcggtgaggacaccccctccttcttccccctgtcttttcctctcgtagcgccaccgcatagctgccgccgggccgcccgccggtcaccgccggtgtcgcgccgtcgtgcgcaatggcgccgggccggcttgagccgagccccgtgcgcgccggccgcatcctcccgccgctgtccgatctacccgggggtagatcggggccgtccgcctcgccacccacgtggctgccatgtggccgccacgtcagcgccatgtggtgtgctgtttttccccggttcgtggacccggtccaccacggaccgcaaccccgagccactgccatgtggggcccgcgtgtcggtgccgccccttctctctccagggtttatttattgcgcaataaatcctttaaggatttttctgtttatagtaaaaacacagtgaaccttctaaaattcatagaaaactcatccgagctccgtttaagcccattcaagtctcagtaaatcaagaaaaatgcaaagaatccattaaaaatggttttgttctctgtttcagtagtcttgtattctgtttgtattgtttgctttgtatgtcgcttagattccggctctcccgacgctccggtgtactttgaaatagtcaccgagattcctccagcagcaaaccaaggcaagtcatgcttgtcacttgaacatattgaacctatattgcaaatgctctatcgttttcccttaaacattgcattgttttataatgttactatgggatgttgacctactgttacaagccatgctatctttgtaccttgctcctttgttagcatgggatatgacctgattagatgttggattagaaattgcttagccatgcttagttcaactagcacacaatggggaaactacattaatgtatagctatcacattctagtattgttgagggtttagtgccaccgctttggtgacggttaattaaaatatattaaatggtgggccgcgggtgcatggttctgatggtcgcgcccatggcatttaaggaccggttcgcgggaaaccctggaaaaattcctcgtacttaccacaagccagcgtgggcaatggctgggcttgtattgtagctttcctctagctgacgcatccaggcaagggtgagcgtgatggagttcggatgggtcctgcgacggcctatgcggctttcggattcacctaggcacgagaggggactgcccgctgccttgcgaggagtgggggtgaaacctaaggtgtggtgtgtttggttagagggggttatgcgaagcgtcctgtcacggtctctttccggtatgtcgtggtggcatgtcagcgcacggaaacgtgtcgtggggctgtgtcttgtggctacagttatacacctctgatcagagtaaaactattcgaaaacgtgcccgcgattatgggcggtcaaccagattcaccatgattagtctcaccctagcttagtctaatggaattgattatttcaggtggatggttgggcctgttgcaacgtggtgtagcattggacagtggatgagtaatattgattaattattacaactgttttaccgctttcaactactgtttataaatgctcgcttttatgcaaatgaaccgctctagctatcctttggttatatcctgcatcataccccggttccggtatgacatgctaagtacagtgggtagtactcagtcttgctctattttccccaaccccagagtttgagtatgcgccagatggtggcttttccgaggagtaggcttcgtccgtgccgtcgaggatgcctgtggagtggtgttcccgctgcagtccaagtcaaggatcagctccagttatcttttattttccgctgcatttatgtaagacttttatgatgtttgtaggacgtagatctgtatgtcaactttgtcgtttgtgtaccctggccggtcttggacaggggttttaatgcacatgttgcttggaattctattcggaaatttctgggcgtgacatagatgtaatagtagtagtagggacgccggcttgatcccgaaggggtcgccggcgatcacttgcggggtagcggtggacttctggtcgccacctgcactatccctgaaccgcctcacgtttcccctccagcgccaatgttgatcggggtttagggttttgttatcggggagattgagaccgagagagatcatcatccctcttgggctggcctccccttttatatttagcactgtagggaatcaggggcgactcaataggaaataaattgggcaccaccgatcacggcgcgttagttaatctggaattaaaacggattcagtcgctgtgatttcgcgtagacaaggggtggaaaacggtctagcacgatttcctcctagcgcggtctcctcccggttttccaaaccgagagatcaattttcccaacattctcccctttgatcttgaggttaatgaattctttcttaataaaatagttcaccaaggcaacgcgtcatggcagttatcatatcgtaccaagactccggtacctatagttcactataaaatttctaaagaactctatctaatcttaatgggagttagttaggactaatgcccctatttccaggatcttagtcttaatcaaaggcaatcagttattcccatgccggctacatgatctttaaataagttgggaagtaagcctttggtaagcggatccgcgagcattgacttagtactaatatgctcaatcttaatggtttgatcctggattctatctttcacaacatgatacttaatgtcgatgtgtttggcagcaccactcgacttgttgttacttgaatagaatactgcagctatattatcgcagtataatgtgattggtctagaaatgctgtcgaccactcttaaacaatggataaaaatcttaagccatttggcctgccccgttgcttcaaaacatgccacaaattcagcctgcattgtcaacgatgcagtcaaagtttgtttagagcttttccatgaaatagctccctttgcgagagtgaagacataacctaatgtagatttcttagtgtctacacatcccataaagtctgcatctgaataacctaggacttcaagttcttcagacttcttgtatgtgagcatgtaatccttagtgccttgcaaataatgcaagacctttttaacagccttccagtggtctaatcctggattagactgaaatctgccaagcatcccggtaacaaatgctaagtctggacgcgtacagacttgagcatacactaggcttctgacagctgaagcgtatggtaccattttcatctgatctaattgtaatttatttttcgggctttgaaatgatccgaatttatcgcccttaactattggagcaggtgttgcagagcacttactcatattatatctttctagtactctgctaatgtatgatttctaagataatcccagtactcctctagacctaaaacataagatacctcaccaagatccttcatatcaaaattagatgacaaaaattctttagtctgatgcaacatattaatgtcgctgcttgctaacagtatgtcatccacatagagtactagtattataaattttccacccttagtattaatgtaaatgcaattatccacctcattctccttaaatccgaatctcttaattatttcatcgaatttaaggtaccattgccttgacgcttgtttaagtccataaatagatttcttaagtttgcaagccaaatggtccttgccttccataataaaaccctcgggttctgccatgtatacatcctcatgtcagtcaccattaagaaatgcagtctttacatccatctgatggagctctaaatcataatgagcaacaagcgccatgacaattctaaatgagtctttcttagagacaggagaaaaggtttcattgtaatctattccctctctttgtgaaaaaccctttgctacaagccttgccttgaacctttcaattttccctttggagtcaagcttagttttgtagacccaattacagcctactgttttggctcctttaggaatttctactaagtcccagactccattatgactcatagattttaattaatcttccatagcttcaagccatttggatgaatgttcactcgttattgcttctttaaattaggtgggatcatctaccttcccaatatcttcacctaaataaacctcataataatttggaatggcagatctcctctcccgttgtgatcttctaagtggttcattttccatcactgacggttgagaaggttcctctagaatttcttcattttgtgcctcagaagtatgttgagtgtcattatttaattctttattattttcaacagagtcggtattaccagaatttttatctggtgctaccacggtctgagtcacaggtacaacatgaggtaccaaatttattggaatattattctcttggatttccggtgtaacattagcccgaatttcctcaagattaatttccctttcttgtgagctcccacagacttcattattttctaagaatacggcgtgtctagtttccaaaaatttagtgacacggtccgggcaataaaatcggtaccccttagatgtctcagggtatccgataaagtggcagcttacagtcttaggatctaatttctttagttgtggattaaatatttttgcctcagcacgacaaccccacacacgtaaataatttaatgtcggttttcttccggtccataatttataaggtgttttgggtaccgacttacttggaactcgattgagtatgtgtgcagctgtttaaagtgcctctatccataaattcacagacaaagtagaataactaagcatactccgtaccatgtccataagtgtacgattgcgatgctcagccactccattttgttgtggttctccaggcatggaatattcggcaattattccatgtatctgaaggtattgggcaaatggaccaggactttgcccataaggagtatgtctcccataatattctcctcctcgatttgatctcactaccttaatttttgcattatgctgattttcaatctcagctttgaatattttaaacttatcaagtgattcagatctatctttaatggggaaaacgtatccataatgggagaaatcatctgtgaaggtaatgaacgagtcatatccatcaacagatgttactgggaacggtccacatatatccgtgtgaattatttctaatggacacgtgctcctagtagctctttcttaattttcttagtgaattttcccttaatacaatctgagcaatgatccacattcgaaaaatataagggttgaagtatctcttccttaatgagacgctccattcttcccttagaaatgtggcctaaacgacagtgccacaatttcgaagacgtctcattatcattacaggcattcaatatattcataatatgatcatccaaagagagcaaatagagcttgtcttgcacgctagcaagaccaatatcaatattattatacttaataaagcatttgtctttagaaaaattacaatcataaccactgtttgttaaaaccattacagaaataaggttcctcttaacagagggagcataaagaacatcatgaagtaaaagattattgccgcttagaagtcgaagatgaagctccccaacggccatcactttaatttcagctccatcagcactcttaggatccgctccccctttcttagcgtcctcacggaacggaaatccctgtaatgagttagcaacgtgcacagtggcacctgagtcaatccaccctgatttatgagaaaattcaacataaagtaattcatcaacattagagacaatattaacattagtacctttcttagcaagcgaagcccgaaagccttcacagttcctctgtgcatgaccttctgccttgcaaaacttgcaaaagaacttaccagcagagttctgacctgctggaacctgagctttgcccttatgggcaccattagaagcctgagtggaaggagtgttgggcttcttcttcttgttttgggagttgctggactccccttgatagaactttttcttaccgcccttagcactatgaaggaggttcagctgatccttatgcttctgtttgtcagccttttgacgatcctcctcctcaatagaatgagaaatgagttcttcaatggaccacttatccctatgattattatagttaatgatgaaagactcaaaatcatcattaattcccatgtccatactcttaagctctccattcatagcacccatctgcataatgtgctttctcacaccacctttataattatagcgcgtggacgttaggcgcttaattatagagctagcgtaagacatagaagaactcctgaagttcctatcaatattttctaagtatgtcttaacatcatcagagtcctcaataccaccaataatgacatttgatatggcactcttgatgtacatgagagaaatcctattggacttctcccattcattagttttctcacgatataacttcagtttctcctcataatcgtgctgaacactaaagggttcctcaggacggtcctctctaatggcataatcataatcaagtatgcctaagttgagcaacacgtcagccttccacttagcataatttgacccttcaagaggctcaatgggtcggatgtcacgcccggaatttctatccaaaattccaaacgcttacatgtgtgtgaaccctcgtccaggaatcagccgaggcacacaataacaaattgataatagagtacaaatattactctaattaataagcgaataaactgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttaacaaatatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgaatcattagttatcccataagtgagctaatgtttctaagcatggctaagcaattatatctaatatctagttgaaccaatataaataaagctcaactagtcaaattataatatcccaaggtatcaaggaataaggtgatcaagaacaaaagggctatagcaacaataggtcaattccactcaatgacattcgaaaatagatgcaatagttgaatagaaacaatagctttaaataggatcaacatgctcaaagggttgtttgggatctgtgtgacttgccttgctgccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcgattttagaaaaatttagagacttgaaccaactaaatcggagctaagatgaattagttatgaatttttaaagattaaatcggattaaaacacttaaattgattttaattgaattatggcgcaataatgaattatttttgaaaaggaaaaggaggattattgcgtcaacggctagggtttggtggaccgggcgcacgggcgacggttcacgcgaacggacggccgagatcgaaccaatccaaaacggacggccgagatcgatcggtctacgaccggctcacggaagagggcgacgatgacgtcagcgatgacgtcaccaccggcggcggcggctcggcggctcgggcttgcatgctcgccggcgaacgacggcacggcgacgcggacggaaggcaccaacggaccaaagcgacggcggaggaccaacggacggcgacggcgacgaggttgaaacggcggcggagatcgggtcgacgacggcgacgatgctccgacggtctccgacggctgcgaagcagcggacgaggacggcgacgacttggcgagcacgacggcggtcttcccgaacgacggcgacggctgaaacgacggcaacgcacggctggagcggcggcggcgacggcggcgctagggcacacggcgctagggctcttccggcgacgagaggcgaaggcgagggtggcgacgggtagaggagacaccgggggtccttttaaaggggctaggaggcggcggcgaaggcccacggcggcggcaacggcgaaggaaagctcggacttggagagaagaaagccgatccgattcgaactcgaatcaaactcattccaaaccgatttagccgaagtttccaaagaagaaaaggtagaggagatcccggagatcatttcccctctatcaattcggccagagaaggaaaggaacggccagattggaaagcggcggcggcggcggcaaagctagggtttcggcccgaggaggacgacgatcccgacaggtgggccccacctgtcagcgggcggacgcgcgctcgcgcgcggcggactgggccggctgggccgaggagagagaagagagggttttgggccgactttcggcccaaagccaaaagaagactttttaaaacctttttcaatttaaattattcatgaaatgcaattccatttattaaaaatacttccttagctcaaataaatcccagaaaaatctaggaattatagaattaagcaaagtatttagtgaaattttatctggccccattttatattggaatttattaattaaaattagatcttctcttcaagacttttaaaattatttctaaaaattccagttaaacaacaatttatatattttgaattttcagggtgtgacatcggatctgaccaaaagctgaaaaaatcatgaagaaaaaatatccaaaagtacatatatgcaattaatttgcgttggctcaattaattacataattaaacagaaatgaattcccctaattacatcaccgttgggcagaaataattttgggaaacataatcataaataaatttacgtgaatttataatcaatgtaggtcagaaaataaattcatatcatggaaaacaaatatctagccaaatttctcgttggttccatttagctagtattaaattaataagcctccataaaaaatttcataatttttcagcaattttaagcaatataaatggtactaatgcaatttctgaaaaatacttaaaggtggattaaaaaattagaaattataatatttgggccggcctggcgcgtgcggcccatgatgcatggctcggcccaacccggagggcgcgctgcggcctgctaatggcagtggcccgatcggaagcgatccgagccgttcgcttagatggacggctcagatcgattaatattagtaaaagaagaaaaaaaaattaaaaacataaaagtgccggctctaaccctaaccctaaaaatttccccattatgtttctctctcccgaaaagaacggctgcagcggcgattttcacggtggcggcggcggcagcggcgcttgtgaggcggcgccacgccatgacgtcgcttgaggcggcggcagagtgcagcacgggaggcggtggcagcaaggcgcagcacgggaggcggtggcggcagggcacagcgctggtggcggcggcggtagggcgcaacggcggggcggcgcggtgcgcagcggagaggccgcggccggcggcgcctcatgcggcaggctgatgccgcacagtctgatgccgtgccggcacccgccgtcccggttctcctccacacgcagccggggccatggcagcgaggctcaacctcgcgcggctaacgggaggcaggtgcgaggccggtccaggacgacggcaaggacgtcaacgagcgcgcgggcgagctgatgccacgcgcggcgacgacaacgtgtttgtaatgccggtaagtgagttgctaatttggggattttagggttctaatttggggaattatgtgattagggtttctgaaaattttggggaaatttggggattgttactatccgccgaaattcacctccttctaattgctacccaagccctaatcgatcttggaacgtaaacctaaacttaataaaccatgagcagcgcttaatggaaacataatccgaataaaacatgattaattcacattaatcttaatgtaatttgcatcaaaaaccgacatggaaatgaggcttagatgcatcttatggcttctaaacaggatgatgggatcattaggctatagcagtggctctgataccaaatgtagattatgtgatctactaaacataatttgctaagccgatacatgatcaccctaatgcggaattttaggattacactgaccgttgtttgaagccatggatgtgattctccctttgttgtcaaccggactggaagtaggggatcgagaacctcgaaccacctcctcacttgtcggtgtaggtgaagtagatgtagcagtagcagtagggacgccggcttgatcccgaaggggtcgccggcgatcacttgcggggtagtggtggccttccagtcgccaccagcactgtccctgaaccgcctcacgtttcccctccagcgccaatgttgatcggggtttagggtttggttgtcggggagattgagaccgagagagatcgtcatccctcttgggccggcctccccttttatatttagcgctatagggaatcgggggtgactcaataggaaataaattgggcgccaccgatcacggcgtgttagttaatcgggaattaaaacggattcaatcgctgtgagttcacgtagacaacgggtggaaaacggtctagcacgatttcctcctagcgcgatctcctaccggttttccaaaccgagagattaattttcccgacagacatgagaccggatccatttgaaaatagactttataagctttccatgaagtgcttgcactcccaaattggagttcgtatgaagtcgtggcggtcgtcacatggtgctttccttcagtccgaatccaaaccgcacgaatactctccccttttgatcatctccatcattcctgagtaaaacaagagcccatgcgtctccggggtataaataagatgaacatgaactcaagaatgaagtcacctgatagttgagttgatgtgcacaagcgcggacaataggaccatgaagttgtacttgtagagacgtggatgtatcgatggtgttgatgtcctcatcaattcctgctattcacatagtactatatagttttcttcttgatggaagtgtcaaatacttactaggaagtccccgtgggtaatcaccaaatgttctagtatgagtaaatctagttccgggtggtcatctagtatgggacctaagagaagccctttttgtatgtgtatgtcttacttgtgtccaaatttatttaatagtactctagacatactgtttttctcagttaatgggataacaccgttgacattagacatgaatatccctctaacgggtgaagtcgacggtgatgccatgaaatctttgccccgtatcatagaggatggcataggtaagcatgcatgttgaactataccgataacagtggactcccaccggggccaccttatgtcgaaactagatttcgtcaatactaaaagggggtggcgaacaagctatgaaagtggatgggttaggaaacaacggatttatacaggttcagcccttctcgatgataagtaataccctactcctatccgaggaaatattccaccgatcgtggtatttatctgatgatcttggatgtgattctcccctcagggcacccccgacccctccttatatgggctaaggagtcgggattacaagagagcttatcccttacgatctaagttctatatatactttacaattgtaaccgactaagactacgggatacttccttgacatagaagttaacataacacccgagtccttatctttacatattttgttactctgagttacccccgatatccagtcaggtaacgtagccctgtgggtatatggtacccataatctccacagtagcccctgagagcttcatagatgacgagacaaccttctcccgagtggtaatgatcttttgacgagtgatttcatgaagaattcgagtacttgaatcatcctcaccacaactcccgagtacctcaatcatctcaagctatgaagggctaaaaaagaaaaaaaatctaggtgcatcgactagatgcaccaaattaggtgtagccccccgactatatgattagttgaacaacctaaacatatagtcaataaaaaaataaacaaccgagtggtttataaaaaatatagtcaccaaaatgattgaatcaattagaaagcatatgcggcttaaatcctcaaaaataatcataattcattggatataccgactgcttttgatatagaaaaacatttagcctaagcataaatgctgattttaataatttacttacgtgataataacatttgatatagtaataaaaatgttgtattaaaccccacaacttttgcagcttataaagaagcccacaaaataagcataacaaagctataaactatagggtaccttttaaaattcatcgtagcaatttcctaaggaattatctaacagcggtataaaaagatatgtaacggtattgggtaattgatcacgtacaaattgccgaagcagagtttgctgaaatcccaaaggaacgtgacaaatcacaccgaaggatatgggctgaaaacactatacgggcctcggcccaacactgttttccaataccctaaataaaaccgccgaaatgaagtcatcttcctgcgctgcttcgtcttccttgcagaatcccctcacaaagcgttattcaaaccttcacgccgccagagttagggttcagatccactgcagcattcgccatccaaaaacaacaccaactgcacaaatcaactacgggcgaacccatctccatcttcccccaaacgatttagcaacaatcccccgcaaccctctcaaccaatctcacggaaatggcagaggagagagaattggctcaaagccagtgggctttgtctgacgtcaaggaatctaccttgttggagatggtggaacactgtgttcttcccagcaaagagatcatcggttggcatctagcattcggtgaggccttccccactccggacaccgacgaaatcatggtatttactcacttcttctactccggcttcgctttgcccacgtctgatttctttcgttgtcttctggaattctacggaatcaatatttatcaccttaaccccaactcaattcttcacatttctgtcttcattcatctgtgcgaagccttccttggtattcagccccattttattctttttcgctgcatcttcttcctcaaactccagcctaacaagagaaatccctgtctggttggcggatccggcctgcaactccgcgggtccctctccaaaaaatacttcagtcttccttttaaatcatccaataagggctggcattcgatctggttttacatccataacccttctccttctctacccgagtactcttgcactcctcctgtctataatgaaatctggagttcactcccgatgggagacgagttatctcaagccaaacaccctcctggaaaaaatgctgaaaatcaaagagcagggactgcaacgggagcaagtcacctggcacttcatcaaatgctgactagctctgataaaagagaggtcaaagcctgccttcgagtacaagggccaaactgtcccaatcatgaagaccccgactcactggacttcaagatcacgaaggctagaatgtacacgatcttctctacgggcattgaggtagactacagccaagggctgcctgttacccctttcaacatattcaacctgcctccaaaggtaattgtcaacaaacttctgccttcttctttcagtcggtatcataaattgtaattcgctttcttgattgttgctataggaaaatgctctttacagctctaagccattctcctcgctaccaaacgactaactgaccaacaggtggcccaaccatcaaccctgccggccaagaaaaacaagctacgggcaaggatagccaagctatgatgaaccctgagttcctctcgacactcaaggctgttgttggcctgatctttcggtgagtactgataactacgatttttggagaagacgttgacgatccgactacaaccgtacgagacgttatgttgcgccttagcgatcgatacacctctccgtgggatgttgatcttgccgatgcaaatcaaccttattcctgcaagcaaatcaaagaaacaagcaagaacaagataaaagcaatctgaattgcaaataggaatgaatacacaccataagttggggttccgaagaacaagcagacggatggtctagccgacacacgcgctgcaagcaagtagcaatggctaaactttaatctatcaaaaccaaagaaacactgaaggggtacctaactatttatagtggtgggaggacggtcgtcctccacctggttggggcgcaccccacatgggccccacttgggccggggtcccaaacaaagttacaagcccagaggcccaagataggtgatgcagcaccttgtttatatgattgcggccaaatgacttggaatctggcgatgaggcaagatccgttggaaagagggctccgagagctttccatcaagtattcacgggccaaaaacaaaggtcgtatgcagattcgacggccatttgaaatcagcagtatagcaggtggccgaatcggattccagcacttggaggacttgaacttgatatcatgctgttcatccatgatgtgagcaatggttgtatccatagtagccatggtcccatcatcctccccttcttcacggaaaaccgtcctcggtttttccatatggtgctcatcacgtggtcgatttaaaacaacctgtttcatccaatcaaaagaagacaaactcgaagtaatatgattagaaataacatgtctctctagcttgcaagttttatccacatgtacaggaggttctaaatccgagcatatataaactctatgcaccaaatatatttctctatcattatattcgccaaagatatgaaaaatagcattagttggacatggcaaataatatttagcaaataatttctccttcaaactatcgagctcacaaaaatcatcacactgaacatagcccaaagtatttaaagaagaagtcaattcacattcctctacttcattagcaatttgaataacatgcttaaaatcatcgcataaagaactgacattagaaatagcatgttcattcactagttgtggcattgatataagtgaagcattatcacacaactcttctttatcacaaggaacaacaaacaaatcaacttgtgacaaaggaatctcagcagttggttacactaatggttgctctactatagcatgaaaagtggataaattcaattcattaacaacacactcaccttgattaatttcagcaccattaagtttacctttgatgccctcttcagatgatggaggtgcctcgactttgagtgtgaacaatgggactgacggctctttcatgtctctctcctccttgttgcagttgttcacttcctgcaaaatattagtaataggaggtacgtgcacaacttgtttcttgttcacatcctcaattggtttttccacatggcaagcaagttgtaacaaatgagcaaaagagctataactttgacaaacaagcatgtcctgaatttctttattaagcccacgtaaaaacctcaactctgtagcttcttcgtactcatctaaactacaacataataaacaagcataatacatgggaacataaacatctctgaaata

SEQ ID NO: 68621 - DNA, 3747 bp, Oryza sativa
cacttggaggacttgaacttgatattgtgttgttcatccatgatgtgagcaatggttgtatccgtagtagccatggtcacatcaagctagctccaggaagaggccaagaaaactgatcattgacgacgatgatgaagactcggacgaccaaacgattggcccgactgcctttgcccagaagaaaccagccgacagattcgtcccctaaatccaaaaatcttcaaggtaaagaaaaaacacttcttttgacgcataacacttgatggtactgcaatgaaatcaatgaatgtctcttctccgactttagaaaaccctcgaacatagatccgtctggcaagacagagattctggttgccagatcagagacagttggtacaaaagaatcagacgccaactccaacccaaacgctgaggaagaggcaaggaaaaccagcggcgcggctgataacaagcccccgactggaaatcagtcggctggcgccaacactggatcgaaccaggagcccctggctgaaaaccaatctggtggagaaaaccatgacgaccaaataccaagtttccaagagaaaacatctagcccaccacctgcccaggaggaaaaaaccactgatccagagctcagcggtggccctcatcacttccatgctgacatcatcaccggttatttctaaaattcgtcactcgtagcctctcacagtctgctttataaagacccaataattagagaaaaagaagaaatcttccgaataaaatctaccaaggactctaatcctcctggcaagctgacatggagagattttcgtaggcggatgacaaaatcaagccccgtcaacattttcgcatgcggtattttagtctcatctaaaatgtccgcgtgcgaaaacaaaaggctctattatgcgaaaatcattttcctaccagtgatttaccgattagcttcacacaagtgttctcgatgcccactgtcgaaagaacggctatgatttgaagtcgttattaccttcatagagggtgatatcgaacaaggtcaaataatttattcgtcgaattgcacagacacattgcttaatcggcacttcgaactagtgatttgttctcgaagaattcaccacaagttaaaaacgctagatccaaggtaattaattatttaaagtaaatattggttatctgagctagcatcccttctcccgtacttctagcttttgggatcatatatcacagattaataactaattgatctaactggataacaatgtccctagatcaattttattttaccgtccgattaaatagcctatggattcaggattatcgtaggaatgttgaatgttttttaaaaacttaatttaacagcatctcttatgtttttgaaatcaaagtattaactttcaaatatttaactcatacatttgtaatctccattaattgtcataaactcgaactttttaggacgcatcactactcactcacgtatatagtcatgtttttttgtgagagcgatgctttggtactctactggtagtattatcctaccattaaaaatatttgttactaagaatatatcagtaaattactaatacagtgatatattagaggtaattttgtcatatatgttttttcctaactagattaatatgcggtcatccattgcgttggcatcgctttccatcggaaaagccaaaaaagatgggaaaaaaggtttagtcactgctaaataataattatacctattcgcacctttttttcaataatatgtctctttatttttctactaccgctaattagaatagtagtataaatccgaccttttcgatcaaatgaaatcaactatgtatattttttttatactagtagtagagggcatcatagtggagcttaattgcaaaccgggaactaattcgaagaatctgcgcacatcgatgtgcatcaagtggagcggcaagacgattaatttattgaacaacagttaattaactaactaataacataacatcatcgcttaattcatactcctaccaacatgctgcacacggtaacagatataattaattaagctcacacattaacacagcacacgtcaactacgacgtcatcatattaagcttttgcttccgacgcacgtacacatggcaatgcgcgcaaccacatagtcctcacggatgcccgccagcgccgccgcttccggcaccgccgccaccgccgccagccgatccttcctgccctgagccggacccactccctccgccactgcccgtgccgccgttcgcgcttccagagccctgcccggtgcccacggcgttgccggaacgtccagtcccgctacctccgccggaagcaccacccccgccggatcctccacctgcgccgccaccgccaccgtgggtgacggtcacgccgccagggccgatgtgaatgcctacgccttttccgccgccgccacccacgctgccgtcggccgagctcgcggcaccgcctccgccaacgccgatgccgacatcgacgccgcctctgcccacgtcgacgccgaccccgacgccgacgcctccaccggcgctcgagccgccgccacggctggtccagacgccgccgccaacacctccgccgaacccgatggtcgtgtcggacccgttgtgcgacaccatccaaccgaaaccatggccactgccagagccactcccggacccggcggctttactcgggaacggcagcgagaacttgctgccactgacgacggcgccgccgctcttgtcatccgggaaggtcctcgcggcggcaggcgggaacacaaccgccgtaacacacaggagcgcaaggaggaaaaaggggaaggcactggagctgctactactaccactagagatcgccattgttgaggtcgtgtttgtttgatgtgtgaagctctcgtcaccccaggtggggcttttataggggattaggtatcaacaagtcgcggtatttgggtccaaatctagaggcagagatgagcatatgagctactaggttttgtggcagcttgcgtgtggagaaaaaaacctaacttagtatatatgcggcttgcatgcatgcctgtgtggcgtacgttgaccgataattcatttggatttagcgaattaaatgcgaatttaaaataaattatggacggtgtatgaaatattcatggagtgtagtttaagctcgacagtgactgatttgtttgtgttggccatttgggtggcatccagattactgttgcgtagcttaatcacgccctggtttgtgtaatttacttacaaaaggtatggacgtaactatatagctagtgatagctggttttagctattacttcatctataagagacaccatcaacctatactttaaatacaattttctcttaaactactcatccaatctacgatccgattacaccgttgtgttcgtaacaattaaatatttacaataagatctcacatgattatattttgatgaaaaatcgcaaattacttttaagatatatctaaattacttttagatttcactaagctacttcttagacatacaaaagtaaattcagtaaagcttaaaagtaatttacatatattatagaagtaacttataaaaaaagaaagtaactttaattaataccttttttcattgaacaaagtatcatatatatataagttacttttagattttagatttgattaaaatacttcctatacattcataatgctctaaggtgattacttttattatggacgtaactacac

SEQ ID NO: 68622 - DNA, 5616 bp, Oryza sativa
ccaaaactcctaaagtactagtacgtgggtgtctctggttaagactaattggagatgcctctccaattagatttaccgttttattattgtttttagttaatttcataatttgtgctgattaatttaatttctagatagagtcatgtttttatctctacaacatatttacttcaaatgacatgccaaagttacattcatttttttctaagttacttctataatatatgtaaattacttttagaatttacttttgtatgtctaagaagtaacttagtgaaatctaaaagtaatttagacatatcataaaagtaatttgtgatttttcatcaaaatataatcatgtgaaatcttgttgtaaagatttaattgttacgaacacaatgtgtaatcggatcgtagattggatgagtagattaagagaaaatttcataagaagaaaaaaaaatatgcacaacctaatagcaaaaactacttgcatcttgcatgcatgtctgtaacgctactagtactttccacataattgtccgcgtcgctcgttaagtctaaatcgatatgcctctcgaaatagattttacgaaaaggtatacgtactcctagaagacatatttgtttaaaagcatatttgtttcagttcaaaaaaaccatatatgtttatctacacatatattttggatgtaaaaaatattcgttttattgcttggggtgctgaaaaactcggtttggggctcagctcgaaaaccaaacgagaaccaagcccaaacttccttcgcagctcgagaaaatcaaggcaaggtctcgtttttttacccctattgcgttttcagtagaaattccttgtcatctatccatttgatttttgcctagataagtacgtttcagcgtgggttatagtgtggtgtactcataatagatccgtctctataccagtttgagcgtacacgcacggatgtgtgatggtgtatgcatattcgtatttatttatgtaatttttaacttagaaaggaagacaggagattacatagtggtctacagctacaaaattaacactatataagagtactttcaaatgagaatataatgatatatattaaatgcgtcacactaaatatatatattatttattagttcaattactggtcaaaattacatttgttaattagaaatctgcatgatggaaggcttaaaaatctgtcacatgatgtataagcagttccttgttaattttgttggaaatttggtcataattcggcatattttaatccaaaataacaagataataaacattatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaatttcaaggctcatgagaatgctctctattccatagcagcttttatataccagtgtttcggtgaagactgttaagttgaactttcacctaaaaaaggagctacacctgaccacaactgaacaatggactatgccttgaattgtcagtcttgtgcagttaggtttcactcaattccataactgatactaggcaaccattagtattccctcgggttggagcttataagtcatactccaggcctttcatgagtatctagagatcacccaaatctcatagactgtgactagcagtcgaactcatataggtgtgttccttctaagatgttctgcaggtcaacatctctgcttggaaaagccactcggatcacattaagacataagccatcctaccatgcaggaaagaagagaagcacatcatgaaaatgagcccatttcaagggtctcttctctcagtcacacaatagtttgtttcaccatccaaattcacgggatctctgatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcattgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttacaagacttccaggaaacatcgccacctccaagtgtgaacacatatccacttgtggcttttatctcatcagcatcagatatccagtttgagtcactatacccttctagtacttttggatacccggtatagtgaattccatagctcatagtaccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgctgggatcatagggagtaggagctggcttgcagtcactatatccaaagcgactcaaaaccttgtccacatagtgggattgcacaagtgtaatcccaccctcatctcctctttgtagtttgatgttaagaataacatcagcctctcccaaatctttcatttcaaaactcttggacagatagtctttgacctcctcaatcacattaaggctggtcccaaagatcagtatgtcatcgacatataagcacaagatcaccccttctcccccaccatagcgatagtatacacatttgtcagcttcgttcacaacaaagcctgcagatgtaagtgtggtgtcaaacttctcatgccattgcttaggtgcttgcttgaggccatacaaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtggtcaagcgagcaactagtgagtatgtgtcgaagaagtcctcgccttccttttgggtataacccttggccacaagccttgccttgtacttttcgattgtaccatcaggcttaagctttttcttgaaaacccatttgcatcctacgggcttgcacccatatggacgctcaacgacttcccaagtatcattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtccttctcaggattttcctcaggcgtttgatcattgtgttctatcggtgcaaagtgctcatggggcatgacagtttctttactagaagtgctaggtgtatatttcataggaaattattctcaaagaatgtagcatctctggactcaagaattgtaccaacatgcatgtcgggtactccagagtttactattaagaatctataacccacactgtggatagcataaccaagaaacacacaatcaacagtttttggtccaagtttccgccttttgggctataggtacatttaccttggccaaacagccccatgttcgtaggtatgagagatttaatttcttcctttcccattcctcgaatggtgttatttccttatgcttcattggaattttattcaggacatgacacgcagtcaaaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcagctttatagattttaaagaaatgcaatgcctcatccttagttttcaatagatacacatagcaaaatctagtgcaatcatctatcagtgtcatgaaatatttctttccccctttagtcaacacgccgttcatttcgcacaaatcggaatgaacaagttctagaggtgccaaattcctcacctcagatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaacccttctctacacaatagagagccgctaactagattcttctttattgaagggacatgctgcacgttcttcagctgcacggtctttcccgaagtaaacttcagatcgaccgt

SEQ ID NO: 68623 - DNA, 28259 bp, Oryza sativa
atattagcaccagtgtccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccctttgcctttcccttgcttttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactatagaacggtcatcgaccatcttgtagtcatagaactgctccataacatacagctcactgccggcgtcagaaactccgaacttggcctcaagtgcatcccacatttccttcccagaaggcatgtacatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaggcatgtggtttcagtgtagcagcaaagccaactaccgaaaatgacctatcaggtttttagattgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcagaggcctactctcccaacgcgtgtgcacacactcgtcgggatgggatttccgtagcagcaacagcttttgaaaatggatgaaagtgtgtcttcttcttttagcgggagatcaaatccattctcattttataagaggaatggaagatgaagagtaagagtcatgcaataggaagaggaatggagcaactaattgtcatcaactagccatgaaccatcctccactacgcaaccatcaaccgacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaaattttacatagaacattagttaaggacacattatattttgggcgggatagagcaagtataatctctattattttggtaaaaatatatgatatgggtgataaaagaaagattgggagcctcgattattttacattaattacgttagaccaacaaaaacgtgcatacttacagctgcaatttcatttttctatgtaaaatttatactttcggaaattaagataactgattaatattctatttccggactgtcatgcacttcggtttctttttgactttagatatggccgtgccttcgctttcaactgaatgtataattttcttgctaaaggtcaacccttccgaaagtaggataaaaaattatcagcgtatatattaacaaagtcagatacaagagttcgacgttcaactgactaagaaaacaatcttctgccaagttttccctataatttgccttttccgcattttctcgcgcagattatatcttcgtttgaccttacgaacccgatttgttccaaacagttatatgtacgtatcaattttcgatgaaacttatgaagcatatatatatatatatatatatatatatatatatatatatactagtatggtccaaattaagaaagatgaactactgttcagacacctttctgtgaacattgtttgtttatatactataaaggctgtgaggtttagaatctctacctaattaaccagcttccagatggatatattttgtactttccacggaccaaacttttgaccgtcgattttaccaactacctccactgaaactgaagatggctgtgaaactgaagaaacaggaagccaatgaggggagagagagagagagaaatgtccaggggtttttcggctagctccacaaggtggtgggctagacgacctgggttcaaagcctcaccccttctaattatttgatattagatccttccctaatattcgagttttaacgaggggagagaggggacaacaatggaaactctttcaatcacccaatcacccaggaaaacatccacccttttattgtaaatatatcatctaaatctctactattataaaaattgaagatgtttttaccggtgttttggtaggcgatccgtatacgagaaggttttaagttcgtttgcttttggaaatacagatccgtatttgagttgggttttaaatccgttcgcttttggaaatatagaaggagccgtatcagaaatctctttaaaaaaattgcatactaacttgacatgattttctggaaaaatatatatccaagcgaattctcacagtgaacaataataataagattaaaacagccttcacccattgcaacgcacaggtattttttctaatagttataaaaagaaaaaaataacagtaagatggagcaatatgtaatatatcactccgcaaagatgtagcttaaaattcaacttgtataaattgtaacaaaaataataaataaactcaaattattatacttatatttacagctaaatttatcatttttgttataacttgtacaagttgaatttaaactttcatgtttgtgaagtattatattacatatttatcgatcatgttaatattttttaagaaaatttataaccatttaattaacatataataaacggatgaacatcgacgtgattagaaccatcttggggataacaggacgaggagacgccgtcttgtcagcaattcgagtcggctcaagtcactcaacagtcaacacattcgagcacaaattggacgaacacctagtcggctatgcgaggaaacaaagcaagaacaaagacatggtttgtgctgccgaacacatcgcagcttgctccgtgccgaacagagacataggcgtgtgaaacaaacacataaacacggcggttaagccactctaataatcgtgcgccatgaccgtccattgtccgcacggaccgcacaatcacaacacgcacgtatgaaaaaacaggaaaacatgaaaaagttgaatttgttgagattataggcatataatgatttaatctattccataaataaatcatgacattacagacgaaaactagcatgaacgcatcattagatctacacatgtaaattacacagtataacataaacagatcaaatatgtacaacatattgaacacgtaccgaggtgggggaaagaccggctgctcggacgaaacttttcgcaggcgtctacgaaggcacgcaacacgcgaacgaagaggaagacgagccgacgcggacgaacagggagcagtcgcgcaaagcacttcccaaaaaccttattgccaccttctcccggtgcaggagtcgaaggcagagattccggagacctgctctcccgatcgcaggtgcacgagcgacggtgcagcacagagtaggaggcaaaccctagattgatttcgcgtgtgttgcgtaaagatggcgggtcggtttatatagagaagggtcgcttgatcagggcgcccgtacgatctccactgcgcgtaaccttaccggataagtcgcgtgtaacttatccagactccacgccctgcgcaaggtgaggaaccaattttggtggaccattcgacgcgtacgtcgtgcacgcgcgccgcctgccctgccctgccctgccttgccaggtgaggcgagcgagcgcgcgtgtgttccccctcttctctccaccacacatgcttcaagtggctaggagggtatcctcccttttaaggaggtccccctctcctagaataagcaaggtggtactaaactccacatgcatgctatcctatgaggtgggcttttgtgattttccagagaattaatcttcgagtgggctaaggcccattcattaattccagcaatcccccaccaaatctcaaaacccactgagatttgccttttccaatgtactgtttatataccagcgattcgatggagaccgattaaggttgaacatccacctagaactccaagctacacttactcacaacttgaacaatagactatgccttgaattgcaagtcttgtgtaagcaagtttcactcagagtcttatctggtactaaaccgtctgtagactacccctcgggtggagcatataagtcatactcctaggtctatagtaagcttcctagaagattcacccaaaatctccatagactgcgaccaacaatcaagctcacaaaggtgagttctttgaagaatactctgcaggacaacatcttcgctaattaaagccaacagaactcattaaggcatagccaacctgccttgtagctcacgagagtacatgcatcttcacttagagagggtatagattggtactctcctctagtttattaatggtttgttcttcccagattctaattcacgggatcttcgatcacatagactgggttaccacgatagtataactcacatgggtctcaaacccatctccttcgatgcattgtctatcacatttcgtgatagtcccttcgtgaaaggatctgccaggtttctagctgtttggatgtaatccaacgttataactctagagtttcttaatttcctgacagacttcaatcgtcttttcacatgtctagacgatttcatattatccttagaactattcactttgacaattaccatttgattgtcacagttcataaggatagccggcaccgatttttcaacaataggcagatccattaatagatcatgcagccattctgcctcaacagtagcagtatccagtgccatcagctctgcttccatggttgacctcgtcaaaatggtctgtttgcaagacctccattaaacagcaccgccacccagtgtgaagacatatccactagtggctttgatctcatccacatcagagatccagttagaatcactataaccctccagtaccgcaggatacccagtatagtgaagccccaattccacagtacctttcagatagcgcattactcgctcaagcacacgccagtgatcatctcccggattagaggtaaatcggttcaacttgctcacagcaaaggagatatcaggcctagttgcactagccaggtacatcaacgagataatgatttgggagtattccagttgattcctagcaattctcttgttcttgcgaagcaacaagctaggatcatcaggtgttggagaaggcttactatcaatatagccaaagcgattcaagatcttctccacataatgggactgcaagagtgtaatcccattctcacctctaattagcttaatgtttaagataatatcagctactcccaaatccttcatatcaaaattttgagacaagaatgatttaacctcatttatcacctcaagatttgtctcaaatatcagtatgtcatcaacatacaagcataaaataactccctcacccccaccatggcgatagtacacacatttatctgcctcattgactgcgaagcctgcagatgtcaatgttttgtcaaatttctcatgccattgcttagaagcttgtttcagaccatacaaagacttcaacaatttgcacaccttgccttcttgaccttcaactacaaacccatcaggctgatccatatagatctcctcatccagctctccattcagaaaagttgtcttaacgtccatttgatgaacgagaagaccatgtgaggctgctagggaaagtagcacacgaattgtggtcaatctagcaacaggtgagtaagtgtcaaagaaatctccgccttctttctgagtatagcccttagcaataagccgagccttgtacttttcaatagtaccgtcaggcctaagcttctttttgaacacccacttgcatcccataggtttacacccatagggtcgctctgtcacctcccaagtcccgttagcgataatggaatccatttcactacggacagtctccttccagtagtcagcatcaggagatgcatatgcttctgaaattgacttaggagtgtcatccacgaggtacaaagtaaaatccttaccaaaagacttagccgtcctttgtctcttactccttcgtggagctgcactgtcatcctcctcagtgacatgttcatgtgtatgttcagtttgttctggtggtgtgattgaactgggaattatttcagatgattggctcgaactactatgtgtatccttcattgggaaaaagctttcaaagaaggtagcatcacgagactccataattgtaccaacatgcatgtcaggttcctcagatttaactattaaaaatctataggcaatgctgtgataagcatatcccagaatgacacagtccatagtcttaggtccaagtttgcgcttcttcgttattggtacattgactttcgccaagcaccccatgtgcgcaagtaagaaagtgatggttttctcccaatccatatctcatatggtgttttgtccttatttctgttaggaactctgtttaacacatgattcaaggtcaacaatgcctccccccaccatgccttaggtagtcccgcagtgtccaacatggcattcaccaagtcagtcagtgtgcggttctttctttcagcaatcccattagactcgggagaatagggaggcatcctctcatgtatgatgccatgttcctcacagaataagtcaaactcgtttgagaaaaactctccaccacgatcagacctaagtctttttatctttctgtcaagttgattttcaacttctgccttataaattttaaaatagtctagagcgtcgtctttcgttttcaacaagtacacatagcaaaatctagtagcatcatcaatcaaagtcatgaaatatcgttttccaccctttgtcaacaccccattcatttcacaaagatctgaatgtaggagttctagtggtgccaagtttctttcctcggcagccttgtgaggcttgcgaggttacttcgattgcacacaactatggcacttagaacctttgacaatggaaaacttaggaattaaacacatgctggaaagccgagacatcaagccaaaattaatatgacataaacgtgagtgctaaacattagcctcatcatccacactgccacaaatatggttcacagacttattgcagaaatcagaaaggaaaagcggaacaggcctccgcactcataacctttaccaataaaatatccatgtttagacacgactactttattagactcaaaaaacaacttaaatccgtctctagtcagacgggagccactaacaagatttctgtcgatagaagagacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccctagtatcaacccaccaattagtagactgattaactgaaaaaacagtaggtaaattaccacacccgcttccatctctagtgttgccaatggtcacattagcagacttagatgtctgccctgcaggtgtcttcatccccttgcgctgtggacacttactagccagatgaccaagttggccacacacaaagcaagtccattcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcctgagctttctcctcaacatcaagagacgctatcaacccctcaacggagtattcctgtctcttgtgtttgagtgcagtaccgaaacttctccaagatggacttagtttcgcaataatgcacccggccacaaatttgtcgggtaagacacacttaaggagttcaagttccttagccatggtttgtatctcatgagcctgttcgactatagaacggttatcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctattctgcagtaagaactccttcaggtttgccagtactcacccagaagcatttcatagctgtcagccatagagtgaccctgatctgccatctcttaaaatgcacaccggtgaatttatccggcctcagtgcattggcaaaaccagccatagtaaaatcaaagtttttggattgttgagattataggcatataatgatttaatctatttcataaatgaatcatgacattacagacgaaaactagcacgaacgcatcattagatctacacatgtaaactacacagtataacatgaacagatcaaatatgcgcaacatattgaatacgtaccgaggtggcggaaagaccagctgctcggtcgagacgtttcgcaggcgtctacgaaggcacgcagcacgcgagcgaagaggaagataagccgtcgcggacgaacagggagcagtcgcgcaaagcgcttcccaaaaaccttattgccaccttctcccggtgcaggacgtcgaaggcagaggttccggagacctactctcctgatcgcaggtgcacgccggcgagcgggatggagtaatctacgagcgacagcgcagcacagagtaggaggcatactctagattgattttgcgtgtgttgcgtgaagacggcgggtcggtttatatagagaagggttgcttgatcagggcgcccgcacgatctccactgcgcgtaaccgtaccggataagtcgcgcgtaacttatccggactgcacgccgtttgcacgcaccggattttggcggaccattcgacgcgtacgtcgtgcacgcgcgccgcctgccctgccctgccctgccaggagagcgagcgcgcacgtgtgttccccctcttctctccaccacacatgcttcaagtggctaggagggcatcctcccttttaaggaggtccccctctcctagaataagcaaggtggtactaaaatccacatgcatgccatcccatgaggtgggcttttgtgattttccaaagaattaatcttcgagtgggctaaggcccattcattaattccaacagaattaacccctcgttttttatacacccttcctcccaaaatataaggcacaaccacttttctctcatgtctcataaatataatgcatgtatacattaactagcacctcttaatcctataaaattgatttattttaaatcctataccatcaaacctcccaatcatattgtttgcacgagtcaaggtgatccaaccaagaaggcgattaaacattttcttggttttttattacgagtggttgagccttctacaataatattgtaggatagagagagtatatctatatgtctactatcataaaaattgaaaattatttcgtcaaaattttggtatgtcatctatagaaattggtttttatatgtttataagggcatctctagtgtgagttcaactgtaccatccatttttagatgatggaaataggttacatctccggcctctgcccgtaggcacacagccaaaaagtccagaagtgaacagaaaagagcttaaaaaaaaggcgagatgggacaaacccactacttctgccaataatatgatctagtaaaataatgtttttaaaatcacgtagattctatcacaaaattctgtaggtactacgccatccaaacaggaataaaagttccttggctaccaattccaagcatagtatcctgttgttcctgtgaaagcatcatacattaagagtagagccaatttgaacacataaagataacctgcatgatgttaggcatttttttatgattaaaaactatatcattacggcaacgccaaattgaccaacatagagcactagctccaaataagattattttttgtctaggcactccccttagccatttaccaaaaataacgttgtggggaggggaatattgaaggcaaagaagacacattgccaagtaaaacgtgcaacatgacagtcaaagaaaagatgttggatggtctcttgtatattaaaaaacaacattgctggtttaccctacattttctctttatgaggttatcttttggtaagatcatttttttaagaaaccacataaatactttgatttttaactgtatcatccataaaagcgaatttcacttctactcggtgcatgcagtgtttaaagtcgatctgcaggacctatgtataaaatttaaaaatgggcaaagatcgacttcagccgagacgtcgattttcattctgacaaataacaaccgactctcacaacgtgcatggttcagttttttttgttgcaagtgtcgatttatcatcacgctggagttgctctaagtcgtctgtatctaattcaacatgagtctagaataactatcatggatccttctcctagcccagcccaacggaccaacaccttccaatgcgcctccactccgcgctgcacgcgctcctcccctgatcgacgtctttttttctttcccttgttttgttttctttttcttcttttcttttctcacagccatactgatcccttctaatctcctctcttttctctttttcctttttttttctcttccaaatttatctcatcaaaaatatcttccttttgaaattattattgtttaaggtgtatatgagacaagtttgttatttgcaattgctttccatttacagtaaaaaaattcactaactgaataatcaaaatttcaatctttggtcaacttatggaattgtcacagaatcgatttgtgaagctatggaaaggtatacataaaaatcatgtgatgatgcatgaagtgaacgcaactggattcaatgctatatatgatttctgactttgttttgccattgttttgttttgttttgtttcaatttgtcgtttaaattgacagagttttatcaatcgtgaaaattgtcttcacctgttgcaacacacacctatttttctagtcacctaaaagtcataaaaaacttgtaaaaaattggtaggacaaattacgtgatacatcactacaaaaatatataagtgcaaattcaacttatataaaaaaatatgcacatctctatggatttgtatgacaaccaccattgtccacgccatatttcataaagaagaggttttccattaccattcttttcttacaacaaaataacttttaattatatatacttgagtgaaggcaaaactagcgcacaaaaaatcatcaatataatggaaatagaagcatgattcaaggactcaaccgaaagttttagttgtttacatgagtgtgtaaattaaattttcttttagatttttaaacccaacacaagttttaattatttagcaaccaaaagcaaatctttaactggttaatcaaatctactaaaaatggcattgccatttagaacttggattatctactgcctgctttgataccatcgtatcaattgtagtgccgagtgctagggcgctacccaacataaaaatccggacagagccttctagtatatatgggatccattagtgactgtctacatgaattttaagcacattagccataagcaggaaattaatgagtgtgtccgcttattgtgagtgccgacgtttgtaatgtgtttaaaaaacggtttggctatttatattgagggtacagagagggctgaaatttctgaaattttagatattttgtttagggaaggcactgtaggggaagcccccacagttaaatagctttattatagaaaataaattacaaaagatataacaaattcaaaagggactgtctctcagaaacatttaatctaaaaactaaaagggaaagatcactcttaaagagagctttccaagaagaaattgagggtgctaaattctggaaaatcagggagttcctctgttaccaaatattccaggctgcataaagaatttgtagcgaggtggtgtggcctttgtgcttgcaagctggaggtaccaaattttagatatttcagtacgaaataatttgaaatgttttaaaaaatggtcgaatttgattttatttaataaattcaaaaaaatttgaaaaaatcctcaaattttgggcaaaatagtttactatcgattttggaaattccactccaaaatattgaaccttgccttttgaatgaatgaatgacccctggaggggcaaaaatacaccttcgattaatgatattgctttagagtttcttaagtgtggttttaattttgatatctcctcattcttttcatctcatctaaatagtcactaaaaagttataaaaaaagttaacaacatagaatatgagatataccatgacacaaacatataagtttaaattcgaattttgatatattaaaaaataacaaattaagctattatatgtactttttaaaatttttcttaggacttgtaaaaagtaaattttgacttatatgtttgtgcagtgatatatcttatattaatatatctttttatttttttaaataatatatatgattatttatgtgacataaatatagaggatatgtcttcttgatagcaacactttttttttcaattgtagcattttggagcaggcaattggcccaaccattaaagaaaaactagatgatgccacgctctttaatgtgggatatttcgataaatatatgttaaatgatggatgaatttgcgaaacgattacaaatcaggcacctgattttttcccaaaaatcgggcgctatttcatgatctttttatgaaaatgtttcaatacttgaaaaaaatgtgtcagcatttgaaatgatgaaacataaccaaatcattcttgaaacattgggctaaaacatatgaaacattgatttcgaaccattgaaacattaaaaaacccatgtgcatcaaagatgaaaatatgaaacactatcaaaatatccactgcaatatttaatccaaacaaaaagaaacatcacaagtgcaatagctgaaacacacaaaaaaaaatatacccggtctgtactacatcttcctcccctcttgctaaaacaggcttgctgagggccaccggttttgtgctctcctccgatcttcgctggagatacacgccgagacgctacaacacactcctgctacgctgaggtgagcaaccgccgcttccctatcgctgctgctactgggaactcggtatgccatcattgtcgcttgggcaaaacggaatccacgccaccaccagatcctcacagggttcgtcatcttcctcccagctcctggcctagctagagctatgctgatgtgcaccggcacgccactgcaaccgcgaggaaccctctccggccacgacaaccatggcctggccgctgccatggagcccatgcagtgatgcttggtcatcatgagctcgtacatgtgagagataaaaggtggctgagaaggaagcgattacgtggcgatatggaataggtggctgagcaggcgcctgatgtttagttagccatcaggcgcccaagcctaatcgttttcgatgaatttagatcgtgaaaatgatgagaaatgatgatttagcatgtttatatgttgagctttaaaatgtaataatttgtagatgatagacgtaattaaagttaagtttttgtatgtactatggtggtgtttgaatctcttgaagatgaagatgaagattaagtgtttcacgcaaaacgatatggtaataatgtgtgattaattgagttttaattattacaaacttgaaaaatggattaatctgatattttagaacaacttttatatagaaagttttcgcaccaaacacaccatttagcagtttgaaaaacgtgccattttaatccaaaatttaatccactcttttaagtggattcaaacagggcctatacatgttgatcttttagtgcttagtgggttgatgtgacctacttgcatgttactaattataattgctatgcttacatattgtgttttacatgtttagtaggttgtaacttcgtagaaatgtataaattcacacatcaacaatcatatgctcaagcagatcaatatatttcacaaggacaggggtaaataaattaaaacttcacatagattgctccaactttaggatgatttcagcgcaattcctaattcgcgcatatgcgcccgctgcgtccacttccagcccacatgacccatgcggcaccgcagaagcttggcactagtttctttcttttttttcatgaaatcaggcgctagtttttttttgggaaatcgcttctttttttctctccacactcgtgcgtgttttgcgatattttataaattcaatatttcaccttcaataatatccattgagagttttgaatttgagttgaaagtttcttaaattaaagttgaatgttttgaattttgcgatgaaagttttcaaatttaaattgagttttttgaatttcgaagtgggagtttttaaatttgagttaaaagtttttcaaacgtgagttaagttttcaaattttgagttaaatgttttcaaatccaagttgaatgtttttcaagtctgaattgaaagttttcgaatccaagttgaaagtttttaaatccaaattaaaagtttttaaatcttgacttgaaagttttcaaatttaagttaacaatttcaaaaaatcttaacttaaaatttcaaacctttgttgaaagtttattgcagctaaacgtccatacttgttccaatttttcgcgtgctaaaaaaataactgatcagagtaattaacactaatgatagtaattagtgggatccgatccactaatcaggaggacgtggggagggggtcgcccattaggaaccccctgattttagacaaatgaggggacatctcctcgagatatcagattcccctccaaaatttacaagaacacggccttcgctgacctgctcatcatccaccttttaattttccttttcttacgcatctgcatcccaattctacccctcgtcagcacgacgcacacgcattggagcactagtgcgttcctcagcagcagcctggccactgtcgcctgcccgtcatcaccctcgtagtgcaccaggttgatctccttcacccgacgccgcaggcaccggatcgccgagaagctcgcgataccaggggagctgtcttcttcgctgtcgtcgccatcttcttcgctgtggctgttgtaaccgatgttgctgccgtagtcatcaccgtcggtgtcgtcgtcgtcgtcgtcgctgtggctgatgtagccactgtcactgctgccgtcgctctcgctctcactatcacagttcgtcggattacatttttctggtttcaagaacagggtgagagactccaggtttggggtcatctccaggatcctcctcatggcgatggctacgccgcaatctgggacgtgcccggtgagttccagccgtcggaggttcgtgaacgtccggaagccggcggccgggaagaggtcactatcgatgcacgaaccgagacgatcaaacttgaggtggaggtgcgtcgagcctgcaaacatcgcgagaaatctttttgcatactgtcgaattcctcctccgaggtgatgagttcctcgctgcagaaatccacagtgcaggaggttattgccagtgagccgtgcatcgaaagagtatacgacggatcgtccgacacggcgcccctgtacgcaattgttgtgagctccgacgcgtcgatggcgacgttgtcgacgttgtggcagcaccggagggcgaagctgcggaggcgcttgtcaagtagggagagggtcttcagctggcggagggcttcgagcgtcaggtcggcgaggcgcgggcagctcgagatcaaccgttggattctgctcctggagccgtggatgccagtcaagcgcattgtcttcaacaacgacaggtcgatggattccagcaggttcaggtcgcagtagcttaggcacagggtctgcaaggcgacgcaggagtagagcgaccgtggaagctcataatggcgcccagggaaaacagggggctcgctgtcgacgatggtggagagtctgtccctttcgccgccggcgcagatcgggccgatccagaagcgcaggtcgaggtggagctcctgcgagctatggcacacgacataggtgacccacgcgtcgacgatgaccctgtcccagacgtggtagctgtcgcaggcgaagtggaagctgcgcagcggcacgtggcggccggcgcagcggcggcggcagaggagcgcggcgttcatccggtcgaggagcttccagctcatgctcttcttctcctcggcttggaagtacatggttatccaatcgtcctccctctcgccctcctcctcctcgaaggagatggtgtggacgtagccgaagatgtatcgccaccggcgggacagtacggcggtgcgggcggccaggttgttggggaggaaggagagaatgtggccgagcaggtcgtcggggagctcactgatccgatcttctccgtccccgccgccggcgatgcgcctcttcttgctttgagaagccatcggtcgtcggctcgtcggttgtggccctaggttcgtgtcgaaacaagatttcggcaataataaaagggggtggctatcaagctaggaaagtggatggatttggagacaaggaattttatacaggttcaggccttcttattcaagaagtaataccctactcctgtccggggatgattccgccgagtgtgttattgatcgtatgatctgggaaaaaagaaattgtcccgagaggaacccggacccctccttatataggggaagagatccgtattacaaaatacagtccatatccctaaaggaatatgtgattacagataaaatacaatcttaaccgactaagatctcgggtatttccttgacatacaagttagaaactaacccgagttctcataaatatattctatctatatttggtaccgtatatccgactaaattataactgtcatgtagatatggggtatccataatctccacagtagcccccgagaccttcgcagttgacaaaatagccttctcgaaacaaaaaacagtaatccgagtgcttcaattcaacttgctccagcttgccgagtgctaaaatcaaagactgtgaagggcgaaaataaaacatggtgcatcgagtagatgcacctaattaggtgtagccccccgactatgtgattagttgaaacactaaacatgtagccaagaaccgagtggttttatagcgaagtatgcatggtactcagtaaaatacccagccgactacttctcaacttgaacatatcaaggataaaaaatacgaaaagggccgagtgataaacactcaaaaggtctaaaaatagacatatttgataggaatccgagtaagaaactcttaaaatgatccaccaaacatgataaaaatcatagtaatcaacgagtctaatagcctaagctatgactctcaccataaccaaattaagcatataacatgctaagagaatgactcttaataaattagtcatctccaatcaacccaaacagcttttgcagcctaataaggcttacaaaaatagtataacaccttcctgtcaggcaccttttgtttgcatcgtgttaattccaaagaattatcaaaccacattaaaaaggattttaacagcattagtccacatcattgtgagcacaaattgccaaagcaaaaagcgcctaagtccctagagatcacaacgggccacgctgaaaataaaattgggctaaagtactgtgtttaggctaataacaccgaagtgaaataaaacgtctcttcgtcttccccgccgagactctcgccattttccccatttcctgctatagtacaaaactgcgccggcaattcatcaatccgctccaatccatcctcaaaaacttcacgaaatttcaccccgcgtccaccgcttcaattccccatccctttccagccatatctcggatcaaattaaaccattcagttcacattcatggcggaagaaagagaaagcttcgagagtcagtgggcgccctccgatgtgacggaaggtaatctgaaggagatggtggcgcacggcgttcttccggcgaaggagattatcgggtggcgaccggcattcggcgaagcattcccgacccccgatacgcatgaagtcgtggtatttgctgatttcttctatggcggtttctcccttccaacctcaagattttttcggggaattctgaatttctatggaatcagcctgcatcatctgaacccgaactccatagttcacatcgccaattttattcatgcctgcgaagcttttctgggcattaggcctcatttcaccttgttccgccgaatcttcttcctcaagccctagccaaacaagagcaaaccatgcgttgttgggggcactggtttccaactcaggggaacactaagccaaaaatacttctccatgcccttcaagacctcaaacaaaggctggcacgccaactggttctacgttcaaaatcctgaacctgcccttcccgagtactcttgtctccctccggtctaccaagacacatggaattcattgcctataggagatgaggctgctcaagcagtggaactgatggagcgcatgataaagctgaaggagcagggtttgcagggagaacaaatcactcggcacttcattaaaagccggttagctccaatcaaagagagatcccgcacagcttttgagtttgacggcaaacatgatccaaatcgtgcagatccagactctcttgactttaaggtcatgaagaaaaggatgtacaagatcttctcaaatgctatcgtcgtcagttattcgcacttgctgccagtcgtgccattcaatgccttcaatcctcctccaccggtatgtaatcaaacacttaaacctttcacaaaatatggtcttgtctttttattgaatcagttaacaatgaaggatattacgcccaggaatttgctttgatgaagttggatcccccaatcactcaacgccgatcaccccaccaccaaaccggtcaagggagcgggggtcccaaaatccgttccgaagcccggccaaatacctctaatccagccggccagccagattcacgcaaaaggaagttggtgtcgagtgacgatgaaggcgataccgctagaaagcctggagaccgagaaacaaccaagaaactgccgaagcaggctactacaaggaaaaaagcatccagtcgtccagtgccaaagatcaggaagtcttccaggtacaaaccacataacgatcttccttgcattgatgtgtacccagtgtagtaataatactgataaccaaacttgtaggaaaccgtctgatatagacccttctggaaaagactctaacccaaccagcacgggaacaaacttaaaagaaaccgagccaaccgctgaggatcatccgagtgataaccagccagcaaccgataatgtaggatctggtgatcaacccccaaccggaaacgagtcggccgaaactggagccggggttaatcaggagcccccgactaaaaaccaggcactgggccaagtcaagagattccagaagttggagctcaggcagacagccctcgtaaagaagacaccagcagtgacccaacgccaggatctcccgttaagacgcaagaatcgactcatccccgtccggaaatcatcacgggtaaacaccttgcccgaaaccgtgttgatccaaatgactctaaccaatcgtctaccctttatacgtggatacattaggaccaatgattggtgatgaagaagaaattccccgtatacaggcggctgaagactcacgccctcccatcctagttaagtggtgggacgatgatatgcaacctcaaggaatcgtgataagcaagcagaaagaagatgaagaagtatgcttgttgaaaaaggcactcagccaggccactcgtattgtaaatgtaagtccatttgtgcatagttttaattgtcccctttcatatcttgctgaaacgccgataaattcatattgcagagaattcatcttagaaatgaggcgaaaaccacaactttggagaaattagttccccatcttggaacccttgaagctactaaaaaccagctacatgaggtcaaagagctcgcgagaaaaactgagcatgatctaaggaatagaatctccgagcttcaagaatccaactatgaattgaatggttcgtccaaaggtaaataccatatctgtctgacgtattcgcgaagccttccttgtcatatcaattaaccgaaaagcattacagtacaagctgccaggatttccgacctagagaagcaggtcgaggccctggagaaggacaaggccgaattagcaaagcagagggactcgaccttaaaagatgttgaaggtaatgataattgattccccatgttcttatagccgctcgctgatatgaatctattgatgaagatcgcaaaatcaagtcccaggcacagtttgatgtcttagttgacaagatcaataggcttgaaggggccagggataaagtcgctaatgccgctaccccactcatccaagccatgttcttcaataacaccggtccaagtgcacttgacacttccgagatctttgacaagctaagagtcgctccagatacttacttcaagaatatcagggaggctgggagtatgggagcaagcctggtgttggcgatgaccaagtccttgtacccgaagattgatattgacgccattgacggctttgcagacgggacaagtgaagaaacagccctcgacctcatcaatgatgcgcaaaaagccgctgacaagattgctgctgacgtagttgagagattccaagatgtcgaccttcggccgactgggtctgataattccgatgatgaaagaactgacactgattagtaacagtgattctgattatgatggaagatcaatttgtacaatactgatgaatttatgctgtgctagacatttctaacttagcctctaatttcttaaaagtttttgtcaaaccttattgagcctaaaactcacaaaagttattaaaaaactttcagtcctgattgactaagccaaaaaatcaagcagggcaatgataaatcaagtaagcaaattgaattgataaaaatcatgttccattattattatagtagcccccgactgataactcaagaaaaggcttgatgttagcagtcaaagagaaaaatacagaagtaatgtctaagcataaaaatgatgaagatgttcaatattccaagaattgttgataagagtaccatcttcgcgcttgagtcgataagaacctggccgagtgacttcagcaattatgaacggtccttcccacaagggagataatttatgccgatcctgtgtggtttgaattttcctcagaaccagatcgccgactaaaaaggctcgtgatcgaacattgcgattatgataacggcacaacccttgtaagtaccgagctgactggattagggcggcttcgcgggcttcttccagtcggttgatatcgtccgcttgatcttcctcatagcgctcctcccggaagttgcgaaatcgaagggattcaaactctaccttacttggcaacattgcttctgcgccataaaccaagaagaacggcgactggccggtagcccaactgggagtagtgcgcaaagaccaaagtatggacggcagctgttctacccacatgccagcatagggacgcagtcggtcgaaaactcgtgctttgatcccttgaagtaccacgccattagcgcgctcaacttgtccgttactcatggggtgtgccacggaggcgtaacaaattttaatgccaaaatcttcacaaaagtctttaaatactccgccagtgaattgagtgtcattatcagtgatgatacgatttggtactccaaaccgatgtacaatattgatgaagaaatctttagctttttctgcggtgattgtaatgaccagtttagcttcaatccacttggaaaatttatccacagctacaaagagatgagtataaccaccgaccgcctttttgaatgggccgaccatatcaagcccccaaactgcgaacggccaagacaacgggatggtttgcagctcctgagctggtaaatgagtttgtcgggcaaagaattgacaaccctcacatgttcgcacaattttgtcggcgtcggagacagctgtgggccagaaaaaaccctaccgataagccttgccgacaatggttcgtgcggcagcgtgattaccacagatgcctgaatgaatatcttttagcaattgtcttccctcttccaaagatacgcagcgctgcagaattcctgatggacttttcttgtacaactcggtctcgtgaatgacatagagtctgctgcgcctggaaatctgctcggcttcatttttgtcttgagggagttcttgtttggtcaaaaatcttatgagaggttctctccagtcggcttcaatcatgcttacgccttgagtatccatggtttcaattgtttcttttctgggcacggttggttcgtaaagatgttcgacgaacacatctgaaggagctgcttcccgttttgaaccaaaattggccagtctgtctgctgcctcattattatgtcagaggacattggtgagctcgagtccatcgaatttatcttccaacttgcgtacctcttgtcgataagcggtcatattatcatctagacaagaccactctttcatgacttgattaacaaccaactgagagtctccacggacgattaatcggcgaatgcctagagagatggcaatccttaatccatggagcagcgcctcgtattccgccatgttatgggacgcagaaaaatgtatccacaatacgtagctcaatctttctccagtcggggaaattaaaacaaccccagctccagtgcctgtaagcctcctcgacccatcaaaatgcatagtccaatattccatctttttctctggcatgtcttcttggcactcgttccactcggcgaggaaatcagctaaagcttgtgacttgatcgaagttcgtggcttgaaagatatgtccaaagacatcaattctaaggcccactttgcaatccgtccgtttgcttcgcggttatgaagtatatccccgagtagaaacgatgtgaccaccatgaccgagtgactttgaaagtagtgagataatttcctgacggtaattaagacaccatatagtaacttttgaacctgaggatatattgtcttggagtcggccaaaacctcgctaacgaaataaattggtcgttaaactttttgaatatggccttcctcttcacgctcgacaaccaggaccgtgctcacaacctgggaggtcgctgacacatataacagtagcggctcttgcggatgtggcgaggccaaaactggtggagtagtgagaagtttcttaaagtcttctaaggctttttgtgcttcgggtccccactggaaattgtcggttttcttcagcagcttgaaaaagggcatcccccgctcgccgagtcgtgagacgaaccggctgagcgccgccatgcaaccaatcagcttttggacgtctttctgggagcttggcggtttcatgttgaggatggcgttgattttctccgggttggcctgtatgcctctacgagacaccataaatccaagcagcttccctgacggtactccgaagatgcacttttcagggtttagtttcatcctgaaagcgcggatgctcgcaaaaatttcttctaagtccgcaatcagatcatccttctgcttggtcttgacgactacatcatcaacataagcttcaacattgcggccgatctgagttgaaaaacacctctgaatcatgcattggtaggttgctcctgcgttctttagtccaaagggcatggtgatgtagcagtaggccccaaaaggcgtaataaatgaggtcttcatgcagtcggattcttttagtcggatctgatgatatcccgagtagcagtccaaaaaactgagtagctcgcagccggccgttgagtcaactacctgctcaatgcgaggtaacccaaaaggatctttgggacaagacttgttgaggtcggtataatcgacacacatgcgccattgccccgtctttttccgaaccaggactgggttagccagccagtcgggatgaagaacttctttaatgaagcccgctgctaacagcttggttaattcctccttgatcgcatccttcctgtcctgtgcaaaatggcggagtcgttgcttgatgggtttggcgtcttccttaacatgtaaagagtgctcaatcacctctctaggaataccaggcatatcggatggtttccatgcaaagatatccttcctgtcctgggagatttgcgtccgaacttgtcgactaggtcctcgtggcgaatgcctttagtaaaggcggcgatgatgacatcgtcggttatgtcggagatcttgttgcgttgctcggagaagcatcggatgtaatctcgaagggattctccagacttctgaatgacgttgtagagatcaaactgtgtgtcggggcgttcaaaggtgccctggaagttggcgatgaagtgatcacgaagttctgcccatgatcatatcgtgccacggggtagtccatggagccaggatcgggcggaatctgctagggccacaggtagatagtttgccatggccttgctatctcctcctgctacacggattgcgagtccgtagacggtgagccaagactctggattagtggtgccgtcatacttcttgattccactcgacgcaggtcattagtgaaggcaactactccatccacgtcgtcgtcgtagcgatctggtgaatggcggtgacctcgtgctgcacggcgctggttgatcatgtcgcgaagatcgacgggacgctggcgaggtggagagcgaggctgttcaactcggcgttccctgtgacattcgggaggcgagtgaacagatcgttcgtcgtggcccctgctcctgcgactggatcctgtgccgatgatgctgaggcttggctgatgataatcatgagatcggagatggggaacccggctaccagtcggcatgcgaacgctgccggagttaaccagaactgaagcggcgatcatggtcttggtctggttcaagatgttgacgacgtgatcggcttgattgagtgcgtcttccttgaggagggtgtcgagaagggtgatcgcagcgacagcgttctgttggggggtgcggaagaccgctgtcccctcaacctctttttgcccgatgagttctctcgctcatcgcccggattccaaggcgcgttgccgtcgatcttcagcctcctttgcaatccgttcgcgatcttgttgctcacgctgtagtcgttctcgctcctgtcgttgtcgttcttcttccaatcggcgacgttcagtttcttgccgtgtgcgctcttcctccacttctcgggctcggcgctgttcctccgtttcgttgtcagccatgaatatgccgaaaaagagaggcgtgtagttatcttcgtagctgtcgtcgaagtcgtcgaagttgccgtggtcgtagtggtagccgaagtcgtcgtagtcgaggatctcggttggtcgtgaactgacgccaggggagctgaggtagccatccaattcttccgtcgagactgtcccaagaggttggagtataacgccaacctccctagagctagattggatcggggccgaagccggatctcgcctagatcgtcgggtggggagatgccttggtggtgaagacagcggccagatcatcaggaagtctcatcaggattaagggataggacccgtcttcttgatctggtcgcggaggagtagattggatctcgtccgagtggtttgaagccgacttgggagagatgatcttggagtaggcctcggcagagttcggaataccgaacagcgcggggacctggtctctccccgactggttcgaatccgagtcaaggagagagatcctgccgaggtcgttggtcatgaagttgaggctgccgaaccggaacgcctgcccgggagggaaggcgaaatcgtcgatgccggagacggaacccatcgcacttagtcggcaaaaacttgacgctgcccctacctggcgcgccaactgtcgaaacaagatttcggcaataataaaagggggtggctatcaagctaggaaagtggatgggtttggagacaaggaattttatacaggttcaggccttcttattcaagaagtaataccctactcctattcggggatgatcccgccgagtgtgttatttatcgtatgatctgggaaaaaagaaattgtcccgagaggaacccggacccctccttatataggggaagagatccgtattacaaaatacggtctatatccctaacggaatatgtgattacagataaaatacaatcgtaaccgactaagatctcaggtatttccttgacatacaagttagaaactaacccgagtcctcataaagatattctatctatatttggtaccgtatatccgactaaattataactgtcatgtagatatggggtatccataatctccacagttcgtgtgatatggcgtgttatgacgagcagaagggttttgtttgtatacccgaatccatagtggattacccttgtcgcgcgcggaaaagctagttaactttttgggagttaacgtagttagttacttagttaaggataatgacaaaattaagagaatacttccttttttttgagtttttttactaacaaattgaaaactttcaagttagatttgaaaatttttgacttaaaatttaaactttaaagtcaaattttgaaaactttcaactcaaactttgaaaatattcaactcaaaatttaaatttgtaagacattttgaaaattttcaactcaagatttgaaaactttcaacttgagatttgaaaacttttacctcagatttgaaaattttcaactcaagatttgaaaacttttgactccagatttaaaaactttcaacccaaagatttgaaaatacgtgggttgaagattaaaaaaaataaaaaaacgaaaaaagaaaaaatgacaaaaaaagaaaatcgcaaaaagaaaaaaaaacagcgctggaggtgctagctggcgtgcgcgacagcaacggaggtcacacgcaccaattagcaatccccgataacaatacgtatgttcggccgtttgttcagccttgccccgtccgggtaggaatatggctctgcttaatgctcatggctacttgat

SEQ ID NO: 68624 - DNA, 1293 bp, Oryza sativa
  unsure (1)..(1293): unsure at all n locations
cacattgtactcccntgcatatattcggcactgtgggtgtgtcttgttaagtacggtgttgaactcagtctggctcatnttttcccaaaccagaagagaagcccctgaagatgaaggctttggtgtttagctcatgcctgccgtcaagcgcctgtggtcgtcgccatagtcttccgctgtttcccgtttgtctttgtgtgtgctgggccttcgccgccctgtaataaattaactatttacgcttccgcttgttgaactctgaactgtatcaacttttggtgtaccttgcctcctaggacaaggaataatgcacgcacgtaaggaacgcccgttagattatttccggtcgtgacaagcccccagcgttagatcgtagtcgatttaacatcggggacactcgcgcaatatatattgtataaaaacatgctctaggtaaacataataaattatagatccgacaatgctgtatgatcttgaaaagtaggtacagtaaattgtatataaaatattgcgtacctttgtagatatatgccggatatatctacagaattagtagatcaatttaaaaaatcaatctactaaatacctgatcatgggtggctggacacgtactgactccatacatatgcatgtgtactgtgtacgtgtaaggagcaggcatatttgttgaattcgcgtcatcaggacgagtagtcagatttgtcaactagaaatttgattctagcgcaaactacagaactcctcgaatccgattaggatattagccactgaacagatcaatgtggtgcttgtatttcagctcctcgacgtgcttgttttgttgatggagatcgatgccgagtctggcttggacccggccagctgatgccgcccaccggttggcgtcctgcacgtcgatgggttagtgtcggatcagttttggattccgccaacactatggtcctctgccgctgcgacatcttgaagcttgattggtctcgccggatcgaatagttgatggcgatgattccaatctcgttgggagacgtactttggccaggttggatctccctgatccgaagtcgtcgagtagcttattgttggagaatccatctcttaaacccatctcgtctaaatcctgaagcaccaaaaaatccccctacctggcgcgccactgtcgacgtttgatgtcgcgattccggtatttgcatagtatggggatcgtcggtactaggacatacgcgagactgaggtaaaagagacagaggcgacgatttttatacaggttcgggcccctgaattgtcaggtaataa

SEQ ID NO: 68625 - DNA, 5148 bp, Oryza sativa
ataatcacacgagtacaatatttggggtagcctatctaactgttgtcgacatggcggtctgtatgtctgactcgtagtcgacaacagggtagtcttcctcctttagttcctgcccggcaagatcagagatagcacttttgtctctcctgacagtatccagagacagcgtaggggactagccgtgcttatccctgaagtcgatatccaacgtgttgtcttggcgtatgttggtttgtatgttgtggcttctgttgttccgtgtatgttgattatggtcggtgttgattgaggtggtcgtgtcccctctcctcctaaggggtcttgtatttatacccataagtgtccccttgtccaagtaaaactagggaaaccaatatggatacaatccgagtagtacttgtcgtttccatacagaactctggttgtctttccttatccagaacttctcctatatccgtaggttgtttccgtataggacatggtatctggtgggtgctgccgagatttagtcaactactattaggtatgtggtatccataaccctgacaatttcaaagttttaaacattgatatattaatgactttcttatatgcatattaatttcaattgaaagccatcttgttgtccatccttcctgacaagatgtagtgtacaagtcattctttagttcagcctcgctcacttggtatcacagaagcataacctagacgtaactaattcagtatagaagcaaaaagtgcaacagcaacaacgagggtggaaactagaaagaaggatttattatgttccttagtttattcagtcacgaaagagtgactttaaaaaaatgtacacttcttccaaagtgaaaattatgagatgtcttacttatggaatgctcctacatgctgaggttgttcttgctgacaccctcgtttctatgagaagattaatctaacatagcaagtagatagtttactgcaaacaaaatggataataaacctgatgtttcaaaaaaactagaggaactcatgcatgatgtacccaaaggaaaccggttcttgacacactacaaatctgtggtagttcttttccatctcgaaaacgaatcaaggctgtgtttggaatcagctgttcccaacatgcaaagtgcgcacggaaaacagggcggtccattagagcgtgattagttaagcattagctttttttcaaaaaatggattaatatgatttttaagcaacttttgtatagaaactttttgcaaaaaaacacaccgtttagcagtttgaaaagcgtgcgcgcggaatacgatggagatgggttgggaaccctggattctgaacacagcccaagtctatccaaaaagtttagacaagaaaacacgtaacaagttggtttacaagaatatgaattacgtcaatcctgcactacatgtatagcaaaatggtgatttctcgtaaatctctcgaatggtgatttaagaattcagtgcaaacctaattcttgctgtaaaatcaaatgttcggtaccacaacaacggaacaataaaaagcacttggtgtaccataatttttgtcactcttgttgaaattttgtaatataaaatgcatgaggccacacgaccttaatgttcaacgtgtcatgcattagtgaaataatagctcacaaaacataacgaatatagctagataacggttgcaatccttaccaaactaacgtataaagtgagcgatgtgtcatatcattatttttctagcctgctaaccaacatgtacaccttccgatcccaaaaatgacaacttccagggatgaacctaaacaaggtttagggtttaggtatgaatctggacaaatgattgttcaggttcatccctagaagtgggtttctccttacgggacggagggagtatatgtgatggacacaaaagttactttcgtgatgaaatcaaaggggatttgttggggcacctaatagaacatgtgtccaaatgacatgactcacttggattctaataggacatcaaagcaaaactaacactccaaagcaaccgatgaggaattgaaagaaaatcagtcccatcgcatctataaatagacaagcgcaatgaaaaccctccccatcgttcacacagttcaagcattatacagcaagaaagaaagatctagtgtcccgtagcaatgaagatcattttcgtctttgctcttcttgctattgctgcatgcagcgcctctgcgcagtttgatgttttaggtcaaagttataggcaatattagctgcagtcgcctctcctgctacagcaacaggtgcttagcccatataatgagttcgtaaggcagcagtatggcatagcggcaagccccttattgcaatcagctgcgtttcaactgagaaacaaccaagtctggcaacagctcagggtggtggcgcagcagtctcactatcaaggtattaacattgttcaggccatagcgcagcagctacaactccagcagtttgatgatctctactttgatcggaatctggctcaagctcaagctcaagctctgttggctttgaacttgccatctagatatggtatctaccctaggtactatagtgcacctagtagcattaccacccttggcggtgtattgtactgagttttaacaatatagtggttcggaagttaaaaataagctcatatatcatcatatatttcacctgagaaactcggggtgatatatcctcgtacatcgtcataactaattaccatcattggtactctacaatattactatgtgcttacattcgatccaaagctactttgtctttaagatataaatggagcgtataaaggatgtccatcctttaattctagtaagaacaaacacgaagcacatatgtcaaatactaaatccactacaacaaaattatagaccatacaaagcacgtaaagatgtagcaatccacattgattcttcatccactactaaaataagcgcatgtgaaaggccgcatatgcatgatcattgtgaatatgacatgcccttatcgagcaaacgtgtcacttcatgcaaatatgttgtttgtttcaagcgacatcaagatatgatttcaaagttttaaacattggtatattaatgactttcatatctgcatattaatttcaattgaaagccatcttgttgcccatccttcctgacaagatgtagtgtacaaggcactctttagttgaggctcgctcactttgtattacagaagtataacctagacgtaactaattcagtataaaagcaaaaagtgcatcagcaacgatgagggtggaaactagaaagaaggatttatgatgttccttagtttattcagtcacgaaagaatgactttaaaaaaatgtacacttctttcaaagtgaaaatgatgagatgtcttacttatgtaatgctcctacacgctgaggttgttcttgctgacaccctcgtttctatgagaagtttattctaacatagtaagttgatatttacagcaaacaaaatggataataatcctgatgtttcaacaaaactagaggaactcactgttaacgaccaaatttggtaaagccatgggctgggttcaaagctagagtcgaagccggatttggaggaattctttttaagaaagccagagtgtgtatcggctacgggcggcatcagctgccgtacgtatcggctacaagcggaatcggctgtcgtatgtatcggctaacgccaaatccaatgaagacaagccgatgtagccagtcttgaaaaagacaggtccacaactatcatcgggatcaatcgaagtgcttcatagccattgccacacaagaatcggtccagcaaagggcaattgtatctattaattaggtttagtttccttaagagatattttggtaagagtccgcctaagggacttgttcgtattttacattgtaataaagatagagtcatgtccaacaaggagatgttatgtactttgggtataaatatgacccgagaccttataatcaggggacgacagctcaataatacttcggcgcatcgccaccctttttctctttcattgtttcgacgagtttttgctttcgagttgggctgcatcaggttcgatctccgacgaagaggtaaagcttgttatagcggattgcgttctcaggattagtgcttacatctttatgacactctaatcctatctatgtgaatcaccgagttatcatatatgctgcataatctagattgatctcgtcatctaatctcatcggctagcctctatcatcgaaaacggccgacagatttagatatcaacattaagctagattatgcggtatatctaccatatcaaatgagtcttcatcgttcttgcttagatcttatgtttcttttcacacttaatgctgcattggttaggttcgatctactaagtactgtcttgaaacattttatctagctctttctatgaatgctaatagagttagtatcggagtttcagccgatcttacctgatttagccatcgtgtttccactacttgggtcttgatcgtctaaatttgccctttatattaaaatatcatctatttgaagtgtattaagctctctatcaatctactagttcaccttatgtcacgaccggaactaacccaacgggcgttccttacgtgcgtgtattattccttgtcccaggaggcaaggtacaccaaaagttgatacatttcagagtttatcaagaggaattgaaaactcattcaaacataaaaacaatgaaattactgtcatactgataccatccaacgtatcaaatcttgtgcattcaatactgcatttatatatgccttgcctacattgtttttattccctcaaagcattaaaaagaatatcaccaaatctgtttccaccctataaatagtatctcttcttcatgtatcaataccaatcttggaatcttccaagataatcacaatgagggaaagtcgagtgattacagtaactcttcttctatcgcatatgttgttctaatcataggggggaagaaattcagtatataagccaaaggggaaatactagtcaaggtctcacaaattatggggttaataaaaccatcgaggtaagtgcaaaattagatcgggtaccgagctcgaattcgcccatatagatcagtaatcaacacgctc

SEQ ID NO: 68626 - DNA, 3207 bp, Oryza sativa
tgccgaaggtgctcctttcaaaccaatcgcacccggaccacagcctaaacacaattttaaggggttttgattaaaaggggaggtgtgtaatccaattcccaaataatccatccatttcaatagtgtccaggtaatgagaatattcccaaattctagagttgtaaaaccaccctaatgttggcttaataaacaagcaaagcatctaccttaaattcatactagtgggtaccataagtagagttgtccactagttgggggttttggttaatctaaggtggaccaaggtgattattaccattaccaataatattaggttcataacaaaaggtaaataggcatggctaaataaaccagtgataccgcggaattttaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctatacgaccaacagaaatgaaaagggtttttactctaataaactccatataacaagtaggaacaaagcacaaaaatgggttcttgacttcttaaggaaaaattagagacttgaacggtccaattccgagttcaaatggccaagttatggccatttaaagtttatatgctctttaaatgaatatttgcgaatttcttcatttaaaatttaatttaaaaaggggtttattgcgtcagccgaggggaaggggcacgcggaccgggtccacaggagtggggcccatgcggcagcctcacggtccacggtggaccaggtgcacccgggctcacaccggccggcgtcgtgggtaacacgcatcagccgcacccgagggcgcgggcggctgatgaccgggccccacgcggcagccactcggcccgcccgaaggcggccactcggcgcggccggcgggaggcggtgcccgcgcccctattgtcaccgacggcggccataggcacggcggagcggcggccgagagaggggaagggaagggggaaaagaggcggcggtccacggctcaccctaggtcgacggcgacgacgaaaaaggcggccggagcggaggaaggcggcggcgcggctcgggtcgacggggtcgacgacgttccggcggtcggcgaactcggcaagggggtggacggggtcgacggcggtgcggcgaagccggaggaggcgacgccggggcgggagacggtcccggcgagcggagaaggccggccgaaggtcggtggcaatagaggagagagagagcgacggcgcgagctcgattccggcgagaaggaaggccggcgagaggcggaaacggacagaggaggtgcggggagggtttaaatagggttggaagggggagagagcggccgaaggggaagaaaaccggcgcgggaggtcggccgccatcaatggcgctgccgagatttgcgggggcaaatccgcccgtttgaacccaagagagagagggaaaaatggggggaaagggagaggggatcacggggagtgatttcccccactttattgcacgcggggacggcgggatgcggcggatttggcggcggcggcggcgcttggcgcaggcggagcggcgggaggatggggatgacgggtgggccccacccgtcagcgagggtggcgggcgggcccgcccgtcagcggcgcgcgcgcggggagaggctgagtgggccgcggggagaggagagagagagagggggggaggagagatgggccggcccggcccaagggagggaagggggacttttaaggtttttctttttataaaactttttcaactttgtttatttcttagtaattattatttgtgctctgaaaattccactaaaatttatttacaccttttaggcttttaggaaaaatacaaaaatcccctaagccttatttgacttttaactttgcacattttaattgttggaggctttcacacggattttaattattctaggcataatttaaaggatatattttagagtcgttttgggacatgacaccttgcttgttagattggtctacgtttcgtatatttcatctgtgctaatattgtagtataaagtggtatcggagtaatagtcgatacacgttaggtttgctcaatcggctatgctgtgagcatacataatccctactttgaagcacatttagatattaagtgatttatactgtctcggcatatcgcccgatctatcccaatcacttgatccaaatgtgctttcattggatagattgcgtactgctgacgtctacagccgattgggtagatctaataatttctatgccttatattcccttgctgatctgatgcaagtaacatcggcttggctccgaacaatacgttatcggcaatccagccgatcggctatcgttgatggatttaactttgttcctttttctttcttgctggttgcaggatcaaaccaactagcgcgctcggaacccgaaagcaattttggacctgcgctagagttaagcagatctctcaggccagtacgtgtgttttccgcatcaacacactttttggcatgcccggtgggaccgactttcgtaaaattttcttcatggcaagcctcaagtagagagaagttgatccaaaaaatgtcatcccaataacaatggacaagctgaccctggagcagaaggcagaatttgaaaagatgagagatgacttgcaaaacgattcctgcattcattcgcacagactcgttccgacaccatggtccagaaatataaggtagttctgtcgaacaacgatgacgcggaaacaagttctggcaaagacgacaaagccaagggcaacaatcaggaggaagatctcgaggcgctcaaatgtatgcaagaccaggttgattatgccgttcatcatgctttggtcaaccaatcaagagtacttgtcaacatgttgaccaacatgatcaaatatgtggttgacggcacgatagctgagcattaagccaaaggtccagtttttctgcctggagggtttttccaaactacaaaactgtcagcatggacaggcatcaacccatctcgagtgccgccccaaacagcccgtggctttaagtgtgcccccctggggcaaggggcaataacattgggcaaaggcagcccggaattcatccttacattcttatcaagccacaaacct

SEQ ID NO: 68627 - DNA, 3957 bp, Oryza sativa
agctaccgatgctttaagggtcagattgtttcctctgtctctgtcaagattggccttcacgtggttttcatcattgccatataattttgtacaaagttgggccgatctggagaaacagttccataagtacttttatagcagttccataagtacttttatagcgggattcattagatgaagttgtccgatttaacgtcaatcaaacagaagcatgacaaatcggttcaagattatatccagagattcagagatatgaggaacaggtgctttagtttggctttaacagattcccagcttgccgatctcgctttccaaggcctactggtgccaatcaaggagaagttctcagcccaggaattcgagagtctagctcacctagctcagaaggtgacggcacacgagcaaaggtttcttgaggctagaaaggcatataaaaaggtgaacaatgttagcacatatgtctctgaaaccgaagaggatgaggaccctgaggtagcaatagctgaatgggcaaggaacaaatgagtggtcacgtgccaatgggtcaaggactctggaaaggaggaaaaaattgatttcgacatcaccaaagacgataggatcttcgatttattgcttcgggagaaacaaatccaccttcctgctggtcatgtaattccatctgctacagagctagggaagagaaaatactacaagtggcataacacaaggtctcacaacaccaatgagtgcacagttttcagacagcagatccaatccgccattgagcaggggagaatcaagttcgacgacccaaaaaaatccatggagatggacggcaatccttttcgtgtcaacatggtcgcccaagcgaggggatagccaatagaagaagctatcggcccaatgccgctatgatcatcagcaaatatcaagggaagcttgagaggcagaaagaggagtgttacaaagccaacaacagtttcgatcctcattgggactacaaattctttagattctactaaaacgaagggatgaggttaccctcgaaggaaggtgtgcccgtgatgcagtgatgccgacgaaaaccacgtcggtagtacaaaaaaatttcgtcccggaaaggaaaatcggtcggtgcagaagaagctgcttgttgatcagagattgggacttgctagccgattggtttctattggattatattgctatactatattatcatcagctgattgccttcatatcattatatacattggacatatagccgattgctcaaaaccctatcgccatcggctggtatcggcatcggctggaattactccatgggcttgtcaactgatcggctcattgatctgctatttgcatatcttgtcagttgcaggatcaaactgactggcacgcccacatctcaccaaactttggacctgcactggagctaagcagatctcccaggccagtgtgtgtttttcgcgtcaacaggttgttaacgattatagagtgttttattgagtagttcagctactagcttggtggtatcagtgattagtagcttttttttgagagttttattaagtttgtttctaaaccatgtagatgaaataacagaattggaacttgtttggtcaagtatatcagttattaattctatgacaccagaaaattacattgtttcatcgcatttaaaggctacaggtatttttcttttttacggagtgatcaaaccggatcaagggataaactactgcaaattatatcttctcgccctagtggacttctttatggagtgaactatatcaaatgttttgcttttgatgctgatctaattagtctgctgatcgttacggagatgttggtcatttccaactcttaatcttgctaatttttttccttcttttgctccttgataggctcgcttggcaaggaatctcccccacaaaattcagaaaagaggagggactgcataatcaggtactgcatactccccctcacagcttcagtaatgcttgcatgaaaaagttattaaaacaggctctctcaaaacaaaattcatttctttgccagttactaagcttaccgtctttaacaactgagaattgctttattaaagaaaaatcaaagtaaatatgagtgatcttgagtgttgtaaatttgatggtataacagcatagaagcacatggattttatgctgctatgttgctgtaacacaagtttgccaaacatttatgcagcatctccatgttctatctagtagtggtttattttgtgtacaacagtgagatattactcccaatgaaatttctacagatttttataaacatattgaaatatgatccattctctaaaaatatgaatgatttgcactatatcatgtaataatctagctcataatgtattacttactttgttgtattttaatcatgaatgatttgcactacgatatttccacatttggttgattaagtatctgccaatcaattgccattcatcctttttattttctgggagcaattttaccatcattttttgcattgcacctttgactgatatttctaagcattgctatttccttttgagtacctcgacaaacagagttgagcccattgtatatcctataactgattaatgcttgtaggtatggatctatttgagcttcaacaaagccctatcagaattttgacatttcttgtgcatgtcaaaggttctgaatagatacacttcaccatttcttttattgcaggataacatttttagctattgtttccggttaattttcaacatatatagattcatctatgttgacattgacgatcagcgattgtgccaactttattcagttaaaacctgatctagccatttgcagttgtgcaactgccgttgataattttttttccttcttggtatagtcacatcattagtttgttgtatatgcatgtaggcacttattatttatcatgtgcagattttatccattggcataagttatactaatatctgttgttttatcctttgtgttcacaaaatttgtattgttgaagatcatttgaactttgaagtctattgattttggcgaattctgaattcgagcaaggttaccattgaccatattatttggataattttatggttgtttctgagatggatttcgtgtccaaaaattgttgatcactgattgcctatatatatgtgggtgaaccagtttaaaggttagcaaatcatatccaaatctctgtcaggtgctattttggcaatatttccatgtattacatgctcaatcatgtcaactcacaagacatacaaggcaatattgctatatctttccataaatatcatgatagcaacaaaggtaacattatcctccttagcctatatatgagtgggtgaacaagtatgaaccaagaaaaaatactcaccactgattgtcggctgcataggactgctggaacttcaactcgtcatcttggtattgttctccaatctatctcttttgtgttggaaattattatactttagtttgcacctattgatctcctacttcttctgtattgtagtaaggcatggcatccatggatgatgtggatgatgaggatttttcaccacatcaagccacaactaaggagtcaatgaactctaaggatgatgtgaaggtgcaaccttcatcaaggcaaacagcaaacaaggggaattattacatggccacgtgaatgccatcatgatgatgtttcagttcatatgtgatggctaccagcgtgttgaaagttccatggaagaatacaagtccaagaaggtagaaaaaggacaaggtgagaaaaggaaggtgggcgaagggtatgatcctcgctggtatctcccatcgagaaaacaatgaagatctacaatgacaacgtctccaatgaacccaccgagaacgaaccatgatttaatattgttgctattgtgttttgaccttagaataatataacatttcttgtgaatta

SEQ ID NO: 68628 - DNA, 2682 bp, Oryza sativa
atcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgacgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggtccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttcccttattgacaggttgtggaggttcacaacgaacagaatacaagaaattttggtaatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtttttcagagggcatggctagcaattcctgaggctagccaatatttagcatttattttttttctggaattaactcatcagtgacggttcggaagaaacatccgtcacaggtaacttcacctgtgacggactcgcaaacgtcggaccgtcacaggtgacccacctggtaccggcttttactttcgggccggtcacagttgggtcaccctgtgacggctactatataccggagatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccgtcaaaggtgagggtttgggcccgtcacaggtgaccttgaccagtgtagtgggaggcggcggcggcggccacgacgagcagccgcctcctcggcgcggagtcggacagaggcagcggcggcgggggacgcgtaagcggcggcgcgacgggcgggacggacgaacggcggcggtagcggcgaactacgcgagcccgcccccgctgctggcctcctccaggagctcaccgccgcgcgacgccttcacggcgagcgcctagacgaaccccaccatcgccagccgcctgttgatcggctccggcgccggcccgctgaacgccagcacgtcccacagccccgtgcttgccgccgacttcgccttgggcaccgccgccgcggggctcggagtcggggtcggggtcgacgatgtggtcgtctcctccttcgtcggctccacctccggctgtagatcgatcgaacgacgacgacgaagtcgccccaagttagcacacgaaacaaatcaccagaacacgcacagtgaaaccaatcaagaacgctcagctcacctcggcttgggccctagcgacgaacgcgacagcacgccggcgaggcgggaagccaaccgcggcgcggccggcgccgacgacaccacgccatggcgcgccaccagcggcggcagcggcgaaggaggagctcagcgccatggtagcagccgccattgttgctaataactcaaattacacagctgatgaactcaggcgagctagctagatcactcttttttctttttcttcttttgctgctgctgctgttgatgatgaggcgggtgacgagacgagtataaataggcgggggatcaaggaggaggtcacgagggcacgcggcgaggtggggagtggtggtggtggtgg

SEQ ID NO: 68629 - DNA, 16964 bp, Oryza sativa
ctccgtctccgtgtcccgcgccgccgcccacaccagcctccatccatcttcgcgccgaggggcggctgctcgtcatggcagtggccgccgccgcctcctcgtcccccgccgtcgtcgctgcgtcccccgcctgccgccgagtcgcgccgaccggcgagaaagcgagaggaagagtgtgagaggagagagaggagagagaggggagtatgacaggtgggtactatatttttttaataaataaaatgattactggactgccacgtgtacgccgcgtaggacaaaaccggtctgtattaggtcgaggggggtaatttgtccggtattaaaagttgagggtgaagaatgtctggttttccggatcagggggtaattcggacgaccgcgatagtttgggggtaattcgtactttttcctatatagaaatattttgctatttatcggtcatcagattttgatccaattcttttaaaaaataaaacggatagaaactatgcaaatatatcaccagtggatatatacagctaaatatcacaagtgcttagaccttggtttcacagaacatcaacaaaagaaaacgacaagaagaataaacattgattttttttctcgccgtgctatgctgccatataggtaatgatatttgctcccttgctatgcagcaacaaacagtttttttttttcagccggctaaaagttccactgcaattaaacgcatgtgaaaattatttttttcaggcagacacactaagcaaccctgatgtgtgaaaacctcttggatggaaaagcattggggttcggtgcttgctcatccgaacatactccaaactggtggtaagtcatgttgacaaatcttttgaggcaaaagaagaaggcatgaagaggaatctggaggctgttcgatctatggaaaagtgtttcgccggcataacggtcgaacatttacctagagaccggaatgaggaagcaggcgccctggcgaaatccgctgccagtggaggcccacattcgccaggcatattttttgaagttttgtacgcactaagtgtgcccacagagagcctggacatcatggcatttgaccaggcagaactgggcgaagacccagaggactggcgaacaccgttcgtgaagtacctcaagaatggtaagcagaagcaaagcgcctacagctcagagccacaagatcaagctgacttcggggcagttgtatcgctccggggtgctccaacccttgcttcgctgcatctcctttaccgaaggcgaggaaatagcgaaagaaatacaccaggggttgtgcggtgcgcatcaagccgcaagaacggttgcctccaaagtgtttcgctagggcgtatattggcccactgtgctgaaagtttgtgtggagcaagccaaggaatgcgaaagctgccagtggcatggccgaaaccagaaagcaccccagtacgagctgtaacctatcgcaccagtcaggcctttcgctagatgggggctggacatcattggccctttcccggtggcacgaaatgggtacaagtttgcaattgtagcaattgaatacttctcccattggatcgaagccgaatagctcggtacgatcactttggtagcagtacagaaatttgtatggaagaacattgtttgccgtttcggagtactgaaagaattcatcactgacaatggcaagcagttcgattctgacaagttcagagagatgtgcgaaggcctagacctgcaaatcaagtttgcttcggtcgcacacccacaatcgaacggggcggccgaatgagcaaattgcaagatccttgaggcgctcaagaagaggcttgaaggggcggcgaagggcaaatggctagacgaaatgttatctgttctctgggcctttcggacgacccccacaaggccaaccaagtttagctcgttcatgcttctttatagtgacgaagcaatgaccccaacagagctaggggctaactcatcaagggtaatgttctctggaggcgaagatgggcgcgaggtgtcgctcgaactcctcgaaggggtgagagtcgaagcactagaacacatgcacgaatacgccaagagcacttcggcaacttacaacaaaaaggttcgatcgacagagctgttgcctggccatctagtcctaaggaagaaggccaacctagtggcggttggaaagcttgaatcgaagtgggaagggccatacctcatcaagcataggtccaggactggctcttttcgcttggcgacgctggaaggcgaagagttcaaccactcctggaatgctgcttctcttaaccgtttctatgtctagaaggggtggcaccccattcgccatcttgtaaaaatgtacatactatcatataggcctttcggcatctcttattatgtaagcccttcggcacaaaaatacaaaaaaaaagaggaaaatgaaaaaaaaaactggatgtagggctattatccatcctggaggcccgaaccaatataaaatccttatgtctttcgccttttttacttgtgtgtgataattcgtggaaaaaccccaaggcaaacgtctgatcagcgaaagcgctagggggcaaaacgaatcggccgaaacatcgctcgccgaacgttgaaaccgcgacaacttgattcaggaaatgaataaccgagcaccgtcgtattcgatctatgtaaaaaacacgagcgtttctttaacgcggaatactacaggtcgaaaacggaagtcgaaagctgaaaagtcagcagacctatttcgctaatatacgcaagggggccgacatgtttcaacctaacaaaagcacgaaaggtggctatgcgtataatagcgaaaaggaaatataacacatctgtattaacttcaaaaaatatatgccatacaacatggtacaggtgaaagaaggtaactggctttatagcctaacttacaaaaaaaattacatcttcgcctccaaagcaccctccactccctaaggtgtgatttggcgaacttggttcgtcatcactactaatattatacactaccctaagaggagaaggaggcgaaacacaaactagaccataacggcgttgggcgatcgcttcctgacgatcagtcctccgatgatttcgccaaaagcgggccatgtcctcccgatgttccacatggatacggtcatagtcgtctagggttcgcccggggtgcgctcgcatccagccggcaactttcaaaaccttgtaactattaccatttattatcatctcgcgacatgaatacttaatttttggcaggcctttaaccgcgacgaatttctcatttttgttccaccgatcccaaaaaagaggccgatcacacaacttcggcgaaaaccctgctgagacagcataaaaatgacaaatggcaaagtgcaaggttaagagagggcggagcacataaagtgggcaaaaagcgtcgcccccttttcgtgtacaaaatgatgcaagcatacacatcaaagccatcaaaacgggacatttagctaaacccggttcatctatttcatatatcaaaagggccattttcggctacaatgcgaaagggggagggccatcggccaaatttacatcgttcgccttccgcagccaacgccaaaagaaatctaaaatctgaaaaacaggcggaggtcctcacacctctagatgatattggtcgacgtccgcccctgcacccgtatccgctccaccttcttcggtcgctggctccttgccctgctctgctgcctctaccttcgccaagtgctcgagcaggcgcgccttaacggtagatcggccctccttttgccagaactgcttgcgccaggcgcgtaaggcgggcgaaacgtcctgagagctgacttcccaatcccccttcgtaagcttggggaactcggcgatgtgctcgcactcattttgttgcagcaggcccatggtgaaggccactgacacacacgcgcaacaattggcgtacgcggtggcggaatcggagaccgcaccgccggcctgttgggtccactccgagaagtcgaaggcagaagcaccttcgccagggattactcgcaccttctcccccatttcagtaagggcgaggcaaagcgtgtggcacgtggtctttacggactcagtcgccttcgccatctcccgcgtgaacctttgtgcgtctttctcagcagttgcttttgccttgcgggcctccagacgaagagcctccatcttcggctcggtaaggttgtattattcagggtgcgctcattagtgtaggtttggctgtgctgcgcgtatagacatgcatcaggcgtggaggagggggcgctagtcagtaacatggacacagatgtaatggtgacggtggtgacgagagttaggtggccgtctgcctttccgtctggtccagacaccttattacccatcagttttcgcagtgagctaaactttccccaaaagcttgcgtgttgtgttttgccattcatcgttccttccagagcaccgcaccaccattgttgcatgtccaagctcaagctcacctattgcccaaaatatactgctgtgccctccccattgttcttcgcacagaggacatctcgaggtcgcctgcaggagtatgaagaccggcggtcgtcgaatctcgaatcgtggcagcaagcatagagggcagtcgtcgtctgcatcatcttcatcgtcgccagtccgggcaagcctggcagaccacgcgcatggcataggctgcttggcctaaaaaggaagcatccacaagcccactttggtgtggtgcatcggaggaggagaaaggtgccgttcgcaggggcatcggcgcttcgtgcagagggaaggcatcagctgcccgattccggaatcgctgtggccattgcagagaccggtcatctccgatctcgtgctgcacagttgaaggggatttggcgcccttgcatcgccattgcggaaaggggatccagctctatataagggcatggctgcggtaggcgtgaagcgcaaactcatcgtcgacaaatcccctacccatcacctcctccatttgcctccgtcgcccatcgctttgcttagaaggagggggctaccttcagatctggaatcctctgagggtttcttcacatctctccgttcggacgctgcttacaccgccaccaccgaagaagatgtgcaagctgtagctcgcgccgtcatctgcatcgccttgaacttccctgaagccatctgccagttggtgcgccagctcaccccggggaacgttgctgtggcgctcgattgggacctcctcgactccgatcaccttcggaaggtacagcccaacattttgtgatttattccccatttttttgcttgcatgactttggttcatagatggctgctgggcacaccacttggaacgaggcggagctgcaagctttcctcgaggcttacatggaagagatcgaggcacgaaccatcacgagcacctgcccaaaccgccaaggctacgccaaccttgaggtcaagatgtaccagaaggcccagaaggttgtgaaccacactcagttcagaaggcccagaaggttgtgaaccgcactcagttgaagaactttggggacacttatcgccgacgcttccaaacatggtgctggctggagtcgatggcaactggccttgggcgctgcccattcacgggaaacatccttgcaagccctgagtggtggacaaggatggaccaggtatgtgttcatttcattcctgttcttgtcatcaatataggttcatatacattttagtaattagcaaatcaaaatgtatgctgaacaggtgtagcattagagactactgttaatgtaagtactgcacaccgtttgattacatgtaatactagtatgctgagtttaacgaagctatttaattagttggaagtaattagatagaaatactttttgctctagtacttatctctgttgtcatgttcatgtaggctcatactcttcagttagtgttgtacagaggtagcgctattgttttatgactgagcatgcttctgtttaggagtactttcagaatcactattactagctttatgtgactttaaccaaggtatttaattagttaggactattggtagttatggttgtagctgtagtagtttactgtaatgtaaaggccatttactgtacaatgaatgagtagtaatggtagtattacaaattatttgtttgcaagtacataaggtagcattttcgaatttagttggaaccaaccatgcgatcggctaattagctatttaagtagttctagctgtagaagtgaactgaaatgtagagttcatttaggctgcatttatgtgtactaaaggtacatttatgaataatatgtttagaattacataacgtcgtttcctcttattatgttctaaccaaccatggcatcagtcagtaaggactgatcttataaaaacttgcaccactattatttgacataaaccaacctacttaattagttacgactaaattaagataaggttgtagctgtactagtttattgtaatgtatagctcatttagtctacttttaagagtactaaaggtagtattacatatcatttgattacaagtacatatgccttgcatactgtttagtatgatttttatgaataccgtactcattaatccttttgtgcttattcctgtgcagatgaggagaggtgcccgtgccttccgcaacggtccccttctcttcactccagagaaccacacggtgtttaggggtagggtatgtaccctaaaccgctctggggtccctgtgagcccatgcgccatctctgcagctcctcaacaggctgaaatcctcgacattgaggatttgactgagcaagcgcagcaagaacccgaggatcaaactccacggcgtggcaagagaacactcactggtggaacatcctctggcagcagctcgaagtggtcaaggggatcttatgccagtggcgcactgaaccgtttggcgaacctccgcattcagtcaaacgagagcagggccaggcgcgaagagctcaagcaagcaaagagtgctagggcctgcatggagctgttgaaggcagacggagtcagctccagggacccaatataccacatggccctccgggtatttcgtgatggcttcttgcgcgagtttttccttgatgactgccccacaccggaggggaggctctacttcatccagtcccagtatcaggacatggcccagtaccagccactacccccgcctggttttggaggatacctccagtcagctcctcccggtatgtatgttgcatgcagcttgtttaggttcatcatacaatttattttcattcatacttgctcttgttcatacctagactgttggtaccaaagtcattcctgctgttgttaagcattatgcaaagacataatttgcaatgatggcaacctactatttaaggtttattaccattactggaagtcacctctaggttctagttacataaagtgctacacaataacaaaacccctagttacataaagtgttgatcaatattgcgcaagttgttgtcacataaagttgttgttacatttacaatacataaccagttgttattacagttattgattgtcacctctaggtattgtggttggagagggttctggttatgctgccgaagctgaaagagttggagctggagatgatgaggacggtgctgatgatgacggcgagagagttggggacaacaagggaggacaaggtggtcatggtaaaggtggtgatgacgacggcgatgatggaaatggtggtgctgccggctatgggggatctggttatgggggtgctctctacgggggcgtccctggaagctatgatctttccggatatgcaatgttttaacattgcatgacactatctgataatcgatccgtctgggagttcctgtcgaacgatgagtgtgccagaccatgagcacttcttttttcgaacgtgttgtctgtctcgaataatttttgctcgacttcatctcgagcaacgtaactgtggtattatgttgagtgtgtaggtgaaaacaatatcggcacatttcgtttgatgtagcttttcaataagtttgcttagtccctagttatcttgttattctgcctattattgtgtgttgcattctatattgacatgcaggttggcgacatgcaggttgactgacatgcaggttgtactgcctggtgaaaagcgactgagcacttcattcaagtgctaattgatgatgctttctttgcaggaaccgaattaaatgaagtatttaatgaactacagtacatcagtgactacttgcagcatgcacttcccgtatttatgtttgacgtgcatatagggccattaattattgctcatgcgtatcactgtcgaatgttaggttgttaacttttgggttcacaattttcttcgctaatttaacttttagtatttttgtagcactaacagttctaacatggttgtgtcttcgctgtgcaggtgttagcttaatgcactaacaaaacttattgttaacttactgcactaatatgtacattgcatggagcattcatgtttactatatatgttgtccacttcgaaagtgcagtaaccactaagttatttgtatacgtattatgttcaagaccatgagcacttcttcagatatcacgagtgggtcatcggctggaaactacacagatgaggaagacaacataatcgatatgttggtagctgatttggaagcccaagtgcaaggtagagctgcaaggcgggcgccacaacaggcagggatgcagtggatgatggagacaatggccaatgctactcagtgccataatgtctttcgcatgagggctgaccaaattcatgctttgttcgcaattttaactaatcgttaccatcttaatggaagtaacgaggtttgccctatggaagcactagggctttttctatacatcatggcagctgggcagtcgcaaagggcaacaaataataggatggcccggtcgggatcaaccatatgcaagtacttccataaagtgcttgatgcagtttactccatggcagctgatatcaacaagcctgtggatccaagttttcgaagagtgcataaccgggtcgcacgagatgaaaatttcctgccttttgctagctgtagacgggacccacatcccagttcgtgttgcagttgaagaagctaatttgcaccgcaatcgtcatcatatcacatcaaggaatgtattagttgtaattggatgggatgatcatgttatatttgcacatgccggatggcctggagctgtgcacgaccagagggtgctaacagaagctgtccggaactatccccataattttccaaggctgccatggggtaagtacataatgttgaaggtttttttaatccagttagtacacatcaccatcatattactcccccatgcaattttcatctgaaatttctcatgttcactgtccaggtaaatatctactagtggattctgggtacgcatgccggtgcggtttcttgccaccgtacccgcatgtacgctaccatttgaatgaatttgctggtcaactgcaagggagggaagaaacattcaactatacacactcctccctgcgtacttcagttgagagagcttttggagttatgaagagtcagtggaggatttttagggagatacctcttttccctaggccaaacacccaaactaagatcatacactgcgtttttgctctccaaaacttcaggcttgacagtgcagacccccatttcatgacacagaactggttgtacaacgggtaccctcccatcccacaggcaccaccgctgcgcgacttggtacgacgcacctaacagtgctgctgggatgagagctgttcgtgacgccattgcaaatgaagtttacaacaactagtcctgcatcactttccatccttaataaatttgtactccttgctcatgtctttctcaatttatcctattttatgtgtgttatcggtatgagaaactactgtcctgttgttctactcgaatttgtgtgacgctattatattgctatctatgtgaacttcggtattgtcaatcacgcatttcacattcattacaattttatcgagcaattaattgtgtacattaatatgcaactaatcatcctgctgatcacatttattcttttttttgtgcgcctttcactgtcggctccatgcgcgcaggcctagctgagcaaggaggaaaaacccccaccctctcccaagtcacgccgacaccagcagctgtggctgcagcgcctttactgctgcctgcgcactgacagccctgcccgtcccgtcgcgtcgctttcatcactgctccgtcggcaatctcatggagctgctccagccggtgtcaaactccatccaacccttgctacctactattcagccaccaaccatatttactactaacagcctatagtaataattacactcagatttaattcgatactacaatatgcacaaacgagcgcaccctcagttaaggcggcggactggtcttgttcctttttaagctcggccttgagacgctcgatctcggccttcgcctcgctccccttctccagctcagcttggagccgcctgttctcagccttcgcctccttaagggtgttggcgaggctttccatttgtaggctcttgcggcccagttcgtcgtccttagctcgaagatggttcttgaagccgtcaaagcgagccctcacggttcgctcagtcgaacaatgagccacaagaatctgggtcaaaaaaaaaggggggagagggggcgaaagcgatcgtcgttaacataagtcgtggaaaaacaacaattaaagagaaagaaaaaaatgaataacatactcggatggctaagctcttgatggcggtacagccttcatcgaactcgttcaactcggtgaacaggctcggctcccagccggagaaacgagatgacttaccccctcgacgaaggggataagacccgcctgggtctctaaatccccaggggcgaagcgaggcgccgcaagcgaatactccgaagccgacgtctcaatggctgccttcttccccttctggatggcgggcagcgaagcaactggatcacgcggagggcttccgaagagcctggcagcggcgttcacaacccggtcagcagaagctgaagtaccggccgcagcgctccctcgcgcttcgcccacgtcggccgtagcaccgagagcggtcgaaagaccatggctccgcctagcgggcgaagtaggggtctcatccgaagactcgtcatcgctgaaaacacaagcgacatcgacgagccccttcttcttggaggttttcttaaccttccctcccttcgccaccttggccgccgcaatcgaaaccagtggctttgccccttccaaatccttccggccgaggggggaactgttcgactccaccccagtttcgacatggtctggacttggggttggggtgtagccgcgcatctcgatgcggttgtcggcgagctcgttcgcggccatttcgatcgcaacatccgtctccacctcatcctccccctcctcttcactgtcctagtcgtcgacggtgtcctcatcgttagcatcagagtcggtggaggcaggggcctttcgcttccgtggggccgatttgacttgcccacgtttgcgcttcttggaggtcccttcatcgccatcgacctcggagggcttcgcccgggaggggagatcgccatcgcacatgtgattcgcccgaccagccgcctgccgcgtaagcagctggctgtattctgtgatcgacacatcgccgatcaccttccgagcttcggcttcggcctgaacaagagttaacactacaaaaacaaaacatcttatcatatcaggcgccaagcagggaaaaagagcgaaatacaaatacatgtaggaagcagaagcctacttttcgcccccccctttggcatgacaagcttcgacaggccatcggcctcctcgtcccggtccacctcgatttgcaatgactgggagaggaggaagatctgaagcacgcaaaactcctctaccaagtcacgacagctaaggcggaggcagactttgcgaagcagggagaaacgggcctccatgatgccagcaaccttcggtttcctgatcggcgcgatcgctttgcgccgtcatcggagagctttcgttgcgtctgacctggcctcgaaggggatggagtggtagaaccacttcgacatccagtggcgatcccacttggacatagaagcattaactggccagagatcggaacgctcggggcgaacattgaagttcacgctcccgaacgctgtcttcttcgtcttcaagtttacggtggcatagaaaatggcaccgaaaagctcagcactcggttcgaacctaccagtccgacatgcccagtcaaagatggcgatccggacgagagccgatgggctcagttgggggagctccacgtaaaacaggcgaaggatctccggtagcaagacgttgcatggaaaccgaaggcctgcctcgaagaacacagcgaagaccatcgtccggttgtcggcgggctttggcaccacagcctttcccagggcagagacctgcttttccgtcagcacgccggagtcaaccagcttcgcaagctcatcttcgtcgacaagcgaagtccccagataagcagctgtttcttaatttccaacactctgatttgagcagaaactctatggagtgtgttcattgatataccaatacctcttcatttcttgatttaccagattggtggtgtcatcatcaatcttgccgggattagggcctgttacggaggccgggtctggcttgcgaggggctatgtcgaaaagtgagagacctgtcgaaggaatatggctgaaaagactagcggatcgaaagcgcacaaaagagagagagaaagagagagctcgcggtgaaaatgactggggggtggtggtaaaaaccgggtggggggtatatataacccacccaggcgacgatttacctccccgcccaatcataagccgccacgtgtcccagggccaggcgaaacggtaaattcccattggctcgggccgcacagcgctaggcccacagagagaagcccatctctgttcacagcagcccaccaaaaaagaaaaaagggcttcgacacgggcaaatggcgaaagctattcgaaacaatggtaaccataaaaatataaatgaatgcgttcaaaatttcttgcaggactccactatgggtttcggcaggaacgtcggaatgggggcacctcataccatagcacataatttgcacggtctcggctgaagctccttactcaccctcgcctgtgaggggcttgttggcggtatggcatgagacccttcgaccagacctaccgaaaccatgataccaacaaggattcaagccaaagacgtcaagtgtacctgggcgaagcctccatggcgaaggctgtggaacaaagacggctaaggccaaaaagccgtgtgggtacctcgcaggaccagtcatatggggcgaagggtgtagacttcgctttagcaggttcggcaccagggaagcccaatgggccatcccggcctcttagggttattcgctaatgggctaactgtaacgaacctaaaattttaatttgcttcgccgcgctgttggcaacctagttatagtatgctcagtgtgttgagctgaacgactagttgtgtcacacgattggcttggatttttttttttttttgcgttagaggatcgattcatatgcatatatcacagatgaaaacacaaattagacacataagtaaattctttatttcttcacatatacattatacagtgttgttgcatacatcaaataatgcatctcatacattattcatctaaaatagaaatagtgaaaattaaataaaaatattggtgtgatctgtgaccacacctaattgctttaggagatttcaaatataagatttaggcaaaagagaaaatttagagttgcttgatgtcacatattttgcaaccaaaccatttcggggcacaaaattagtaacattagccatctcttagtagcttccaaaactatttatttcttaggtaaactctgagtttttgggcaattgaaaatcagtccctaaactcaaagtaatctccatatttttaaagtctatggtactataatgcaaaagttacaaatattatatttttcactaggtttttatttaattgcaaatctgtgaaaaattatgctgagcctccaccgaataaaccatgcttaggtgtcaaacagggagaccaccagtaaaaccttagtaggtgagtcacctagtagtcaaccatgtccctgtcacaaaaaccatatcagtgtgaactccatcctgaccgagcctcattttcctcgtagagaccaaaaccagttagcaagaagaaccaccataaccagagagttagagaagaaaagaaaaatacaagagggcaaaatcacccaacatcaggtggagcaggggctccagctccatttggagcaggtaccccagctcaaggaggagacgctgattcagtagaatcaaccaaccaatagaagctgcagtagaagcaaaagaggagttcaactatatattttcacaaccactgaataatcaacaaagaggtaaactagattaagagcatcatccatggcatataatcatgattagaagtcagattatttacaaatcaagaatctagagaccatattatttgcattacaaggttacagtggcacacatctaacaaatacttctattgtgagacattatgagaaatagaacagagaaatagaagggggaaaagggatatggagttactggtgagggttgtggccggcagagttgccatttgaggcattggccgtctccacagcgaccatcacaggagttgggtaccaatagccatggaggacagcaatgctcaaattacttgagagaggagtggtggtagtagaggatggaggtgaagcaggacatgagtttgtgggaactagggggatcaaatcactgcaggggtagctgctagggagatcaccggagtggggcatggcagccggcctgagggagagcgtcggtgttggcggcgctgtttggggatggcggcacaggagagaaggcgtgagggagagaaggagatagggacagaagaagatgagaagaaagaaagtgggctggttgggctttggttttgtgggctggactaaattgatcatatatagtctccaggaaattagatttagatttagaacagaatgtgagcaagtttttatgtcatataaattgatgattctaaattcttgatatgagtgttaaaataaaatctgaacagagcaaaataaatttataaagcagcacctgatcattatatttgccattcataatacatcattcatatgcattgcatgcggtaaattatgcgttcggaatatgtccttattcggactttcgtattttttttttcagaagttcgagttcctgaggaatcattcatttcgattgaatttgagggtattcgtggtgttttttatccaggcaagtccatctcttgatcatattgcttagttatttcaaatatttgcaacctatataactctcaccattgcatagaaaaccagaaatttatttttgaatgttaatattgtgcatgtggatctgtggatcagttctttggtgatcttaataattgccagtctgaacttggttattgtgtagtcagctgtatatgcttaacatcataaggttaattaacaactgctgtaaggtatgcaagcgtcgtagcgatcgtgtcgaccatatgacttggaatgggacatgctagcttagtagttctttcttaatggctttatccaacgggcttaaggacttccgcgaatcctgtgagcgtggcctagcgatgagggttgctgttgttgcagaattcgattagatgatgtggatcgccattgttgcaggatccaatgattcgctgttgttgcgggaatcacccgcagagataattaatagatgggattgataaaaagcttgtgaccttagccttgccggcatacaccatgaagtgtgcttcaagcgccgacgggcgtgggcattaaaaggtttaaggcgtcagtgggtacagcgacacacctctgcagagtgtatgaattgtgatatgtcactccctgtttcgggtagaaactgcgaacgcggcaggaaagggatcaatcggagattctatcctgtggtacttgatatgcagtagtgttttataattaaaatttgaatttttgcaacaaatatttgtcaaaaacattatgaattctttgaagaatcttggattctagagatagttgcattcacacattttcttgctattgatgggcttgttgagtaccatttgtactcatcccctatgttaattccttgtatatagatgttgaatcattagaatctgttgaacaagaatatatggctggaagtgaaggaactcatgttatggatgacaaccaggaaggactctacgatgatgctgagattgactatgataattagtgtataatatgcatggttcatatagttgctgtagtggtgatggtagtagcagtggcagcggtagtatttgtactagtagcagtaacgttaatatgaatagaagcaatatctgtagcggtacttgtgaattttctagtgtgttgtatatttgctgagcttttggggtttgtatattattttgctgttatcgctcgaggcttgtcttgagctgtatctatggtactataataactggaaccaatgcgatgtttctgctatgcaactctgatgtgcatatctctgagtaaacgatgtttatgaagatatatgctatagacttatattctactcttgttgtggaaatatgtgggtcgtttcactaacgttcgccagtcggcccatagaaggcctatgtatccaaattacactg

SEQ ID NO: 68630 - DNA, 728 bp, Oryza sativa
  unsure (1)..(728): unsure at all n locations
atcgcccatgtctcgtttcgcgaaagaaccgagtatcnccgcctcggattcgacgggaacgaaggtgccatctccggcgcgactgagaaagtcctagacgctgtcgcaatccaatgagcnccatttccattcaatatgcgttctgtaatcacctctcaatgccgtcttttaacacaaccaagaacacctcatttggtgcacccaatctccaggaacgcgaccgcgtcaactcggaacaccgtagcgctctggacgccgcagcttcacctttgcctgtcgcccggcttcaacagttcgtaacaagctgagcctcttcgccacgagcttcatcaacaccttcagatcaagaatcccgaagtaatcgacgcgaggtggaccacgatgggagatcctcttcttcttccccaattccggccgccgacgccattcctttctttctccttctctggtcagcttcggcgcaatctttttcgcctagagctaccttgtgctgatctaaaccgaagcacgtaccctttctatgcagtacaagcccgggggtacaccgtagcagccgcgccgtcgccgaaccagtacaccatcgccaagacttcgccgagccgcgttcgcttcttggtgagtccctagagtccttaccatacgcatgcacgattagatcgagcctcaaaacccacatgcatgtgcaagccgagcttagccactgcctctaacaccctaacagccgctat

SEQ ID NO: 68631 - DNA, 790 bp, Oryza sativa
  unsure (1)..(790): unsure at all n locations
acgccaanataagagcatctgactacactatcggccgaattcgagctcggtaccctacagtatcctgatactttggtagcacctgagtttagaagatcgggtaactggtttaatggtggcggaagaaaaggccgaggccaaggaagaggaaggggatggagtggtcgttcttatcgacctgactctgatatggctgcgtatgatgggggcgacgatgaggagatgatggatacagccactagcccttcaaaacaagtggctaaacactatgctccctctacatccgtaaaaaagagattggctctggaacaggtgacgtcaccaaatctgaagagcaagcaggccctactactggagaatacacctgtgcaagatgatggaaatataaatactgaagctctcccaaaggaagttgatgagtcaaacagtaaggaagaggacagttcaacatcactagacagtaagcgtcagaagaaggtggatgaaggcagcaatacagatgacttggcaacatcggcgggctccctcgaggagtaccgccgggcctaatgtctatcctagcttggaactgtcggggcattgggcgagcccggacagttcaagatttagtctgcatggtgcagactcactggcccgaaaatagtcttcctagcggagacgaggcaaaatcaaaacgttgtgagaaacctaacatggagattaggtctgcgacgcttctttgtagtgaatggaaggggggaaggaggtggcattgcccttgttttggatgaaagcattaaagttgacctaa

SEQ ID NO: 68632 - DNA, 1296 bp, Oryza sativa
  unsure (1)..(1296): unsure at all n locations
ctttcataatacattccaattatcctttccttttgtatctggtacgtatttgaattaatattttaattactcttatttttttcatatgataacataaatttcataattgtttagtgccctgtgttgttgaacaatatttgaagccgttttcattttatatgctattaaaaacccttttttcattgttggttacacttcttattatgctgcattttcagctgatctttttagcattagcataatattgttattcctatgtccagcaactttataaaggtttttaatactctgtattgttctgtattgtacaggaaacaagaaaggtgggagctttcttcattgaaccactgcacaaataattcctttgacggtacgccattaaaatcctcttttccccttgatcatatctgccactgtagactgactaagttgttttgcattaattttagtagcggttgctgcaaccttgaaattatcttaacttaatagtgagacaagaaaaggaagcgagttgaattgcataagtttttcaataatttgaactgtcaatttgaaagtgaactgtcaatttgaaagttcaacacattgtgcatattcggttgtcttgacaacaatattgatgttatatttattggagtctgaactcctatctgatgttatatttattggagtctcggctcctatctttattattttattcttttatttgattgaatagaataaaatgaagggtgtaatattcaaactatttctttttttatacttcaaactgtagaagatttgccggatatattagaacgagaaaagaagtagtaaaccagagccttacatatgtctgttaaaaggaaaaaaacatctagggaagatatgaggattgatttacataaaaaaagagagcgattgattgaaagatcatgaaacagacagatccttgactattaggctaattttttccttcactagaaaagcgacttagaatccattcttcaacaattgttggaaaattctattgtgtaccagccatatgttccaccacatcatcaacaaaggtatggaattacagagctcactccaccaatctgtgatggtttgcatggcttgctgttctggggcttggaagttcatccaattgcacactttatcctaactatttctacatttatatcgtaaactatatctttagaaatgtgctatttgacttaacatgtcaatgtaggccatgtgatatttcatttanngttgcttgcacttgcagcagccgacccaactttcactatgagtactgtattttttaag

SEQ ID NO: 68633 - DNA, 1170 bp, Oryza sativa
  unsure (1)..(1170): unsure at all n locations
aaaaactatcaaaagattggatgttttcattttaaagtgctngtaaatgaactcaatcatttttgttaaaagaaatatgtgttgctctgataactcaaacagatacacaaaacctaantattccctcgaccttgcattgttttagtttgacaacttctattttctattttatagataaatttataagtactaaaaattacaccgtgctaacgtagtatgttacatggtaaatataaacatatgaattccatttatcataatcgaacaatttaaaatatatcagtggtcaaagtaaagcaagcaccagtcaagattataaaatattaagaaattgatggggtattatataatggccccttaatttgaagtgctatttgttagtaagataatggtttttcactttgacatccctctttcaaataaacaagtcctttgtcgatatttgttacccaaattaccaactttaaattattatatttctgagtaccataaatttatcttacataagcttatgaataaatattagtttatttattctgactagctaatgggtttggaaaaatatgccccacccatcaggtaagattcaattctagccatccattcttttcatctcatttaatcctaggcatcctctccttttcatttcccaactccacctcccataaccattttgccaaacagggtctaagtgttgcacattcagtccttcatgtaattaacatgctgcaaaatttcgtatatgtatttacgttattttgattcataaatgttttttttccttgtagaaagcagggataatatattgggatgatatatatatggaataggggtcacaacaaatgtttacgagccaaaggtgaagcatcattgggttcctagtggatcatggatacaaattgaaaatggcacaggatgtggagatgtggttagtgctagctcttgggtctagccaaacttcagcgatgataactttgctaggtttcatatttttgtcacgcccggaaattcactggtaatttccgaacttatttgtgcataaaatcctcgtccaggaatcagccgaggtacacaaactgacaatttaatatacaaatccatcataataataacgttacacacttataatatcccaaggtatcaaggaataaagtaatcaatgcaaacagg

SEQ ID NO: 68634 - DNA, 5314 bp, Oryza sativa
tatttttgttctaaaataaattttattcttaattatcaggattcacatttgcattgagagaaaagacgaaagtatccctcattaataagagaacgtggttgtatttcggtagatggatagataggaagtatgaaagggaactcttctatttacagagagatcaaataaggaaatatgagcatatttatatacctctaaaatttcagcttgatccttttcatgtccctgccgttacatttttctatcatttcactgttaagtttggtggctcatgtctttaatgcccttgatgatttaggtttggaaataagtttgaaaaataatgaaatttttgtttgagtgtatagtatatgcattttatgtaactaatgagactaaataattagtgcggaaaattttgacataaattttaaaaataaaacaaatgtaataaattaaaatttttattttactagaaaagatgtccgtgcgttgtaacgagtgaataatattttaatcttattattattatacaatttagctatggtgaaattcactgtaggaatttgcttggatatttttaagataatcatgagctgcagttaggagtccgattttcatctcaaactagtatgcaagtttttctaaaaagatttcttatacgacttctttcgtattttcaaaagcaaacgaacttaaaattcgacacaaacaccaatatgtatttccaaaagagaacgaacttaaaaccaactcaaacacggatgacgtaccaaaatactggcaaaaatatttttaatttttataatagtagagaaatctaataggacaatagatttcttttgattgggagcattcataaaaaatatcgtgagcatttatagtcctagctttgtatggatgctcctcatttttatgacttttgaacaaataaaacaaatacatatgttttattttattatctaaaaataaattttatcatatactccctccgtccctaaatatatgggattttgcttggatatgacgtatcatagtacaatgaatatagacataaagctgtctagattcgttgtactgtaatacgtcatatccagccaaaattccttatattttgggacggggggagtataatatatcgcacaacaaacaataataataatagtctcatgtgataaacttttacattttcaataatgtaattcataaatttttatattcattcaaaggataaaatggtcatttttgtagaaattagacggtcatctgacgggaggagcatagaatggatcaaaatcaaattttagactatataatgaagtaagcaaaattcagaggcgtagaagggattagctaaaattttaggggtatacaagggattttctctatatattttatgaatatttagtactactatttattaaacggtttttgccgcttaatttgattacctcgtctaatccaatgatgcttcacgctttcgtgtgattggaatttgggaattccctcatttgtttttgcgttggattaggacaggaggggtcttttccttcttttttttttcctttgggtgacaattgttggagatcttttgggggggttggtgacgcgatcgattgcgtggttttggtcggccgtacgaatgttgcagccatgaatttgattgcgtcgatgttggcctcctccaaagatcataggatgcacatgttgagatgggctccagatccagctctcaatcaaaaatttgcagctttatcaaaaagagaatgaattagcgggttagagtgatcaaaagaatgaaacaaagaggtgaaacaaagcacgcgagtaagatttagaagctaaagccctatgaacagacctggagtaataatgacgggtctgattgaatttcatgaataagtttgctctgtccgtagatgtcatgtcgtcatgttaatttgaactttggatgattgaaagcatgaatgcccgaagcacgaatgatcacaaaactaggcgaagtgatcggtcggccggatgaaccggtttgtgtggttccaaatatgctggaaggtaagacagctacttgatgcagcttctttactttaatttcagagccttaattaattagcggagtagtcacggaatcacgtggctgtgcagctgctaatgaacgtcatggagtactgctaattcggtacgaacaaaatagaggaaaaaaataggcaaggaaaggaatatatgaacgtcactcatgactcgtgtattgcatctgcatcataactctatatttcttcgtctctgtgaatagtgaactccgtagctagattgaaacgtactgttaacgaaacaaatgcgcatcttgtcgttattttacttctaatgtgcttgggaggtacaactgaatatactatgcgaataattagacagcagatgctgtgcgatatgatatgccaatatatgtatgtctgctaaattactccctcgctccgattacaaagaagaaccagggtaactttttgatttcagagtagaaacagctcctcatgggtttcctgaaatccgaccgaaaaccgataaaagccgataactttcagtcaatactatacgaaaatcggttaataccgaccggttttcacaaacggagacatagtagtttcacgaaaaccaatcggtttttacagaattccattggttttgtgaaccccgcaaagaacacgttgtttttggcattaaggtacaaactttgattgataacttttattaaaaagatatttcaactaaaactagagtattataaaaaaaaacttttagggcgacccaaacctagagatgaaaacgatcgatcgataatagtctcttctttttatttttacaaaaatagttgaaatcttttatatttatgaatttaactatttaatgtaaacttcaatgtgatgctaatagatagtagaaaaactaatatttggaaactgtacctgctgataaagatattattattatactccctcggtttcatattataagtcgctttaacttttttctagtcaaaatactttaagtttgatcaaacctatagaaaaaattagcaacatctattacaccaaactagtttttattaaaactaaaatttaatatattttaatagatctttcgtttcatgttaaaaatattgctatatttttctgtaaacttagggtgtgttcggaatccccctttcccaactcaccattctctttttccgcacgcacgtttttcaaactgctaaacggtgttttttttccaaaaggtttctatacgaaagttgcttaaagactcatattgattgatttttgaaaaaaaaaagctaatacttaattaatcacgtgttaatggaccgctccgttttctgtgcggagagtttagttccaaactccctagccgcgaacacagccctagtcaaacttcaatttgaccatgaaaaagtcaaaacgtttgaaacggagggagtattaattttgtagaagtggataatatggttggaaaattttcttactgtttttaccggtacccgggccaaacctactgcttctgtgcttcggctgtgtttgtttgggtgatagggagtaagaatgcacatcgttttccgcgcgcacgcttctcaaactactaaacggtgtgttttttgtaaaaattttctatatgaaagttgctttaaaaaatcatattaatccatttttaaaatttaaaatagttaatactcaattaatcatgagttaatggctcacatctttttgtgtatcttccaatctcctcaatccccttctcctcaaacacacccttcaagtatcagacagtgagaactgggaagacttcaagtatcagacagtgagaactgggaagactgaagagatcagtggattatacaaattgtcaaagagcgagggcacgtggagtgcacggcgcggcgccgaaatatataattctgaaggtcattcggggtgatcgataggtgggaaacgagaaatgtgtgtgcaagcgcaagcgtgcacgtctaacgctcacctacagattcttccgtcgtgagagagatgcgtatatcgatcattgtccacttgaccacataattatgtggtgtttaggttactagtactagatgatacagacgtgcatgcagcatatagcgatcatcacgttaattcgcctgttcattactgcttgtttgttggatatagagtaatatgtacaggaactctatatcacaatatattaattaacttaatttgtcgttgatcgaaaagagtagtcgtatactcgtacttgctaccgcacccagaaatggtcacttggaccacgttctagcgtggcatatgctcgattgcccaatgtggggatcccaaagccacatgcatagtagtactgtgctgagtcagcgtgatgcgacaacactgtaacactccaagtacttcgtgtgaaaggaatgcaccattataaaatactagcgtttgtttagtttacgttaaaattgaaagtttagttaaaactagaataatgtgacggaaaaaagttgaaaattcatgtgtagaaaagttttggtgtgatagaaaagttgaaagttttaagaaaaattttggaactaaactcggcctaacagttaagtttactaagagcaagtagtttaataatatagcactctaaattatctatagttaatttaatagctaatttatacaatagttatctataaatatatattataaaattaatacctgattccacctatcatatacacacaggtatcttggaatccatactgcagctgtctataagtctatagtccgctgcttttctctttattttttgtcttctcgaaatgtgtttatagctagcttataatatacaattgtacctactcctgatcactgtagctcatatagctcatagaatggcacacattaatctacaattaacaataatgccgttctccataacaaaacaaagagagaggatattaagttaatttgcatcgatctagaaccacatgaatttcacgtgaggtggtactttaatcgccggatgaatatacgtcaagacaaattcgatatgtatgttgcaaacaactgggagcgattatttgttcttccccatacaactactagtgcatgattgtggggcttcttgtcctgttccctgcttctggccccaacaacgtttctttcttctagaagggagtcttgtactgttgctccctttgtcacgtcattctcgaaaggtggcttatcataaagttcacgacatacttaaatacacgtgttttgctatggataaaaatgaattatacatatgcacattgtttagagcaagttggttgtaa

SEQ ID NO: 68635 - DNA, 5136 bp, Oryza sativa
  unsure (1)..(5136): unsure at all n locations
accgcccgccgccgctccacttccacccgcgacccctttgctccgcccaccgcccgccatccttccgcccgcagcccctttgctcgccgcccgccgcccgccggggtagagagaagagagagatggggtagagagaagagggaggctgacatgtgggaccacatgggctccaccttttctttttttagctgagatgtgggtcccacgttttttattattttcccgggatccatttgccacgcaagcgccacgtcaacgccacgcgggacgaggacctagtcaaagggagccacgtaggcgccacgtcatccaaaaccgggcacaatacttccgagggacctcttttgcacggttttgtaagttgggggacccgtcatacccggttttgcgatgaagggacgaaaatcggactgtgcgacaaatagagggacccaaagtgaacttattccggagagaaaaggggaggagttgggccggctgtagagaaaggagggggtgcggcccaaaaggaacaatagcacatgggaattttcgagagagggtttggaaagaaaattattgatttgactttgaattttgaattcaaatttgtgatttgaactcaaggaagaaatgggatatttttgagaggataatttgatggtattttgggaaggagaatattttggagggattttgaattgtaaaattcaaattccagggttcaaatctggatccgaatttttgggatgagatctttaggtctcaagggcagggattttgagatttttggcacttagtccttagtagcacacaaagaaccaaaaattttggaattaggatttgtataaaatagtttctaacggcccaaaaaatcggagctttacaatttcaggggaaatcctgcaaaaaaaaatgtaaccgtgtttacatgctaaaagttgggtctgaaaatttctgtgcactaatcttaatcatgagaaacatcacaagacatggtatacaaattttcttgaactctcactactcaatatcttcccctggatgctctcagctcagtggattaattgagataccgatccaattctcccttatttctgatacttgtgcataaggattgcgacagcatgttttgatatagttagttgcagtgaaacagcaagtgggacttgcaaaagtaaattcatggatatatatatatcctagccaaaaccaaaagatgaaaaccaggacttccaaccatcacattatcaccgacgatgatacacagagttaataacacatgcatatgaaactaagaacctcatgcgtttctgtgcagcatccatcctctgccttgttgctgcactattctgcaggttacaggcttgagctcttagcagttagcacgatgtaagatataccagcgacgagtctcaaaaaggatgatcgcaacttacgcaccttgatcgtttctgaaactgcgtaggtacagatttttaaaaagactagcacactgggcatggacgcacggccacttgtgttcgtcttccctgcgcggcattttctttttttttaccaattcaccagaggggagagattccccacctgaaaactttgtcattatctaaaacatcaggaaaagttcattacatagtactgagagtttgtagaggggtacagaagagttctttccaagtcgaaactacaggtctatcggaactcttcagtctttcagcccataggccggcttcgtccacacacttccttaggcatctgctgagcgatggagtttgatttctgaagcccagaagcataggagatagaacagctgaaaatgttttctgggcagcccttgccccggcttcaataggtgcagcatcttcacatcttatatcgtaggatggagccctatcttgttccagaaggttgttgcaaaaggacattgtatgcacagatgactagccgtttcagccgagctttcacaaatggcgaaaaccgccgagctgacaatgttcttcttgaagatattttgttttgttgataaccgctctctgctaagaaaccacgcgaagatttgaactttcatcggggctttgcttttccaaatgaaggtccagtttggagaggtttcgcccccagttagcaacgcatcataaatctgttttgtcatgaggtttcctgccaggttgttcgcattgtatctttggtctgcagcttgcgtcagggagtggtaatgtagcaggtccagcaggcagcagcattgccctgcgcggcatttcatcaaacaggcaagagctcccagccatggaaacctcccactcctccgctcttccccgtgcgagcagaggaaacaccgcaggactttatatactccgcctgaggactcttagagcctatggagacggcggacgatggccggatcccggagcggcgcgcgcggcgggggcagttgagtttcttggctgttggccggggaaacacgtcctgcgagtctcgcacggagcgtcaatggcgtgattaagcagcaaggaaattttacacgatcgttgatttacctccacgccgccgcctcctctgctcctcgcctcctccccggccggtcgccgcggccatctgcccatctccacgccaccgtcgtcttccccgccacgcggtaacaaaacttttctcgaggcgaaatcaactcacggcgttaatacttaatagtgggccggccaaagtacacgtgattttggaacaggatgccaggtaggaataagtctatttcgtgtcccttatctcttgccgcgggttgaattatctccctcaatcataaaacaaagtataacgcattccctatctctgaaaaccggtgtaaatcgtctcttttgattgttttggaagtgattttgtcctacgtgacgctcattggacccacatgtcagtgaaaaaaatgaaaaattaacagccccacatgtcgatcattctaatctctttttctttctcacctctctcccctctttcgctttcctattctctctcccagaaggaaaaaaaaaaagaaatctcaccacattagcagcaaaagatttcctcgtttgtcttcataatttgttgccctgggctcggttatgccaactacaaagcaaacgctctgacatagttcgatgagtgaaatacaccagcagttgctagctccgttgtctgtgtaaactttagtttacgttcctctctgaaagatttaatcttttttttttgaaaagaatcagcacgagattgtgctatttcattggatatagaggtaaaaaaaatacagcccctagagacaaaagggaaaactgaacacaaatacatagaggctaatgctacgaagggaggaattctccaagtcgccttgcgcctgccatgatccaggttcttgcctcttcctttattttcgccataagattgggagccgttgtttccttgtgctcaaagatccgttgattcctttccttccagatttcccacacaatgagcagggttaaagatctcagtcctttcttaggcacttcctttttgttgtttagcatgtcccaccactcttggatgctttggcatgggtcccaatggttcggatccaattgctgataggcgacccagctggccgttaatctccaaatcctcctggtgtatctacaaaaggcgaccaggtgacatgccgtctcgttcgtctcccgacataaggggcacagaccattattttgccatcctcttgcagctagccagtaagatgtttaacccaaaagggnaaatttgggtttcccccaaactttgttttgtatcacaagccacaaataaaatttgcatttcgcaggggcccaagatttccaaatcaaggaattgtagttggtgccgacatttcctagcaattgtgccttgtaggccgaggaggctgagtattctccatggttcgacagcttccaggtgatgtgatctggttcatcttgatttagtaggatgccctgggttgcactccacaaggacacaagttgtcttattacgtccactgtgaaggtagtgttcccgttgagcttaagatcttcaatccaggtgtcattttcaattccttcgcgcagcgacttgcctcttttcttggagattgcatagactagcggcatgatgccttttggtcgttgcccatccagccaggcggagtcccagaatcgtgccgtgttcccgtcccctactgtaattttggtagctgcggcgaagaggagtttgtcggtttcatcacacggtgtctctagacacacccacggtttggttggatgaaagatttaattttgaaactgatacgagcttactaatcttttttcttttaggatgggatggctatactcagattcactgaaagcgactgaacacaaacaaaaaaggttctggtggagataccagcttacaaggaaacatcaacttcagaatgcaaaacgccaaaatgcatgcgggaagtaaaaataatcagaactgtcaccaacatcaccccggatttctagccatcttcaaatttctttgaatttctcgtccttggatggcttcagagcacagcagcattgctgcaaaaatgaggcaagtttgtagcaaccatatgtgaaagcaacatcattttgaaaataagagtgctgcagtactgtgggaagttcttcatccttgaaatttgcacttgcatagcttaaactacctttaaagcttaaggtcccttaaacctgctgctggccggtgaaaatgtcctgtatcttctgccacctgcttcactggcaggtgaaagtccaccataacctatactgcctcttttactgacaggcgaaggtgaaaatgccgtgtagcttctactgcctacttcactggcaggagaaattccgccataaactgtacttcttacctcactggcaggtgaaattccaccccggctcatattgtgtgcttcgttgacacgtggaagtcccccagtttgcttcactgcattgtaggcatctccccaataagtttcagtgaaatcacttcgcgagtcatcttgaagcagatctttttccagagatgccagaaactcttccatggtgtcacctgcagatgtgctaacctgtgacaactgttcttctgatacacgagaactgtcataaaaataaatttgttaccatcaggcattgtgttgtgctt

SEQ ID NO: 68636 - DNA, 3352 bp, Oryza sativa
agtaaagttgagcagttaagttttcctttagaagataccatattatttaaagaagaaattaccataggccttcacgttttggtccaaagtatttggatggaattgggctttattgagatattttccatgatgcaccagatggcagtccattatttgttgaagaaatctgctggcatgttgcttggatagttggatgtcaatttgttcagtgtgattttcagaaactggtaaatctgttcagggtatcaacagaagcaaggcataaatcaggaagcatttgacatgaagtaatttccacagcaaaccatgaaggagtaatggcggcaattaagttactcaaaagaggcaagccagacttacttgctggtgctggacttggttgcattgagcatgatcccttaaggtaacaattgccattgctggtatgaaatgattcatgttcttgatgaacattcatttcttcagtgtagctagagtaatttgctggtcttggcttgcatttaagagcatggttaatgatcatgtcccaatcttgatcagaaatatttcccaaaatctatacaggttattgtggcatgttacattctataggagtacagaatagaaataaataatgaaattcattgcgtaccttacgcaattctttgggatttttatggaagaagcataaaaaatccccctccgtcttgatacctttatgctgtagtaacttgtgcctatcaccattcatggcaattcgagtcagtttttatacagcatcacagggagaaggatgttcactcttctttgttgctgtacagaaagacgccaggcattagatgtagaagaatgagacctagtagacatatgaatcagttattgatgaaaaggttcggtttaaaaggttgtgttcacacctagcagaccattgccaggatgcacaaaggaagatagtttcatacgtttactgatcaaatttaccttacataacagaacagttcttcaaattgaggattgtggcataataaatgatagagaagcctccacttttctagtttagggcctcattactaaatgatgctggatgctgcgggtttctcttttgagtatggctgtttaagagttaccggccttttaattaaaagtaaagacgctatgaggtgtaaaaataagtatcatgttgaaaaggcgttaggaacttgaatataacaatgttttgcacttgtcctttagctagcttatgcaacagaagaattttgttagagagattgacagaatgcatatatgtaatgagagctatttatatgaagagtaatgtgtatgattgtctaaacttttggtgctaggatgaaacttaatattacttacagaatccccggccatcctttacggcaaaagattcagatattccttcgaggattttttctgatatgctatcatcagctgccatgactcctaacctgaactgcttgcttggaagaaaactcgagttatcctggaatttggcaccatagaggttagccacaccattttccagccttagataaagttcgttggcaaacaaaggtagttttccaggccgcccatatactatgttctgaaggaaggagtctctattccactgcactttattgtccttgttaaactcgccattcatgacaacaatcctaacttgcattgaggataaaggtccatttgtgataatcttattatcatgatcatatatggctactttgataggactgccgtcatcagctgttatgacgtgtctcgagaacttgtcgttgcaacatctgttctcaaatttcagtcggtgcgttctaatttctctctgataagataagccccttaaaagttatgttaaatgatcaagtatactatgtccaaaattttaactaattagaatcacctacataaagtctactgagtggcgagcctgtgtacgagacgggccaaagatttgatacttcaattttctagaacaagagatttcctacctgtgattagtgtgtttcttaacatggtccccaggagtacttgtgtcctgtcacagaaacaaatttacaatcattagtcagaaagagcaataaataaattcagctcagcaaagatgctaaattcttcaaatgatgagattgttttttgacagtgaaacacggaatgacggaaatgcctttcataaggattttttttccttgactcagtttccttgaagttcccattttgttagtataaaaatgtcaaaaaaactatcaagcttagttgctattatatcgggttgtcctttggttcatatcattagttctgataattgtagatattgctgttttccgtagtcttcagttcagtgaccgagtgactttggtaggtttgtagcctttggtgttaccatgcattctcacaaggaagtaaagaactaagagtactaagaatataagggagaggacctagaaaattttcagtcaagaatagtcgaatctatcaaaacttgaaagccaattatgaagcttccaactataaagattaaacaagaaagtaggtgtttaccgaaatcaaggtgttgaactgcccccagatctgttccatcctcctctgttgctcactgatctgctcattgagctgcagctgggaattttggtaaaacagttgcatctctctctgtaagactttgcgctcttcaatgaaaccttttgacatacattgcatttctttcttgagtatttcaatctggctcttgtagaaatcttgtgtctccctatcatgcacataaagaagaagaaaattctcaaataagaaaatggtctcatcttattattccatacaaacttgcaagaaaagcataaggccttgttcgtttcgggcgggattgtggcccaaaccccatggatcagcctggcatgggaaaaatcacggcctgcatagaaatgtgtgttcggttaagcctagtcgggattctaacccagcccatcctagccttttcccctcaccccggcctgggaaaaaaataatcttatccagaggtgtggaaaaggaaaatgtatacgaaggtccctcaacttgtcatcgagttacaaaatcgtcccccaaccgcaaaaccagatatatgacatccctcatcttacaaaaccgttcactttaggtccttcggtggttttgaccccggttttgtccaacgtggcagctgactcagcgtgggactcacgtgggccccacatgtcagtatgccacgtcatctctctctcacttttttcctttgagccagccgaccggcgggtggtgtgggacgaggtcgccggggcgaggcgggaggggaggaggtccggcaacttggcggtgggccacaaggaggcggcggcctccggtttcccccggc

SEQ ID NO: 68637 - DNA, 26449 bp, Oryza sativa
gattaacttataaccgagtcaaggtttatccagattcaagaatcatataaagaacccaagctttagagtgtctctctcctgctcatgatctaataatgaactgtgatctgctcaaggttacaaatcttttacattggtaagctgttactggattcatttgacccatccaggatttagtatcaaatgaaatctgaaattgagagaaacttttacagtaattaaagagttaccgaaacaaacaaacaaacaaggtgggcaactgaatctaaccattcatttaccgaggttagaattgtttttttataatcaacctaaaaaaatatgcactgttgcactctccctctcatggaagatcttatcaatggactaccttcactgcttggcaccgcaatgtatcatgattaagaaatcaccgcatcatcatctccatctcctttttattagcataaacacatatgacatatcacaaccatacgatggtgaaaagaaagaacattacctcctgacaacaaataaagcattcgttcatccaatgcagaattggaagtgatacaaatatcatcagatcagaggtttggaatatctgtcactatatgaaaagataactaaattctcgttcacagtaaaagaaatgttccatccatacagacccaaggtctcaccagacattgtgctaggtctttgttgccacctttattatgcctactattgcattgagtgcagagttatctttcataaggatctcctaaagtataagcctacaacaattgcttccatgcccctatatttttcgcactaatctcatctggtacttgtatgagtgttgctttaaggtcttttagggtgtcctaagaccttgagaattggatatattttgatggtttttacaaggtggtagtaaattaaattttttacaaggaccaaacagaaattataaattaaaatctcaagtaaacaaattgtggtagtacattcatgtctacataatcaaacacaagtaaatcaaccaaaaatgattttccaagtcactgcaactggcaagggatatatcacagaaactaggcagaagaggagcacagctggcacgctagagtagtataccaacaaatatggtgagagtagctcccgattgactgatgtggcgtggcaacatgataacatactgatgaggacaacaatgactaatagaagatattagtgatctgttacaaatatctttgggacatttggggacatacagatgaggacatgtggaggaaatttgatatgcatgatcatggaggatttagttgcaacattcttgttaagggcatccttaatcttgctcattaaatgaagtaaacaaaaatgtagcagaatcttggatagacatcttcatcttaaaactgaacatggaggatccaaacaggatgtacattatgactctgggtagagaccctttacatgtaattctaaattctaatttgcatgtctgcatgtccttggagtccaatcctagtagaatcggttgtcaagccaaatctgaatcttacaaatacactataatactctcttttcaaggaaatcccctatcattacgatttctaagggtttaataataggccaatgcatcagatactttgttaaaccagattggggcaacatttccatagctccataaatttgtttcttagtgtttgtggatgagcaaatcaaccaggtggcagatcacataaacataatgactactgtattcgctgaattgcaactatcagctatttctttattcctgtttgcctaagaagtaagatgagtcacactagcagagggcttagtatttaggtccacagcttcagtaactaaaaaggcttagtaatgatgctcatatatagtttctctaaaggacaacaatttctacttaatttacaagctattgcagtcacataatggctcacctggagtagtagtcgacacactaaccaccataatattttcaggaaaaaaagaaattcccatttcggtaaaaatttagcaatggtgtgtgaagattctctgacgaaaaggttttgactcttgggcgtcaaaaggaaaaggggtggtgacccatgcgaccttttctttcatcaggcaagaaaactgaagaacagtaaaagcagcaggaggaggagactgaggacaactcactgatggcgttgaggtcgtcggcgtagccgtggacgcgcaccgtctcctcgaaggcgagcatggcgtcgcgggggacgccgtaccaggtcttggccttgccgaagtggaggaagttgaggctgtggagctcgtggtcctccacgtgccaggcgaaccagctgtagagcatggccacgtacagcatcggggtggtgacgcccgccacgtcgcgggccatggcgcggagcagcgacccccgggcgcggggcgccacccgcatgttccactccgtctccccgacgtcggtggcattggcggcgtcggggagctcgtcgggggaggcgaagccggagccgggcatgtcgttgccgtactcgacgctgaagggcctggaggcgcaggcggcccagaagagggcctcgagctggaggtgggtggggttcctgggcggcgcggcgtgcctcgggggctcgaactcggccgccttggcgcggaacgcctccagggtgtagcgctccccgctctcccacacccggcggctggcggcgcggcggttcctggcggagaggccgacctgctggagccgcgtggggaaggtcggggaggggtcgccattggaggaggccgcggcggcgaaggcggcctggaggcggcggaaggtgtcgtcctcggggggccgcgggagcgggggcacgatcttgcagatgccgtagcgggacgcctccggctcgatcctgaggatgtaggcgatggggtcggcgaactccgccagcgtcgggtggtactccggcgccacgggcagcgtccgcagccactccggcggctccaccgccggcggctgcagcgacatggcggaggcggaggcggagggggagggtttcgtcaggggaggaggaggagtcgcatttgggaggaggcgatttgggggaattggcttggctgctgctgctgctgctgctggcttagcttgggtgctcgctgctgatgccgcttgctgctgctttgggggtagtgagaggagagaggagagagaaatggtggggaagacgaggtgatggggattttctttgggggtttttttatttgtttatttatttttctttccatgcgaacggtggtagtagaaatcaagagatggaatccgttatttgcccctttggaaactatatattcgaacaaaatttggggaaactgccggagatcggattttgttatggggtttgctcttcttgtttttggaaagatttttcagcccgaaattagggaaataataatataggtaagtactttttcagatctgagatactctgagataaggagatcgatggcggtcgtgaactcgtgatagtgatgatgatgaataaaagatctcttcaatactttgatttgataaagttcggtgccaaataatggtattataattagagtgagggttgggtagtaagaaggctaatatggagatcacacaaactaaaaataataatgtagttgttatacagatctaaagaaaaattatagagaaaatataatcgggatgagagagaattctatggattactttggctaggagattggaggagttagagctattatatagagataaagtaaccgcttttttaagtatacaattattaaattcactattattttccttgatcaaaagcaaatgcttttaaacgatacttcaaatttcaagagatatttgtggatgaaagatcatgacaaattaagaaaacaaagcaggctccatcattgatgatgagagaaagcatctctttctagtcaaacgtcggcatggacactatgcattaattgcacatatactcgatatccgttttcatttctaacattgacaattggtatactccagataacatgtctcatcatttttaaacggcacgatctactaatgatatggaattaattctatttttacattattactatgaggagccgtatgaggtgaaaacctcatgtacatcctccatactcgtaaaggaaatcgttttggacaacgatacggtctccaaaacacaactttgccttcttatttctataaaaatatttattgaaaaataatatatgtatacttttacgaaagtattttataatttttacattttcaaactcaacaacttgagagttattcatgatttatactctcaaggtttgacttaaacattatctttaaacgacttcctttacgagtacggagggagtatagttttggagcggagatttttattaaatagaatgaacgaccataatagatgttgtctcaatctgaaggaaattatgtggaagctttgcagaattattatgaagcattgcagaattattatgaagctatgcgactagaaattgatccctacgatcaaagttatatactctataacataggccttccacactggctctgcaaatattatttccgggcactagaacggaaccccttcttaccataatatggccatgatctgtcattacgtgcgactatctccactatgtagaatttgtaggatcatacaacaagaactaaaccaaccagaggggggtgaatggttgtagtacccaaaaaccaaaacttttagcggaattaaaagttgccctcgaattcgatatagattggtctgaccggagtagatgcaccggtctgacggctcgaagacctccgatctgaccggtagtgaagctcgatctgattgtgcattgccctgctaacgcctgttgctgccgccggtctgaccatcataaacccgtcggtttgaccgggctgatgctgtcaatttgaccaccagtgtccagtcgttttgaccgggccgatgccatcagtctaaccgccagtgtcccatcagctggatcaccgaatccgagcaaacacaaattgaagatctctcaaaataaattcagggcctgtttggcacaactccagctccagctccacctctcctggagctggagtcaaaccaaacaatttcaactccacctaaaatgggagcggagctgggtggagcactgtcacaaaatgaactagagaggaggagctgggtttaggctgctccacaactatactccagacccaactctaagctaaatttaggagttggagctctaccaaagaggccttgaaactttattacttctatttatatttacaaagtgcaacaacaactctcctcacaaaaatctcgactaaactcaaaaccctaacttttctctagactcaactcttacaaaattgaagctggaaggctctatttatacctgaggtagacagcctaaagccacaaaccaacttgtacaagaagtcttaatcccctaggaaatcttcccgtacaagaaacaaactttacaaactccaatcataccaaatttggacttcttccaaattcgactccgcatccatacgcacacaacatctccgtcgtatgccatataaaatcttcaccaactacgcgcatgataccttgatcgttcggatgtcatcttctcccaagttgactcatgatccatcaccgacaacgctctcatcaggcatcaagactcaccctgttgatgggggatacccgttgaccgtattcgaagggtattgaggtacattggtatgagaatctacacgataccgacaccaagcacataagaagacaaggattatactggttcagacccctcataaggtagtagccctaatccagtttatacgggggattatggaagaaaccacagagtacaatagagaacaactgaactccgagatcctcgttgaggggaggtcgacgagatctattggcgagtaggcttcaagttctccggattgcgtttgtggtggcagatgtcttgcactaagattcgatgccatgtacacctcaggggcttagtgtttataccgtggatcaccttagtttccatgtagaactcggagacaacggaccccgtacgactagatagtatcctaatcttctccgagtaggactatgttatttctacttttgcaaatactatttctttattttatacggttcctttccgtatatttgtggatataccgtatccgtatatctcatgattatgccttatccctaaccccgacacacctacacatgaaccaataaagaaaccatatccgagcacatgttctctccaacttgaatcaacattagcacacaacagtattatacacgtatagtatccatctagaagccataagcatgaattaatcacggatatccaaataaacaacttgaaaccgaaaccggcacaaagtcggtttggtcagaccgtcgggatggccggtctaaccgctcgctccactccggtctgaccaacggccatgcgcccggtctgaccgactccaaacaaccgaaacacatgttcatcatctgaaaacaattcataatatttgtcaggtctgaccggtacacaaaccctagtctgatcgaccctaaaaccacttcatctattatctacaaatatcaaaaccaattatcttacatggtacaaattaataatcaaccacactttaattttacagaattctcttagacagggcaatgataggttaccactgttatttattctcttagtgtaatttctgaggagaatggaatgatatttttatatttattgtagtcaaactattgggaggaaacatacaaaactgggaatattgagatatgatcttatttgtcgcctaattcatgcatgcaatgtacatgaaaagtcaaagtgcatgcaatgtacatgaaaagtcaaagtacgtgacatgaaatcaataattaacattttcaaaatagtttaaacgataaatacatatatcataaaaaggatatatacctaacatgtaaagttggattgtgttgagtatgaatcccatatgagattttttctttagctttggccatacacttctaagggtactatgggccttttttgacgcggtaagccggtaacgtagtgtatttgacgaaaagctaacgatgatggtaaaaatggaaggaaaacacttacgtaactgcgatggcattttgtacaaaacaagctcactgatgagaacttataggatcaatcttttgtcaatagcaaaacttcgagtttaggcaacataatggctcctttgaaacacacgattgaaaaagcagaaaaatagaaaatccctgttattttgacaggaatacatgtataaaatagatactaactccgtttcaggttataaaactttatagtattgcccacattcatatagatgttaatgaatctaagcacacatgtatgtctggattcattaacatatatatgaatgtatgcaatgttagaaagtcttataatataaaactgaggaagtaattgtaaagggaaaagtacgaattacccccttgaactattgaggtcgatcgaattacctccctgaactacaataccagacatttgacaccctaaacccttgaatatggataaattatccccctaacaaaaaccaaagtggttttcagcctacatggcatacacggggtgatacagtcagcaaaaacaaataaaaccagtgggacccgcttgtcagcgttggtttttctctctctccttctctcccttctctgcttctctattggtgagaggaagacagagccacagacatagcaccgacggtgagggccagtctgaggagggtgtcggagacaacaaggcagcggtgaggttggcttgaggcggtggagaggtgccctctgctagctcatggagggcatccaccgtatcctctggatctagcagagaggcagggagatgggaggtggtggagaggccgctgggcaaccgacgacgatagcagcacaacagtgaagcgggtacgggagcggaggaacttgaggagggttcaaccatggtcactggcactggctccgttgtcgcggtagagcttgccctagaagaggagatccatgctggcggccgcctcatcgagcgcaagctttgcaacttccctgcattgaaggccatggaggtcccggggacggagagaagcggctgcgggcgtcccctccgttgcctcgacgagccgcacgctgccggctgtgggtgcccctcctcccgccccgagctccgctgcccactcggccctaagttccgctcactgttgtcccctccaccgccccgagctccgctgccccatcaaggtgaggaggggagaagagaggattttggagagagatagagatgtgagggtaaaagagagggtgagagactaacatgtggggcccgctgatttaaaaagaaaagaattgatgattggactgccacgtaggccaaaaccgcttgtaaagctgctcgggaggaggggggagggtcatccggtatcgatagttgagggtgaaaaatggctggtttttaggtttggaggggggtaattcgtactgacacaatacttcagggggtaattcgtacttttccatatgtaatatatagaaaaaaatacataaatgattgtttgagtagaccgtaagtgaaacgtaagagtaggatgagagagatagagtcaaaataagattggagctcttactaaccactttccaaaacctttatagaattgtccatgacataggtatttcaaaggaaatgatatttgattcaaggaaaattttgctataggacactgatattgtgtggttttagccctacgacaccacacaaactaacatttaggggaaaacactccataatcattgtattttgctagtggataccgcgcctactaaaataataatttccggttgaagaggagagagaaatcatgtgaaatgtcaaatatgcccttgggcccacatggcagtgactcagcacgaggaggagcagaggcaatggaggtcggtgagcttgtcgccggtgccggtcgccgaccgccggcggtgaacggcggggtttcgcgaggtgtggccaaaagaggatttgtagagtggaggattgtgaagctaatggtgatggtatcgtgcacattggtgactggaatcagtgtcgacggcagcacgagcggcggtgagctttggcatgctagtgcatgttgagctctagctcgttttagtgcaaacccgtgcatgcatatgtgcctacatggtgcttggatactcacccgacatcatgcgcgggttggcgaagacaggacagtagtggcgacgggaggaatggctctggcattggcggaaatgacaggatgatgccgatagcgagaagtggcccacggtctaccaaggaagcatgcgcacaagattagttgagctactaggaagcttcacgcccaaggaatggggcggaatcggaatcggaaaggggaagcggtggccggaggtgaggaagacgatgttgatctcccacctcggtgcatgattcttggggattcttgggtggtcttcgagagaaggctgtggtggtcacgatggctcggtggctcggtctggtgtggttcacagtggccagaacggcgacgaaatcatggcggcagtgctcggtgcgtgctccagagccgacaatggcatggcgacattcccatcgctgcagtggatgaaatgagatggtatcgaaagaataattgtttggcatgatgaggagaatagggaacgcagaagagatggggatggagatggcttggcgatgaatgcggacatcatcttcttcgctgcctcttccgtcgctatcgtcgccgcgcgcacaaagtagccacgagagctcgccggcacggcagcgccccagtcagcacctgcagcgtgccctcagctcgaacaacaacggccgcggcgagcctgcaacatgacgctggcgtgcgccgcaatgcagcggagtagagtagggaggggatgaggtcccatgggcatttcggtcacaccgcgtaaaaaatcaggcccgctagcgcctcgtcagcacggaaattatattttagtcggtgcggtgtccactggcaaaataccatgattatggagtgtttttccccaaaagttagtttttgcggtgttttagagctaaaccacacaataacagtgtcctgtagtaaaatttcccttgattcaagtgtaggaatttttagtacaggattaaaatccttcaatttttttaacgttttttctataataaaaggggtctacaaatggagataataatgtgtacaattatatactcccaatctaaacaatattttcaaatactactttagtatatgagatgcagcttatctggactctgcagaaccgagcattgaaggatgggccaccacaagagttgtgtacttgtcacacaagtgccagttgcaggcagggtttaacttaccgccggtaaccgcacggttaccgcggttaccgggcttaccgcgggggtacggtaatataaataccgcggtaacctccttaaatacaaataaatttaaaaaataatttgaatttttgataaattttgcacggttttgtacggtttttcacggttaccgcggttaccgcgcggtaaccgtgcttactgccggggcgcggtaaccccggccccggcggtaaggtaaaccctggttgcaggtaggcgagtttaaggagtaaactatgccggagaagccacccgtactgttttcgtttttaattttacacagctccccttacctagatcgaatgggatttttcgtcctactccctccaaaaaaaaagaagaagaagctaacacattatctactaggttgacttttttttctttttatggagggagtgatcagacctaactaaattaaggatagcttattagagtgattaagtaaatagggatgtgctataagtgttattgaggaataaataatcaaatcatgtggttacatataggtacgctaagcgtgtacgtttagtggaagaaggggatggaaggagaatgaatctccactttaattaagtacttctatcatttacaagtacttctatcataaaatataacatacgattgaatgagtcaaaatataagaacatagaatcgatcggatggaacatttacaagaaatatgaatctgccacctatccaaattagtagtattaggaaatatctcattcgattctagttttttatattttgggatggaggtagtagtagagatgagagtagtttttttttggcaaaatttgctacaggacataaaaaaaatacgtaattagctggggacaccgtaagaacatgtttttgcaggagggcagcataaaaaactggtaattagttgctggacatccactgcgctattttattatttttgaaggaaatggagagagaaacatttgttttagacaggtttgcccatgggtccactagtcagtctcacatatctctttctctgttcctatcttctttctcatggtggttggccacccatcagcggaggaggaacaacggcggtggcggtagagtccatcaagcagcggcggcagccgtgtcaaccatggaaaaaacaacgccgacgagggtgcgagcagcagcaggagtggcggaatgagggtcggcgatgaagtgagcggcagcgctggtaacatcgactacagatctaggggcggtgcaagcagatccgacagtgacggcgaggtctcggagacgacagttcagaagcagctcgacatggcacaagaaaatccagcagcggtcgcaagcttgtcatgccggcgacgtcggtgagcgtagggatgtttcctcctcaccctgaatccatgttgctcctagcaagggtggcgtctgtcatctccttgtaaaatcaaagtgtttttgattgttattctgtgatgaacaattggcatcgaagattattggttttgatatttggaatttatttttgaagtggttttggagatgattggattttacgggtgatctacaagaactgttgtctgtgatttggtccaatcagaccgggctgtgtgtgccggttagaccggcgttgattgagcggtcagaccggccagcccgcggtctgactggccgactccatgtcagtttcgatttcgggttgtttgtttggatatccgtgattgtttcatgtttatggcttctagatggatactatacatatataatactgttgtttgttaacaatgagtcaagttggggatagcttggtcttggaatatggtttctttgtttaattcatgtctaggtgacttgatgcctcgggagagtattgccggtgatggatcgggagtcggcttggggataagacgatgtttgtgacggtcagatatcttgcgggatacttaggctagagttcaatgcacgtggttggtgaagattccatatggcatacaatggaggtattgtgtgcgtatgggatgaggactcgaatttgggaggagtccaaatttggtttgattggagtttgtaaagtttgtttcttgtacgggaaggtttcctatgtggattaggattggttcatggctttatgctgcctacctcatgtataaatagtgagggagcgtgaggcttcccggtatcgcttttgagagcattgagttgatagtttagttagggtttcgagtttagtcgagattttcataagaagtgctgttgttgcactttgtaaacacatagagaagtaataaagttgtcatctactctgagagttcttcgatttgtgtttgctacggttcggcggtctaaccggcgacacaccggcggtcagaccggcggcaaggcaatggtcagaccgacggcgtacctgcggtcagaccggcaacggtgacaggaggcagaggcaatcttcaggcggttggaccagcgatcaacttcggtcagaccgacggtatcaactcagtcagaccggcagatcaatctctgtcagaccgatctccgtcaaatttgagggtaactttttattccgcaaaaagtttgggtttttgggtataccaaccattcacccccctctggttggcttagttcttgtgtttcgatccaacaagtggtatcagagcattgttttcttctttggattttaactgatctagagttgttttgccatggctaataaatttacaactacgccccatgtcttcgatggaacggatttttcttcttggtgtagtaagatgcaatcttacattatggctgaggatcttgatatttggagaaaagtttctaatccttatgtgattcctgatcaaattaataatgctgctttaaaaattgaatttgaaaataattgcaaagctcgcaatattcttttgagtgggatttctcgttcggattatgatcgtgtttctcatcttcaaaccgctaatgagatttggattgttttgagtaattttcatcaaggaattaccaatattaaagaacttcatcgggatcttttaaaaaaggagtatataaaatttgagatgaaacctggagaagctttggatgactatctttctaggtttaacaaaattttgagttatcttagatctattgattgttcttatgatgttaattacacacaatctgaggtttctcgtcactttttgaatggtcttgacatgtctatttgggagatgaaacttacatcaattcaggagtatgttgtcacgcccgaaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataaaataaacggcgcagacggctccactccacagacagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcataatagggttttatttgcaaaagcagcatttagcaaacatttctgaatttaataaaacagttaagtattaattaaacaatattaaatcaacgctatacaacataccctgttgtataggcccaaccattctgaacaaccatcccggctgcacagttctatctccaaaccaggaatgtaccattccaaaccaggagctaatcagattattaccagttatagcatcatttactatggtgagaagggtgagactaatcacgaaagacattgttagacccgcccataaccgcgggcacagctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcacctttcctggatcataatcacccccttataaacaaggcatggactccccagcgacccccgtgggcttatctccgccgcttctcagtctggtgccccgcaatgaaccatgctatacaaaaggtaaagccgttgcccatgctggcttgtggttggcacggttaatgtttcacaaccgaaactcgtgaaccggtccttaattgtcatgagcacgactctcaaaaccatgtgctcacaacccaccattatcaggttttagttggcacattaattaattaaccaatcacgattgaccatcgtgagctatcattaagccatcattaaataatagtgagtcataagttatcccaatagtgtgctaatgtttctaagcatggctaagcaattatatctaatatctagctgaaccaatatataaagctcaactagtcaagttataataacccaaggtatcaaggaataaagtaatcaatgcaaacaaactcattgtttataatcatgaatgtatttatttattacatgattgctgcaaactcccgattacacaatgataagtagcgaactgaaaaccacaaacatggctactcattctgattctggagaggtatagctggcattgttctagtgactgcatccttgattggttctgtgatgatgtgataggactgcatattgctatcattcacaggagaagcttccttctgattgctattcgaagcagagaacggtcttctgcttggtatcgccctcctgagattgattgccctttgctcggcctggagtaggtcggggagagacacaacttcttccatcgatgacaattctttgctgaggctgtcggtgcagagaatggttggtgctgaaggtattattgctatgatttattgcagagtcaggtgcagcaggaggagcattggtgctgtggatgatatcgtcgatgttgctgttggagctaactagctgatgagacaatcgtagggttgttcgttggatttctgcggtcttggtcaacaacacactgagttggcaatccttgggcacatggtttgtaccttcgcacagaaaacatgtgaccttgcgggtgggacattcacctggtggatggtcttccccacaatgagggcagagtgtgagacacatgctagcaatgtgtccaatttctccacaacggttgcatgcttttgattccatctcttcctcaccgagatgtcggggagactcatcttcataatccgaggagacttgatctgacccttcactatcatatactctgccaccatggcttaggaggtgctgggtcaactgtcgtgcacctcggaaggtatttcctctttgacgtctaggaatagttatccctgctggaggccattcggtgctggtaatagtcatcttacgtacttcttcttcagttcgcatcggcgcttttctcttctgattcttactcttcttgcctttggcttgcttagtgtgtgaccccacgtggtacgaaaggctagaaagaaagcatttcccgggattcaatggattctcttcattgggctctctgctttgcacactaggctgcaagcttgacttggtgcgaggaggctggcttagcgatgtctgccctgctaaaccaaaggaaggggcttctttagcatatacccatggacaattcagggcatagtgtccttgttctctacaatcatgacaaaaggggacatgctcttctggcatgggaagctcattggcctgggtggcaaatgctcgatcaaacacatacttattttggtcttgacttccaaccaatggtagctgtgaactaagccgcatacttggaatggaccaagggtgtgccctggttaactctcttgaggccagtggtggattgagttgaaaactggagttacttgaggcatacccgctgacattctttcctttttctctgttaaacatctgttacagggattgaggtgagagagaaaacaagccaggaaagaatagaccagaactagagacaggaccttaaaggaactaactcttcttgctgatgtgttgtttgtttcacttattctgcaagttgattaagcaaacaacctagcatggtcacatcacagcccaccgatgcaaaccacacactacacacacaagcaaggaaacacacgacaaacgaaacactagagggtggcttaggttctgcgacgagttcccaagatcttcactccttcacagctggcttcactgcttcctccacttcgctagcggaccctgcggtcttccggaccttcggcgaacaattggcgacatcttcttcttcgcaaaactaaccaactagtactagttgaaatctgaagaaggaagaagggagtaaaccttttgcaaatagcacaggggaaaggaggaaaaagggactttcggaaatagttttatgtataaaatatgtccttaggttttatccacttggcttatcctacagtcgagatggctctgataccagcttgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacatcttctccaaagcttctcttactgaaggggggagaaagattgagcaagaatgagtacaaccacagtactcagcgagccacaccggcggatgcacgattaatgcaagggggtacaaggggtaataatatataggggttaagttttgcagaaaacggcatttaaaaatcacttagttgcccaaagccattttaaaaagacgatcctagagctacacagtattattaatcaaggtcgtgaacccgcacgaacctgccttaacccaaggcctacgatgattcagaccgaactggcaacccgaccctgggtcccagctcgtcccaagccaacccaggccaaccattccacattttagctgttaagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggtaggcaggattgagcccctagcagcaggacaccagccctgtaccatgacatctcgactaccgggccacagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacaaaagccaaccattccaaagtatccaagtgatatgaatattcccaaagtctaaagttataaaaccacctaatgttgcctaattaatcagcgaagcatctacctaaattcatactagtggaaccatgaatagagtacccactagttggggttttgtttaatctagggtgaacaaggtaataatatcaatagcaataatattaaggtcataacaaaggtaaataggcatggccaaataaaacagtgataacgcgggattttaaataaagcgataatgcaataatttaaatcaaaataattttataaactgggattcaatatgttcaaggatgatgtgacttgccttgctccgggagaacggccttccgaaccttcggcgacgaccacgaaccacgcttcgggaacctccggaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttgcggattattgtaattaggttttgcaactataaaacatgtggaagcgctagcctggaaaagacaggaaggctgcgttgttgacatgcggaccccacatgtcaacctaaaggaccacggtagaccgagtacacagagacggtccacgggtcgacggaagcggaccccatgtgtcaaccgaggcgagtggccaacaaacggactccactagacaccacacgggctgcacatgtggaaaccatgctgctactgagcggacacactaacacggacaccacacggtcaccacccgcacacgtgaacgactaccgacaccggtacacgggtaccggggtcgacaaccgcacaacgggtacggggcgacaccgaaaggacgagggcggggcagcaagaggagagaccttaccaccacgcgacgaggcgtgagaacgacaacgacgaacgggcgcggcggagacggacggcgagggaacgacttcggcggcgatccttgaacgaaggcgagacacggccggcacgaggcttgacgacgcggaggcgaggacgaagacgacgacggctacagcgaccttgacgaaacaccgaggacggacgagaacggcttgacagagggacgaacgccacgacgaccgggaacgacgggaggacgacgacgacgacgaccgggaccggcgaggagacgacgagggcagccggcagcggctgcacggaggcgaggacggcgtggaacacgccgcagcgatgcccacgacggaggcggcgccgcgagacgacgaaccgggcgaggatgaacggtgaagacgacgacggataccggcggtgttcggccgaaggggaagcgatgccgaggacgacgtcgcggctgcgatgccgaagatggtggaggtgtggccgaccggtgcacgggcgaggagggacgggcggccgaacaactccggcgaggcggatggagaggttcgcggcgatgtgcggcggcttccgggcgaaaccgaggggtggacgaggtggagggctacgtcaccgtgccgagggagggacggcagcgccggctgatgcacgggcgcggcggaagggggctgccggaggagacgtcgacgaggaggaaggagaggccggcgcgggcgacggcgttccggcgaaattcgggcgacgccgtggcctggccgggaaagaggacggcactccggtgccgggagaggtggtggcgacgtcggccggcgcacaggggacgcggcagaggcgggcggaggcggaatcgtggcggcaacaccacggttgccggcggggaggcacttccggaggtctccgcggaaaacagagggtaggccggcgaagaggaggcggctgcgatgctggaggaggcgacggcgcgaccggacggcgctccggcgaggagggagaggcggctggaggcggccggaggcacgggagagagaggaggactgcggggagaggtgatacgaccacggggagactcgggatgaggttaaaacgatagaacggaggatggggattccattttatgggatgggggagggagccggccacgggaggagcgggaacggcggcgggaaacacggccggcggcaatggaaggcggccgggaatggcgcggccgttcccggcgattgggggcgccattcaaggggaaattaagggggaaagagagatgagggaaaggggattaattccccccaattaattttggaatccaacgcttaaatcgcgcggattcgagggaggaacgaagctagggttcacgggagagagagagagaggagaccgggcgggaggaaggagacgaccggcctggcgcgtgggccccacgcggtcgggcgctcggtcagcgcacgcgcggcgtgcgtgcgcgggaggggagcggctcaggcaggggcacggcgtgggccgggcggccggcccaggaggagaggaggggaggggtggcccggggagagagggaggaggagggagtgggccggggaaggagggagggaaggagagggagagaaaaagagggaggagagagggacttcgggctgggcttggcccaaaggaggaagaggatttatttttaggtttttctttttaataaactttgataattgtttttgttgcttaataattatttccggtgttctgaaaattcaagtaaaatttgagggctcattttagaccaaggagaatttaacaaaaattctccgggccacatttgaatttttcttgtacgtattttagtgtttgccaatttcttttcgaattttaattaattctattattccttttggaaaatgatttttatttcgggatgaatttatcaggacgtgacattggggaatcaatatcctgaatgagaaaagaagggaaaagaaaactcttcagggaaaattggaggagctagataggaaagctttagaagatgacttatcccctgaagaatggaattagagatatgaggtggaaagggatctagaacacacttataagatggaagagttgtactagcataaaagatgtggagaacaatggatcttggagggggataggaacactgagttttttcatagggttgctaatggcaggaaaagaaagtgctcaataatctctttgatggatggagatacagagctgactagtaaagaagatataaaaaaaatcatattgtctcttattacaaaacccttttttagagctgatgttttaactatacccacttggctcgagatatctggagtggcggtctgaacctttctgctgacaacaaagagagtttgattagacccttcaagattgaggagttagataaggcgcttcaggaggcaaaattgaacactgctcctagtccagatggttttagcatccttttttgcagagcttttggcctcaagtgagaaatgatttgtttgagatgttgcttatgtttcataatgaggagttagatctcaagagactgaactttggggtgatttctttgattcccaaaaacaattagcccacagacattagacaatacaggcccatctgtgtgctgaatgattgcttcaaatttctcagtaaagtggtgaataacagactctcagaggtagctaatgatgtgatttctcctacccaaacaaccttcattcctaggagattcattcttgagggctgtgtgacaatccatgaggtgttacatgaaatgaggactaaaaatagagaagggattattttaaaaattgattttgaaaaagcatatgatagggtcaaatgggagttcttgatagaggttatggaaagaaaaggtttccctcccaaatggattaattggattaagtcttgtgtgataggggccgggggagggtctgcattaacattaatggggataggactgagttttttagaacctttagaggccttaggcaaggggatcccctttctcctctccttttcaatctggtcaatgatgctttagctgcaatgttggataatgctaagagaaatggagttattagtggcttggttcttgagattgttcaaggggattacccatttacaatatggtgatgatactgctcttttcattgctaatgatgtctctcagattactgccacaaagtttatcctttattgctttgaagagatggctggtctaaaaattaattaccacaagagtgaggttttcactatagggttagaggaatctgatactattggagcttctcaaatgcttaattgtcctataggtcactttcctatgaaatacttgggcttgccaattagccctgagaaggttttaaatcctgattttgatttcttaggtcagaaactagagaagagattgggaaattggggacctggtagtctttctcatgctgggagagctgtgcagattaatgcttgtatgtcctctattccttcttatgctatggggttctatcttcttcctgaaggggtgcatcagaggtttgacaagataagagggaggtattactgggctggtaacaaattgaaaggtaaatatcacatggtcaaatgggaagacatggcttttcctaaggactttggggggcttggttttactgaaacaaggaggatgaatgcagctctgctggccaagtggattattaagttggaatccaatgatcagagtttatgccttcaggtgctgaggggaaagtatatgtaggaaggtggtatgtttcagtgtaaatctgggaatggttctcaattttgaaagggtttgttgaatattagaaagtgagtgcagcttggtgctgaatgggttttgggatgtgggaatcatatctatttctaggaggatttctggttacacaattgtcccttgtgagttatgtatccaaatattttcaaaatttgtaatcaacagaaggtgctggttgcacaggtcattcagagaggtgtggagtgtctcactttaggaggtcctttggccctatagaaagtgtagaatgggacaacctgaaaaatgacatagagaatgtgaatttgagtaatgagcctgacaagccgatttggggtttagcctctaacagaagattctctaccagatcactatatagagctttaacttttagaggtattagagaggtgaactcagagttgtgggctgccccctgcccaatgaaaatcaagcacttcctctggcttgctctaaaagatagaattcaatctgcagagaacctgaaaaagaggggttaggagggttttgaattctgtcaactttgtgggcaaattgagactactagtcatattctttttaactgtggcatggctaggatggtttggtgcatttgtagagatgctttgggatggggttccatccctcgaaattttgatgagttctttctattatgccaatgtgactgtaacccatcttctatgcatctgtttatgagtttgcttgcggctgtttcctggaatctttggctaactagaaacaatatggttttcagagataagatcttgtactccccactaactgtcacagcctgatttttcgttttaggatttataaattatttaataaattattaatagaatttatattaaatgttctttaatttacaagtgaagttaaatgtgggaaataaaattttctaaatataaagcatggatggatttaatttttaaattctccatgattaattatactctctgaaattttctcagatttttcggagctcaattcctaaatgatacaaaggacagttcagtaattagttaatcaataatcattaatgatttaattataattatgttaagtgcttttcttgtttaaaaatccttaaattacaaattgttgtttaattggaattagtagaaatgatcttaaaagcttaaaagaaaagatctaattttaatttgttaaattctaagataaaagtgggctagataaaatttcattaaatactttacttgattctatagttcctaaatttttctgggatttatttgagccaaggaagtatttttaataaatggaattgcatttcatgaataatttaaattgaaaaaggttttaaaatctccctttttgttttgggccgaaagtcggcccaaaagccctctctctctccccggcccaagttagcccaccagccgagccgccgctcgcgcgcgcgctctcgctcgctgacaggtggggcccacctgtcaggaccttcttcctcctcgcgccgtcgcccggccgagctctagccgagccgcgccgccgtctccttccaaatttggtcgcacctttcctgctccggccaaatcatttgaggggaaataatccccttgatctcctctatcttttcctctatagaaacttcggataaaatcgtttggaaaccgatggatttgagctcgattcggattcgtctctctcctctaaccctaacctttccatcgccgtcgccggtcgctatgggcctccgtcgccgcctcctagcccctataaaagcatccccgggacctcctccgtccgccgccaccctcgccttagcccgccgccgtctgtagcgccgcctccgcgtgagatcttgcgccgccgtcgccgccgtttgtccagccgtgcgtcgccgtcgctccggtcgtcgtcgtcgctcgggaaggccgccgtcgtgatcgccaagtcgtcgccgtcctcgtccacccctccgtttccaccgaggatcgccggagcatcgccgtcgtcgtcaagccgatcgtcgccgccgcttcatcctcgtcgccgtcgtcgtccggttgtcgtccgccgccgttcgtttctcggtaaggttcgccgcgtcgcccactacccgttggtgtcctccgtttgcgccgctgcgccgtcgttcgccggcgagcatgcaaggctgagccgccgccggtgatgacgtcaccgctgacgtcatcgacgccgtccgccgtagaccacggtagaccgagttgatctcggccgtccgttttggataggatagatctcggccgcccgttccgtagaccatcgccgtgcactcggtccaccgtgagccgagcccactgacgcaataattcccttttccgtttcaaaaataattctttattgcgtcataattcaattaaaatccatataaatgttttaatccggtttaatctttaaaaattcataactaattcatattagctcggttttagttggttcaagtctctaaagttgtataaaataaagatctacatattaaaattatccataaattgaattaaatttatttaatcctttttaaataggctttaattagattaaatcttgtaaaattcgtaattatttcatatgaagtcagaatgagcccgttcaagtctcataattcatctaaaatcatgatctacacatttgtttactttatatgtattggttatttggagtttcttagtctttttccttggtttgcgttttagcttgtcgtttccgtcgtttcgaaggttcgcgagtgcgccggaagtattcaagaagattaattgaagacccgttattgcaaggcaagtcacacagatcccaaacacagttcctttgagcatgctgatcctatatttaaattctctatttatttcaactgtgcatttattttttaatgtcatcgggctctgtagacccccgtttttataacaggaatcaatcgtgtaaacagtaccatttccctggatcaagtagtctggtacacacgagttcatagccgagataccaaatgcacatacacgagagtctagtgcgaattattacaacataagtctgcaggcgtagtcttaaatcatcagaccgatgtcacatcctgattttttcgttttaggatttataaattatttaataaattattaatagaatttatattaaatgttctttaatttacaagaaaagttaaatgtgggaaataaaatttcctaaatataaagcatggatggatttaatttttattaaattctccatgattaagtcaactctctgaaattttctcggatttttcggagctcaattcctaaatgatacaaagaacagttcagtaattatttgatcattaatgatctaattatttttgttaagagcttttcttgtttaaaaatgcttaaattataaattgttgtttaaaaggaattgttagaaatgattttaaaagcctaaaagagaagatctaattttaatttgttaaatctcaatataaaattgggctagataa

SEQ ID NO: 68638 - DNA, 4985 bp, Oryza sativa
accccacccgccggccggttcggccaaaggagaaaaatgtgtgtgagagagagaggaggaagggagagagagagagaggggtgatgatgtgtcatcctggcatgtggggcacacgctgagttagccgtcacgtcggataaaaccggggtcaaaaccacctaagaacctcaagtgaacggttttgtaagttgaaggatgtcatatatctagttttgtggttaggggacgattttgtaactcgatgacaagttgagggaccttgagtgtactttttcctgtggaaaatatcctcggggagaagacgcgcggcactgaagggacattgcggcggctgcgcgactagttggcgacggaccgacggacgagacaaggaggcgaccgcgacgctgcgctttcccctccggtggctttccccaatgtctgcacagcgaggaggaccgtgttcttggcggcgatgctgaccgcagtctgacacgatcttgtcaactaaaattcgcgatgctactgaatagctgaccatgatgttgtgcgccatctgattgatttgcttagctagccttttttgtttgatcgacagaaactcctgtactagtgccatctgctgctggaatgacattgtatcctgtctgcctagctatcactttaattattcaagatcttgaatatgttaagtgactttaagaaaaagtagggccatccagttcattaaaatgaaattaagttctctgaaccacactgaatgttgcccccaccatgaggtaactgacttactcaaactgatgttgctgaggtagtttctttctcgtgtttagttcagatggtgcttggtctgctctttttagttcacatatatgcatgcatcatcaagtgtctttttttgaggaaaatgtttacaacttggaaacttctgtactcaccaagtttagttcagatggcgcttgctctgctctttttagtttacatatactgctctagttactgaagcagattctacttcatgtcatgtccaacatgtttaagtatgccaaaagttgacgatgatcctagttcatgtcttgtgcataactttgagttgtccacaagttctttttcttctctagataccctaaacacttgtatgtatcctacactgatgcaaatcctagtttttacatgccatgcacaaagattgttccctgcttaaggataagtataattcctcagccatagttaccactgtttacttttcatttgaatttaattactgaagtgtgttcttcataaatgttgaccatggcaatttaattactgaaggtcctgatccctatggtttattaatatcattggagcatacagttctggtgttagctcttttgaccatacttatctatagtaaattagtaagtagtacagtatacatgttgctttccctttttaccttttgcctgtagctgctagataacatagcagtctccatttctctgtactacaatacaaagtcaaaaaacatgtagccgtgcattgacaattattattttattgtatatctatataagtagtatatatgatctctgcatcttctgaaaatgcagacaagtcaagataaacaactccaagattaacatgatttctgcattggccatatatctatctatctgttatacatgatttctgcatcttgtgaaaattcaaacatctcaagattaacatctataattagtttggattaacatctgaatggacttcaagatgttatatattgtccattgtattatgtctgctactttctccgtttcacaatgtaaaactttctagcattgcccatattcatttagatgttaatgaatctagacatatgtatgtgtttagattcattaacatctatatgtatattggcaatgctagaaagtcttacattgtgaaacggagagagtagaagggaaaaaagtggaattggtgggtagtaggttaaaaatatggaggttttgtgcaaattcattaaccaaagttttgtttctttttatctgtttgtgagataggaaagctgatgtttactcttgtgctttgtaggttccttgaaatcgactggtatggaaattccagataatttatttgatggtagcaatttcctgaagttcccgaagatttattacttcagacagcatggtgaaagtcagggcatcattatagcgtctcctgctgctcagctcatgccactcatattagacctttttagtttgtgatgtatctgagttccaatgctcgtttgtttggatttttagtagcacctggacacccagtttgtgttgatgattttattgacaatgacttgtatgtattccgttgttgctcagcagcaaatttctatggattaggagaagcaaactactactatatggcttttatcctgctctttcttttcttttttgttttgctggaatgaccgaaggaggtcattcaatataattaagataggaagaaaaggttacaagaaaagttttacattgacagctggctgtcgaggaaggatgtgcaccagagcacacgccccgaaccatgtgtcaaccgtccaaacacacgctatagaaagggaagccaagcaccgaaccggccatcgctatgcgagaccgatcgccaccaagccaacaacaccactacgacacgaagactctaaaacgacgccctcacgagggttgcgacgccgaaagacgctgtcatcatccgtccaaagctggacaaggttttcacccatagttccttgccaagggaggaggggtacctcaacaataccctcaggagggttaccacgcctgaaggcgtagtcactgttggcccaaagaaattgggctaagctttcgcttggaaccccttaccgccatggtccgtcgcccaatccgaaaccaccatctaaacatcggcggcacatggcttccgccatacccgaccgacgccccaccgtcggtcagtttccagtcctgccaacgacaagactgccaccacaccgcaccgacgccccaccgtcggccgacttcatcgaaccaccatccctgaaagttggcctaggaccccctccgttccaccacccgccggcctccttgccaaatctggccggaggaaaacccgggactaggtggcattgcttcgacatcctgagcttcccccgctgacaacctgccgcctcaatccaacctagaaactccccgcaaagaagggaggagctccaagaagggcgatggtgacaaccggcaatgaggaaggcgacccaccgccgccagctccctttgcactaccatctgggcctgcgccgacgctggaaacgctgccgctcctgctccggcgcacccccccccccacgatccagcctccacgccggcctatgcgcctctgctgctccggcctacgcgtcgccgcgccaccatcccgaggagcgcgggcctccgcgctgacagtcgcgcctccagccgcacgtccacgccggcccctcctacaccgacctcgggccgccggccgtgcccccgctcctcgccgcccgcggcgctgtcccgcgccggccgcctgatctagcggcgccagacccggctgcccgagctcgccggcctcctccttccccgcctccgcctcctcccgagcgcaggcttcgacgtcggcgttgctccggccagcctccaccgtggatgcccgcgcctgctctggtggtggtcgccgcagccatcctcgtgagcctccagctttgctggctactcgttcaagcggcggcgaggcaggggtgagaggtggggtggggcgacggcggcggctagggttccgccgcccatgtcgcccatgcgggaggcgacgcgggggccaaccaacctaagttcacgtctattctgctctttcaatttatcagattttgatagctaaaacgaacatagggtttaagacagggaataagagagagcaagggattccaacccccatagggattgagtgacatgggagggattcactcaatcccttcctggatatattccacttggggattaaatcccaaggaaccgaacaatgcctaagtggcatcaaaactcctggattttccctcgaattaattgtctaaagactttcttaactaatctgaacatcttgtatgcataagttttctttcttttttttttgctggacttgttataaaaccctcgatctatctgcttggtaactctaaatattttatttctgccgtttaaccccctctttcaattcttttataggtttattcagcatggatctttattattccaatattcacaaaagaatataaattgaagcatatgatggtgacagatgaaagaaacaactgatgaacaggggaccgaattcactggcaacaggagcagagccgaggtcgcttgccttcaccaccaacacggccgtcatcgctctcctcctccctgcgccgaccaggccgggagagcgacattgccggagctcgaggaggtagctttgctgggatccaagcaaaacgcggtggatgcacgaggtgtagcacaagcagaggaggaggaagacgtacgatggcgatgacaattacgcgtgcatgaacttgcaagtgatcaagtgatctaaacgcgtgcttgtgaattcgatttataatacagtataggagtgatataacgcggtgaggaatactcgctcgtttttcctcctcgctgcttcctcgctgctggctgtcgttcatggggtctggttaggtttgccgagtcaagagtcatctcttttacccttctctgctgtgcaacttcttgtgccaaagatgattagtgcctggtggtcaattcaaacaaacagttgctgttttggttcaagatgatggatgtggttaggctggtgttttatggatgagcaattttcaaggagtgaaattgattcagaatagcctggatttttcacattttgattcttttagaaaacttattttacaaatagacccctaaaaaaacttagtccttttcgcggcgccaatttctttg

SEQ ID NO: 68639 - DNA, 6170 bp, Oryza sativa
ggcgccaatgacattggtgccgcgaaaaagatcatttctagaataagtttttttagaggcctatttgtaggataagtttttcaaaaagactaaaatgtgaaaaatccagtcagaatagcttccaggcactgtacaagtctaaaaactgtctctgcttgaagaaactctgaaaattaacacggggaatgattccaacttaggcaccttcctcgtttctgaaactggacatatgtagatttccagaagagagagaagagcataccaggaatgcacggcattatataaaaaacgtcatcattgccatggaaataacaggaacaaacaagaacaacaaacagggttgttggtcacagatcagaggtcagagccacaccaacaggttgctttccaatgaaatagtgcatagaattgtactaaatttagacgccttggtttttctcaaagcaaaaatataactatggtatgcataaaatgtactgaaagctatggtctgtaaatatactaataacatccaaatatgcactaaagttgaactgaatacaagcaatccgatgggagtaccttctgaataaacggcggcataaaggcatgcatcacccgtttcatcagtgaagtatatatatatatatatatatttttaagaagagtgaagtatattattcttcatccgtgaaatatttacttgtattgctgatattgtctgaaaacaagacaggcggcagtggggtaaaccataagcagtcgctgctactggcttctccaaagacttgttcaccgtagctgctactgcgtgcttctctgtgtcttctactgccagctcccctggcaggtgaaaatgaatgtctcctgtgtctcctactgcctgcggcccgtgaaggaggaagtcccctgtggctccaactgcctgcttcattgacagccccattgtagttcatgctacctgcttcactgacaggtgaatgaccccagttttgctccgctgcagtgacaggcgaatgaccccagttttgctcagctgcactgcaggaacctcctgagccaggagttcccgtgaaatcatgctccccccgccccacatattcactcagcaaattttctctcctctgtgcatttaccatagattccaactgcacatctgcgtggccatgaatccagtccaacgacgaattccaatcagatggattagcatgtgataatccattccctaatggaaaaatatgacagcatgcaaacatcagactattattccaaaacattaactaacaaaaagtgccacagaaataaagttgctaccatcaatttcagccgtattgatgtgccccaaagaatgttgttgctgtgagctcgacacttctaacatattgttatccatggatgaaaccgacataacctcatttcctaccgatgaaacttgccggtcgacaacttggatacgctcaagttgtcctgcagaaaattcagagcaaatctacctttaaaactgatgacatacaaaatatacacaccacagagaaaaaggccaattaccatgatgcatcaagttttggtctgaagtgtctggttggaacttggacctatttggcacaatcactgataatccaccggatgatagtccattacacgttgaagaaatttgctggcgagttccttgaacatcaagttgttctgtgagtttttgaagaatcaataaacctccattgggatatccacagaaacaaggaactacctccagcagcagaccatgaatggcgaatggaagcaatcaaattactcaagagaggccagtccaaacctaccttgtgatgtatgacttggttgcattgagcatgatccctgaaggtaatagctgccattgcttctaaaaaatgcctcatgttcatgagacacattactctcttgaaggcaactagagtaaattcctggtcttggattacatttcagagcatgactaatgatcaaatcccaatcttgatcagaaatctttcccaaaatctacatagggtgacattaaaaagaaaagaaaaggaggattaaaaagagaacaaaaggaggaactgttggtgatattgtatatgagaacaaattagatagcaaaataacagtgttaataattcattctcatactttacgcagatcatctggactcttgttgtagaaagataagaagtcctccactgtcttgataccattctgctctagtaacttgtgcctgtcaccgttctttgcaattttgctcagtttatatacagcatcacgtggggatggattgggattcttctttgttactgcagagaaagacattcaatgtagttatcctgcctcttatcctttgaaaaatattgatgtgtgaaaatgttttttctgtaaaataaatggatggtggccaagttttaaaggttcttaagtatctaaaaacaggttttacatattgataaaatatgaaatattcacatgggttaccaactagttatcgtgatccctaaattgttcttactactcattctgtttgcaccttccaggttaatggatgttcatgtacatgatagagatatcagcacagaggagcaaaataataagtattaaaaatataatagaatagcgtgaactcacagtatccccgaacatccttcacagcaaaagattcagttattccttcttgaattctttctgagattctttcatcagctgccataacacccaacttgaactttttgcttggaacaaaactagaattgtcttggaacttggcattgagataacccacaccattttgcagcctaaaatacagcttcccagacagcaaatgtcctttttgaggtcgtccaggtactattttactacggaagtactcttcagtccactgtcctttatgatcatcatcaaagtcaccatcgatggctacaatcgatctgaactctcattgaagaaaatggttcacttgttacgatcttgttgttacgatcatatatggctacctgaagggggctctcgtcatctgcttctattttgtgtgttgagtacttatcgttactgcatgaattcacaaattgtaatcgaagtggttcgctgcagttctgatcaggtaacatcctaaaaaatagtgcaagtacatcataaacatacagtgttgaactttaatatatggcagttacttatgtgtactcaaagaaacaaagaaaaataacacagagcaatacaggtatcccatatatgcacgtgactatatgagaatgagatatgatggactagatgttctcttttccctcaactcttaacttgctactttcttgagaaaaaaggtgcccggtttaattttagctagcactttttcgagaacatgtgagagccttggatgtcatttcactgagagccttgctagtagaacacgatgggtaaagttaggccaccaagcaagctgaaccctttgataagttaaccctccccaataggcaaacaagccaattaagactttaaagaaaggacttcataaataaattaagatcatcatggttgctcaatcccacaataatgacagcatgtgtgacaacatcccgatttgtggctagtacattccaaacctccctaactccacctctttgcaacagaaatccaaacgattaaccttcagaagatgacttcactatttatataatcttattttgtttcaacatcggataaaatatctagtcaattgacaactgacatagcaaaaacaaaataaagaaagctggaaagataatgcaatgttttttagtcctttacagcaaagtaaataaaattgcatattcttgcaacagagataaacattatgtttctataaaaagagatagacactatgtcagtttataggtgcaaattcaacatatgtgaaactacaaaatgaaaaactgaacgaaatgtgcttcttcatctgttaactaacatcataacattagttaaaatagcacaaaacttttcttaattcatgtacaattcaaaaacttaaagcaggtatgttgtaactccatgtacaaccgaaaaacttgaagcaaaggaaaatgtattaatgccaatattaccaagtaccaacctaggcgcagggattcgcttatggtaaccaacaacttcacttattgcctgccaatagagtttaaagagcatcactttctagacgtaaaatgcaaaattaatttgcaacaatattggtataaattctgataaacctcaaatttgatatacatcagttaacatatgacatatcttaagtacaaggtagttcattaatctattggctcctatccttttgagatcaaacaatatgtaaattttgctacttaagaactgagcacacataatactatccaaaaactacttttcaagatctcatatattgtatctaacagaaacaatattgtaaaggaagaagttcattttatcatccttaactttcatggaagtcttaaaatcaactttatatttcaaaactggacatttcaaccattctaagttcagcttaaggttgaaaagtgaatgattttgaaagttcaagataattttcttttataaaggaagttcaagattttaaagttggggtttgatgtggaagttcaagtccataaatgaacttcttcatatcggaaagctctggaatcatatcatcccaaccatgaagtctgaagcatacatttttgctctatgggatggaagcacaaattaagctcttaccgctgttaggctggaaactttttctcgcagctcctgattctccctaagcactaatttgatcctctcattttgctgctgcatcattcgattcatccgtagaatctcctggagcatttcagtctgcttgtcactgccatgcaagcgaaagaaaataagctcaatttcttacctctctaggctagcttaatagcccacaggtagtcatcatctgttttttttttcatttcacagcatattgtgcccattttattgggaagtgtttttgcaatactttcttctatgcaaactaaggctgtgtttgaatctgtgggttcgtaacccatttctcccgcagggaaaacaaggtagctcattaactcatgattaattatgtattagcgaaaaaacttgagaaatggattaatatgatttttaaatcaactttcctatagaacatttttgcaaagaacgtactccctctgtcccaaaatataacaacttttagctcttaagatttgccacagaatataacttctccatcaacattctcttcacaaccaatcacagccctccaccattcatttttcccacctacctccactactcatccaatcacaacccttcaccattcacttctacctactttcttaataaccgtgtccaactctaaaacttcttatattataggatggagggagtaccatttagcagttcgggaagcgtgcgcatagaaaacgagagagtagaagttgggaaagaggatgttcgaccgcagcctaaaggtggatctactgcaatatgtaccattttcccttaaattattatatttacataaatcacatatagattataaataaccgattttcttagtagagaagggtttatttatagagggagggaataagatagtgagaaaatatggattgagacacacttgaacacaaggttggcatgagcacctggcaactccctgccgctaggctacgatgctgttctcaggagagggatttactgacttacttctttttcactagacaggcatggtcaattttattaagaatagagaggcgtgaccaacaaacatggttattgtctagaaaacaacttggaactcaccagagttccgaacacaaggggggccttttaaaaaagtggtttttgcatattgaaccaccaacacaagttgctgagtttggatgaagataaactggagaaactaaatcctggtccgctttccctttaccaagcagattaatctgaggaggaggaggggggggggggtggggaatttacatcaacgaacatcatatggcacataaaggagagtgtgttgtgattagatcaaacaaaatactgcaaaagtgaaacataaatgaagcaagattgtagaagtgagctcactcgaaatcacaggagttccgcagtcgcttcgcaggcggtgatctttgtgatccttcgtcgtcattctcctcatgatcctgaggcag

SEQ ID NO: 68640 - DNA, 4059 bp, Oryza sativa
tcgtgtaatcttcctttgatgcacggatttcctagatttttgcaattcacaccattgacagctttcttttcagaaggagagagagagagagagagagaatgatccacgtgaatgttccatgaaacttcagccgttgcacagcagtacctcactactgagtcaatgtggagcagggaagcattaggtgcgtttgattccctgtatttcaacctggcctaaatggaccgtttattggaggagatcaacctccaagccgcctaccgcgtccgcgtggagattggagagaagatcgacacggttttggctttggaaaattgaagcggaaccgtctctagatgcttcttttttttttttttgacaactgatacttttcagatgaagctttcgtttcaatttcccgagaaaacacctaagtatatatcccaatggaatttagcatgaagccccatattcgtaatatttttctattgattttagtgggttcaaacaaaatgggcaaataaaaaacgaaactgttggggatgtgcgagacttaccacatatgtgccgactgttgattgacaactgtagattcgatggagaccgcatctgcatctctacgaacacgatctctcccggtgcggcatttcgccgaacacctctgcgtcgctccctgtcatgggcctgggcctgtcaagtgagctatgttgattgggctggcttgaggctgaggggaggcaaaggatacactataaaaggaaagaagcaacaggcatgaaggggatcgatgaatagaacttgtggctgctgcctcttcttcctcctcctcctccggatttctttcccactcctgctgttcttccaatctcaaactctgcttctctaataccagtcccttgcttccctttctagtcttcactcctatattccttgcaattgtatcccaattacttgagtgatttctactgtggatcgttggttccttcctgtgttgatattgatctgtgaatgagttgacggatcgtgacaatatggtatcaaagcagtcgattcgtggggtttcttgtgtggagatgaagtgggagagcgctggtggtcagaggaacagccaacaacttggtggtggtgtctttggaggagatgcccaccacctgttcgatgaaatgtcgagctgtccaagagctgactcagctgctgtccttcgcgtcactgtgagccagatcatatatccagtgacatctgaggtgttgcatcaagtgtacgatacctatggagcagtggcggtgcaggttcttgcggtgagcacatggcaagtcaaggctcttgtgtcgttcatgtccagccatgacgcggagagggctcggtctgccacccacggtcgcgacatctacgacgggggttgcttactggatgtgcagcacgtccagatgttccctggagatggcgccaccgccacgcacaccacctgttcgacgatggtaccaagtagcgccaccgcaaggccagtggccaagagtactgctgctgcaccagaacgcgtgttccctgctactacagcttcatctgtaccctcaattacatcagcagccatggtgacatcggttcctttcaacgagaccaagaaggctgagactgacatggacaaggtggtggagaacttagacaagaccattcaagacctgtgcaccaagatcgatcggatgctagagaggcatttcgcgacaccaaggtcagtacagaggccggctcaactaaccttgttgacacagccaagcttggcatgggaacaaccatcgagtgttcaatgaagtgtgagaaccagttggctgatgatgatgatggcaaagacatggccaaggaggagtggatggagctcatggaagtggataccatgttcaccgctatgtatttatgcttcagagatccatttttaatcatcaatgcaattcctcccaggaactggagttggtgcttgagccgtgcctactttggagttgtaggcctctctttcgtttcatcgaaattggaagtactctatggttgctttgaccggagcttagaatacacagctagccctccaccggtaccaccttggagagcagcaattccatggaacaaagctgagatgacctcaggttctcggcctttaccatggcctgatccacagctttgtcaaggcagcggaggcgtggtggtaaagctcttacaactctagccgccacctattcaaacaaatgttaaagctgaaattgaaacactgaatttatatggtgagtctcatcaagtctccttgaactacagtgttgcccagttcatgagtagaacaattaattccactgagggcttgctgcaaaatctgatggttggatggtgtatttggcatgagatatgtctctctggtgcctttaggaaggcctatcagcacacacatcattcaacctatggttgggcatatggggatcatgaattgttcttgctgctgatgctgatttcccagttgtcacctgatgcatggtgtgattgcttattcagttgtgataatgctgatggtatttgtacttgcaagtcacccgagagaagtaccaactgccatgctcggtgctgcagtgttccaactccatttcaggttcagagcaaaaacaatggcgtaataggtgatacttcatggactcaattcagatcaaacaatggtgatgctgtgctgttggtgccacaaccatggccacagccgattctcttcccagttcatattatggttgagctagaggtttcgttgaagggaattattgtctcaacaaaaaagttggtcaacttgcaatctttggctcctccttcgctttggagaaatgaggtattcaatttgtgtgcaacaggagggcaagggctaaatttttcctggaaatgtatatatgaagagctacagcagttgcaatgtacctttgagtttactctttggaatcaacatggacagacatataagctattgttacaaaaggagcagctgaaacttggtgcagtctatctcagtttggaagtaaaatcttcagagacatgcttcacttgccggacttacgaggaggacatgttcttacaaatcacaaattttgtaggtcacaactatgaggggagtaacacttgttctacccatcaattcagtcatggttggcctaaatatttggtaagagctaaattcgttcaattccaaagaggcaagattctttaggagcaagtgcaactggcatatagcaggccaaacgggcggcccggcccagcacgacacggcacgccgacggcacggcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgagggaaaaaaaagaaaaaaggcagaaaaaacataatataaaggaaaaaatgataaatataggataaatgtgaggaaaatttaggaaatatatcataaaatatatggtacaaataggataaaatgtggaaaaaaaataaaaaatatgagaaatatatgggaaaaattagaaaatcgtaggaaaaataaatgggccggtgggccgtgccatgcctgggccgtgccgtgccggcacgctacagtaaacgtgccgtgccgtgctagcccacgggctgaggcatcggcccaaacacggcacgggataacgggccgtgccggcacggcccacaggctggcgtgccgtgccgggcctgggccggctacagtacttccgtgctcgggccggcccggcttggcacgacccatttggccaggtataaactggcattgtatacaacatcactggtgcgggtgacttgggatcctggtggctgtgttgtatcggcttggggacaagccgaaattcatggagggaggaatgtcatgggcctgggcctgtcaagtgagctatgttgattgggctggcttgaggctgaggggaggcaaaggataca

SEQ ID NO: 68641 - DNA, 6614 bp, Oryza sativa
ctgcagccctgttcttccaatctcaagctctgcttctctaataccagtcccttgcttccctttctagtcttcactcctatattccttgcaattgtatcccaattacttgagtgatttctgctgtggatcattggttccttcctgtgttgatattgatctgtgaatgagttgacggatcgtgacactccccctcgccttgtcctcttctaacttcatggccacatatcaggcatcctccacctgttgagcagagcagtgggaaaacgagaatgaggagaaggcgccgcagccggcaagctcgatctcgtcgcgcgcgccgaccgtcgcgccattggagcgccagaagcgggcgggtggcagcatggcaaaggcttcgggagctcctcaaccaccgccgaggcgctccgcttcgtcgagcaccgccagcgcccatgccgccgcgcgcttcccttttgccatacttcccctcgtcctcgccggcggcgaccagtggagcgcttacgtggcagaaccagaaccagacgtgtttcgacgggcgtaaataaggcccatccacacaaggccttgcaaggcttaaagccgggcccattttgaagcctatgtattccacgcctagtggcctagtggactaggcccacaaaactaagctcaaatctcacttgagagattctcacttaggccgagtttagatctaaactttttcttcaaacttctaacttttctatcacatcaaaactttcctacatacataaacttccaaattttccatcacatcgttccaatttcaaccaaacttccaattttgacatgaactaaacacagccttaactcatttttacaagtgccattgataagttactactccctgcattctctaatacattttggtatttgtttatgataaatatggtttctgatagctaatggatctaaatgtactaatattagaaaaaataaatacttttgaatacaaatgtaatcataccactatgttacggggaatgtttcaggtgcgacctcccatttgggaggaaacatggaaccccgaaccctccatctccaccatctagacgcatcctcctctcccgccaatcattttcaaaagaaataaaaacacccaccactaaataatcattttgtattttagttcctagtgttcactttctctttttctctatatctctcttccccctctctctctctctccttcaacgcgactatcaaaagagcaacattagtttacttcttcgatgttgtattatgttagtatttatctctacaaaacctggtaaaagttagaatacttttatctagaacaatgtagtatcccttatatttcttatattttaagatgggaagtatcatataattttgaaaattatataaaaatgtcaagtgagaatttgtatatcacttgaatctattgtactagagcgagtcggagtgggtgagatgtcaccacgtacaaatttacaaaaagcatgtgattagctctagacaaggttctaattaaagaagtttgagatcaaagagaggaagtgtttacatctaggggtgaaaatttttggcgtgtcacatcggatatacggacacacatttaaagtattaaatatagactaataacaaaacaaattacatattccgcctgtaaactgcgaaacgaatttattaagcctaattaatctatcatttgaagtattaatattgcttattttttaattccgaatttcagttaattttaaattgtattcctacttgaactcttttttctttttgctaattttagattttatttttatttttattttgaatattaattaatctcgtattgggttcttatatggactcttctctcaatattccttattttaattttgaatttcagttatttttaaattgtattcctagttggactctctttttcttttctaattttgggttttattttatttttattccgaattttgattaatctcgtgttgggttcttatatggactcttctttcaatattgcttatttttatttctgaatttcagctctttttaaattgtatttctacttggacattccttttctttttctccgattaatgtgggaatttctagcctccgccgcgaacgtggtacttcctttcaaagctatcttttttattttgaattttagtttttctattttatttttattttgaattttacttaacctcattttgtgttatagataatctctgatttcaatattttttatttgttattttgaattgcatcttgggttgccctcatgcgattgctactattcatcacatgagcagttggccctcctcccgcagccctagtaggacgaatttacgaaaaccttctctaaagtccgatgcgcctttttttaattgtcttttttgaaattatttttatttttattttgaattttaattaacctcattttgtgttctagatgatctcttatttcaatatttttatttgttattttgaattttagtttttctattttatttttattttgaatttgaattaacctcattttgtgttctagatgttctcttgttacaatattttttatttgttattttgaattttagtttttctaaaatatattcctactcaaactcttatttttatttttataatttcgaaatttattttattttgtattctgaattttaattgatctcctatcgtgtttaagatggattgttattttaatatttcttttttattctaaattttagtaattattaaaaggtactactactctaactctcttttttttctactttcaatttttttgttttatttcaaattttaattaatctcgtggtgtattttacatggattattctttcaatattccttatttttatccgaaatttagttgtttctaaattgtattcctacttggactttttttttccacggttaatgtgttaatttctagcatctggattgagttttttacatttgtaatttgaatttaaaaggattttttttcaagaatatgcaaaagaaacatagaaacaatctagatctgatgataacgcccatgttcttttgctagtttttagtgtgcccattatttattttaccaattatttatttctttttatgcctggtatattgaaaggtgtaaatcacgttaaaaacaatgataggattatatgcagaagaactattttactgatgtctcacatgaaacctactctagttctgtttccttttgctatgttcctttccaaatagagtctagtgtcctgatgctactgctatacgccatactcaatatgagttgtaacgtgctaccatgtacgtttctatagtgcttatgtggaacaacaatatgtttccaaaattttattcattaaatctcaacccttgagatctaaatttactatgatctagtggttaatatttttctctttttctccgattaatgtgggaatttctagcctccacagcgaacgtggtgcctccttttaaagctgtcttaatagtataatagatatgtagtgtaaattcaaaaattaccgttggatctaaagttaaacgtctaatatttgttgacatcatgaagattaaaaagtttactccagataaattttgtacaaatggttgaatctagaaataaaatttttactctcggtggtgtaaacaaatctcaagcatccatttttgggtcaaacagtagttttcaaattttcattatatttgtgatttgcactacatatttttccgtttatacccataagttgactacatagtaagacattataactgtagctctatggtcacaagatatcctggtgctactagctgactggtgaaccctctaagagcatactaaagaatgagcagactcatgggccaacaacaatcacgggtccagccaagtaataatgggtctagtattctcgagcctacactacagcatggccgcacgaacagttggtgggtaaggcatttaatgcctccctcaacgatgttgaagccccgcgtgcaaccttctcctccaaaggcaaggcaaggcctgtaccttgctagtggacggatccagggccccgcttacccttcggagtggacggcgcccctccggcacctcaaggagggatgatattcttggggaggcttcggtatcgttaccccggaggggttatcgaagcctataatatcccccaacagttctttttgtttttttttcgcaaatacgcaaagtgcgtatcatttgtattgagaccaggcttttgttttcttttgtgggcatacacaattaaacatacaaatgtggtgtgatcttgtttgctgattttttttatctccacttgtgcagctcttctgaaccaacaactcctgatcccttgctctcaacttgtgatgtgaattgcactgacaaaagaacagaaggactagctataaatcgctaaagatttttttttaataaaattcacacgaatgtaattacggtataattacaccgcaattggacagtagttgaataaaaaatgagattggttagtagctaatctggttatggttgcatgccctaaaccgtgatatcgtgggatagattcccattacctgtgccctttctcttttttttttccgccagttagcactcatctcaacgtgaattttttttccgccagttaacactcatctcaacgtgaattgtatttcataattaacttattggacatatttttatttccccgagatgcaagcatgattcattataaaatatgttggtcaaaacaagcacctagtgtccttgccagaaaaaagaaagggcaactagagtataaaaataagcgaggtcagtgagacgctgacaattaagattttttttttgagaaatgaaaattaatatgtcaagacgcggcaacagccgcctcatttcttctttgccatatccgtttgttagcaggaacagaatcctgaccttaatgccatggcactgtggggcgggctgggtcaggcggcgacggtggcgcagctggtcggggcggacatcggcggcctcatcaccatgatcatgcaggttgcgatgacggctgcggtgggaggagcggccagccatttcggaagtcgtggccaatctagagaaggcgctcgagctcgtccgttgcgacgggtaggcggtagcatagcgtgggctcccgagacatcttatgtgaataattgggcaatgtataatgtagtaataattaacgctgtttgcttctgttctcttttgtgcgcatgcacaattaaacattggtccaatgtggtgtgatcaactaacaaaatcttatcatttttgctgatttctaatgtccacttgtgcagctgtgctgaaccaacaacccccggatcccttgctctcagcttgtgctgtgaattcaagtgttaagttaggtgcctcccaatctcttcctgttcatctgtttgcaggtaggagtatgaggaagatatgaagattggtgtaaggaatagttgaagacgcacggattttaactggttttgctcccattagcacaaaaaaagatcaacaaaaatataaaggccttgaatgttctgaattttctcttgacaccttagcagccctgcaactgctatttcttcgtattttccccacaccttctccctgctcttaaaactaagaatctcgttcatgtctgtgcagcagtatccttcaggattaaagcggggttcatagggctcagagtgtattcaatggatgattgcaactgacgtattttcccggaaatgtttctcaaaaacctgataataggtacaggctacagagttccaagaatatactggatagtaacggacactgggcttcctttgcgcggcatttcatcgaacacttggagctcaagaccaatcatgccagtataccatagccctttcgctccttctctctttcaagagcgcttgaggcgaccgcgagccatggccgggcgtggcgtggagggcacgagactgtttgcactatctgctcgactgctccgccgcgggcgccgcctcggcctcgtcgtcgtcaagggattctgcatttctgctgtactactcagtagtatagtggtctcccttcctccactaccggcggtggccttggtgggcacagcaatgttcttggaagctaccgaagctaagagagaggaaagagaagaaacaagggatgactatgcccatttattttctgtaagaagtttgacataaccaaaatgaaagaatatcacgtcaaaaaaaaagaaagaatatgtaaatcctcattatcaactttacatagcaaaaaaaatgcacgtagctaggagcctaggaagcaaatagccgggtgttaattaatccatgttcgcggtgagcattcttaattctgctagctcgactccctgacaggctaaagtcccctgaacctgcagctccagggtttgctggctggtgaaggcgaataccccatataccttctactccctacttcactgacaggtggtgaaagtccgccatagcttacactgcctgcttcactggcagctgaaagtccaccgtggttaatattattattatgtgctccattgacagaagaaagccccgtgctatgctccactgcactgtagggatttgcc

SEQ ID NO: 68642 - DNA, 4601 bp, Oryza sativa
ccacgcggtcgggcgcgccgtcagcgcacgctcggcgtgcgtgcccggaagggaaccgtctcagacagggccgcggcgtggtccgtccgaccggcccagaaagagagaagggcaggggtggcccgggaataaaggaagaagaaggaagtggcccggggaagaagggagggaagcagagggagagaaaaagagggaggagagagggacttcgggctgggcttggcccaaaggaggaagaggatttatttttaggtttttctttttaataaactttgataattgtttttgttgcttaataattatttccggtgttctgaaaattcaagtaaaatttgagggctcattttagaccaaggagaatttaacaaaaattctccgggccacatttgaatttttcttgtacgtattttagtgtttgccaatttcttttcgaattttaattaattctattattccttttggaaaatgatttttatttcgggatgaatttatcaggacgtgacaaatccaccccccttacaagaatctcatccccgagattcgaggaggctagcatgaagataggttgggcggtattctcttcttgtctgacttcttccgtcgcgtcttttataacaaacttgcctagcaaaacttctccactctaggctgcttggctcgatcccttgttgtagatggaatcttctcttcacctgacttgtccctggttgaacctttagctgacttcgactgggttgcggcacttgaagatggggcttcagttccagaacttcgcatagttcatatctttggagtcaacctcatacaagttacccacttcatgtcatgcgtcgagatcagctcgtcattactaggataccatgcttgtcatcatgagaataccatgcttgtcatttacttctaacttgccaccaactgcctcatattagctttcctgctctccgggtgctagctacttctgctattcgatgcaagggtcggtaactttgcctttgaattatgtttctaaaaagaaccaacttatcccacttgacatgctttgacgtctccccaaatgactttactactggacctgttatggtatgatcgttatcctaccaaatctgaagcttcgttgttagatgtgattttaatctgacctctgtagactatcttcgaacatatcacttggttcataactgggaatagctcccacgaacaagcaactcggattcactttctttatgtttagtttactttccactattctcttcatgttgtcatcatttagcattcaacgtattcctttacaccttcgaccttgatgagttccttcccattggatcatctcccaagacatggcattgcctggtaaccggtgcctgcacttttcactccgtgtagcatctgataccgagttgaagatttcactccttgccttcatagaaacacttttacctaggtcatcttgcttactcacagatttatttttttttctctcaatgacaaggtgactgttgcagggcgattactgtcaggagtcttccttgtgtgatgcagagcatgtttctgattatcctttatcaatcacctttcggcctacgtctttcctgctagagaacatcttggccaacctcttttatcaatcatctttcggcctatctctaacaggtggtactctttaatgtgggttgcggacacttctggtggcgatggggtcctttggtctgctgcctttcagtgaaaccttgaagtgttttcgccaaaagctatactgactgtcattgcctttgatccgaaaaagacacgtgtgaaactcttagtccaaacaaatgtctctttggttaatcgcttgattttcttttccatcatcaggttggttattaactcgaggttagaacatagttcctctgaaatgagaccctaggtctcctttgacagtaaacaattatacacataatcccatatcagcatcttctgaaagagtcctcatagaacttgtttttattacacatttctcccatattacatgaatacgaggcactaccttaaacaaaaagggaaggtgcttaacatcggtacattgtatcctcaacatgaatcatccataaacatagtaaactcactgtttatagacatgaatatatttatttattacatgattgctgcaaactttcgattacacaatgataagtagcgaattgaaaaccacaaacgtggctgctcattttgattctggagagatatagctggcattgttctagtaactgcatcatccttgattggttctgtgatgatgtgataggactgcatattgctatcattcacgggagaaacttccttctgattgctgtttgaagcagataacggtcttctgcttggtatcgccctcctgaggttgattgcccttcgctcagcctagagtaggtcggggagagaaacaacttcttccatcgacgacaattctttgctgaggccgtaggtgcagagaatggttggtgctgaaggtattattgttatgatttattgcagagtcaggtgcagcaggaggagcattggtgctgtggatgatatcgtcgatgttgctgttggagctgactagctgatgagacaatcgtagggttgttcgttggatttctgcggtcttggtcaacaacacactgagttggcaatccgtgggcacatggtttgtaccttcgcacagaaaacatgtgaccttgtgggtgggacattcacctggcggatggtcttcttcaccatgagggcaaagtgtgagacacctgctagcaatgtgtccaattttctccacaacgggtgcatgcctttgattccatctcttcctcgccgagatgtcggggagactcttcttcatcatccgaggagacttgatctgacccttcactatcagatactctgccaccatggcttaggaggtgctgggtcaactatcgtgcacctcggaaggtatttcctctttgacgtctaggaataggtatccctgctggaggccattcggtgttggtaatagtcatcttacgtacttcttcttcagttcgcatcggcgcttttctcttctgattcttactcttcttgcctttggcttgcttagtacgtgaccccacgtggtacgaaaggctaggaggaaagcatttcccgggattccatggattgtctccattgggctctttactttgcactctagcccgcaagctaaaataagtgtgagaaggcaggtttaacgatgtctgccctgctaaaccaaaggaaggggcttctttggcatatacccatggacaattcagggcatagtgtccttgttctatacaatcgtgacaaaaggggacatcctcttctggcattggaagctcattgacctgggtggcaaatgctcgatcaaacacatagtgattttggtcttgacttccatccaatggtagctgcgaactaagcagcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagacaggaccttaaaggaactaactcttcttgctgatgtgttgtttgtttcacttattctgcaagttgattaagcaaacaacctagcatggttacatcacaccccactgatgcaaaccaagcgctacacacacaagcaaggaaacacacaactaacgactctaccctagagggtggcttaggttctgcgacgggttctccaagatcttcactccttcacagctggcttcactgcttcctccacttcgctagcggatcctacagtcttctggagcttcggcaaacaactgacgatgtcttcttcttcactgacctgaccatccagtactagttgaaatccgaagaaggaagaagggagtaaacattttgaaaatagcattagggaaaggaggaaaaggaactttcgcaaatagtttcatttataaaatatgtccttaggttttatccacttggcttatcctacagtcgagacggctctgataccatcttgtcgcgaccgagaaaattgcattttcccgaacgctagtgtattaatccccgtcccaggaaaagccggggtacaccatacaaacatgatataaaatacacatctttattatatcgataatatttacattattacaaaggcacttaaggcctgacaatcaaaaataaacagcagcggattagcgggcctatggctccatcttcacaggcgctcaactggggtgtaagccaagactccacctaagacatcttctccaaagcttctcttactgaaggggggagaaagatagagcaagaatgagtacaaccacagtactcagcaaagccacaccggcggatgcacgaataatgcaagggggtacaaggggtaatgatataagggttaagttttgcagaaaaccgcattaaaaatcacttaatttgcccaaagccatttttaaaagacgaatcctagagcttcacagtattaataatcaaggtcgtgaaccccgcacgaacct

SEQ ID NO: 68643 - DNA, 1860 bp, Oryza sativa
ccctaacatatcatatatgttgatacatagaccccatgagatgcccatttatataccatccagtattaaacacgttttcttttgctgccaaatttaccaacgagaaaaatatacaatacctaccgggctgcagcaaatcaggacaacaacctcttgaagaaccgcggcagtagggcaagaagcggcagcgctgtcgggcccggtcttgcggcgtgaccgtgcgagggaggcctgctgggtggggaatggtagggctagggatttggtcggggagctgtggacgacaggacacgggaagaggggaggaatgggggagatgagagcgagagagagaagggcacctcgtcggcggcgcgcgtgcttgaggtgcagaggtcggcaacggccatgccgtggcagcagcgatgggaatgggggcaagggaagggaaggtggggggattggatggttcgagcgactcggggagggaagtggagcggagcctcccgggagataagatttgcgcggaggcatgcgtggcctacgcattggcaccgctggcttccatctgggccgtcggcttcccagccgacggagttggtgtcggggctcggggcatggtttttgcgttttgagggaaatgcgtttcatatgtttccgacgaggagtattctagaataatacctactacatctagaatcatgttcattatttattagtgttgtttttttatttctttcgatgaaagtaggtaaggtgtctattttgattggtaataaagaacagagtttacataaatattacatatgctctagcagataaatagttaaaacataacgattttttaccataacggtggagggagccaaactagaaattaagaaattgggagtaaacattaaccaaaagtgcatgtatgattgttatgtaagatttattgttatatatttcaataaacattattgtaacatgagtcatgtatcttctcgtttgcagaaataattgcatgggtgaagtaaagggggcgggtatacacagtgcttggatgatcataaagttgatcagggactaaccaatatccttccccaaatctacttccatgataccacgtcatttctcatctattgaataccagagataaagttctacacttttttatttggattcgggcctcctaacagcatcaattttaaacggacatgccgctgaactagacggactcttagggtccataagtacttgttaaaatgtttatggagtctactttcaaatagttttggtcccatgttaaaattcttccttggatgtcaaaaatctgcaaaacaagccacgtgcatcatccaatttgagtttgatttgggccttagaccttgtaattatgtcatgggataagtccaaggactggacaccctaggacatccctaatcatacttattcaatagccatcaaagtttagagtggtttttctatcgtcatgcagtttcaacgctagtcagtttgtagaattctaacttcaagttcttaatcattcatctacaattgagttacaatcgactttgttcttgcttgtgtttttcgattcgcatatagagattatccttctcggcgaagtcaatcaggttttaaactattgataaccaaaggagatatagaattatgattggagggtttgaaatcatgttgattggaagctggatcttgtatgtcaagtttccgcaaaaatcgataattatcttcacttgatggaagatcgaacactcccttgtcatcaatcgatcaagatttttgtcatcatcgaaactttcgatgttacataaggcaaacgctaggatgtaatttatttgttgcttatgtagcaatagatttccttatatatatgta

SEQ ID NO: 68644 - DNA, 1507 bp, Oryza sativa
  unsure (1)..(1507): unsure at all n locations
ccccaaccggagacgcaagaggcatgnagatcggcttcctcttccccggtgtcgatctgaagcngtcatcaccaatccctccttcaccggtgagcgcacgcattgtagaggcggtcgtggacggcgaactccacggcatggccctgctccagcgtgacaccgctgctgccatggaggacctcgccgcgaaggcggaggcggagcataaggcgctttgagtagggctcggtgaagacgaactccgcggcggcgaggacgacgccgaggcggtcgaagtggcagaggaggagcctcatgagctccggcgacgggcagtgcagcacgtcggcgtgcgtcgagagagagagagggaaaagaaaagaggagagagagagaggaagccgtgtgccgggatgccgccgtgcgtcgtcgccgtcggcggcgaaccctggtgatgcgccgccgccgccgcccctctgtggccgagccgtcctggctcgggccggccaccatcgcgcctctgctcggctcaatagcaagcgtgaggaagaggaaggggaaaagaaaagaaagagggaaggggcattttggtacttacacaactctttctctctccattttaacccgtaataataaaataatgggagaagtgtccagcagctaattactacttttttacagtgtccacaatcaaatacacgatcttcgggtgtctcacagcaaaatccacaatctttcggtgtactgtagcaaattttgcctttgtgaaaagttccctttctatagaacctcgaccggggctgctccactagctctcttcttcccctcaccttgctcttctctagcaaatccttgtagtcttgtgagcggtggtggcaggtgtatcctagtgacttgcaccaagttcttctcctgttatattttatagatgcaatttatgtttataatagacaaaacttagcaattctggacctcattaatgcacacacgtccgcgtaatagctaggtatgatttgcgcttcttaaattcattctttttcagttttacaaatactgtcatccttgatagccccatgtatttacattttacttcattttatttgtgtccttcatgtcgtacttagagttttatttatagctatatatgtgaaaatttatagtatctgaagttcccgtgaatgcaaggattaactgtttgtttaaccaaatcctgcagtttgttgtagctaaattttgtaccctatagttgtgtgctactcgttaccacccgcattttacattatcaaaagtgcataacagacttttaaatctgaatgaattgtcgaaacatcataactaaccgcacgctagcttttttggtttacttgtttaaccgacttaattacttcaaccatccccacaaaaaaaaaacttacttcaccataaagtactgcttttgtatgaatgatttgtgtatattttatattaaacatttttctcatctagagtcgacgtcacttcctcatcatgtttatttgatttgaaaggg

SEQ ID NO: 68645 - DNA, 1522 bp, Oryza sativa
ctgctaccgctgggcagtggtgaccaggttggtcatgttgtccaaccatcgctggacaggggtctccggctccgaatttatggggggatgccgtagaagggctcccgccgcctaaagtgcgcctcgggatgagccgccgttgccgtatgtcaggcggccccgtgccccgacactgcgcggtttctccccgcgcggcggcggggagaggttcctccctctgtgggggggtcgcggtgggcaggagtgggagagttgttgcgacggtggtgggggccgcggctcccgctagcatcgtcactcccggagggagtaggggtgtgcgccaccacttcttcctctaggacctcgaccatgatcgttgaggatggagggaaacttgtggtggaaggaaacgatttctctttcaaacgcgcgaattccccctacctggcgcgccagctgtcgaggaatgatcctctcttgcgggtgattgagggacccccttttgtgagttcggccgggggaaagggcgcactgatcaagaacgtatatctgcctagagtctttcgagaccgcgtgtgagagctgggattgtacaagttcgggccgctagggagcgtaataccctactcctgtgcgtgggatttaagggttgagtgttacaaaggtttctaaactccagggagaactcttactcttcttcctctggggcttaggctaagtgagagtcatccccccttttcagtgggcaaggtcctccttttatagttcaaggggataccacatgcaccgcctctacctactccttcaagggagggggcccacgccgcttggagcggaccaccattcgtgccttcaccggaagctaagcagccgtccgtcctcgagtggggcccagcgccgtcccctgcctgacacgggggacgcccttgtcattcccctttaagtgaatggagacttttggcggttcacctcacgtggagggggctctagacgatgcattgatgggacggggcatacctgcccccactccgccgagcacagggcggaacgtgggggcaccgccgcccgtccgattggatgtgatcggccacagaccggtcacgcccgattgacgcgggtcaatcgggcagcgccgcacgtccgccctcaccgcattaaatgcggtgtgggacggttggggtgctattcattgatggcggctcagattcggccaccgccccactcactccccccgccacgtggcggccgggcgagggcctcggggcgaggcagcctgagggtcaaaggggcgtgacgtggcaccccgaggccccctggctgcctttgcgtcgtccgagatgtggggggagggccaggctgtatggccgcgtggctggacgggattgagacttccccatacttctcatatcctcaggcccatatcaccgacaattattctcacccctagttagctaatgtaactagttagttcaggtggtggtttgggcttgtctcaatgtggtgtagtgttaaacagtgattggttaatattgattaaata

SEQ ID NO: 68646 - DNA, 552 bp, Oryza sativa
tcgccgccgcccgaaaccctagcgcaagccgccgccgtctccttccaaattcggccgcgcctttccttctccggccgaattgattgagggcaattgatccttgagatctcctcttccttttctcttttggaaacatcggctaattttctttggaaaccggtggatttgagttggattcggattcatctctctcctctaaccccgacctttccttctcgtcgccggcagccgtgggccttcactgccgcctccttgcccctttaaaaggacccccggtgtctccgctacccgccgcctctctcgccttcgcccgccgtcgtgtgtagcgccctagcctcgtgagcttttgcgccgccgtcgccgccgttcgtccagccgtgcgccgccgtcgctacggtcgtcgtcgtcactcgggaaggccaccgtcgggatcgccaagtcgtcgccgtccccgtccgccgcttcgccgtcgccgaagatcgccggagcaccgtcgccgccgtcgacccgatctccgccgccgcttcttcctcgtcgccgtcgccgtccgtt

SEQ ID NO: 68647 - DNA, 761 bp, Oryza sativa
tgagatctcctcttccttttctcttttggaatcatcggctaaaatcgcttggaaattcgcggattcgagttcgattcggatcagcctctttcctccgaatccccgatctttccatcccaccgccggtcgccgtgggccttcgccgtcgccttctaacccctttaaaaggacccccggtgtctcctctacccgccgcctctcttgccttcgcccgccgtcgtgtgtagcgccctagcctcgtgagcttttgcgccgccgtcgtcgccgccactccagccgtgtgccgctgccgtttcagctgtcgccgtcgctcgggaaggtcgtcatcgtggtcgccgtcgggatcgccaagtcgtcgccgtcctcgtccgccccttcgccgccgccggacaccgctggagcaccgtcgccgccgtcgacccgatcttctccgccgctttgaccacatcgccgtcgccgtccgttggtcttccgccgctcctttggtcaccggtgagttcgccgtgccgtcgttcgccggcgagcgtgcgccgtccgagctgccgagccgctcgagccgccgccgccggtggtgacgtcatcgctgacgtcatcgtcgccgtctcccgtgagccgccgtggacccgatcgatctcggccgtccgttttggatagggttgatcttggccgtccgttcccgtgaactgtcgtcgtgcacccggtccaccgcaaaccctagccgctgacgcaataatcctccttttccttttcaaaaataattc

SEQ ID NO: 68648 - DNA, 7371 bp, Oryza sativa
acgtgacgacggcgcggggctcgagacgatggaacgccagcgcggggctcggggcggccacgcgcggggcagagtggggggggggttagggctagtgacctcaatcgaacacctttggggcaatgaacagtgacttttcctatttttccaacttggttgtttttcctattcaaatcttgtcccaatatttctaatttttgctcaaatcaagtttacacaatatttgtgttgctctaacctagattatcactacccatattttatttttatttttatttttaatttattcgaatttaattagggttaattcttattccatcgcacctaaatttaattgttaccaatatggccgcgataatattttatttatttccaacctcacctaatctatattttaattagttattttgccaatttaattttagtgtttattcctaattaattattccttattcgcgatcggtaaactttgaaaccaaattccaataaaataggcaaataaaatcagcatgatgcaatttattaaaaagtttttgaaggcccatatttttagagttttgattttcgttggttgaattttcaggatgttacaaacctaccccccttaaataaatctcgttccgagatttcttaccggtcttcgaacagatgcgggtattctgtcttcaagaattcttcactttcccaagtggctttatcctcagtgtgattactcaattgtaccttgtacatatgccacactttggccctagtcctcttttctacttcatccagtatccgaactggatgctctgggtacgtgagatcattgctaatatgaatttcctccaacggagcttgctcctccggcactcgcaagcacttctttaattgggacacatggaagactggatgcacatcggcgatgttttctggtagctgtagctgatatgcaacttctcctcgtctagccgtgatttgaaagggtcccacatatcttggcgctagttttcctttgaccttaaaccttttcgttcccctcatcggagaaacctttagataaacataatctccttctttaaattccaggtttcttcttcaggtgtcggcgtaactcttctgtcgtgattgagccacttttagacggtctcgaatcaggcgaaccttctcttcggcctctttgataatgtcgggtccaaataccgcacgttcacctgtctcggaccacattagtggagttcgacatcgttgaccaaacaatgcctcattgggtgacatctttaggcttgcttgaaagctgttgttgtaggagaattcggcgtagggcaaacatctctcccattctttgctaaaatccaatgcacaagctctcagcatgtcttccaggacctggtttgtcctttccgtttggccatccatctgcggatgataagctgtgctaaaagcaagataacttcctagggcttcatgtactttttcccagaaatgcgaggtaaactgtgtgcctcgatcagatataatccttttaggcacaccatgaagacacactatcctggtcatgtacaactcggcgagtttagcactattatagtttgtcttgacgggaatgaatcttgccgtcttggtgagtcgatccacaatcacccagatggaatcataccctgttgtggtcttgggcaacccaactatgaaatccatacctatctcatcccatttccattcgggaatcctaaggggttgcaacaaacctgccggcctctggtgctcagccttcaccatctggcatacgtcgcagagcgctacgtattcggtcacatctctcttcatgttgggccaccagtaaccctccttcagatcctggtacattttggtacttccggggtgtaatgaatatgccgattcgtgagcctcctttaggattaatcctctcagtccaccctgttcgggtacatagatcctctttttgtaccatagaacacctttttcatcggttgaaaattcctttgcacatcctgcagctaggcgtcccttcacctctcggatttcctcgttgtccttctgggcttcttctatttgggttctcaaaagaggttgaacgtccagggtgtttatctatccatgaggtactatatgtaggtttagttgagccatctcctccttaagctcaggaaccatcccttccgtcctcagatgatggcaatggctcttccgactcaaagcatcggccacaacgtttgccttgccggggtgatagtgaacctctagatcgtagtccttgattaattccagccatcgccttagcctcaagttgagatctgactgggtgaaaatatacttcagactcttgtggtcagtgtagatatcgcaatggtttccaatcagatagtgtctccaaatctttagcgcatgaaccacagctgcgagttctaggtcatgggtggggtagttttcctcgtgtggtcgcaattgtcgtgacgcataggccacaacctttctgtcctgcatcagtactcctcctagtccttgccttgatgcatcacaatatataacaaagtctttcctgatgtcgggaagaactagaataggcgccgaggtcagcttttctttgagctgctcaaagctttcctgacactgttctgaccacacaaacttcttttccttcttgagtagttgtgtcatcggtcgggctatcttagagaacccctcaatgaaccttcggtagtatccggccaagcctagaaaactccgaatttcagtcacagacttgggtgctttccatttcgtaacagcctccactttagcaggatccactgctactccaccggctgagatcacgtggcctagaaaagcaacttccttcaaccagaactcacatttgctaaattttgcatataacttatgctttcgaagtttctcgagtaccaatcgcaagtgctccacatgctcttcctcatccttggagtagattaaaatatcatcgatgaatactaccacaaatttgtccaagtaatccatgaacactttgttcataagattcataaagtatgccggggcgttggttaatccaaatgacattactgtgaactcatacaatccatagcgcgttgagaacgtggtcttgggtatatccccggtcctaattttcagttggtgatatcctgatcggaggtcgatcttagagaacaccttagctcctttaagttgatcgaagagatcatcaatccgtggtagtggatacttattcttgatagttacttcgttcagtgaacggtagtctacacacatcctaatgcaaccatctttcttcttaacgaatagcactggggctccccaaggtgacgaactggggcgtacaaatcctttttcttgcaactctctgatttgcttcttaagttcctccaactcattgactggcatccgatatggtctcttggatatgggagcagttccgggtatcaggtcaataataaactctatgtcacgatctggtggcatcccaggtaaatcctctggaaacacatcaggaaatcgttgcactacaggcattcctttcatgggtagcatggtgaatatgcctccggcatgttcggccagtctaggatcttgatccatagttgttctcatatccgatccccaggggtggtcaaggtaacttttctacgcctacagtcgattacccctctgttctttgttaaccaatccatacccaatatgacatccagggtctgaggtatcaaaaccataaggttggagggaaacacaacatccctaaggcgaatatgtacgtctatgcaagcatgactcacagttatctcgccctcaggtgagtgtaatatcataggctttctaagtcccactagggttaagttgtgcttttgactagccttcagagatatgaatgaatgcgatgcaccagaatcgaagagaactttaaccggggtagaattgatagaaaacatacccattagtatgccctgatcttcctgggcctcttcagctcggacatggttcacttgtccgcgcccaaatctggtagcggtcctgttagtttgcggagtcttgaatagacctcgtccggcaatagggatagtagtcccacgaacagtcattgcattagcgctagtacggacaggagttttgcgtggatgagggcagttgttggcgtagtgcccatactcctcgcaattgaagcagtccacattcttcttggctccaggggcagccagagttggtgtaggggtgcggttctgaattgcaaccggcctgttgaaattgctaggtgcggcggggcggttggtcgccacaatagggggtttccacccagacgaagtggctcccttgagtcgctgaggcactccctgaggtgggcgattcatagcaagcctcctcttgcggttgtgctctacagtcctttggtcattctccagcctaacgactttgttgatcaggctctggaagctctcatggtcttgcccaatcataggtccacgcaattcatcattcagcccttctatgaacttgtcgatcttttcctcttcatttgcaaggtctccaattgcatagcgggccagctgagtgaaccggttcagatattcctgcaccgttgtgttcccttgtcgcagccttctgaactcgttcttcttcatacgcattaccgcagcaggcacgaagttctcgcgaaatgctgcagtgaactcttcccaagtgggttctccagcatcctcttcccgagcttccttgtaagtatcccaccaatcaccagcgggtccctccagttggtttactgcgaagatcactttgtcggcttcgcgcacccggataagggtcagtttcttctctatgatacgtagccaatcttctgcctccataggctcgtctgtcgtagtgaacgtgggtggcttggtgctcataaactctccaaagcttgatccttcgtggttgccttgattgtttgcaatggcttgcagaagttgggtttgagtggccataactccggccagggtggttaggtcaggtgtctgggtttcatcattgctggttgacgcccgacgtcggcttgccatctgtgtaggtcgattgagtaagtatcctaatctcctaactggctcttatggttttatctctttaagggaattgtcttgatgtgaactttgttttgcaagcatggtggaataaactcatttacaacacaacagcaataatatcataaataacatcacagagttccacaaatagtacataaatcgtgatgcaatcgactgcacacatacgcagtccaaataaggttcatccaaaagatacattgaactaatcatcaaactactcgtcgatctaggtaagggggggtgtctcgcatgctatccaaaaaccatatgaagcgagatcgaagctgcaaatagtcctccagtctagtcatccaaccatccgcaggatcctggggcaggtagagggtggttgctggcacgggcaaacctgagtccccacggcttggaggtagtggcctctggatctggcttgggcttcttgcccggggatcgggtgctcttgcgggcaatgctgagggtgtgagggcctccgatgaaggtgatgcggggaacaggggtctcatcctctgaaggatcagtgatgtctggctcgatctctggctcggtgtcggtcccctctgtctcggagtcgacctggatcggagtctccatactggaacccagctgtggtgacggggtagggaccagtggggtgtgcacaatctctggtgcaggtggctgtgtcactgtcgtgtccactaggtagggtgctgacttagtagctagcatgccaatctctcccagaagagtgtggaatgcgggtggatatggcggggtgaggaagaagtagcggtcacgccctactgctgtggaagtagaagctcctggggtgctgaccgtggctgctcgaagctgctcctccagctggctgacgtgctcctgactctctctcagctgctcctcaagtgtattcatcatcccgcggcgattgttgtactgatgagataactgctggaactggtcgccgtggacctggagctgtgccttcagtgagtctatctcactgccccaagcctggtgcacctcccctagctgaagctgttgcactgtgaggtcagtcacctcggtctccaactctcccacaggcctctgctagtcgtcgatctctaacagagcctcctcgtagaagtcgtctactgcctcagcccatcgtgacagtcgagtcactatcgggttgtagcagcaaggtgtgtcctgaactgtgcagacggagttactctcctctcgaaacgggtggtgagcaaactcagtactcgccaactcagctcggtggatagagctaagtcggagaaaggcctcccgggctgcatcctacatcgcggtctctggtaagtcacgacggtggcatgtcggaaagctatagtctgactctgaaggaactcgtgtgtgaacctcgactcgggcctcccaaacggatccacactgtctcactcggtagatcggaaatctggggtaccgtagacgcctcatcaaccgatgcagctcaatgacgtatccctctgagcggggtacgcccatcatccaggtagcgggtgaatcctgatctgccatctaagtttaagaaaaacccaaagtcagctgagagtaaaacttgttttgtgaagaaaatagttaagagtaagatgaaaatcgtatagagttttgtgaacatagcatttttatttttgaaagtattactaaatgggaatttctcccttggccaacttagaaaagggggtggggcgccttttggtcttttcctacagtcgtatggctctgataccagctctgtagacccccgtttttataacaggaatcaatcgtgtaaacagtaccatttccttggatcaagtagtctggtacacacgagttcatagccgagataccaaacgcacatacacgagagtctagtgcaaattattacaacataagcccgcaggcgtagtcttaaatcatcggaccgagcggtccggaatacatcccaaaagcagaaatagataaggcagcggaattaaggcagcggcatgccattgccataggcaatgaccgtaactaagacctattgagcgtcatcgtcttcatcaccctcctggtaataggcatagggatcctccgaagcttcatctccggcctctgattaagtttatatttgcaagggtgagtaccaaccgtactcagcaagccaccacatcaacaatgcacatgataggggtatttcaaaggatggctatggttcttttgcgcaaagcaagttttgtaatttttttcacaagccttagacctagcattgactgatcaaattttagtaccagtgtttatatttaaacaa

SEQ ID NO: 68649 - DNA, 18582 bp, Oryza sativa
aagatgtcttaggtggagtcttggcttacaccccagttgagcgcctgtgaagatggagccgtaggcccgctcgtccgctgctgtttatttttgattgtgaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacacccaacctgtcaaaaattttctcatctctgattgctttctagtccagaactctaaaatataggaactatctctttctaacatcttatgacaaaccatctccttaaacccattttcagcaagccaggctgactcgaacttaaagtaactacagcttctttccctttcctcatcagtgtcaagaagaagaggagtatggtcagaacctactctagggagggaagagagcagagcagaggggaacttaatatcccaactatcattcattagaactctatctaggacttcctgagcagggcactcttgcttattagtccaagtatacttaggtccattcctaaaagtctctctcaaatctaaatcagcaataaaagagttaaacaacaacatattcctagagtcaacattagcattggatttttcccaagcaaatctatacaacttaaagtctccacctaatataaaggggtaatcattaccctgaatatgccatttcaactcatctaaaaacccacccttcaagtgattgtccacaggaccacacacacctatgatttcctagagatagtcatctttcttatttttcaaaacacaacataggaaataagctccggcatgagtagagataacctcaaacatctcagaattcacacctacaagaatgccaccagaagtccccctggatgctttcagcaccacacaaaagacctccctccttggaaggaattcaactctctatctaagaacacctctttcttagtttcttgtaaacagataatgtacaccctcttttctttgatcagctctttcagttgtccacctctagctacactacctaaccctctaatattctagaacaagataatcatttttttttcctttgtttgaacacaccacctctctttatcagctcagggctcttttcagcagccacctcctctaatggcatcttacttttttagccacaacctcttttcctaacttttgattcacctcctcagatttttctacattaccttcctaacttttcaattttccatctcttttttccagtttagttcagctagtttagcatgggctatctcttttgatttcaaggattctaaattagtatcaatctcagtagaagtactacccaaatctatcttagcagcaatagcaattttatttaactcaactgaatctagcagctgaaaaatagcaaaagggtttgaagcattaccttccatgttcttcttctgagtgagaattctagccctcctggtgacaggaacatcagccaactccctattccttaagctcatcctggatgtaattgtaggttcagtttttctcgcccaacttttcttcttatgagacacctcttgaaagctctattcatcatctctattttcttcctccctcaacctttctatgtcagaatcagtgggaatttgacacctctccatctcatcatccaacaagtttttttcacccattgtcagccaatcattctgagttccctctaaatcttcctgggtcagcatctcaatgggatttatcagctcttgggactcttgttccaccaccgtgtcacctttctctcccaaaccaccagagaagtgcaagaatcattcacctcctcaaatatttttcagaagagaggttttcttagaggatatttttttcccacccccactctgaagtaactgtgttttccctttgtacacaggaggtgcagaagaggctccaaatatgccgccctggttgtttccttcacctctaagctgtctacctctctgattgtcctgagacttgaactcgtcatctaagtttatatcatctctttcctttcgtcatccttgtcatccttatcatcaccatcctcaggtgggtcatgtctgttgtcataaggaatatgtccttttggttcccatctaatcatataacccactttgttaatgtagatgtgaactgagaaatgcaactaaatagggcccttacaagcaagcctcaccctcacagaggccatcccttctaagactagtcatatctagcatctcattttttttaactaggtcaacaatgaccttgatagaatcttctattctagctagcttcggaataccatagatctttacccatacagcaaccagctcatcaaccgcctcttctgtcataccagtttccactacacttgccttgatcagtgaggtctcaaaatcaaaactcttgtatgttgatatcttgcttctcacctcatcagaagggaaattgattaaaaactctttagcatttagttgtttcaccttccactccccatttagcccaacaaatagatgcttcagctctgcaaccacttttcccacagaagcttcaccaagaatcacagttagtatacctttcacaggagctctagccaactctatatcagaaatctcaacttgcaagctgtaaaaaccttgcccagggaacccaaacccacacagcttaatacccttctttcccaaaagcaatggacagtgagaagagatatggccagtattgtgacaggagtagtagaggtgagggttagggcacgttgcctgatggtgaccttcacgcccacactcgaagcattttatcctcacctcgatccgccgctctcgcaccacgatctgcctcgccaccttgacgcccttgagatcttgcacctagattccccgttggattttgagcgagaagttggcgtcgaagctcatcctattcgcgcgcatcacggttcccctaatctccacctctaatcggatccgtcacccttcgcttgttgacttgccactccggccgaatttggagggcgcttgtccatcaccacctctgtgtatgaacgatggtcgcgcttgcgctctggaactctccagatccggcgagcaccactaccaaatcaccggacttcctcacctctcgcagggaaccctagctttggttgcacctctccttgcttcacccaaatccactgctctaccgaggggataaacttggggaaaagtcaggtttcccaatagctctcgaactctccgcatgggctccaacagtattaggctgtactgtagatgttgggctgccgccattgatgacgtcatgcatgtgtgctgggctagcccaaaccatcccagctagaaccccatgtgtcgaaggcctagccatctcttcagaaggaaacctcccgccggagcactccgacgacctccgaagtcggcgatcgccggaaaacgaaggcgatgacgtcccctccccatcacgaacccgagactcctccatcggttccttcccctcacggcgaactgtgctccccaccgtatcaccggagggggctctatcaccagagggagctctcgccaccggcgtaagcacatcggcgtgcgtgtacctcgccggccaaccatgcgaggggatcgcctccctcgtcgccttcctcatcacctcactcgtcgcctctctcattgcctccgccacaggtcaatccaacggcctcccaacatcaaatgagctcagtgtgctggccgggccgaggtatgtctttctctagataggcatcaccttcatctctccgtcatgctcaacgtctggagcttcatctacgaatggcgttggccctagatgcctgggcatgtgcttcgggctatttgattcgttgtttgctcagattcaactcggtgattgattcttgtgcaacttgcagagaaccaaaaaagggagattttggatcaaggaaagggaaagtgatcttcttagcatcaaccaagttcatttcgtaagatttcagagcttctgcacttctaacaatggatgaccggcgagaagctagtaactagcaactagcaagacactgttttctgctccctgccgcatggcatgacaccggtgcggcccagtcctgtaacccttagaattcctcaatgcgcggtttgccccagtacttgatgcgaggtcttattattatgcagattaggtaatccctgcgtatgcatgactgttgagattgaaggtatctaatcatgcgggtcaatgtgatgaatctaattatagacagtgcccacatatttttatttattagctagttatgtagacttaatgatccatcagtattttaatgtattgacctgatgaatcagtgagttattattttcagcatgtagtctgaattcttcttaggcaatcttgcaagtagcataatgtggattgaagcaaactgcaccccacactcttacctgcttgaagactgcaaatccctctatttcactgcacgtccattagtattgctaacaaagattttcttgtgtttgtctgtctcgttggaaatcagttatattaaacaagctgccatggggtatgtgttttggtatctgcaatgggcaactgggtatcatcgtatatttcatgttacaggctattaatcacttattcttatacatgttatgtatgtcgaattcttgatgcattctattctgataacaaatgactggcctgcatgcgggtaaagcaagaaaagttttattttctaactatgtgctcacaaatggtgagattacatctttccttatgcacttgaatttctgaactatgcggattgtagttctgctatcgctattccaatagcacaattgttctatttgcgtggaaagtgacgtggactagggttcgatctttcggaaggttctgataatcaatgatttgggtggagtcgcgacacaaatcgattcggcttcttgaacgaacacgctcttgagccctgcaatcgcagcaccatgtctcctctggttatcacccgtgttgaaacgcggacgaccttgccgagaaggctaatccctatttgcgaatcaaagaacacaaataggaacaaagaagaatacaaccaaaattgcagatgaatgattaagctcacaagttcgggccttacaaaccgatctagcggcgaaactgttcttgacagaataagcaaaacccaaaccctaaaggtgacggccagtggcgattctagcaggtaggctccatcaggctctagcctatcctccaatttttgcaaaaaaaatatcaactaggtatcctcaagcatcagccggcgtcttggagttcatggcgacatgtgctcggcgctgggaagaagatgaacaggacacatgggagaaagaagaagcgaagcggtatgcagatgaactaggttgtgttggaaatatagtcattattcggcatattttaatccaagaaattgaaacaatgatcatggcataagcagtgtagggtgatcttaacataaccagtagcatactatgcgcatcatgaatgtcagaaacaggaacataccagtaacgcgataacatgctagaggcatcatgtagaacaggaacaagaacatagcgcacacagtatagcgctaacaatgggaacaggaatagcgctaacagcagtagcaggaggagaagattataccccgagaatggccctccgctggatggtgaggcagaattgcctccgttgttgtagtcgttcacggcacctcctcctggcgcaccagctcctgtcggcggcggcgcaccagctcctgtcggcggcggcgtaccacctccaccggtagcggcggcagcagcaactccagacatggcgatgagcagtcgtgcaggaggcactccccaaaaacctgatctcccgcctacccggtgcagatctcaggcaaaggtgtggtttcggaggcactcttctttcaatctctcgtgcgcgcaagagatcaaaagcggggaagcgagagcaactcaggcgcggagaaggagaaactaacaccgggaaaaaagctaagaagtcggatcggactcgcggcctccttatctatcaggagaaagaacgtggacgcgctgttgcggagggaatcgtgggaacgtgggttagtggctgcaaaaggattgtgacgtgacgcacgcacaccgccagccagccacgccacgcctcgccttgccctggccctcgcccacgcccacggcccggcccggcgcgcgcgcgcgcgtttagcattccgacccctacctcaactggtcaacagggagcctctaataactccctatttaggttgagatatttctcgcttaaatcctgaggtggtattattatcctcaacatttattatgggcctttgagatttaattattataaattgggcctagcccaattattctaacaatccccaccaaatttcaaggctcataagaaatgttctcaatgttgtgcctgtttgatataccagggttttggtggagactgttaagttgaacttccacctaggaaatgagctacatcagaccacaactgaacaatggactatgccttgaattgtaagttttgtgtgatcaggtttcactcagaaccttgactggtactgggctgccgttcgcatcccctctgtttggagcatataagtcaaactccaggcctttcatgagtatctagagattgcccaaacctcatagactgtgactagcagtcaaactcatataggtgtgttccttctgagatgttctgcaggtcaacatctctgcttggaaaagccactcggatcacattaagacataagccatcctaccatgcaggaaagaagagaagcacatcatggaaatgagcccttttcaagggtctcttctctcagtcacacaatagtttgtttcaccatccaaattcacgggatctccgatcacaatggacaggtttccactattatgcaaccttaggtgggtatcaagcccatttccctcgatgcactgtctatcacattacgtggtagccccttggtaaactggtctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtgccctttagatagcgcattactctttccagagcctgccaatgatcatctcccggatttgagacaaaccagctcagcttgcttacagcaaatgagatgtcaggcctcgttgcgctagccaagtacatcaatgaaccaatgatttgagagtatctcagttgatcccttgctattcttcgatttttccttaatagcacgctgggatcataaggagtaggagctggcttgcagtcactatatccaaagcgactcaaaaccttgtccacgtagtgggattgcacaagtgtaatcccaccctcatctcctctttgtaatttgatgttaagaataacatcagcctctcccaaatccttcatttcaaaactcttggacagatagtctttgacctcctcaatcacattaagactggtcccaaagatcagtatgtcatcgacatacaagcacaagatcaccccttctcccccaccatagcgatagtatacacatttgtcagcttcgttcacaacaaagcctgcagctgtaagcgtggtgtcaaacttctcatgccattgcttaggtgcttgcttgaggccatacaaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtagtcaagcgagcaactggtgaatatgtgtcgaagaaatcctcgccttccttttgggtataacccttggccacaagccttgccttgtacttttcgattgtaccatcaggcctaagctttttcttgaaaacccatttgcatcctacaggcttgcacccatatggacgctcaacgacttcccaagtaccattagatataatcgagtcaatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttcatcattgtgttctatcggtgcaaagtgctcatggagcatgacagtttctttactagaagtgctaggtgtatatttcataagaaattcattctcaaagaatgtagcatctctggactcaaaaattgtagcagcatgcatgtcgggtactccaaagtttactattaagaatctataacccacactgtggatagcataaccaagaaacacacaatcaacagtttttggtccaagtttccgctttttgactataggtacatttaccttggccaaacagccccatgttcgtaggtatgagagatttaatttcttcctttcccattcctcgaatggtgttacttccttatgcttcattggaattttattcaggacatgacacgcagtcaaaactgcctcaccccaccattccttggaaagccccgcagtgtctaacatggcattcaccatctcagttagaatacggttctttctttcggccaccccatttgattggggtgaatagggaggcgtcatctcatgaataattccaaactcttcgcaaaaggatgcaaactcattagaaaaatactccccacctctatcagacctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacatgccgttcatttcgcacaaatcggaatgaacaagttctagaggtgccaaattcctcgcctcagatgccttgtgaggcttgcgaggttgtttcgattgaacacaagtatggcacttggaacctttgaccaaagtgaattttggaattaaactcatgttagctaagcgcgtcatacaaccgaaattcacatgacagagtcgcgaatgccacacattagactcatcattcttgctaatatggttcacagcattatgattattacacatgtcattcaaagaaaagcggaacaagcctccgctgtcataacctttaccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctctcgacctgataagaagaaaacagagaaatgtcagcacatacatgaatattagcaccagtatccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccctttgcctttcccttgcctttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgttctcaagttccttagccagcatctgaatctcatgagcttgttctactacagaacggtcatcgaccatcttgtagtcatagaactgctccatgatatacagctcactgccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggaaatatagtcattattcggcatattttaatccaagaaattgaaacaatgatcatggcataagcagtgtagggtaatcttaacataaccagtagcatactatgcgcatcatgaatgtcagaaacaggaacataccagtaacgcgataacatgctagaggcatcacgtagaataggaacaagaacatagcgcacacagtatagcgctaacaatgggaacaggaatagcgctaacagcagtagcaggaggagaagattataccccgagaatggccctccgctggatggtgaggcagaattgcctccgttgttgtagtcgttcacggcacctcctcctggcgcaccagctcctgtcggcggcggcgcaccagctcctgtcggcggcggcgtaccacctccgccggtagcggcggcagcagcaactccagacatggcgatgagcagtcgtgcaggaggcactccccaaaaacctgatctcccgcctacccggtgcagatctcaggcaaaggtgtggtttcggagccactgcttcttccaatctctcgtgcgcgcaagagatcagaagcggggaagcgagagcaactcaggcgcggagaaggagaaactaacaccgggaaaaaagctaagaagtcggatcggactcgcggcctccttatctatcaggagaaagaacgtggacgcgctgttgcggagggaatcgtgagaacgtgggttagtggctgcaaaaggattgcgtcgtgactatcaggagaaagaacgtggaagcgcggttgtggagggaatcgtgggaacgtgggttagtggctgcaaaaggattgtgacgtgacgcacgccgccagccacgccacgcctcgcccacggcccggcgcgcgcgcgcgtggcattccgacccccacctcaactggtcaacagggagcctctaataactccctatttaggttgagatatttctcgcttaaattctgaggtggtattattatcctcaacatttattatgggtctttgagatttaattattataaattgggcctagcccaattattctaacaggttgtcccaattcgatagtaatggcccagtccagtggcccacttcccacacttcacactcacacaggtcaggtggggatagggttgggggtgtttagggtgggagctgtcgctggcaactggtggcggctggagcagccgacgccgacgcaagtcgcaagagctcgaggcctcgagctgcagcgccgtagctagctgtctggtggcgagtaagagcaaacaaaggcggccgcaggcgcggaagccggcaggctgcaggcggagcggctgcgcgaagccgtcagtaggcgccatggcggcgcgcggagcagcaccacagtagccgctagcactagcagagcagcagttatactatgtttacggagtatatgcatataggtgtttgttattctcatatgactgatgtagtaatcaattacttcgtattggcaaggtatttttctttatttctttcttttctattcaatcatgtatcatgtatgtgttgaataactaccgtaagtactgcaatttactactccaaaatataagcaattttagctataaatctggacaatcatgtgtccaaattcatagccaaaatttgttagggacagaggtagtaacttaatacttggagatcaagcctaccctctttttctatcctggattcgccactggtgacggcgggtactgatatatagagtttagggtcatgcaaccaacccttgacacaaccctaataggttccaatacgatacacagcccaaaggcctaaatacggtgacgcagcactggcacagattgtagacgtcaacttgttcggtcgattcccgttgactcggaaagaatttggacgtgggaccagaaccattggaaaggttatcttcttagcttccatccatataaagaacgccccaatccgagcacgtatgcgacctggacgcccgttttagtgtagactggttctggactccgaattgcactcaaagttggcttgctttggccctccaccttgacttggacgtccttgatgatcctccataactctaagtccttctccaagtgtctctttgtcctctccattgttcctaatcacaatataatcattaggtagcaatctattctcaaattcatacaaagaagaacataggaacgagcttacctctaaattcaattgtcgcacgcgagctcttgttatcggttcttgaatgaccggtggaggattgttgtgtgtatccgaaggagtgatgtccgcatcagaaagattggttgacgagttgatgacacagttatatatattgtggagtctaggttcatgccattgaacatgtatcgcgttggtatgcctcgtggtggaagatggtctcccctccgagtgtagcagcaactgccttgagcagctgcaacctgtggagcactgcgtgcagaaaaccacatgtaggatcatgatggagagcaagattcaaagttacttctcaatgtggcagaacagtactagatgcgttttttcaggactgttatcaattgagcagtgacatatcaacagaggacatctttatgaagactatgtagataaattgatactgtgcagcacctctcaactgtatttgactacatatctgccactcattttatcagttactgtagaatttcacccacattcctatttcagaaattgcctgatgcttcatagccgtgtctgcttacaaagacatcagctttcttcgtttcaaaagaggagcagtttccctcccactggatctggcggaaaggaggacgccgccgctgcgccgctacctcccgggcaggcgccacgagaggggagggaaagagagaggggagcgaacgaccgagagagagcgatagagcgatctagaatatttctggatggatcgaggtgtctagccgctggccttatctctcatggtgggccccaccagctcggcttaatttgtaggtgtcggtttttaattaatcggcacctataatatattatatgtgtcggttctttttaaaaaaatcaataccaattgtattggtgccagtttttctttagaactggcacctataattgttcaaaggtgtcggttctttattttttatcccgcggaaggtgagaaaagatcaatatgtaccggttttaaataagccggtccctatgaggattttttaagtagtgtctagtgcctaacacggtaacaccccttaccttaattaagggtaaatcaataatttactaatattatgattagaaggtttagtcactgctaaatgataattatacccctctgtaactattttttaataataatgtcccttcatgtttctcctaccacaaactggggtgacagtacaagtagattttaaaccattcgattaaattatatcaatggtttagattactttttaccactagtaaagagcactgtagtggggtttcttaattacatgttaaggtcccgaccgcaaaataacaactactagctgttccacttcatcgcgcaaagacagtaagaaagttcttatgaacccaggaagtaaggagaagcagtgtgcatttgaatcttcgaacggagagacctggtgtgacgccccacactcgaggccgggccctgttacatctggcagctttaataggacacagactagcacccgggaagaattaagaaagttcttatgaacccaggaagtaaccttagagttctttcgagatcggcttccggaaaagaagttgcaacttgttggtatgagtattctattaatcctctttaagccctgagccgggatgtcacattctctcccccttaagacaccgacgtcctcgtcggtcaacccaggccgggaacgtctcctattagcaccacgtatatacagacaattttcggcgcacatacgtcatgccatacgaccacatcgtggatcatcccgtgtgcaccgtatgcccgcgtacatattcatatatacgtatagctgcaagggtcggcactgataccatctgtaacgctgcaagggtcagctctgataccatctgtaacgccccacactctccgaggccgggccctctctacatctggcagctttcctaggatatagactgccctcatagcacactttgtcctcactcgtgcgcacccgggaagaatttcccggtgaccgccaggccctctctatatctggcagttttcttaggatatagaatgctctcacagagcaacacaagtcttttctgcacactttgtcctcactcgtgcgcacccagaagcggcttccggaaaagaagttgtaacttgttggtatgagtattctattaatcctattaagtcctgagccgggatgtcacacctggctccttggatcatgtcaatcttctgcccagccttgacgaaggtgaaggtgggtactactccgttgacatcatacgagtctgcaatttcctccagctcatcgatatcgaacttcaggaaaactactccagcgaactccttggcgtactcagcgaaaactggagcgatcctgcgtgaaggttcacaccaggatgcaccgaactcgatgaccacgagcttgccacacaccatggcctgttcgatgagatactagaactcatccatggtgtggcactcggtcaacatcccttccacgccgaagggcatttcctcttctcccctctgccggctgcaaaaagttaagagatctgtttcaatcttttgcatatattatctacgtaatattgaatggttttaatctattgtaataagactttaatatttcacatctgcctcaaaattgtgaccatagtgaactttacaaaattttaagcggttgattaacaaaaataatcaggggatgaagtgagcgtagctcaactagctaagtttctcatggtagaacctttgttcacctgaaatttaagtctcagacttgacacgggtgatcaaatttacagctaattattcttttagtgttagacgatatatatatatccatcgataacgatgtgtctatggtgacttcgttaacctcaagatgtattggctcagtttttccaaggtgtttataaaggtagaatgtgcgtgtatatgttcttaggggtgagagtgtgagcgtttgcgtttatattgtgtttctaaaaaaaatcaggggaatatatatattgaaattcccttatttgccactcaatatccgttaaaccctaatatgtcagtatacaaatttttggtattttacaatgcactttcatcacttctgttaggtcaatttaatccgagttttgtatttaggctaattattctctcagtggtagacgatgtatacgtcgacagtgaggcgcccgtggccgtggtgacttcattaattttatgatataccgactaagtccttcgtagatgtttataggagtaagttgtgtgtctattcataagggtgagtgtattcaaaaaataataattttgagcttgttattttttctgaaaatgataaaatcactaaaccgatgccaccggatattttgtcggcggtgtctttcattgtcgataataaccttatattcttttattgagatcaacaaattgactaatgtctgattgaatcattgaaccattcgttgagttttgatcaagaagattattggttgtgggtcatcacgctccaaggacttgctaaacgtgtcattgccacagggacatactcaactgaaaacacaagcaaggataattagtccaacgaattgcaaagttgaaaccctagatcggaatcgagtaccggacctcctcacatccgatcaacctgccatggccgccgccgcccgtcatgtggcttcgtacatgggccgctttgctcctcggtgtggctacgccggcgacaccacctgcaccgccgccgcctggacgcggcctcagctgccacacgccccgtcgggcccactcgtcatcctccggcgcggcatcgcgatgatccccggcgaccactcccccggacccgccgacctctcccccgattgctttgaccctgaagctccaggtaacctaatcgaccgccattttttttttttattttgcctccacttcaaggatactgtcgtcatgatgattatctgttatgacccgaactcgtgagagaccgattgctcgtactcttttcgtattttaatgtatgacatcgttgactttttgactaacgtttaaccattcgttttattcaaaatttttgtgaaaatataaaaatatttatgtcatgcttaaagaatatttgatgatgaatcaagtcacaataaaataaataataattacataaattttttaaataagacgaatggtcaaatgttagacaaaaagtcaacagcgtcatacattaaaatatggaggtagtaattgttatgacccgagctggtgactagtagcagtattatggataactcgttgtaatttggggtgaattattagcagtattattgatatcttgttctattttggggagaaggagaattttggtataggaaacagagaaggaaaagggaacaagaaaaacacactgaagaagaaactcagtgaagaaattcagtttatttcatttgcagccttattgtgtacatggcctagctaaccccattacatgagtcacacggacaagtggaacaatggcccttgatctgagctagcgaacgcactaaagcacacacactctatccctgcactatctttatttgtacttgctctgtcctaacatataagtaatcctgggattgtgctaagtcaaattctaagctgatcaaatttcttagcaaattctaagctgatcaaatttcttagagaaaatattaacatctaccacatcagagaagtaactttgaaaattttagcctcagtactattgcgaacttgtgatgtgggtctctgttaccataaaaaaaatatatatgtacaattatgtttgttcagagttgtaccataaaaagtttactcaccacaaagtaaggttcacactcttgttgtcttgttgaccctatatactggattgtgattgtttattgacgtggtaataataactacccctccgtcccaaaaaaaaaaagttcaatccttgctacgaatctcgacacatatatgtccaggtagtatgatgcaggccatggcaggatctgagtagtatgtaatcttctatgtaaacctaagctcagtgcaatctttttccttcaatgtaaatatgtgatcttgttatctcaaattatacactgatccaaccggtacaaccgtacacgagaatacactcaatcttaactggttccttttcattttctaaacattcattgagggaatggatccatgtgtagttaaaatcatatgtaaatatttgtttttttcccgcaaatcatctttggtcattactgttgtgttccttttccatgttgggacgttcctaacagcagtattagtatttgttgttgttgttgatggtggttagtagttttaattgtgtgatataaatttatgtcaattattattttcactttgccttttacattaagtccaagtaaatactatactaaatattaaaaaacaaattaggctgcaacatacgtccaacatatttggtttgattttatttcctaatgtgcgttgcacatgcactattacttagtactccctcc

SEQ ID NO: 68650 - DNA, 5650 bp, Oryza sativa
ctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggtaaatggagagaaagacttattaattagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcactacaagagagctcgatgtacgtacaaataaattcaaaattttattacgtagcgatttcttgtttaattactaatcaatttcatacattcatatagtttattcgcatgagggataacctgaccacacacaaggaatttatcgcggcggttcaagaacaacctcatgggattcatcacgaagaaatccttgatcccaagggtgaattctactacgacggaaacacaattcaccggtccttagcttctgagctagcagcgactactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtgtaaatacatatatattatgcatgtatatacatataatataatataatataatatatatatatatatatatacatatatatatgtatgcatatatatgtattgaaacatatatatgcatggtttatatatatatatatatatatatatatatatatatatatatatatatatatatatatagatatatataaaccatgcagcaacagggccatgaaaaaaaaaaaaggtcagctcgatctttagtcccggattggtactcccggtttggaaaccgggactaaaggggagttacgaaccgggactacaaaggtttctccaccagtgaaaggtgctaaagatttcacttttttttataatctacagcgaatattttataccgtttagtagggcacgtttaaataaattgtacatgtagctaagtacacttcatgtcaagttctatgtgagagtaagatttttttttcagtaacactaacaataaaaatctcggtgctccaatagtagcatttttccagcaccaaaaactactattagtgtttttgaatatgctcaatttacatgttgatacataaaaaataattactgttgtaaattatttaccttgtagggtagaaaaaaaaagctagtgcttttgattttgtaagataggtagcccatgtactgaacttatggtcagaactaggggtgaaaatggtaacggtaattaccggccgaccggcgttcgttttcgactttctaccggccgagccatatggaaatggtaatcgaccgaaacaaaaatggaaatggtaaaaaatatggaaatgaaaacggaaatggttttgctgttataccgatcgtttccgtatttaccgtattctcgcggaaattaccgtttcttataatatggtaattaccgtattctaaatatgtcgatattataggacatgtctatacttgacccacagcttatagattgaatgactcttcaataaaatctctaacttttgtacatggctaaaatgaagttaatttataatttatatagtataagcttgaatttatgtatatatatataacatacttatgtaaagttaaatatatgtttttatagtttaatgtttccatatttgttaccggtttctgatctgtaccgacatgtttccgtccgtattgttccgtttccggttttccgatatttccgatatcgttttcgtttccgactttaccgtttccgatttcgtttccgagaaaaatatggttacggaaatggttgaggctgttttccgatcgtttccgaccgttttcatccctagtcagaacatacgcaactgctgccttattgttggcacggttaaatagttaatgacatgcttttcacttaccttattttggtaacatttcattaatatctataacttataataaagtaatagaaaaaatagcctccacattagctctcaagatctagaaactttcatattaattggaataaaatgggaaaaaaaaaggaaaactcattgcagacaaggattctttctttttatttttttaaaaaaatcacattatagatgtgtagtgtccgatcggacacctgctgacctgcatagaacaaatcttttgcagtttgcaaaagaaaaatcttttgcaaggaaaaaatgacctaagctggctgctagagtacccgtgtacaacacaaatcacaagtgtgcatgtaagtagtactcccaatattggctcattaacagcacatcgcaatcaagaaaaacacatacaaagataaaatccgtacccctatcactgtgtttgttacttcgagcagagacgggttgtagtgcctgtatgccagtttatttcgatcaatttgacttgtgcaaacctgatgatagctttagtgaaaatcacagcaagcccaagccatcacagacggtccactacagccatatgcatctcaaattgggctgagatgggcccacgttaaaaacttacttataggccggcgcatactaccacaattctggcccatatggaggcacgtcaaccgcgaccccctttcggcccagcgattcgtcgccactagaagaattttttttatttataattttttttattaaaagtttgacaaaaataattttccattttgaaaattgacggaagtagtcgcctaccgccctctgggagggcgatttttaaaaatcgccctctcatagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttacaggcggcccccttgccgccctccgcgagggcgattttgtactgtgcggggggccgcctgcagatgggcggctagggggcatggaattttgcaggcgggccccctttgggggcccccgggggcctccgttaggagaatatgtactgtgctctatatttttgtataaatatcaatagttatcaaatctttttatattgaaaactatacaagattaaaatctccaagactggtaaaatacaattttattattttttagggcatatttggattgttaccgtacaaatatttttttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggctttcattttcgtgtgttgtgtgatagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaacgtgcccgtgggagtacgtgagtcggtccgggggtacggcacggccaacccgtcctgcctgtataggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcatggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcgccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtactcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacaacgctgcaataaacatgatcggaattagacagggctgcag

SEQ ID NO: 68651 - DNA, 955 bp, Oryza sativa
cgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaaaaccgtccacgggaccaactgctgctcccgccagcggtagcccgagcaggtacgacacgtcctgcagtgtcggagccatctccccacagggaaggtggaacgtgtgcgtctcaggtctccagcggtctacaagagtggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactc

SEQ ID NO: 68652 - DNA, 1623 bp, Oryza sativa
caggctgtatggccgcgtggctggacgggattgagacttccccatacttctcatatcctcaggcccatatcaccgacaattattctcacccctagttagctaatgtaactagttagttcaggtggtggtttgggcttgtctcaatgtggtgtagtgttgagcagtgattggttaatattgattaaatactacaactgtttttactgctttcaactactgcttttaaatgcaagcattatgcaaatgaaccgctagcctcctttggttatatcttgcatcatacctcctcttccggtatgacttgttgagtacagtgggaagtacttagtcttgctctctcttccccacaccagagttgaagttcttcttagttggagatgtctcgaagaaattggtttcgtcgctgccgtcaaggatgcatgtggagtcaagtcttcaggcttagctggctttcatcttttccgctgcatttgtaatcttttatatttttgtaaaacgtggatctgtatttcaacaattgtcgtttgtataccctggctggttctggacatgggtttaatgcacattcagcttagaaattctggttcgtgaatttctgggcgtgacagttgtccatcattcttgacaagatgtagtgtacaaggcattctttagttgagcctcgctcactttgcatcacagaagtataacctagacataactaattcagtatagaagcaaaatgtgcagcagcaacaataagggtgaaaactagaaagaaggatttatgatgcttcttagtttattcagtcacgaaagagtgactttaaataaatgtacacttcttccaaagtgaaaattatgagatgtcttacttatggaatgctcctacacactaaggttgtgtaatgccccgagtttcgaattagtatatttcggggaatattagaacaaatgcgcaaaagttcaatttttttaaaccgttgttcgaataggcgatcaggaaccatggatgtatagagctcgtcaagtagtgcaaaatatactaagtcccggggattgaaacaatgtgggacgttggatctcctttttgtctctttatgtaactaaaagaaaaaagaaacaacggttttgctaaaaaactggcgacagttttttctttagaaaactttcgattttctagccattagatgcactccaggattcgtgcaacatatacggccatatgggtagaataaaaaaaatctcgtgtgggctagacaagcattgaacgagctaggatctatccatcaaacttgccacacgttacgctgaggtacgggcactttctgattattaatagcatttgtagttatatatcacttacaccctaggtacataacacttatactctagttacatactctagttagttacatagcacttacaccaactagagtagttacagggtaattacatggtataaaattaggatttgtaatttttttcagggacatatatatgcatattacttttgaattgaaagttattatcaatttgggcactaagactcgtggtttgtactagtgcagactgttttcctgtaatcgttgatgacaaatcctatggttgaaaaatttgacagttctggacctaaaaaactgt

SEQ ID NO: 68653 - DNA, 1216 bp, Oryza sativa
cggatggatggtagggattagggacgatgatttggcctgaagcattgctaggctcaactcatcctttttatattagtatagatatagatgtacaattcttccaaagttaaaattatgacatgtcttacttatggaatgctcctacacgcggaggttgttcttgctgacactctcgtttctatgagaagttttttctaacatagcaagtcgatagtttactgccaataaaatggataataagcctgatgtttcaacaaaactagagaaactcacgcatgatatacccaaaggaaaccggttcttgacacactacaaatctgtggtagttcttttctatcttaaaaacgaatcaaggctgtgtttggaatcagctgttcccaacatgcaaagtgcgcacggaaaacggagcggtccattaaagcttgattagttaagtattagcttttttttcaaaaaaatagattaatatgattttttaagcaacttttgtagagaaactttttacaaaaaaacacaccgtttagcagtttgaaaagcgtgcgcgcggaatacgatggagatgggttgggaaccctggattccgaacacagcccaagtctatccaaaaagtttagacaagaaaacacgtaacaagttggtttgcaagaatacgaattacgtcaatcctgcactataggtagagcaaaatggtgatttctcgtaaatctctcgaatggtgatttaagaatttagtgcaaacctaactcttgctataaaatcaaatgttcggtaccgtatcaacggaacaataaaaagcacttggcgtaccataattttgtcattcttgttgaaattttgtaacataaaatgcatgaggccacacgaccttaatgttcaacgtgtcatgcattagtgaaataatagcttacaaaacataacaaatatagctagataacggttgcaatccttaccaaactaacgtataaagtgagcgatgagtcatatcattatctttctagcctgctaaccatcacgtacaccttccgatcccaaaaaatgacaacttctatggatgaacctggacaaggtttagggtttagggatgaatctggacaaatgattgtctaggttcatccctagaagtgggtttctccttatgggacggagggagtatatttgatggacacaaaagttactttcgtgatgaaatcaaaggggatttgttgaggcacctaat

SEQ ID NO: 68654 - DNA, 2124 bp, Oryza sativa
ccataacttggccatttgaacacggaattggaccgttcaagtctctaatttttccttaagaagtcaagaacccatttttgtgctttgtttctgcttgttatatggagtttattagagtaaaagccttttctttttcgttggtcgtgtagacgctgcagcttcggaagatccgctcttcgtggaagttgaagtcgacgtttgggaaagcgagcaaggcaagtcacatcatccttgaacacattgaatcccagtttataaaattatattgatttaaattattgcattatcgctttatttaaattcccgcgttatcactgttttgtttagccatgcctatttgcctttgtatgaccttattattgttattgttattattaccttgttcaccctagaataaacaaaaccccaactagtggacactctactcatggtaccactagtatgaatttaggtagatgcttcgctggttaattaggcaacattaggtggttttacaactctagactttgggaatattctcatcacctggacactatggaatggatggattattgggaattggattcacacctccccctctattcaaaaccctcaaaatggttttaggctgggctcggggtgcatggttttgatagtagcacctcggccataaaaggaccagtcttcgggcctctgttgcaaagcactaccgtacttccacatgtctagtggctaaggcttagtttgtggctcagtctggttataaacaaaagtacacggatggagatggacgaagtcgggggtcaatggacatctctagggcaaatgaaggctacacgagctgcggcccggtagtcgagatgtcatggcacagggccggtgtcctgctgctaggggctcggtcctgcctacctgtcccgaaggttccggccgtaggtggggttgggtcggtaatcttgtctttggctgggttgggttggaaactatgtcacgtcttccgtccgtataccgtggtggtatgtggcacgtggttacacgtgagaaagatgtgtcttgtgggtaaagatgtacacctctgatcagagtataacctattcgaatagccgcgccctcggttatgggcaagcctagcaatgtacccaagttattgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggactgtgtttacaaagtaggttggagcaactaagtgacttttaatgctgtttactgcaatccctaaccccctatattatggctcccttgtactcccttgcatttattctgcacttgtgggtatgtcttgctgagtacggtggttgtactcagtcttgctcaatttttcccaaacccagaagaggagttcctagaagatgaaggttttggtgtctagctcgtgcctgccgtcaagcacctgtggtagtcgccctagtcttccgctgtttcccgtttgtctttgtgtgtgctgggccttcgccgcccatgtaataaattaattatttacgcttcctcttgataaactctgaaatgtatcaacttttggtgtaccttgcctcctgggacaaggaataatacacgcacgtaaggaacgcccgttgggttagttccggtcgtgacataaggtgaactagtagattgatagagagcttaatacacttcaaatagatgatattttaatataaagggcaaatttagacgatcaagacccaagtagtggaaacacgatggctaaatcaggtaagatcggctgaaactccgatactaactctattagcattcatagaaagagctagataaaatgtttcaagacagtacttagtagatcgaacctaaccaatgcagcattaagtgtgaaaagaaacataagatctaagccagaacgatgaagactcatttgatatggtagatataccgcataatctagcttaatgttgatatctaaatctggccgcccgtttcgatgatagaggctatccgatgagattagattaccaa

SEQ ID NO: 68655 - DNA, 990 bp, Oryza sativa
gagtagtcagatttgtcaactagaaatttgattctagcgcaaactacagaactcctcgaatccgattaggatattagccactgaacagatcaatgtggtgcttgtatttcagctcctcgacgtgcttgttttgttgatggagatcgatgccgagtctggcttggacccggccagctgatgccgcccaccggttggcgtcctgcacgtcgatgggttagtgtcggatcagttttggattccgccaacactatggtcctctgccgctgcgacatcttgaagcttgattggtctcgccggatcgaatagttgatggcgatgattccaatctcgttgggagacgtactttggccaggttggatctccctgatccgaagtcgtcgagtagcttattgttggagaatccatctcttaaacccatctcgtctaaatcctgaagcaccaaaaaatccccctacctggcgcgccactgtcgacgtttgatgtcgcgattccggtatttgcatagtatggggatcgtcggtactaggacatacgcgagactgaggtaaaagagacagaggcgacgatttttatacaggttcgggcccctgaattgtcaggtaataaccctatatcctgttggccgaagccggtattgctcttattcaccataatcacacgagtacaatatttggggtagcctatctaactgttgtcgacatggcggtctgtatgtctgactcgtagtcgacaacagggtagtattcatcctttagttcctgcccggcaagatcagagatagcacttttgtctctcctgacagtatccagagacagggtaggggactagccgggctaatccctgaagcggatatccaacgggttgcctgggcggaggtgggtttgaaggtggggcgtttggtggttcccgggattgtgataatggccgcggtgaattagaggggcccggtcccctctctctcctaaggggtctggtttatataccaaaaag

SEQ ID NO: 68656 - DNA, 709 bp, Oryza sativa
agggaatttattccagagccaatacctaaaatgaaaattatagctctagacatcccaaagcggtataaattagtaggaaaatatgtccgtataatccaatgtatttgtagcaaaatgtatatgattacccagaaaattgtcacatcctgatttttgtttcaggatttctaaattatttaataaattattattagaatttatattaaatgttcattaattacaaagtgaagttaaatgtgggaaataaaatttcctaaatttaaagcatggatggatttaacttttattaaattctccatgattaagtatactctctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggaattattagaaatgatcttaaaagcctaaaagagaatatctaattttaatttgctaaatctcaatataaaattgggctagataaaattttgttaaatacttctcttgaatctttagttcctagatttttctgggatttatttgagccaagaaagtatttttaataaatggaattgcatttcatgaataatttaaattaaaaaaggtttttaaaagtctcttttggctttgggccgaaagccggccca

SEQ ID NO: 68657 - DNA, 1830 bp, Oryza sativa
  unsure (1)..(1830): unsure at all n locations
tgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgagcaatggtggctaacaaacgaggcaaattatcataagaagcttcaaatgtgccatacctcatctcaatgattttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacgaacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcncagggtacatgatcaccctctgatataacaagtccagagaagtcctcatttgcccaatcagtggccattacatcaccttcctcatcggatgatgcgtcgtcgtccacttcctcattatccgaatcttcccttttcattcatcaacaattataccgactctctccccctcatccgccatgcccatagcctgctcctcccttggttgattttcctcattttgcatcgatggtccaacaacatcccttgcattgataggacctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaattataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgc

SEQ ID NO: 68658 - DNA, 10183 bp, Oryza sativa
caagtgttcgatgaaatgccgcacaacggaagcccggtgtccgttactgtagtctgtacctatcatcaggtttttgagaaacatttccggggaaatacgtatgttgcaatcatccattgaatacattctgagccctatgagcccagctataatcctgcaggatactgctgcaacagggcagacagacagaggattctgctgcacagcagggagaaggtgtgggggaaaatacgaagaaagagtagtagcaggactagctgctaaggtgtcaagagaaaattcaaaacattcggggcctttatattttgttgatctttttttttctgtgctaatgggagcaaaaccagttaaaattcgtgcgtcttcaactatttcttacaccaatctacgtatcttcctcatactcctacctgcaaacagatgaacatgaagagattgggaggcacctagcttaataattgaattcagagcacaagctgagagcaaagggatccgggggttgttggttcagcacagctgcacaagtggacattaaaaatcagcaaaaaaagataaggttttgttcattgatcatatatgatcacaccaaattgtgtatgcgcgcagaagataacagaagcaacagccttaaatattacatgatgagaaatacattgcccagttcacataagatgtcttgggagcccaggctatgctacccgtcgcaacgggcgagttcgagcgccttctcgaggttggccacgacttccgaaatggctggccgctcctcccactgcagctgcaggcagcgagctgctatctgcgccaccagttccgccgcctccagctgcctcggcgttggctccggtgccggccgcctgtccagaaacttccacagctcccccgcctcgatcagtatcagcgccaaggacaccaagctttggtgaccaatcccgtcctgctctagccactcataccacctttgttttgttgttttcccatcttcttcactctcctccttgtcctcttctgtgttcttcctctcttgctgatcacattcttccctcttctcctcttccacacattcttctgtcttcttctccttccattcttcagagaaatatggtttcttccccgtcaatacctccagcatcacaacacccaaactgtagacatcgactgtcgggttcagagtgccatctataatgcactccggggccaagtatcccaaggtgccttgtacgagaagatcaaccacatggtccgggccttcccatgtgagtgccagctcgaagtccgttaagtgcggtgcccagcttatgtcgagcaggatattggacgtcttgatgtcacggtggatcaccggccgctcagcgtaggactgcaagtactcaatggccctcgacacacctagcagtatctcgatgtgcatcttccaggatgttatcactggcgacgacgaccgtgggccgtgcaggtggctgttaagggagccgttctccatatactcaaggacgagtaggatctcttccagctttttccgaaacggtggcaggagctggcgcttctccttcacacagctgccaaagacgcggacgatgtgctcgtgactaaaggaacggaggatgctgagctctcttatgaggtctattttccctatgcaaaagtaaatagtacggagcatgcgtttgatggccacctcgcgtccgtcgggaagcctacccacgtacaccgggaagtagccccttaaaccaatttttctgtcaggagaaaagttgttcgtcgccgttgcgagcttcttaaaagcagggttggaaatttcggccgtttcggtgggtcccgatagacatgagctccggtcaaaaatttcggcaaacactgttcatggtcaaaatccccaaattcacggtcaaaatccccaatttcccatcccctcctcacttaccaaaggcggctgctgcttcgctatcctcctgcagctcgcccagcaggcagcaggtcgccgtcctcccaagctagcgaacagcggcggcggcggtgaccggaaccgaaggcggcgggttggttggagtggccagcggcggcgctccacggcgcgacgacgacacaagccgcgtgggcctcgcgaggctggacttctggagtggccggcggcgtctctgcggctcttcagcaccacgacgacgacacaagccgcgggcctcgcatcctccgtttggctggagttgccgccggcggctccatcgctcttcggcagcacgacgacgaccggacgatgacacaagccgcactagccttgcatccttgcgtgtttcattctcttgttcctctgctttggatttaatagactcgatgcttatctatactctgatcttggtcaaatttctttcttttttattgtttaaattcaaattttgtttgagaatttcgtccgaaattaccgaaaatttcggaaatttcggaatttcggtgacccccgaaatttttccccttcccgataggttgaaccttggtcaaatttctttcttttttattgtttaaattcaaattttgtttgagaatttcgtccgaaatttcggaatttcggtgacccccgaaatttttccccttcccgataggttgaaccctgcttaaaagtgaattcttttactccatggatttctgtccgaacaaactttgtggcaacctagtatatcgatgaatacacatcggaaagaaaagaggaactgaataccaaatcaaaagagttgcagttggtagtagtacaagtacaaacaattgaatgcttgagtcttcccatttcaatgtatacctgagcggcagggactggatttgggggcacggggaaagcaggcgtagatggtccgggcgtgttggttggaagcaggatgttgtagatacgatcgagacgacgagtgatgtctatgtggctgatgaatgggaagacgaggaggtacgagtcgatcctgctctgaacatctctgaacctctcagcctgccgccctgccatcaccaacctgtacacggcgctcttgtcctggcacgacaacacaagctcgtgcgcctcccggagcgtgtcgtcgagcccggtcagcggccgccggatctcaggccgccgaagcacctccggatcctgcaggtgctgcagcagctcggcgatcgtgaagacgcggcgggcgagctgctcgcactccttcttgttctgttgagccgtcatcgcagcctgcatgatcatggagatgaggccgccgacgtccgccccgaccagctgcgccaccgtggccgcgtgccccgtcacgtcccacagtgcgatggcactaagatcaggattctgttctttgttcctaacaaacggatcgacaaattaaggtgaaatgcagaggacggctaccgcgtcttgaagacttgatcctcagcgtctctctgaccttgcttattttatgctctagttgcccccctttttttgtgagagagggggataaggacgttgcttgtttttgacacaaattatatgacggaatcatgcaactgcctctccgtctccggtaaataaaatatgtccaataagttcatgaagtggacgtgactacgacgtaaccgtacactggattgtcatgaccagcgacctcactctcagatcgggttgctactactacacccaacattgcatgtattttttttcttcttataaaattttctcttaaattactcatctgatttacgatctgttacaccgttgtgttcgtaacaattaagatcacacataatctgttacctaacccattgccatccctaggtgcaaaggtaaaaaaatagcccagagcagttacgtaatgctctcccctagtttagcaaatttaagcaacgtgccattgctctgaacttgcacaatcacaacagagcagagataaaaacggtatgaaattttccagctgtaccggtaccattttcgatgaaatagtaaaaaaataaaaatttagtttttctaatttgtatatgtgtcgtattgaagttattactaactagtttcataaatatagaaaaatcctgtctgcgccaataccattttcaaataaataatatcattatcgatagttgttatccctaaatgtttgttttgaacttgtaacaacagtacaacgcaatcaagaaaaacacatacaaagataaaatccatacccctatccctatgccagtttatttcgatcaatttgactttgagcaaacctgatgatagagctttagtgaaaatcacagcaagcccaagccatcaaagacggtccactacagacatatgcatctcaaattgggctgaaaaatgggcccacgtaaaaaacatatttatagggccggcccatactaccgcacgtcaaccgcgaccccgtttccgcccagcgattcgtctccactagaacagaatccctcgacgacgacgaggccgcggcggcggtgccaacagcggagcagtcgagcagatagtgcaagcagtctcgcgccacgccactcccgaccatggcatgctgtcgcctcgagcgctcttgaaagagagaaggagcgaaaagttcaactcgccggagaggctatggtatactactggtatgattggtctttgagctccaagtgttcgatgaaatgtcccgctaaggaagcccagtgtccgttactgttatcaggtttttgagaaacatttccgggaaaatacgtcagttgcaatcatccattgaatacattctgagctttatgaacccagctttagtcctgtaggatactgctgcaacaggccagacagacagaggattctgctgcacagacatgcatgagattcttagttttaagagcagggagaaggtgtggggaaaatacgaagaaagagcagtagcaagagctgacaaggtgtcaagagaaaattcggaacacattcagagcctttatattctcttgattgattttttttttgtgctactgggagcaaaactagttaaaattcgtgcgtcttcaactacttcttacaccaatcgtcgtatcttcctcatacgacaggaagagattaacagatgaacaggaagagattgggaggcacctatcttaacaattgaattcacagcacaagctgagagcaagggatccgggggttgttggttcagcacagctgcacaagtgggcattataaatcagcaaagaagataaggttttgttcgttgatcacatgatcacaccacattggtatgtttaattgtgtatgcgcacagaaaaggagaggagaagcaacagcgttaattattacatgatgagaaatacattgcccaattattcacataagatgtctcgggagcctaggctatgctacccatcgcatcgggcgagctcgagcgccgtctcgaggttggccacgacttccaaaatggccggccgctcctcccactgcagccgcaggcagcgggcagccgtgtgcgccaccagttccaccgcttgcagctgcctcggcgttggctctgctgatggccgcctgtccagcaccttccgtagattaccctcctcaatcagtggcagcgcgaaggacaccaagtccctcctctttttcaaatcctcgtggagtttttgcgtcgtgtcctctttctcccattcttctctcttctgcgcctcttcttcacactcttctctcttgtcttctctcttcttctcctccgactcttcttcaaagaaatgtggtttcttccccgtcaataactcaagcatcacaacaccgaaaccgtagatatcgactgacgggttcagaatgcctgtcataacgtactccggtgccgcgtatccgtacgtgccaacaaccgtatcctcatggcctgggccttcccaggtgagcgccaacccgaagtccgtcaagcgcggcacccagttgccatcgaggaggatgttggacggcttgatgtcacggtggataatcggctgctcaccgcagtactgcaggtactcgatggcctgcgacacacctagcagtatttccatgcgtgtcttccaggacgccatcactggcgacgacgacgacgacgacgttgggccgtgcaggtggtgatccagcgagccgttctccatgtactcatagacaagcagatgctctttctccttttccttccggaacggtggcaggaggcgccgctgcttctcctcgaccaacacatcacagtagccatatagtggaacaatgtgcttgtagcggatgggggagaggattgtgatctctgccatgaactccttgtaaccctgaagtgagttccgactacggtgcttgatggcgaccacccgctcatcaggaagccttcccatgtacaccgagccgaagctaccttcaccgatctttctttcaggggcaaagttcttggtcgcctttgcgagctccttaaaattaaactcttggactctatggggttccttccagttccaacagatcttagcagtatcctagtatagagaaatgcacataatggaagaatggtaaaattagagctgagttctaacttctaagcttccctttgaagccaagtacaaagtgcaattgaaagtttgaggatatatatactccctccatcccattttaagtgcagccatgatttttccatgcccaactttcatcattcatcttatttaaaatttttttgaaaaaattttaaaacataagtcacgagtaaaatactattcatattttattatctcgtaacaacaaaaatactaattataaaattttttcaaataagacggacgatcaaagttgagcagagggagtattatatatgtatgcatttcaatgtgtacctgggaggctgggacagggatttggggcatggagacaggagacatagatggcccggccatgtcgttcggaagcaggatgttgtaaattcgatcgagacggcgagtgatgtccatgtggctaataactggaaagaggaggaggtaggagtcgatcctgctctgaacatccctgaacttttcagcctgcctcccggccatcaccaacctgtacacggcgctcttgtcctggcacgacaacacaagctcgtgcgcctcccggagcgtgtcgtcgagcccggtcagcggccgccggatctcaggccgccgcagcacctccggatcctgcaggtgctgcagcagctcggcgatggtgaagacgcggcgggcgagctgctcgcactccttcttgttctgctgagccgtcatcgccgcctgcatgatcatggtgatgaggccgccgatgtccgccccgaccagctgcgccaccgtcgccgcttgccccaacccaccccacagcgccatggcagtatctcaagttctcaactctcgggaggattgtgttcttgctaccaaattttcgcggaattatggatggacaaagggtcggtccagggaaggagatgactgacgcggtgagaggaattttcctggaagtgggttggtgtggactgtgaaatgattttttttttctttaaggccgacaaaagctttgggtttgtgtatatataagagagaaagcaacgagtggaatgaattatattttttttaacagtctcacacagccacagctcagagtttagacttcaaagtacgtccctgtccagttagaggggtaaaaagttttggcgtgttatataggatatacatacacatttaaaatattaaacgtagactaataattaaacggaatgtgaaggagatttattttacacatattatgatgtggatatactccctctcaatccccttcatttctccttgcttagggattaaacgaccaaggccttagttgtatatatggtgaaaatcaattatgaaatgagaagaaaaatcatccccaactgatctatcttcttctacttctgttcttcttcttcctcacgtgtcgttccaagtccacccgattcccgcgaaccacgccgccggcgattgggtcgtgacacgcacacgcctttagttagttggagtttaacgcggagacacttgaagttgaagaagcaaagcgcgtgtggctattttgattacttaattaggcaaatgattttatcgtctagtgctgagttactgacacagtgatccgaaagccagcgaagcaccagaatatattactcccaccatttcagaatgtttgacaccgttgactttctagcatatgcttaaccattcgtcttattaaaaaaattatgaaatatgtaaaactatatgtgtatatgaaaatatatttaacaatgaatcaaatgatatgaaaaaaataaatatgtaaaactatatgtgtatatgaaaatatatttaacaatgaatcaaatgatatgaaaaaaataaataaataattaattttttttataagacgaatggtcaagcatatgctagaaagtcaacggtgtcaaatattttgaaacggagggagtattatatcgacctgatgacctccatccctgatcaccttgtgtcaccaatattcttccgagttgcgagagatggcgatgtggggcgggctggggcaagcggcgacggtggcgcagctggtcggggcggacgtcggtggcctcatctccacgatcatccaggcggctggcacggctcggcagaacaagaaaaagtgcgagcagctggcacgccgcgtcttgaattcttgatgatcgccgagctgctgccacacctgcaggatccggaggtgatgcggcggccggaagtccggcggccactggccgggctcgaggacacgctccgggaggcgcacgagctcgtcgcgtcctgccaggagagcagcgcggcgtaccggctggtgatggccggacggcaggccgagaggttcagagatgttgagagcagcatcgattgttacctcctcgtcttccccttcatcagccacatcgaggtcacccgtcgactggatctcatccacaacatcctcgttccaaacgacacgacggtgccaccatctccatcagtaggctcctcgactcatgacctggtacgaattgttgctcgagtactgtacgaattgaatggcatatatccagtcatttgcagatcgagaagctttctttgttgaagagaagcttattagcaaactaactaccctctgtgacaggtatttgtagatgtcgttagaaaggtggcatcccatggaaagggaggcgaggtgttcaccctggtggagctggcggcggcgaccaacaacttcgccgctgacagagagattggttatggcagcttcggcactgtgtacaagggaacctttcccgacgggagaaaggtggccatcaagcacgaaggcgcggactcagtgcaggggcaccgggacgcgttcctatcagaggtcgacatcctccccacccttcgccacaggcacatcatacgcctcttgggctggtgcgtggccgagaaggagaactcgctcgtctacgagtacatgaagaacggctcgcttcacgaccatctgcacggtggtgctccatcgtcttcatcaccctctccggtgacaacttcgtggaggaagcacatggagatactgctgggcatttcgcgggccatagagtacctccactcgcacgccgtaacgccggtgatccaccgcgacgacaaggcgagcaacatcctactcgacgacacctgggcgccacgcttggcagatttcggtttgtcactcaaaatctcatgggacgatataaagtgtagaaatgcccccgtcatgggcacctctcgatatgccgacccggagtacattagcaccgggagattgacgttggccatggatgtctacagcttcggcgttgtgatgctggagatgttgacggggaagacggcggcggggcttgtttcgaacaacaagaacagcttggtgtcgtttgcgctgccaaagatcgaggccaagaaactcgaggaagtgctggataggcgcccggcgcagaagccgacagcgaggcagctccaggccacggacctcgtggcggcgacggcggcgcgatgcctgtgtcttcaggggaagaaacgaccggctatttcggaagtcgtggccgaacttacactggtggagaaaccatctttcgtcggtcggccgatttccacaatagtcccggatacaataaaaaccggggctaaagatgatctttagtcccggttcaaaagggtaacgggcatatttgatctttagtcccggtttgtgttaccaaccgggactaaagagggctgcagg

SEQ ID NO: 68659 - DNA, 2636 bp, Oryza sativa
acctttagtcccggttggtaacaccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttattgaattacatacaaatcagaggtgcctaaaaggtttgcaacttcatcctccaaagtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataatatttgtgtagggtttttttgactcatgtagatggatcggcaatggatgtacgctgaccgcgggtccaaagagattattgacggcgtgcattattttttgagagtggccgaagctaccaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggggaggaggaaatagctgctgatggtaacgacgttgcggatgatcttggtcagatgttgcagaacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgaaacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccccccggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaatagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggggagcataaaggtaccgtctggatactccacgaatatcaagcgaataataagcacgaaggagaagaagttcacaaactaaagtctcat

SEQ ID NO: 68660 - DNA, 1171 bp, Oryza sativa
attagcaaatgtttactgtagcatcacattgtcaaattatggtgcaattaggctcaaaagattcatctcgcaatttacatgcaaactgtgcaattgattttttttcatccacatttaatgctctattgtgtccaaatatttgatgtgacatttttggccaaaaatttttgggatcttaacacacccttagtgagatggtcccttgcttgtatttttggaaaacaaaataggaccatgaggggacttcaaagggtctgaaatggcatctttcctacacctattcaattgcttttatcttgtataagatgccattgattcagacctgaaaagacagcagcacatgggctgaggaggggttggtcgaccccttggttcggccgaaccaagggtggctcttcccttgttggcagttgctaagcaccaatttcgaccgtcaatatactcaataaataaaaggaaactagcatttcttatacacatattagttacaaataatgttgttccacttgtccttggagaatattatggatacagggattattgttaacgaccaaatttggtaatatcggcatcggagatgaagatgggatctaagcgaaatcgaagataagggtgttgtggaaacagagcaagaatcggctgcaatctaaatcggctacggttaggatcggcagagttcgagtcggacggggctagccgatacagccgattccggcaatacgatttggtgtatgtcatcgggttgagttaatatgcttcatggtggttgccacgcaaggatagagtcctgagaaggcaactgtatctattaattaggatattttatgtaatttccttaaaatatgtttgggcaaaagtctgccgtaaagacttatggtattttagagtttgttagagataatagtcgtgtccgagatggatatatcttgtaattctcgggtataaatagaccctgagcctcatgtaaaaaaagggacacacattcaatacaatttcggcgcatcgccacccttttgcttttgttttatttcgacgagttcttgctttcgggttgagctgcatcggttttaatctttaacaaaaggtaaagcttgttatggcggtttgcattctcgggattagtgcttccatttttatgacactctaattttgttcatgtaatccgtcgagt

SEQ ID NO: 68661 - DNA, 25672 bp, Oryza sativa
  unsure (1)..(25672): unsure at all n locations
gattaggttagatattgacgttgatttaggttatataggatatctaccactctatgaatttccagcggcttgattgtctagatattgttcttcttttcatactaaatgctgcatcagttgagtntgatctattaagtcgtgcttagaacttcaatctctagcttgtcttctggttgccgattagggtagtatcggagtttcagccaatcttacctgatttaactacttttatcctatatgcttgattgatatgttaaatctgccctttatgttaagatcttgttgcatttaagtatattaggcttctgcttgatgtattctgcttgctttaatatcttaatatagagtagtatcggagtattagccgatacatgctagatctatctgatcggctatgctataaatgtatctagtcccattattaatatatatttcgatctaagtgatttatactgtctcggcatggcgtccgatctatcccaatcacttgatttaagtatatatcgatatagggagtatatattgttaatatctacagccgatcgagtaggtttagtttctccttatctattcacaactgccgatcgatgtacatatgacatcggctcaaagataaatgatatgtcatcggcacttagccgatcggctatcgtttatagatttaattacggtttctttgttgttatttcttgttgattgcaggatcaaatcaactggcacgctcatacatccgaaggcgagttttggacctgcactggagttaagcagatctcccaggcctcgtgttttctgtcaacaattatacaataaagtgaaggagaaaatgcaccagcatgtaagtaaacacacctccagcgaatcacgtgaaagcacacggattgaagggcccacaagtcaaataaaaccgacataatttgggctaatccattgtgcaccatcctaggggcctacttgtcagcctcgagagagaaggtcggtggagaaaggcggttgccttggttcagctgaaccaagggtcagccgaaccaggctcagcccctctcacctccaccttccacgtggcagctcctggttggtccctgatagcggttatgggtgcaccgacctctacaaccgtcattggagactataaaaagattatacattctcacttcacaacacacactcaaggagcaattctctctagtattagtagagttaggcttagtcttcggtttcctagtcttctcggagattcggatatctttttagtattttactctatttgtaagactatgagcttaataaagaatgtatcttctttaattattaatgtttatagttctactactttattagttatgtattctatgactagtttatacttcgtttacatgcttcacttgattaggctagtcaatctatgccacggtatttgttaaatgatcttaatgtgttgcactagttctaacttgtctatccgaagggtgggagtcccagataaattagtgatattttttagcaatgtaagcatgatacttagattgattaaatactgttgggtgcggggtgtgccccacggaaaatagaggcaagcgacaggtgctaacagccctgtccgtctttcgtatttctccatgtttgggtatgacgtaagagttcgtaaaatgccataaccatgctagcagaccagtagggaatggtctctcggtggttcttgggcgcctagaactaaatcctagccttgtaagcatgtatatgttaagtatagtctaaagcattataaatattgaaatgcatatgaaacttagctctctttcgtccttttccacaatctagtgtattcttattacagttgaatcttttgtgtaccacaatacccatactagactatggtatattacccataccatgattatgaatatagtggctcaagtctttacaccgccaccttccctacgggaaaacagataacgatacccttggaatactctcgggtgaaaagctacagtggtattgttgatgcgaaaacacgcgcggcctgagagatctgcttagctccaatgcaggtccaaggcttacctcgagtgctaacggcgtgccagctgatttgatcctgcaatcaacaaggaaacaaaagaggggagattagtcaaccgatagccaatcggccggtacgccgacagcgtatcgttggtggtccccagccgattggatcggctatggacgggatatatcaaagaatatgcatgctctaagaatgccctctcggctaatgcactgtccgcagagataaaaacatatgagctcaagacaaagcttgcaaggacagccgataaagtaaatacagagcaaaaagataacgtaccagctcgtaccctggcacatacctatacaggcgagccaagctatagcaaggcgccgagattgaaccgatggtcgaattagcggccctagccgatacgatgcagtctcgatgccaagctatagcgaagcccatctatataggtggcggatacacatgtaacgatctaagaaacaagcatatcaggtaagatcggctgaaaccccgatactatctctaattatgaataattccatgttagtttccagggttctaaacacgactagggatgatgcatctcaaaatatgtaaataaacctaaagtctaaacaatcaaggaattaaacacttttcaagatggtagatgacttagctaatctaatctagtaagacgatttagccgataccggcagaaaccctaaagcgagagacagccgatagagctaaatcgagatactaagattagattaactaaggcatatgataatgatggtcatgataaaagaactaaaacatctaaagtgatgtaatagccccgatagcacaagccatcgagacgggttacctcttgcggagagaactcaccgaaaacaagaaaagtaaaaagggtggcgatgcgccaaagttgtattggattgtctcccgtattacagtgctagtgggttaatatttatacactgagtacaaggtaagtccgttatggacacgactcaaaccttctaaactctagatacaaacaagactatttacagcggtctctgaccaaaactgaccaaaccgacgtaactaacctaattaatatatacaactgccttcaatgagctctatctctatttggcaataacggttattccaaaattgggtccgtgccgagcccgagttgcattatgatggctggttcatttatcagccgactcggctggtcctggtcgctggcttctgttctcggccgatgcaatcccttgccgtcgcatagttaaactcgagtcccagcatatttcggtatcaaatctatcctgattttcttcttccttcctgagtttttgttgctaaatttcaccgttaacaggtatccgtgcacttgtggatttatctatgaccgtatcaaatatactctccgaaggttcaaaaggagaaacgaccgtcacttcttcgattggctcggattcggggagaggttccgtcaaagaatttttcaatcgtgagatcaggacgaaaaaaagtcactctctagttttatgtcgaggactcttgctgttggtgcatctagaagaagttttcctaattgatagccaatcagaagatcgaagtcatggacttcgaacatgtgaaagtctaggatggcctcgatattattgtgccttacaggcactccacatagaatcccacaaccttcaataatagaacctaaggcactccggaagattttatctatgcgtactaacggttcatcccctaagcaagtaaatgcaaaggttgcggatatgatgttggcaccgacaatgggattgtagagaactttcaccatatcctttttcacgagataatgcatagttgaggatgaggagctaatccgcatggcttcaggagaaagctcaacctcccttaaccactcatcgcttatgatagtaattaattctctcaccgtctctttgaggaaactttcctcgagcggattagagggactactcgggataggtggtctcttttgacacaaatagtccgaggtgtttccataatcttcaaaaagatcatcctcgaactagaaagggatttccgaaggctgaatttcttcttcctccaattcccgaggttcgggtgagggctcaaaggttgaatcttgcgatgtggagggtatatgctccgattcaaaggttgagggctcctcatgtgtatactcgatttcctagatggttttgcagtggacgaaaggggtgttcttcaggatgtgatccaagaacttcctttcttttgccatggtttttttgtgcgaatgaacctcctgcagaaatatcgagatacgaggcagactctttgtttagacccaaatagaagtgttgtaacaacacatgattgggtatagacaagtctgggccgaattgagttaataatgagaacctagcccaggctgctccaatggattccttctcactttgttgaaagccgagaacctccatacatagagagacaacacattgtaacggaaagaaagtaaggtagaacctgtttttgacttttgtccgttcactatgtgtctttcaaacggtatgggtgtaccattacttcgccccctctataagagagaagagaaataactcccactttaaggtttcttgtgtcagacacaagcacaattgctcgaactcacgctgatgatggtagaaattttcgttatcgcgtcccaagagggattgctcctaaaccatggctacaaagcgaggacagagttcatggccagatgagaagatggattttgaagagggtgatggctcacaaaactcgcccttagaagcgaaatttttttgaatagatagctactccatggtagagaagaatagaaatgaagaagataaaaaaatacgaggatgaaccaaattcgaagataatacatagcaaccgttccccgagaacggcgtcataaatacttattggtatttgatactatcacagataaatccgtaagcgcacggataccgctgtagcacttcacctcaaagtatttcaaaggtatcgaatcacatggaacatgtgtgtaaaatgtaagaaacaagattcaaccaagaacaacaactaatggaaggcttaggatagggatgatttctatgggttttaaagttcttaattaagttaaggtaaaacactatcagttgattcgggcaccggttcacccctggtctgccaagagactccggcctatagctccatgatatacccaaacatagaggattacaaaggatggacatggctgtcactacctatcacatacctctacaagcacacaacaatcgaaggtaacctctaacctagacaccacgtatatgttattgaggagtactactttagccttgcgcagaaactttcttctttatccagagtcttagtactagagcacccaatacaagtatcaagcgacgagcccgcaatgatgagaatatatcttacttaaataagaaaactaaatacgcgaaagaaattatgaatacttacttatataaaagcattagccgaggtacgatagtggagagagtgttgacaaccccggcactcctccagactcccctaaaaagaaagccaacatctccggcacttctccggaacatcctcggagagaatgccgacatctgaggtactccttccggagcttctcctcattctcttcctatattctaactctactagagagtaacctaaatatgaaagtaagttgtagtccactttgttgtgtgtctcttgagagtaaagtgagagctccttttataggcatcctatgatggtagttaagtcgattaacacccctaatcgccattgggagccaatcatgtagtgccacgtggaaggcggtggcgaggggtgcaacccctggttcggccgaaccagggaaactgcttttgttcaccgaccttccctgggagactatcaggtgggcccttatgacggtgcacggtggataggctcaattatgttggttttgctctaatttgtggtccctccaatccgtatactcgcgtctgattggccggaggtatatttcttcgcatgacgtgtggttttcgtccaaaatcacctgcatacaaatatttatcaaacttgtgagaatgattagtaatactccctccgggttgataatacttgtcgttttggataatggtaaagtcaaactttaaaatttttaactacaaataatttttaaaatatttatcttaaaaatatgaaaaccatatgtgtagattagtcttaaaaagtacttcaataaaatcatatattttttgatatttctatatatattataatagaaaatagtcatcaaagttacttttgggagaccgtgcccttgtccaaaacgacaagtattattaacccggagggagtaaccactactattaagtttgatgttttacttcatttgcttttatgtgggaattgactgttagatttggtatttaaggaccgtcaacactgatccagggattgatacagggaaacataataggttttggtttccgaaatcggggactgacacaggcgatgcgacgcacgaccctcatggaccggcgcaccgcagctccacttgtcacagccttcctctttggtggcatcttgttagtgtggagggcttgagagtttgcgttcgataccccacgaacggcgccaatgttagaacaaaatccaacagttatcgaacgagacaaagtgtgtatctaataccggtattatattctttcttctgccccctctctgaggggcaggctacatatttatgtgggccagtgtttcggggcaacccgggtggccgacaagtgacccccaccttcgggattaatcagtaaaatcctaggcaaccgggataggtgatccattaaagcttgagccagcccaatctcgtagatcccgggatcgccatcgtgtacatgctcccgtgatccatggccttgactgcagcccctccactacccgacccagagcaggtggctagggcagtggcggagccagcgacgaaaacctgtggggtcaaatctataaaattctttaagttttatattgttgcaatgtaaatatcagtagtttttagactattttgcaaaaacctgaccccacagattatacctagctccgccactgggctagggtaggtggggggtggctaattagcgcacgcatgctagcaacattgctggcgtgccctcctcccttgcgtgattttttattttttttgctatttttttttcacgctcgccagctggcgcaccctcctccctcgcgcgatttttttcttttttttcgtgatttttttcactttccttttttttaatcttcaacacacgtgttttcaaatgttttgagttgaaaattttaaatcttgacttgaaaattttcaaatcttaacttaaaaattttcaaatctccagttgaaagtttttaaatctgagttgaaagtttttaaatctaaaaaaagttttaaatctcgagttgaaagttttcaaatctcgaattgaaaattttcaaataccgagttaaaagttttcaaatctaggtcgaaagttttcaaattttgacttcaaaaaattcaaatttcgagttaaaagttttcaaatctggattgaaagttttcagaatttgacttcacgtataaatttcttttgtatctattactgaaaaaaatctttagaaaaaaaatcttattttaattatcatcattatcttaacggattagttagtataggtgtgggccggaaattacgctccggggggcgcatacgcccgagagaggaatctcgagagttggtgaggggtattaatgctcacgtccaatcatcataatcctcgcgtggaaggggcggcaacctccggaggctgggaaaccttacggaggctggccctccctctccatcctgcatcagactgtaacggaatattccttcaggcttactcagcagacgatgagacgagctcactataggaggacttgaagtcagtgggtcaatgggcttcggcgacgcggtgcttagctagtttggttgcttgcttcccacggttccgtgagaaaatttgcaaattgttgagagggacagacagggacgattgctgaactagacagtagacagacaggagggaggaagattattctacgacttaatcttaaccgtttctcttgtcaatttggatgatagcagcaatacatatcagagcttttatacctaattaaactagcaatgattaaggtcttaattgctaaatttcttagaccaccgtatacttagaccaccgtatagttaatcatgtgcttgtctatacctataccatcagtggcggatttagaaagaaatagcagtgggatctaaacaaattagatagagttatagtccccctcccatatacatatggtaaaaaatttcagtgggatcttcgtgtggattctcatagtcttcacgtcagaaatgagggctccagaccccgccggccccatgctagatctgcccctgtataccatgcttatacataagctgctatgattttggtggcgtaggcacacagcgcttaaccgctcaacggcatagatcatctcaattaaggtcaaccagggcatctgactgtaataaagataattgtatggtctactctctccattcgtttattataagataatttttaagtttgatcaaacttttaacaaaatataacaacatctgtaacaccaaatttgtgtcattaaatctaccatttaatataatttttataatatacttgttttattttgtaattgttgttatattttttctataaatatggttaaacttaaagaagtttaacttataacaaaatcaaaacgtcttattgtgaaatggagggactagtacgcaaaacatcccttagctgctacataaccgcacaaactcgatcacacggtcatgtgaggcctgagtaggatcgtaactgatagttgcgatcctgagggcttgttttgtgagatgatatgtgaggaggggagactctcctggacatacgcgaacgaggattggtgtgatcgaagcttccaaattatggtacgttctaaacaactaatagagttatagattatttgtggcacgcttctaaaaatatgatttcttccaaaacttttctacatattatccagttagaacgcgccctaagtgtgatgctgttttaacgaagcaatcatcacccatttacacggataatttagtttgagtaattagtatttggagaaacatctgtatttaagaaaaagtgagcaacacgaaagatctatttttttccccgtcttgggctaatgggatgccagcggttgaagtctctgagatatgcaggaacaatttagctctccagtttgttcgggttaaagaaaaaaaggaataggccatgctttcagagtttcagatgcaaaccatcaagtcaatgcagtgatgccaaattcagtagtgccgtatatgatgggcgtgggaccgtgggcgacgactaattaggtgcgtccgccgcgttcttgtcttgttcaggaggttggaattttttgctgcttgtcaaattcattgaccacaagtctccaactcaacatcatcctcagggtgtgtttagtttacgtcaaaattgaaagtttggttaaaattgtaacgatgtaacagaaaagttgaaagtttgtgtgtgtaggaaagttttgatgtgatggaaaagttggaagtttgaaaaaaaaaattgtaactaaactcggcctcagagttaaaacacaaattaaacatgatccaaaaacatcaagtaaacagaaatataattcgtctgataatatcgatcgggagcatataaacttcattcaaactttattattattactactcgctcatgcagagcgtctgaagatcatgcagaattacagaatgaagcaaacatgatggactcaactcgactacacagacatgcagaacacagcattacagtacacacagactcgatcacactgaaactgcttattattaagatgaagctaggaatgggcggatatatatccaatttgaattgaatccgatcatgaaattaaatgcagttcagatgatatccaacccaattccgttgcaacccgaatgcatgatgtggaaatccatgtgttatgtgtatcatcacgtagtccatggatttccggatacccaaatatgcgataaaatgaaagcttgacctgttcggggaatcatgcagtacccttggtacttgatctcgatcggtgctcgccgccgtggcgattctttgggtgtcgccgcggcggcggcgccgtcgtcgtcatcactggtggtgatggatcaagcacgagctgcgcctgcgcagctgccggagcttagatgcttgcatggcttcctccgtgcacgcgcgcgtggatcacatcacggagcaggaggtgggatcctcctccatggagtggacaaggtagtaagggaagacggcgccggtgggggtgcatggctgcggctgcggcggtggcccggccgccttcttgcctttcctccgtttgccgcccttccctccgttctgcttgtgctgctgcccgcccttgttacctttgttgccgctcttgccggcgttgatctccctctgctccgaagattggtcagctcaatcggctaaagaggaaaaaaaaaaaaacaaggagtaattttgatgagccatgtatcttactggattgtttgtgcggcggtgatcgcccccaccagcggcgacggcgaggtggcggtccatcttcttctgtaggtgggcaacgttgacggcctggagggcgatgaggcagttgttgatcctactgttgacgtcatcgagcttggcggcgagcccgtcgctggccacgaacctgtggagcctgaagagcagaccgtccctgctcctgccgcaggactcgacgagcttgagcgcgtcgtcgagggcgtccttgagacggcccagaatcttccgcgtcgtcgccgccgcgtctcccatggccaccttcttgtactccctcaggatgtcgtcgacttccttcacgcgctgggctagctcccggcacctggtcttgttccggcgagccgtcttcactgccttggcgatcgccgaagccaccttcggcaccgcgcccacgatgctgcccaccggctccatctttgaggttgttgatcacccggggctgcttgctttgctttctctaacgttgcggtactgctcttgcaagaagaggaagtgtggccactctacttatcgtggaggccattgacggctggccaaacggatctagtgctacgatgcgaacggtgagccgtactatcttatatcatattcacgtgaggacaatgctttgaaactatgggcctgtctagattccatcccagaattttataccctatcacattgaacatttgaacacctacataaagtattaaatatagactaaaaaaataactaattacacagattgcgactactttgcgagacgaatcttttaagtctaattgctccatgatttgataatgtggtgctacagtaaacatgtgctaatgacagattaattagtcttaataaattcgtctcgcgatttactgatgggtactgtaattaattttttattagtgccccaacaccctatgcgacatcctatataatatctgatgtgatacgtcaaaactttataccctaggtctaaacccgtgttcttggatcacaattgaacggatatgattcatgttcaaggagagcgtggtactatactgtaacggaatattcctctgtccactccgcgggtgagctttcacgacgcggtgattagtttggctagctgcttccctgcagtttcgtgagagcatcttcgtcagaattgccaaaccactccaagccaaaattgagcaaatgtgagaaaaaatactctccaactggctctataagtatgcgtttggttcatggaaggttggatgggatatcacagttcatattttattggatatggcgatctttttttttttaagtgaatatgacgatccagttttttttatttggttatagggatgaaggtagatctggtgatgcaattttttgtttggttggaggaagtagggtggatttgcaggtgtagtcacctctcacttgagacggtgaatatacccccatcaaattaatacataacacaaatcataaattctccaacaattttacaccactacctccattataaatacacatagaaaaaagaaaaaagaaaaagaaaaaaggaaaaaaagaaaagaaaaaagcagggtggatctaggggctcagcgccgccgcctactcctcctcccactagctgctgttgctcgcttcctcccgccgatgtggcactcgccgcccgcatcgtcgttgttgtcaccgggttcgcatcgtcaccgttcaccggccgggctcacatcgtcatcgtcgtcgccgcggtgctcatctcccgcgccggatctccgagctcaccgccactccctcctcccgccgacggggcgctcgccacccacaccggccgcagcgcatcatcgtcgccatcactaggcactcatcggcattgtcgtcatcagccggctcgcatcgtcatcgtcgtcgccccctctctctccatggaggtgacgcgaccgctcgccccactcgtccggtcgctcgggcggctgcatccgggtgatttggctagagccagccatccggcatgtgaggagaatattctcctccgggccgccatatcccgtctccgcccaccaaccaaacacctaaaaaaacgggctgccatgtcctatccacccaaatcctcccatccaaacacaccctaagccatccaactagccaaaatacacccaaacacaccctaagccatccaactagccaaaatacaccactggctggccaaatctggccagccgctggctagcccatcctagggttcaatattttttattgggggtaccaatatggtccaaaataatttgattttttcacaaaactatgatggtagcccgcgtattcgactcctctgacttcgcacgcgaacagtagaggcgcacagtaaaatgagtctagcgctacagtgtgaaacaccacctctatttaaacagtggaaaacagtaaaaaatcgctggtttgatgtactgttcactattactgtgctacactgtagcgattgatcttgatcgtcgattattcatcggacggctgagacccatgtgaagtcggtactgtgcttctctgacttcacatccgatttggtagcccgcacatatgcgtaggcaccttacttaatttgtgtgaaattttattatgaatgtctatgtacaggtagttttctatcaaaaatattatttttctttatcctaaactaaaactaaacttttttaacatgctttgaactttggtttgcacagtgcaatataagtcccatggcggtttgcacgtcggttttagctgacgtagcgcctatgtggctagtttgactcggtctttatcccacgtggtattgacatgtcgcttacatggcaatctaatcttaaaaaataataatcgtgggcccacatgtcagttacaatgaaaaaataattaaaaatagtggggcccacgtgtcattactccagtgacaggttgttgcaaagcaacctgtggaatagggcgaggcgtgagccttatcccagaactaaaacttgatacattagagttttgcagctaaattatttaaaggtcttgggtttttcaaatgaaaccctaccactccttgtttttagccttgcatgtcatatttttttcatggcttgctgagtacactgagtactcacccttacttatatttatatttatagagttagaggaagtataccttgacccttctgtcgaggcctactttcaggagcaagtcgagtacgatttctcggggtttcaagcctagttcccaaacatagcctgtggatttacggttgtcatcctgtttctagtgctttcctttccatgtttccctccactgcttttatgcttccacctatgtgtaccttatctttccagtgttcctaccagtctggggtttgtccacgacggtagtagtttgagacctccttgtaataaagctttgttatttctaaatttcactattattctatgagtaccagcttgtatattctgggactggtactgtaaacacagttaatgttgtgaccttcagcctatgccggtttgtattcttgattggcatagtttggggtgccacagagcccaagcaaagaagcacgggtgtcataaatttcggctcatctgagccgaacagggcagaccaaatggccgacagatatcccaaagtggttcggagtggaaaggtattttgtacaccccaggtgccatagcacctggtatatgcatatggtttaaatagttatatggaaaattcataaattttgacaagataaattacgttaatataagacactatacaatgcaagtcatttacacatgaagaaacaaaaatagcaaattttatctacgctttacatgtacaattcattgcctgattttattagttttgtttctctagttgtacatgaaattgagtcttttatgtttatctatagatttatatcatctatctattatattattaaaacagctttgaaaggaggcatcacgttcgctgtgaggctagaaattttcatattaattagagaaaaagagaaaactttacaccgttagatcgtagttgtctaaattttaagggctaagatttaatagaaatatacgtagaagttttaatatggcctttagaatcagatacggatacgtgtgttatagaaattggccagcatgcagctagctagacttttcttaccaaactagcactaggaaacaaaattgcaataggaatctagggaaaaaaactatgtccgtgtatgattttgtatccgattgctatggtggctagctaaaaaaaaagagatactacaaagcaatcaagtttctcatctgccgtctccaacaaaataacaaagaaataggagccagagaaagagaaggtatgacatagacgagagaaatagatatatttgatggctggtccatttgttcaattacctcggataactctttgtactctacttctgctataagcgatagaaatttccacattaaaccaaaaaaataattgttcaagtaaaaatacaatttaaaagtaactaaaattcggaattagaaataagcaatattgaaaggagagtctatataagaatccaatatgagattaattaaaatttcaaataaaaataaaataaaatcagaaatttaaaaaaacaaaagaagagttcaagtagtaaaaataactaaaatttggaattaaatataagcaatattaaaagaagagtccaaataagaacccaacacgagagtaattgaaatttaaaataaaaacatgaaaaatacaaaaataaaatgagagtggaatacattatataaataactaaaattcgtaataaaaaaaataaaaagtattgaaagaagacaccatctagagagattaattaaaaaacggaataagaaataaaataaattctaaaatataaaaataattataagaattcaagtaggaatcaatttataaataaaaaatatcggaatgaaaaatatggaattttcaaaaaaaaaggccatttagaacactgcgatgacaaatacaataaagaggagagaaaacaataagcctgtaaaggaatagagtggtggtggttgatgggacatcaaaaactataaaaaaaacccgaaatagaatcacaatgacaattaagaggagggacgacggcatgccattaagaaacatggttacggcagtcggcgagacttatagaaagtaaaaaataaaccccaatgataatcatgttcgattttaaaaatctttgtgggtgggccgtagatgagtacagtggcgaagccgctaacgttttggtgggacttagtaaaaaggaacacaaacaataattatgtttattttttaaatcccaatgataacaaagagaggatgcggcggacgggccgtagtggagtacattggcgacgtttgacgggacttctaaaaattataaaaacgaaacccaacgagacaatgaaatctgaaaactacaaggtctaattttcaaagttataaagaggataaataaaagtagtgatagatcgagcaatcaaatataggggtgacagaggagtaagggtggcgactgacgtgacttttaaaaacttcaaaattagaaacacgggaatgataaattttaaataaaatcatatgtaaaaaacaaataattttatactggtgctagccgcgtaattgcgcgggccacccaactagaaaaataattataagagttaaagcaggaatatattttataaataaaacaatatcggaaagaaaaatatggaatttccaaacaaagaaatttcatctagaaaacagatgacaaatgacaataaagatgggagaagcagcaggccagtaatggagtagagtggtaacggttgatggggcatctcaaaactattaagaaagccccaaatagaatcccaatgattattgaaagtaggaaaaacggacatgtcgttaagcaacacagtcaaggcggttggcgggacttctaaaaagtaaaaaataaagaggggaggcagcggcgaggcgtagaggagtacagtggcaaagccaatgataatttggcgggacttctagaaagtaaaaaatgaataccaacgataattatgtttgatttaaatctcaatgacaataaagagatgaggcaacggacgggttataaagaagtacagtagcagtgtttgatgggacttctaaaaattatagaagtgaaaccccaacgaagataataaactctaaaaattataaggtccaatttttaaaggttctaaagagaataaatagaagcagtggtaacggttgatgagacatctaaaaactattaacaaaaccccaaatataatccaatgacgattaaaagcaaggacgacggataggccgttaagcaacacagtcacgacataataaaaaataaacccaatgataattatgtttgattttgaaatcccatggacaataaagagggcagttagcgggtgagccgtagagaaatacaatagcaaagccagtgatggtttggcgggacttctagaaagtaaaagatgaatctaaacgataatcatatgtttgatttttaaaatcccagtgtaattaagagatgaggcaacggatgggtcgtagaggagtagaggaatacagttacagcgagtgacaacgtttgacgggacttcaaaaaattataaaaataaaacccaacgacgataataaactataaaaactacaatgtctaatttttaatttttaaaggttcaaagagagagaatagaagcagtaatagatcgagcaagtaaataaggaagggggtgaggaagaagtaaggagtaacaactggtatgactttcaactataaaattagaaatacggggatgataaggtttggtcttttaaagtcttaaaacaacgagatagctatttaataaattttaagtaaaatcattttaaaaaatagataattttaaatgggtactagccgcgcaattgcgcgggccacccagctagttccaattaatgttaccatttttttaaatttttctgtaactttttaaatcgcatgtatataacgggtgccatggccgaaattgctattgtgcggatatccacgcgccctccccccgcacggcgcaaccacgtgcacatgccgacacgcggagatgggggatggcgggagggcacgggaagagggggctcgtgttggtttttccggtttttacaaagtttgggcgcttaactaaacagacgtttagcgtgcatatttgcaaagcaatacttctgaaccgaagatttctgtgctcaagaggcttggagttttgtcagaaatgcatccctgacgaagacgccaccgccacgccatgtaagtaacaagattttgatactgaaatgttccgaaactcgtaactacatccctgaagaggacgccaacgccatgactgaacgtgtttcctttgcaagacaccattgtcttgtttcctgctggtgagaccatatcaatattttttcggctcatcttggccacacagccagatcgaaggaaccgagggggtcgcagttttaaactccgaaccctatttatcttctcagatggccgttactatagctcggcccattgagaggagcccgcgcaacccattaattaaggtgcaagttgggtgggggccatttagcctgagagaatttggtgaataaaaattgaaaatatatattatttttgaattttttttgcaattatacacgtgtctttaaaagatttacgaaaatatacgtgtcccgctgtctggccgcgcgccacccagtgcagccgactgatgtgattacatgcatgcgctgccttcatgcattcggtggcgcggccaagacgtgggaccgttggtcctgcgcgtacacgccgcgccaataaaccggtcacgcaggccacggcgtgatacacgaatattttcgtaaatttttcaaaaacacgtgtataattgcaaaaggttcaaaaataatgtatattttcatgcgtgcgccgcgaggacgacgacgacaaccagccccatcatttgatatattggaggaaaaaacggtatatttgtaaatgaaaaataatctattatctactaaaagttcattagacttcctataaacgctcttatgccaccacgtaacgctctaataaattagagaaaatcgtaaaatttctatgaaaaaagatctagtcattgatttttatttaaattggtggatccataatttaattttacaccgtcagattagattaatctccgggctctcggatacctctcctgccaaagccctctccacgcccctgccacctcccacacgcccctatttctgatttttttttccttttgattggtggttaagatatttaatggcctattttatatagaaatttaattaaattttcacttctcttttctaacgtgtaggctgagaactgactatgcaccgcttgcatccatgcacttcgcatgcattcgtggtttatacttattgagttggtccttttaaaaataaataaacaatattttaagtgatatagcttttatgttgtatataaacaatttgtgatcgatttgaaccattctatgcatttctttacttaaacgatttcaggcgtgaactatgcttcagagtaaaacacaaatattacatgttggacccaagaccactaaattaaagacgatcataaaaattctcactaaaatgcaaaatatccaggaaccttttattatggaattggtatatatcttttgatggaaaatcatgggggcaaaacatgcaaattttccaccattggatacgttttaagatgcatgcgtgggagagagaaaaaaaatcgaatggcgcatggataccaaggatcgaaccggcgatcaacgcacaaaacgctagagcatgtgttcactactgagctttgtaacttttctattttacaatgtaattacatatatctttcttgtatcacaattagatacgagttatttacactgctattgtattataattacatttacaagatttttaggggattttgtatcaaatgttagataggcggtctctatttttttaatctaaatgacaatgagaggccgttagaaatacatgcaacgcctttctatcattagaaatatacacaatgtctttctgccaactgtcccaccacccctatcctcacctcctcttgcctctcctttactccttttttcctatagtagttgagataatatttataacttattataataaatatcaaaaaactaacttttagattacccaaacaattattatttgttaacaccgttatatttcttacaattaaatctctatgttatctatattttaatttatgaaaaataaatattattttgggtaggaccctatgcatcatatctaaggggaaaagaacaacaacatatattgtaatatcatctatcgctttacaaacatgcataattaaattagctctacaatgttttaaattatactttagatcgtattttgaatctttgcatgaaatcccaacggacatgaaaattatgaaaaacatgacaatataaagtatgtcactatatacctttaaacagactaaattgaatttataatgtcagcaagtaacatatcctatctttatctttagatttataaatatgcttaacatggatggtccaatctattcggcccctatgcggggtaacctaaagtatcaaccctatttaccaccatgtataaattctacattttagagatcgactatattaactccctaaataataagcaaaagagcatgggggtacatgttttctctttgatttctattaaatatgtatggtatgaaggtatttcatactaactttggttaattacggaacacaaatcatactaaacttatattagtgccctaaactaataagagaatagtgagagtacatatcatgtcatttcctatttgatttccactaaatatttatggtatgtaatatatcctaaaatccataaagacaagtataatagtgaagaaaaaaatttagcaactccaaaaacaaaatatgataaatattttaaaaaaaacacgcaccatacaaccatagtttcataggaaccaactctattgttgtgccataatattttctcatgaattcaagattgtatggttttaagtaattttagtttagaatttatatgttgcaagagtaatcaaaagaaattcatagccaacattcaaagtaattgcatacaaattatttgccaaaatagacttagaatagagttaatgaatatttcaagaaaagtccacctacgtagaatcattattttaaattaaaataacaataaataaggtgcccacaaacattaaaacgataataaataagatgcgcgggctacctttctagtttgtgaataaaacttttatatatgtattcttaggctccgttcgttctccagttttggagagaaaattttgtggcacgcaaaacaagaaatctcattagcatttgattaattaaatattaactattataaatttaaaaaatgaatttatttacttttttaaaacaacttacatatagaaactttcttaagaaaacacactatttaacagtttagaaagcgtgctaacggaaaacgagaaagttgaagtttggagttgaagaattgaacaaggccttaatgatctaaaagcaaatgataaaaattaaactacgataaaaaaccccaaaatcaactccgagtttaagtttgaaaattcaaattttggataacaagcataaccataagcgatggcaacggcgaacatccggagaggagataaatggacaacgtgcagattagttgctgcttgatcgtgcgctgtgcgagagacggccggggccggggacgtgcttccgcggccaacttccaagcaaccgcggatccactctcggcgtaaccggagaagtacgtcggctctcgccgggatgagtgacggagcgcaaggttcgcctcgcaactcactggagagccctgacctgccactgccagcccaaaggacatgacctctctgacataggcaatgggctctcacgtgttcgatgaaatgccgtgctgagtagaccaagtgcctgtgcattctaagtatatattgcaaaatctgtccaagtttcacgaaaggtgcgtcaatttcaatcgtcctcttttgataccatccgatggtatgcattgtgctaagggctcgaacttgcaacctgcaggctgagcatgagcagcaactaagccagaggacagctgctgcagagaaacgctcgaacctgtaaccctttgggaaactatgtagttacctcgagaggatgacctctcgttgtttgcatatcactcaaataattataaaaaaataaaaaagatgtattaacatgtgatataacacttcacaaacatgcaagttcaaatttaacttctacatttcgtaacgaaaaaaacaaattaaactgcagctagttaacgtatattcacggtcaaatttgtttttttgattgcgagatgtagaggttgaatttgaacttgcatgtttgtgaagtgatatatcacatgttaatacatcttcttttttttaaattttttcataatcatttgagtgacatgcaaaaaaaacgagaggatatcccctcaatagattaaaatccacttttgtaacccttgtagtggctcagaggtaagtaattaacttctgttcgttgcctggctgttggttcctgcaacatgaaaaattgctagatttgaaggatcttaattctctcgatcccttggtttagccaatctaatcaacaagtcattgctctgatcaaagtggtaatccacttctatgtgcttagttcgcgcgtgaaagactggatttgctgataaagtggtcacaccaatattgtcacaccacaagcatgcagcctgcggcagagctatgcggcgttccttgacatgcatacataataaaacagaataccatctgttcagaacttgtaacaacaacaagcccttcccatgtaagaaaacagatcttctgtacttggaattaattacaaccgttggtcatcaataatccaatgcactaaacaagaaggtactaggaaaaaggtattaaaagggtgggccaggtataaaaggtgaaaggttaaaatggtaattgacttttatagttgatttgtgcagttaagggcaaatgcgtcttcttttcaatatttgggtctgtattctctgatccgttcgggacagcaagctcgcggcgaccgtggcggtcgctgccgctgtcaaccgcgcctccccgatccgttctaggcgaaggtggaattggaggtggtggtggctgtggtgcaggcgcacgggctccccttccttcggagtgtgccgtcgatgaccgcgagctcacggcgactgcggccaccacggaccgtcgctgtcgctgatttcgagtgtgccacccgctctgcgtggacatgaattcaccggaatggattatctngtgggcatctatccacacaacatcacatgacctgagaggatcagagtagaatcactgtagcatctcgcgtgattgtctgcacagcaagacctgtcgagcacttcatttgtcgccgtcgtgcgagtactcacgctcatgtaggtgggacgaagaaccatagcggcaagctggtagccgaaacatttccatagtccaaactgcaaccttttgacaagtccaaactgcaaacatttccatatgtcatatcctttatcgtggaaggctacatatctatatatcagatcgacaagactatcgtggaagagataattgattggcatcaccggcgccagccgtgctacccatcgcaccgggcgagctcaagcgctgcctcaaggctggtgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacacggacgaggcgaacaccaacaacagcagcagcagcggaaccaacggtctaacacccaacaccacaggcgacggctgggaaccaggacaaaaccctaatcttcacttcactttatcttctcttcagggcggaggaactatatatatttatatagagcaagggtgagtactttcgtactcagcaagtcacgggaacttaggtgtttaatgcaagcttggaagagaggcaaggttgttttgcaaatcttttgtttgaaatcattttggaatcactaagtgatttatttctttctatgtttgggcgaaaagagacttgcgtctcgattcaactttaagagatgcttttcaacagctcatttagtaatgtatcgacctcccgggtcagatcattacttctcggctcccagagccattccacttgattagtcggctcccagagcctttttcattttctcggactcccagagtccagttgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagccttttcccagccgactcagggttacctcatgccacatagaaggatcaaatcctcacataaacataggcctttttaggcgtgcacaaatcaaactccaaccaccttgatcggtaagtgagcaagcttctcgttcttgccttaccaggaacccggtttgtccgaccccaccccggcgttcccaactattggcatgcgaggtttccctgaaccgtctagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttggaggctttacaaacccatttcccaagttttcgacaagcaacggtgtatgtgggatatttggtatacgcgctcagagagcacgaataccgaggtaccacaagggtggagcgacaaggattcagggtagtacgacctacagaaattggtgcgactactgggtaggtccgtcggtttagcacgcaaaccgaggccaagcatgttaagtgtgtgaatctaataatgcaagttgcaaacaaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattattagtgccattaaatagatctcaattttacggaattactggaagtggaacggagtcaatcggatgagcggttgagaagatatgaattttggaagtttaattggagtttctggaataggagaaatggtttatggaattttatagaaataatattctcaagaatattattgacagtcactgacgtgcgggaccaaaggaaatgattcatggaattttggaataaggaattgatttatggaacaagggaaaaggatttattaaatccctgggggctgcagg

SEQ ID NO: 68662 - DNA, 581 bp, Oryza sativa
ccaaacaaaggaacagaagttgcgcaagatgtccgccgatcgccaagaagtagcaaaagccgaagtgcaaaagctgctcaagcccggggtgatccgagagatcgaccaccctgagtagttggcgaacctggtactggtgcggaagtcaatcggcaaatagcgcatgtgcgttgatttcacagacctcaacaaggtgtgcccgaaagacgacttcccccggctcagcaagtgggcggcggagttatctcccttcgatctgcattttgtcgcccgcactgctatcaagtcccaagtcctagctgacttcgtggccgaatggacgccggcattcacccctgaacccaagcctgtcgaacaaccttgggtaatgtactccgacggttcgtggtcacaaaagggggcgggtgccgcggcagtactcattttgccaaggggcgtgccgattcggtatgccataaggctgtagttcaacacgaccaacaacacggcagacgtcgtactgctgggcctaagaaaggtgaaagcattgggggttcggcgcttgctcatccgaatagactccaaactagtggcaagccacg

SEQ ID NO: 68663 - DNA, 1001 bp, Oryza sativa
  unsure (1)..(1001): unsure at all n locations
cggttgcttttgaaaatacgaaaagaagtggaataaaaattcttttaagaaaaccntgcatactagtttgagataaaaatcggactcctaactgcagctcatgatatctttaaaaatatcaaagcaaatccctcaagtgaatttcaccatagctaaattgtataataataataagattaaaatattattcactcgttacaacgcacggacatcttttctagtaaaataaaaattttaatttattacatttgttttatttttaaaatttatgtcaaaattttccgcactaattatttagtctcattagttacataaaatgcatatactatacactcaaacaaaaatttcattatttttcaaacttatttccaaacctaaatcatcaagggcattaaagacatgagccaccaaacttaacagtgaaatgatagaaaaatgtaacggcagggacatgaaaaggatcaagctgaaattttagaggtatataaatatgctcatatttccttatttgatctctctgtaaatagaagagttccctttcatacttcctatctatccatctaccgaaatacaaccacgttctcttattaatgagggatactttcgtcttttctctcaatgcaaatgtgaatcctgataattaagaataaaatttattttagaacaaaaatagtaataatccattacacctcccgaaatttcgcttgctcggctggatcctctgactctcccagtctccacgcccacagccgcaacaactggttaaaaagatccccgcgacgcgcacgcgacgcgacgaccacccagccacgcgcgacgcgccgcagcagccgcgcccgccatggcgaaccccatcatcccgagcagcagcggcagcgacggggaggaggcgaggaccaagctcgggcggctgaacgcggcggtggagcgttcgtgggtcgggcggcggttcaagctggcggcgcgcgggtcgacgttcaccacggagctccgcgccggga

SEQ ID NO: 68664 - DNA, 1547 bp, Oryza sativa
  unsure (1)..(1547): unsure at all n locations
cggagaaaaaccctttttttttcccccccccgggggggggggaaaaaggccccgcccacgncttacttctgggaggcgctcttcccgttcctgtacgtgaacatcctcgacaccacgggggggctctactccatggcgaggttcgccggcttcgtggacgacgcgacgggggacttcgagggccagtacttcgccttcatgtccgacgcgacggccatcgtgttcgggtcgctgctggggacgtcgccggtgacggcgttcatcgagtcgtcgacggggatcagggagggcgggaggacggggctgacggcgctcaccgcggcggcctacttcgcggcggcgctgttcgtcacgccgctgctggcgtcgatcccgtcgtgggcagttggcccgccgctggtgctcgtcggcgtgatgatgatgcgcgcggtggcggaggtggactgggccgacatgaggcaggccgtgccggcgttcctcaccctggcgctcatgccgctcacctactccatcgcctacggcctcatcggcggcatcgcctcctacatgctgctcaactcatgggactgggcctgccacgccgtcgcggtgctccgctcccggcgccggagaggggcgcgcgccgagacgaggagcgccgccgccggagacaatggggaacagaggaagaacttggaaatggcttaattagcttttttttttgcataatttcctttttaaaagatttagaaggtgattaggatttgctatatatactggaagatggttcaaaaggcttagtaggatgttcaagtaaagttattaatcaagtttcagtccctgagtgcctgtccattttcggaggtaatataacaaaacaatcatcatttgaaaaaaaaaaatcgaccttttacaatagatgtcgagaacttgtaaaagatttgcacattattccatcgaaataacatggtgcgaaggtctaaatatacaacgaaccaaaattttctgacaagctgatctaaattcatttgtctgtccacttttaggtgaaataacttgctcgagtgtccatctgtttgtcattttttttgaaagaactaaaaagagaatggaactaacccttgtgagcgcctgagcgggctcctcatttattgatttttttaatcataaaacaaggtttagaaaaaataaactataatacccttattaaatgaaatatagctagggttggaagggtggttagggtaaaatgaaaaaaatgaatactaagacatgattagtactgtagatgttaattattttgagataaaatttgaatactaatgagacaattattttagaacggatatagtatttttaaggagaaaaaaatatgaaatgttatgagaaaagaaagggcaaccgatgccggcgaaagtcaagaattgcgtatcaagtaaacgggtatgaccttacatgatggtatctttaattaaatattgctaactgatgccaacttatgtgaattggagtgatgggagcttttaagtggcactatcaatcagtcataacattttgacttgttgaca

SEQ ID NO: 68665 - DNA, 839 bp, Oryza sativa
gggtaaggttttttacggtgaatctggttgaccgcccataaccgcgggcacggctattcgaatagttttactctgatcagaggtgtacaactatacccacaagacacagccccataacacgtttccgtgcgccgacatgccaccacgacataccggaaagaggccgtgacaggacccttcgcataaccccctctaaccaagcacaccacacctcaggtttcacccccactccttgcaaagcagcgggcagtcccctctcgtgcctaggtgaatccagaagcgacagaggccgtcgcagggcccgccccgctccatcacgcccacccttgcctggatgcgtcagctagaggaaagctacactacaagcccagccgttgcccatgctggcttgtggtaagtatgataagttcttccagggcatcccgcgaaccggtccttaactgccatgggtgcgactagcagaaccatgcacccacagcccaccatgtgattcattttaattgaccaacaccaaaacggtggtactaaaccaaccttaccaattgaacctaaagtctatattttagtgagctttccccattgtgtgctagtggaactaagcatggctaagcaattcctagtccaaaatctattcatgttataacccaagctaacaaaggagcatggtatcaaaaatggcatggctgtaacaataggtaaacaccccatagtaacattataaaacaatgcaatatttgaagaaaaacaatagagcatttgcaatataggatcaacatgttcaagtgacaagcatgacttgccttgctctgctgctggagaaacctcggcgactatctcga

SEQ ID NO: 68666 - DNA, 731 bp, Oryza sativa
tccctctcgcttcctttattgtcgctgccaagggtgatctcgacagctcctgttgtgacagagccttgaacacctctacgctgtcagtttccaagattcttggcatatgaatccattccatggctgcccttaatccttctagacatgccaatgcctcagcttggacagcagtagcacaggatttttttgcacagcaaacagcactaaacccctgcagtctctaatgatgattccagcagctgaaactcctgtgtcttctataaaaccagcatccacatttacctttgctgaaccttcgggaagggcgtgccatttatcaacctgattggttgtctgaacctgcagtaatttcaccattggttcattatacattaatccttttcctttgatgtcatcgctttgttgtcggatcggcaacagtaccttctcatagttgacgaggaaatttacagactctgcaattgtggccgtcccctttccatggatcatatcattcctgaggaaccatgctcttcacaacaagtacaaaacacgcgccttgtctgaactattcaagctatccaacaggacaaggagccagtcaggcccagtcatagcaaactttcttttccggcggtagcgcccagaactctctgatggcttttccgaacgatctcggcattggacattcaacagtcgcatggaaaccattttccttctttacaccacagattaggcagatgcctactggt
